United States Patent 11,931,406 (FLAVIVIRUS VACCINE) - sequence listing, part 62

SEQ ID NO: 21901 - RNA, 9879 nt, Artificial Sequence
  derived and/or modified CDS sequence (opt6) from DENV-1__EU482795__SS-prME
aguguuacuauguuacuaaugcugaugcccacggcauuagcuuuucauuuaacuacuagaggaggggaaccgcauaugaucguaaguaaacaagagagagguaaaucauuauuguucaaaaccucagcuggugucaauauguguacuuuaauugcaauggaucucggagaauuuugcgaagauaccaugacguacaaaugcccacgaaucaccgaagcagaaccagacgauguugacugcuggugcaacgcaacugacacauggguaaccuacggaacaugcucgcagacuggugaacauagaagagauaaaagaagugucgcacuagcaccacacguaggccuaggauuggaaacaagaacagaaacguggaugucuucagaaggagcauggaaacagauccaacgaguagagaccugggcacuaagacaccccggauucaccgugauagcauuguuuuuagcccaugcuauuggaaccagcauuacacaaaaagguauuauauuuauuuuauuaaugcuaguaacccccucuauggcaaugcgcuguguuggaauugggucaagagauuuugucgaagggcuaucaggugcaacuuggguagacguuguacuggagcauggaagcugcgugacgacgauggcgaaagauaaaccaaccuuggauauagaacucuuaaaaacagaaguaaccaauccagccguucuucgaaaauuauguauagaagcuaaaauaucaaacacgacuacugauucuagaugcccuacucaaggcgaagcaacauugguagaggaacaagaugcaaauuucguuugcagacgcacauucgucgaucgaggauggggaaauggauguggguuauucgggaaagggagccugauaacuugcgcaaaauuuaagugcgugacaaaacucgaaggaaagacuguccaguaugaaaauuuaaaauacagcguaaucguaacgguucauacuggugaccagcaucaagugggaaaugaaucaacagagcauggcacgaccgcgaccauaaccccucaggcaccaaguaccgaaauacaauuaaccgauuauggagcacugacauuagauugcucgccccguaccgguuuagacuuuaaugaaaugguguugcuaacgaugaaagaaaaaucgugguuagugcacaagcaaugguuucuagauuuaccgcucccguggacgucuggggcuagcacuagccaagaaacuuggaauagaaaggaccugcugguuacuuucaaaacugcccaugcgaagaaacaggaaguuguaguuuuaggaagucaagaaggagccaugcauacugcuuugacaggagcgacugagauccaaacaucgggaaccacgaccaucuucucaggacacuuaaaaugccgcuuaaagauggauaaacuuacauuaaaaggaaugagcuacguaauguguacuggaaguuucaagcuagaaaaagagguagcggagacucagcaugggacaguccuaguucaaauuaaguacgaagggaccgaugcgccauguaagauaccauuuucaacgcaagaugaaaaggggguuacacaaaauggacgucuuauaacugcaaaucccauaguaacugauaaagaaaagccaguuaauaucgaggcggaaccaccauucggagaaaguuacauuguuauaggagccggugagaaggcacuaaaacuuucuugguuuaagaaaggauccaguaucggcaaaauguucgaagcaacagcaagaggcgcaagacggauggcuauacuaggagauacggcaugggauuucggcucaauuggcggaguauucacgucaguaggaaaacuuguccaucaaauauuuggaacugcguauggaguauuguuuagcggaguaucauggaccaugaaaauagguauugguguccuacuaacgugguugggauuaaauucacguucaacaagucuuucaaugacaugcaucgcaguggggcuaguaacacucuacuugggcguuaugguacaggcggauucggggugugugaucaacuggaaagggagggaacuaaaauguggcagugguauuuuuguaacuaaugaggugcauacuuggacugaacaauacaaguuccaggcagauucgccgaagcguuugagcgcugcaauaggcaaagcaugggaagaaggagugugcggaauacgcucggcuacccgacucgagaacauaauguggaaacaaaucaguaacgagcugaaucacauacuguuagaaaacgacaugaaauuuacuguaguaguuggagacgucgcaggcauacuugcacaggguaagaaaaugauaagaccacaaccaauggaauauaaauauuccuggaaaaguuggggaaaagcuaagauaauaggugcugacguucagaauacaacauuuauuauugaugguccaaacacaccugagugcccagaugaccaaagagcauggaauauaugggaagucgaagauuauggauuuggaauauuuacuacgaauauauggcuuaagcugagggacagcuacacucagguuugugaucacaggcuaaugagcgcugccauaaaggacucaaaagcuguacaugcagauaugggcuauuggauagagagugagaaaaaugagacguggaaauuagcacgagcuucguucauagaagucaaaacauguauuuggccgaagucucauacguuauggagcaauggcguauuagaaucugagaugauaauacccaagauuuauggugggccaauaucacaacacaauuaccgucccggauacuuuacucagacggcgggacccuggcauuugggaaaguuggaacuagacuuugaucuuugugagggaacaaccgucguaguugacgaacauuguggcaacagaggucccaguuuaagaacaacuacuguaacaggcaaaauaauccacgagugguguuguagaaguuguacacugccuccacuuagguuuaaaggugaagacgggugcugguaugguauggagauacgaccugucaaggaaaaagaagaaaaccugguaaaaaguauggucuccgcagguaguggagaaguagauucuuuuagccucggauuacuaugcauaaguauaaugaucgaagaagucaugagaucuagauggagcagaaaaauguuaaugacaggcacauuagcgguauucuuuuuauuaauuaugggacaauuaacuuggaaugaccuuauccggcuaugcauaaugguaggugcaaacgcuuccgacagaauggguauggggacgacauaucuagcauugauggcaacuuuuaaaaugcgacccauguuugcgguuggacucuuguuucgacguuuaacaucaagagaaguucuauuguugacgauaggacuaucgcuuguagcaucgguggaacuaccgaacagucuagaagaacugggagauggacuagcaaugggaaucaugauacuaaaacuauugacagauuuccagucccaucagcucugggcaacauuauuaucauugacuuucauaaaaacaaccuuuaguuugcauuacgcauggaagacuauggcaaugguguuaagcauaguuaguuuacugcccuugugucuuaguacuacaagucaaaagaccaccuggcuaccaguauugcucggcagcuuaggcugcaagccacucacgauguuuuuaauugcugaaaacaaaauuugggguagaaaaagcuggccacuaaaugaaggaaucauggcaguagggauaguaagcauacuucuuucuucauugcuuaaaaacgaugucccauuagcaggaccacuaaucgccgguggaauguugauagcuuguuauguaaucucagguaguagugcagauuugucacuggagaaagccgcagaaguaucuugggaagaagaagcugagcauaguggggcuagccacaauaucuuaguagaggugcaagacgacggaacaaugaagauaaaggacgaagaaagagaugacacauuaacaauccuucucaaggcgacacuuuuggcgguuucaggaguguauccccuaaguauccccgcgaccuuauucgugugguacuucuggcagaagaagaaacagcgcucgggagucuugugggacacucccucacccccagaaguagagcgugccguacuggacgacggaauauauagaauaaugcagaggggacuucuugggagaagucaagucggagucggaguguuccaggaaaauguauuccauacaauguggcacguaacaagaggagcuguacugauguaccaggguaaaagacuugaaccaagcugggcaucagugaagaaagaccuuauuaguuacggugggggcuggaggcugcaaggaucuuggaauaccggugaggaaguucaaguaaucgcuguugagccagguaaaaauccuaaaaacguccaaacagcaccagggacguuuaaaacuucagaaggugaagugggggcaauugcgcuagacuuuaaaccgggaacaaguggaaguccuaucguuaacagagaaggaaaaaucguaggcuuauauggcaauggagucguaacgacaaguggaaccuauguuagcgcuaucgcccaggcuaaggcuucucaagagggaccuuuaccagaaauugaggaugaggucuuuagaaaaagaaacuuaaccauaauggacuuacauccaggaucggggaaaacaagaagauacuuaccugcgaucguucgagaggcuauaaagcgcaaacuuaggacauuaauuuuagcaccgacucgcgugguagccucagaaauggcagaagcacuuaaggggaugccaauuagauaucagacgaccgcaguuaaaagugaacauaccggaaaggaaauaguugaucugaugugccaugcaacuuuuacuaugcgguuauuaaguccaguacgaguuccaaauuauaauaugauaauuauggacgaagcucauuucacggacccaagcucgauagccgccagaggauacauuucuacuagaguaggaaugggcgaagcugccgccauauuuaugaccgcuacaccaccagguuccgucgaggcuuuuccgcaauccaaugcaguaauacaagacgaagaaagagacauccccgaacguaguuggaacucgggauaugaauggaucacugauuucccaggaaagacggugugguuuguucccucuaucaaaucugguaaugacauugcuaacugccucaggaaaaaugggaaaagaguaauucaacuaagcagaaggacguuugauacugaauaccaaaagacuaagaacaaugacugggacuacguaguuacuacagauauaucugaaaugggagcaaauuuuagagcagauagagugauugacccaagaagauguuugaaaccaguuauuuuaaaggacgguccugaaagaguuauacucgcuggaccaaugccggugacagucgcgagugcagcgcaacgucggggucgcauaggaagaaaucacaauaaggaaggugaccaauauauuuacaugggacagccauuaaauaacgaugaagaucacgcucauuggacugaagccaaaauguuacuagauaacauuaauacuccagaagguauuauccccgcauuauuugaaccagagagagagaagucugcugcgauagauggagaguauagauuaagaggcgaagccagaaaaacauuuguagaacucaugcgucguggagaucuaccgguuugguuaucauacaaaguggccagcgagggauuucaauacuccgaccgacgcugguguuucgauggcgagaggaauaaccaaguauuggaggagaacauggacgucgaaauuuggacaaaagaaggagaaaggaagaaacuuagaccccguugguuagaugcgagaacuuauucagaccccuuagcucugcgcgaauuuaaggaauuugcugcagggagaagaaguguguccggagauuuaauuuuagaaauagguaaguugccacagcacuuaacucagcgagcacagaacgcucuagauaacuuaguuaugcugcacaauucagaacaagggggaagggcauauaggcacgcaauggaggaacuaccugauaccaucgaaacgcucauguuauuagcguuaauagcgguuuugacaggcggcguaacacuguucuuuuuaagcggaaggggccugggaaagacauccaucgguuuacuaugcguuauggcgucaagcgccuuacuauggauggccuccguugagccucauuggaucgcagcaucuauaauauuagaguucuucuuaaugguucuuuuaauuccagaacccgaucgacagagaacaccucaggauaaccaauuagccuacguuguaauaggacuguuguucaugauuuuaacagucgcagcaaaugagaugggauuacuagaaacaaccaaaaaggacuuggggauaggccacguugcuguagagaaccaucaccaugcggcuauguuagauguugaucuacacccagccucagcauggacuuuguaugcgguagccacuacaaucaucaccccaaugaugagacacacaauugagaauacaacggcaaauaucucucucaccgccauugcaaaccaagcugcaauucugaugggccuagauaaagguuggccaauaucuaaaauggauauaggugucccuuuacuugcacuagggugcuauucacaaguuaacccccucacuuuaacagccgcuguuuuaaugcuaguggcgcauuacgcaauaauaggaccgggccuucaagcaaaagcaacaagagaggcccagaagcgaaccgcagccgggauuaugaaaaacccuaccguagauggaaucguggcaauagaucuugauccaguggucuacgaugcuaaauuugaaaaacaacuagggcaaauaauguuacuuauacuaugcacaucacagauauuacugaugagaacgacgugggcacuaugcgagucaauaacacuugcgacuggcccuuuaacuacgcuuugggaaggaagucccggaaaguucuggaacaccacuaucgcagucucgauggcaaauauauuucgggguucauauuuagcaggggcuggcuuagcuuuuucgcucaugaaaucacuaggagggggacggagaggaacgggcgcccaaggugaaacauuaggggaaaaauggaaaagacagcuuaaccagcuaaguaaaagcgaauuuaauacauauaagagaucaggaauaauggaggucgauagaucagaggcuaaagaaggacuaaaacggggcgaaacuacuaaacacgccguaaguagaggaaccgcaaaauugcgaugguuuguggaaaggaaucuaguaaaaccugagggaaaagugauagacuuagguugcgguagagggggauggaguuauuauugugcggggcugaagaaaguaacagaaguaaaaggauauacuaaagggggacccggacaugaagaaccuauuccuauggcaacauacggauggaacuuagugaaacuucacucagguaaagacgucuuuuucaucccaccagaaaagugugacacacucuuaugugauauaggagaaaguaguccgaauccaacuauagaagaaggccgaacgcuccggguguuaaaaaugguagaaccuuggcuuagaggaaaccaauuuugcauuaaaauauugaacccuuauaugccauccgucguugagacucuggaacaaaugcaaagaaaacaugguggcaugcuaguuagaaacccacucagcagaaauucaacucacgaaauguauuggguaaguuguggaacuggaaauauuguuucagccguuaacaugacaucuaggaugcuacucaaccgauuuacaauggcucaucgaaaaccgacguacgaaagagauguagacuuaggggcugggacucgacacguagcaguagagccagagguugccaaucuagacauuauaggucagagaauagaaaacauuaaacacgaacauaaaucuacuuggcacuaugaugaagacaacccauacaaaacuugggccuaccaugguaguuaugaaguuaagccaucaggcucggcaucuagcaugguaaaugguguaguaaagcuccugacgaaaccuugggacgucauaccuaugguaacacaaauagcaaugacagauacuaccccauuuggacagcagagaguguuuaaagaaaaaguagacacgagaaccccaaaggccaagagaggaaccgcccagauaauggaaguuacagccaaaugguuauggggauuccucucaagaaauaagaaaccaaggauaugcacccgugaggaguucaccaggaagguuagaucuaaugcagcgaucggcgcaguauuuguagacgaaaaccaauggaauagugcaaaagaagcaguggaagacgagagguuuugggauuuaguucaccgcgaaagagagcuucauaaacaagggaaaugcgcgacauguguauauaauaugaugggaaaaagggagaagaaauuaggagaauuuggaaaagccaaagguucacgugcaauuugguacauguggcuuggagcaagauucuuagaguuugaagcccuuggauuuaugaacgaggaccacugguuuaguagggaaaauaguuugagcggcgucgaaggagaagguuuacauaaauuaggcuauauauuaagagacauuaguaaaaucccaggcggaaacauguaugcagaugauaccgcaggaugggauacaaggauaacggaagaugacuuacaaaaugaagcuaagauaacugauaucauggagccagaacacgcacuuuuagcgaaaucaauauuuaaacuuacguaccaaaacaaagucgucaggguacaacgcccugccaaaaaugguacaguuauggacguaauuucacguagagaucaaagaggaucugggcaagugggcaccuauggccucaacacguuuacuaauauggaggcacaauuaauacgucaaauggaaagugagggcauuuucaguccaucggagcucgaaacccccaacuuagcgggaaggguucucgacugguuggaaaagcacggaguggaaagguuaaaaagaauggcgauaucuggcgacgacuguguggugaaaccuauagaugaucguuucgcaacagcauuaacugcccuaaaugacauggguaaagugaggaaggacauuccacaaugggaacccucaaaaggauggaaugauuggcagcaaguaccguuuuguagccaucauuuucaccaguuaaucaugaaagacggacgugaaauugucgucccgugccgcaaccaggaugaauuggugggacgagcuagagucucucagggggcugguuggagucuuagagaaacugcuugucuuggcaaaaguuacgcacaaauguggcagcuaauguacuuucaccgacgggaccugaggcuagcggcaaacgcuauauguucggcugugccaguugacuggguaccuacgagcagaacaacauggucaauacacgcgcaucaucaauggaugacgacugaagacaugcucuccguauggaauagaguguggauagaagagaaccccuggauggaagacaaaacccauauaucaucuuggggagauguccccuauuuggguaaacgcgaagaucaauggugugguucuuugauuggacuaacugcaagggcaacgugggcaacuaacauccaaguugcaauaaaccaaguucgcagauugauagguaacgaaaauuacuuggacuauaugacaucuaugaaaagauuuaagaacgaaagugacccugagggagcacuaugguag

SEQ ID NO: 21902 - RNA, 9879 nt, Artificial Sequence
  derived and/or modified CDS sequence (opt6) from DENV-1__EU482796__SS-prME
ucaguaacgaugcuuuuaaugcuuaugccgacggcguuagcuuuccaucuuacaacaagagguggugaaccucauaugaucguaacaaaacaagaaagagguaaguccuugcuuuucaaaacuucagcugguguaaacaugugcacauugauagcaauggauuuaggagaguuaugugaagacacgaugacuuauaaauguccacgcauaaccgaagcagaaccagacgacguagacuguugguguaaugcuacugauacauggguaacuuacgggacguguagucaaacaggugaacauaggcgagauaaacggagcgucgcacuugcaccacacguggguuuaggacuagaaacgaggacagagaccuggaugucuucagagggagcauggaagcaaauacaacgaguagaaacgugggcacuacgucauccaggauucacaguuauagcgcuauucuuggcucacgcaauaggaacgaguauuacucaaaagggaauuauauuuauauuacuaauguugguaacaccuagcauggcaaugagaugugucgguaucgguucuagagauuucguagaagggcuaucaggagccacuuggguagacguuguuuuggagcauggaucguguguaacuacaauggcaaaagauaagccuacgcuagauauugaauuauugaaaacugaagugacuaacccugcaguauuacgaaaauuaugcauagaagcuaagauuucaaacacgacuacggacucucguugucccacacaaggugaagcuacacucauggaagaacaagacgcaaacuucgugugccguagaacauuuguggaucguggauggggaaacggcuguggguuauuuggcaagggcagccuaauaacuugcgccaaauuuaaauguguuacaaaauuagaaggaaaaauuguacaauacgaaaaucucaaauauucagugauagucacaguacacacaggggaucaacaucaaguaggcaaugaauccacagaacaugggacaacagcaacaaucaccccucaagcgccaacgucagagauucaacuaacagauuacggagcauuaacauuagacugcagcccacguacaggauuagacuucaacgaaaugguucugcuaaccaugaaagaaaaaucgugguuaguucauaaacaaugguucuuagacuuaccucugccguggacaucaggcgcauccaccucacaagaaacauggaaccgccaagaccuguuaguuaccuuuaagacggcacaugcuaagaaacaagaagugguuguccuugguucgcaagaaggagcuaugcacacagcgcuaaccggagcaacagaaauacaaacaucaggcacaacaacaauauuugcuggccacuuaaagugcaggcugaaaauggacaaauuaacauuaaaggguaugucauaugucauguguaccggaucuuucaaacuugaaaaagaaguggcggaaacacaacacggcacgguacucguacaaauuaaguacgaggggaccgaugccccaugcaaaauuccguucaguacacaagacgaaaaaggggugacccaaaauggcagguuaauaacagcuaaccccauaguaacugacaaagaaaaacccgucaacauagaagcugagcccccauucggagaaaguuauauuguuauaggcgccggcgagaaagcauugaaguuaagcugguucaagaaagggagcucaauugguaaaauguucgaagcaaccgcaaggggagccagacggauggccauacugggagacacagcaugggauuuuggcagcauaggugguguuuucaccaguauagggaaacuuguacaucagauuuuuggaacagcauaugguguacucuucucaggaguuagcuggaccaugaaaauugggauugggguacucuugaccuggcuuggucuaaauucacgcaguaccaguuugaguaugacuuguauugcaguaggauuagugacauuguaccugggaguuaugguacaagcugauagugguugcguaauaaauuggaagggaagagaauuaaagugcggaagcggaauauuuguaacuaaugaaguacacacuuggacagaacaauauaaauuccaagccgauucaccaaaaagguugucugcggccauuggaaaagcaugggaagaagguguaugugguauuaggucagcgacaagauuggaaaauauaauguggaaacaaauaucuaaugaacuaaaucauauacuccuugaaaacgauaugaaauuuacagucguaguuggcgauguaguaggaauccuugcccaagggaagaaaaugauucgcccucaaccuauggaacauaaauauagcuggaaaucauggggaaaggcuaagauuauaggagcagacguucagaauacaacauucauuauugaugggccaaacacgccugaaugcccagaugaccaacgagcauggaauauuugggaaguagaagacuacgguuuugggauuuuuacaacaaacauauggcugaaaaugagggauaguuacacacagguaugcgaccaccgacugaugagcgcagcaauuaaagauagcaaagccguccaugcagauaugggauauuggauugagagugagaaaaacgaaacuuggaaauuagccagggcuucauuuauugagguuaaaacaugcauauggccaaaaagccauacguuauggucaaacggaguccuugaaucagaaaugauuauccccaaaaucuacggagggccaauaucacagcacaauuaucgacccggguauuucacccagacugcgggaccauggcacuuagggaaacuagaguuagauuucgacuuaugugaaggcacaaccguugugguagaugaacauuguggcaacagagguccaucucuaagaaccacuaccguuacugggaagauuauccacgaaugguguugcagauccuguacgcuucccccauuaagauuuaaaggugaagauggguguugguaugguauggaaauacgaccuguaaaagaaaaagaggaaaaccucguaaaaucuaugguuagcgcggguaguggagaaguagauaguuucucucuaggcuuacuguguauaaguauaaugauagaagaaguaaugagaaguagguggagccggaaaaugcugaugacugguacacuggcgguuuuccugcuccuaaucauggggcaacuuaccuggaacgaccuaauucgguuauguauaaugguaggugcuaaugcuuccgaccgcaugggaauggguacaacuuauuuagcuuugauggcuacuuuuaaaaugagaccaauguucgccguaggucuucuguuccgccgacuaaccuccagagaaguacuacuacugaccauagggcugucuuugguggcaucaguugaguuaccaaacagccuagaagaguugggagauggucuugcaaugggcauuaugauauuaaaacuuuugacagacuuucaaagccaccaacuaugggcuacacuauuaaguuugaccuuuauaaaaacaacguugucuuugcauuacgcauggaaaacaauggcaaugguacuaucaauaguaagccuuauuccacuaugcuugucgacgacgagccagaaaacgaccugguuacccguguuacucggauccuuagggugcaaaccacugacgauguucuuaauagcagaaaauaaaauaugggguagaaaaagcuggccccuuaaugaaggcauaauggcaguggguguaguaucgauacuucuaagcagcuuauugaaaaaugauguucccuuagcagggccauugauagcaggaggaauguugaucgccuguuaugugaucucuggaucaucugcagaucucagucuugaaaaagcagcagaaguaucaugggaggaagaagcggaacauagcggagcuagucauaacauauuaguagaaguccaagaugacggaaccaugaaaauuaaagaugaggaaagggacgacacauugacaauucuauugaaggccacccuccuugcagugucuggagucuauccgcuuuccauuccggccacauuauucguuugguacuuuuggcaaaagaagaaacaaagaaguggaguauuaugggauacaccuucgccuccagaaguagaaagagcaguauuagaugacggcauauauagaauaaugcaaagaggauuauuaggaagaucucaaguggguguaggaguuuuucaggaaaauguauuucacacaauguggcacguaacacggggagcaguuuuaauguaucaaggaaaaagacuugaaccaaguugggcuagugucaagaaagauuuaaucuccuaugggggaggauggagacuucaggguaguuggaauacaggagaggaaguacaaguaauugcaguagagccuggcaaaaaucccaaaaauguucagaccgcuccagguacauucaaaacaccagagggagaaguaggagccauugccuuggacuuuaaaccggguacaucagguucaccgauaguuaauagggaggguaaaauaguagguuuauauggaaauggaguugucaccaccucuggcacauauguaagugcuauagcgcaagcaaaggcgagucaagagggaccccugcccgagauagaagacgagguuuucagaaaaagaaaucuaacgauaauggacuuacauccggggucagguaaaacaaggcgguaccucccagcaauaguccgugaggcaauaaaaagaaaguugcgaacacucauacuugcucccaccagaguaguugcaucagaaauggccgaggcccucaagggaaugcccauucgguaccaaacaacggcuguaaaaucggaacauacagguaaagagauuguagacuuaaugugucacgcuacuuucaccaugagacuacuaucaccaguucggguaccaaacuacaauaugaucauaauggaugaagcacacuuuaccgacccaagcuccaucgcggcuaggggauacaucucuacgcguguaggcaugggugaagcagcugcaauauuuaugaccgcgacacccccaggauccguagaggcuuuuccacagucuaaugcagugauucaagacgaggaaagggacauaccagagagaucguggaacucgggcuacgaguggauaacagacuucccaggcaaaacagugugguucguacccaguauaaaaucaggaaaugacauugcaaauuguuuaaggaagaauggaaagcgagugauacaacuuucuagaaaaacauuugacacggaauaucagaaaaccaaaaauaacgacugggauuauguaguuaccacagauauaagcgaaaugggugcaaauuuucgagcugauagaguaauugacccgaggagauguuuaaaaccagucauccucaaagacgguccagagcgaguuauucuagcuggaccuaugccggugacuguagcuagugcugcccaaaggagagggcgaauaggucgaaaucauaauaaagagggcgaccaauacaucuacaugggacaaccucucaauaaugacgaagaucacgcucauuggacggaagcaaaaaugcucuuggauaauauaaacacaccagaggguauaauaccagcuuuauuugaaccugaaagagagaaaagugcugcgauagauggugaauauagacugcgcggggaggcgaggaagacauucguugaacuuaugagaaggggugaucuuccaguauggcuuuccuauaaaguggcauccgaaggauuccaguauucggaccgacgaugguguuucgauggugaaaggaauaaucaaguacuagaagagaacauggacguagaaauuuggaccaaggaaggagaaagaaagaaauuaaggccacgcuggcuugaugcucgaaccuauucagacccgcuugcuuugagagaguuuaaggaauuugcggcuggcagaagaagcgucagcggggaucuaauccuggagauugguaaauugccucagcauuugacucagcgggcucaaaaugcauuagacaauuugguaaugcuacauaauagugaacaagggggacgugccuauaggcaugccauggaagaacugccugacaccauugaaacauuaaugcugcuagcacugauugcaguccuuacaggugguguaacauuauucuucuuaucaggcagaggacucggcaaaacuucaauuggauuauuauguguuauggccuccucaguccugcucuggauggcuucaguggaaccgcacuggauugcagcaaguauaauacuggaguuuuuccuaaugguuuuauuaaucccggagccugauagacaaagaacuccgcaggacaaucaauuagcauauguggugaucggcuuguuguucaugauacuaacgguugcggcaaaugagaugggguuguuagaaacaacgaagaaggaucugggcauuggacauguugcgguggaaaaucaccaucacgcaacuaugcuugacgucgauuuacaccccgcuagugcauggacucuuuaugcuguugcuacgaccauaaucacaccaaugaugaggcacaccauagaaaacacuacggcgaacaucagucucaccgcgauugcgaaccaagcugcuauauuaaugggacuggauaaagguuggccgaucucgaaaauggauauaggaguaccauuguuggcucugggcuguuacagucaaguaaauccacuaacuuugacugcggcgguucuuaugcuuguagcacacuaugcaaucauuggcccuggacuucaggccaaagcaacuagggaagcucagaaaagaacagcggcugggauaaugaaaaauccaacaguugacggaaucguagcuauagaccuagauccuguaguuuaugaugcuaaauuugagaaacaauugggccaaauuauguuacugauacucuguacuagccaaauacuccuaaugcguacaacuugggcguuaugugagagcauaacacuagccacagggcccuugacgacacuaugggaagguucaccugggaaauucuggaacacgacaauagcugugucgauggcgaauaucuuuagagguaguuacuuagccggagcaggccuugcuuuuagccuuaugaaaagccuaggaggaggcaggaggggaaccggugcccaaggagaaacucuuggagagaaguggaaacgucaauuaaaccaauuaagcaaaagcgaauuuaacauauauaagcgaagcggaaucauggaaguagauagaucugaagcgaaagaaggauuaaaacguggagaaaccacaagacacgccguaagucguggaacggcgaaguugcgcugguuuguagaacgaaaucuaguuaaaccagaaggaaaaguuauugauuuagggugcggucgagguggauggucuuacuauugugcuggacuaaagaaagucacugaagucaaaggguauacgaaaggaggaccuggacaugaggaaccuaucccuauggcuacuuauggauggaauuuaguaaaauuacauucgggaaaggauguuuucuuuacaccgccagaaaagugugauacucuguugugugacauaggagaaagcucaccaaauccgacuaucgaagaaggccggacacucaggguacuaaaaaugguagaaccaugguuaagagguaaccaauuuuguauaaaaauuuuaaaccccuacaugccuagcgugguagagacauuagaacaaaugcaacggaagcacggugguaugcuggugcguaauccuuuaucacgaaauaguacucaugaaauguacugggucaguugcggcacaggaaacauaguaucugcaguaaauaugacuagccgcaugcuauugaaucguuucacaauggcccaccgaaaaccgacuuaugaaaaggauguagauuuaggggcuggaacccgccauguagcuguagaaccagaaguagcuaauuuagacauuaucggccaaaggaucgagaacauuaaacaugagcauaaaucuacauggcauuacgaugaagauaauccauauaaaacgugggcauaccacggauccuaugaagugaaaccauccggcagugcaucuaguaugguaaauggaguugucaagcuccuuacaaaaccuugggacguaaucccaauggugacucaaauugcaaugacagauacaacaccauuuggccagcagagaguguucaaggaaaaaguugacacgcguacucccaaggcgaagagaggcacgguacagauuauggagguaaccgcaaggugguuauggggauuucuuucaagaaauaagaaaccacgcauauguacgagggaagaauuuacccggaagguacgaucaaaugcugcgaucggagcagucuuugucgaugagaaccaguggaacucagcuaaagaggccguagaagaugaacgcuucugggaccuuguaaagaaagaacgggaacuacacaaacagggaaaaugugcaacauguguauauaauaugaugggaaaaagggagaagaaauuaggugaauuuggcaaagcgaaaggaagcagagcuauaugguacaugugguuaggugcaagauuccuagaguuugaagcgcugggauuuaugaaugaagaucauugguuuaguagagaaaauucacuauccgggguugaaggagaaggucuccauaaguuaggauauauacuucgggacauuagcaaaaucccaggagguaacauguaugccgaugauacagccgguugggauacaagaaucacggaagacgaucuccaaaaugaagcaaagauuaccgacauaauggaacccgaacacgcauugcuagcuacaucuaucuucaaauugacauaucagaauaaaguuguuagaguccaacgaccagccaaaaauggaacagucauggacgugaucaguaggagggaucaacggggaaguggccaaguugggacguacggacuuaacacguucacuaauauggaggcacagcuaauaagacaaauggaaucagaagggauauucuuaccaagcgagcuggagacgccaaauuuagcagaacgaguauuagauuggcuugagaaauacgguguugaacgcuugaaaaggauggcgauuuccggagaugauugcguaguaaaaccaauugaugaccguuuugcaaccgcccucacugcccucaaugacaugggaaaagucagaaaagacauuccacaaugggaaccuagcaagggauggaaugauuggcaacaaguuccguucugcucccaccacuuucaccagcucauaaugaaggacggucgagaaaucguaguuccuugucgaaaucaagaugaacuuguagguagagcaagaguuagucaaggagcaggguggucacucagggagacagcaugucuaggcaaaagcuaugcucaaauguggcaacuaauguacuuccauagaagggaccuccgauuggcggcaaacgccauaugcucagcagugccuguagauugggucccaacuagccgaacgacguggaguauacaugcgcaucaucaauggaugacaacugaagauaugcuuagcguauggaauaggguauggaucgaagagaacccguggauggaggauaaaacacauguaaguaguuggggagacguuccguaucuugguaaacgcgaagaucaaugguguggcagcuuaaucggccuaaccgcacgagccaccugggcaucaaauauucaaguagcuauaaaucaggucaggcgucuuauaggaaaugaaaauuaucuagacuacaugacuagcaugaagcgauucaaaaacgaaggugauccagaaggagcacugugguaa

SEQ ID NO: 21903 - RNA, 9879 nt, Artificial Sequence
  derived and/or modified CDS sequence (opt6) from DENV-1__EU482797__SS-prME
ucuguaacgauguuacuuauguuaaugccgacugcucuagcauuccacuuaacaacacgaggaggggaaccucauaugauaguaagcaaacaagaacgugggaaaucuuuguuauuuaaaacgucggcaggaguaaacauguguacgcuuaucgcaauggacuuaggagaguucugugaagacacaaugaccuauaaaugcccuaggauaacagaagcagaaccugaugauguagacugcuggugcaaugcgacagauacauggguaacuuauggaacaugcucacaaacgggagaacaccggcgagacaaacguaguguugccuuagcaccucaugucggauuaggccuugaaacaagaacugaaacuuggaugaguucggaaggcgcauggaaacaaauacaaaggguugaaacgugggcauuacgccacccgggcuuuacugucaucgcccuauuccuagcacacgcaaucgggacgucgauaacacaaaaaggaauaaucuuuauauuacugauguugguuaccccuucaauggcaaugcgauguguaggaauugggucccgagauuucgucgaagguuugucaggggcaacauggguagauguugugcuagaacacggaucaugcguuaccacaauggcuaaagacaaaccgacacuagauauagaacuauuaaaaacagaaguuacaaacccagcgguuuuaagaaaauuguguauugaagcaaaaauaucuaacacuacuacagauucaagauguccuacucaaggggaagcaacguuaguagaagaacaagacgccaauuuugucugcagaagaacguuugucgauaggggauggggcaacggauguggccuauucgguaaaggcagccucauuacuugugcaaaauuuaaaugcgucacuaaacuagaagggaaaacgguucaauaugaaaauuugaaauauucgguaaucguuacuguacacacaggagaccaacaucaaguuggcaaugaaucuacagaacaugguacaacggccaccauaacaccacaagcgccuagcacugaaauacaacuuacagacuacggggcacuuacgcuagacugcagcccuaggacagguuuagacuucaacgaaauggucuuacuuacuaugaaagagaaaaguuggcuggugcacaaacaaugguuucucgauuugccauuaccauggacaucaggcgccucaacaucucaggaaacuuggaacagaaaagaucuucucguaacuuuuaaaacggcccaugcgaagaaacaagaaguaguaguauuaggcucucaagaaggugcuaugcauacagcuuuaacaggagcuacagaaauccaaacaucugggacgacaacuauauuugcaggccaucuaaaaugucgguuaaaaauggacaaauuaacucuaaaaggaaugagcuauguaaugugcacuggauccuuuaaacucgaaaaagaaguggccgaaacacaacacggcacagugcucgugcaaaucaaauaugaaggcacagaugcaccuuguaaaaucccguuuuccacacaagaugaaaaaggggucacgcaaaauggaagguuaaucacugcaaauccuaucguuacugauaaagaaaaaccgguuaauaucgaagcagaaccuccuuuuggugaaaguuacaucguaaucggggcuggagaaaaggcauugaaauugaguugguuuaaaaagggcagcucuaucgggaaaauguucgaagcaacugcuagaggagcuagaaggauggcaauacuaggagauaccgcaugggacuuuggaagcaucgggggaguguucacaagugucggaaaguuaguacaccagauuuucggcacagcguauggcguacuauuuaguggaguuaguuggacaaugaaaauaggcauagggguucuacuaacguggcuaggcuugaacucgagaucaacuucauuaaguaugacauguauugcagugggauuaguaacgcuguauuuggggguuaugguacaagcugauagcggaugcgugauaaacuggaaaggaagagaacucaaaugcggguccggaauauucguuacuaaugaaguucacacauggacagaacaauacaaauuucaagcugauucuccuaagcgacucucagcggcgauuggcaaggccugggaagaagguguauguggaauuagaucagccacuagacucgaaaacaucauguggaagcaaauaaguaaugaauuaaaccauauccuacuagagaaugauaugaaauucacuguaguuguaggugauguagcagguauauuggcucagggaaagaagaugauccgaccacaaccaauggaguauaaguacucauggaaaagcuggggaaaggcuaagauaauaggggcagauguccaaaacaccacauucauaauagauggaccaaauacaccggaaugcccggaugaucaaagagcauggaauauaugggagguagaagauuauggauucgggauauuuacaaccaacauaugguugaaacuuagagauucauacacacaaguuugcgaucaucgauugaugucagcggcgauuaaagacaguaaagcagugcacgcagacaugggauacuggauagaauccgagaagaaugaaaccuggaaauuagcucgagcgagcuucauugaaguuaaaacaugcauauggccuaaaucccacacgcuauggaguaauggcguuuuagaaucagaaaugauaauaccaaaaauuuaugguggaccgauuucccaacauaacuauagaccaggauauuuuacucagacggcagggccguggcacuuaggaaaauuagaacucgacuucgaccuaugugaaggaacaacaguagucguagacgaacacuguggaaaccgcggcccaagucuuaggaccacaacaguaaccggaaaaauuauacacgagugguguugcagaaguugcacacuaccaccauugcguuucaaaggggaagaugguuguugguacggaauggaaauaagaccagugaaggaaaaagaggaaaaucugguaaaaucaaugguuagugcagggaguggcgaaguagauucauucuccuuaggucuuuugugcauuucaaucaugauagaggagguaaugcgaagcagauggucgaggaaaaugcuaaugacugguacccuugccguauuuuuccuacuuauuaugggacaguuaaccuggaacgaucucauaagguuauguauaaugguaggagccaaugcaucagaccggauggguauggguacaacuuaucuagcacuaauggcgacuuuuaaaaugagaccaauguuugcuguagguuuacuuuuccgcagauuaacaagucgagaaguccuuuuguuaacaaucgggcuaucucuaguugcgaguguagagcuucccaauucucuggaggaacucggugauggacucgcaauggggauuaugauuuuaaaacuccugacugauuuucagucucaccaacuuugggcaacauugcugaguuugacauuuauaaagacaacguuuagucuacacuacgccuggaaaacgauggcuaugguauugagcauugugucacuauuuccauuaugcuuaucgacaacuucccagaaaaccacauggcuuccaguauuacuuggcagucugggcuguaaaccgcuaacuauguuccuaauugcggaaaacaaaauauggggaagaaaaucauggccccugaacgaagguauaauggccguaggaauuguguccauuuuguugaguagucuucugaaaaaugauguuccgcuagcgggacccuugauugcaggcgggaugcugauagcauguuaugucauaagugggucuucggcugauuuaucccuugagaaagcagcagagguaagcugggaagaagaagcagaacauuccggagcaagucauaacauccugguagaaguccaagacgaugguacuaugaaaauaaaagaugaagaacgcgacgauacacuuacaauacuuuuaaaggcgacuuuauuggcugucagcggcguuuauccccucaguauuccagcaacucuuuucguaugguauuuuuggcagaagaagaaacaaagaucagggguacucugggauacuccaagcccaccugaagucgagcgggcagugcucgacgacggaauauauagaauaaugcaacgggguuuacuugguagaucucaaguuggaguuggaguauuucaggaaaauguguuccacacaauguggcauguaacccguggcgcaguacuaauguaccagggaaaaagauuagaaccauccugggcaaguguuaagaaagaucuaaucucauauggagguggcuggcgccuacaaggaucuuggaauacaggagaggaaguacagguaauagcaguagaaccgggcaaaaaccccaaaaacgugcaaacggcgcccgguacauucaaaacaagcgagggcgagguaggcgcaauagcgcuggacuucaaaccaggaacauccgggucucccauaguaaauagggaagguaaaauaguagggcuauacggaaaugguguuguuacaacuucggguacauacguaagugccauagcacaggccaaagcuagucaagaagguccucuaccugaaauugaagacgaagucuuuaggaaacgaaaucuaacaauaauggacuuacauccagguagcggcaagacacgcagauaucuaccagcaauuguacgcgaagcuauaaaacgcaaauugcggacguugauuuuggccccaacccgaguuguagcaucugaaauggcugaagcucugaaagggaugccuauccgguaccaaacaacugcagugaaaucagaacauacggggaaggaaauuguagaucuaaugugccacgcuaccuucacuaugcgguuacugucaccuguucgggugccaaacuauaacaugauaauaauggacgaagcacauuuuaccgacccgucuuccaucgcggcaagaggcuauauaagcacaaggguuggaaugggugaagcagcagcaauuuucaugaccgccaccccuccaggaaguguugaagcauuuccccaaucuaaugcuguuauccaggaugaagaacgugauauuccugaacgauccuggaauaguggauaugaauggauaacugauuuuccuggcaaaaccgucugguuugugccaaguauuaaaucuggcaacgacauagcuaauuguuugcguaaaaauggaaaaagaguaauacaacuuucaagaaaaacauucgauacagaauaucagaaaaccaaaaauaaugauugggauuacguggucacgacagauauaucagagaugggagcuaauuucagggcagaucggguaaucgacccaaggcgauguuuaaaaccaguaauacucaaagaugggccagaaagaguaauauuagcuggaccaaugccuguaacugucgccagugccgcucaaagaagagguagaauuggccguaaccauaauaaagaaggcgaccaauacauauauaugggccaaccauuaaauaacgaugaagaccacgcccauuggacagaagcaaagauguuauuagacaacauaaacacuccugaaggaauaauacccgcguuauucgaaccggagagagagaaaagugcagcgaucgauggcgaauacagacuacgcggcgaggcaagaaaaacuuucguggaacuuaugcgucggggagacuuaccagucuggcuauccuauaaaguggcaagcgaaggauuccaguacuccgacaggcgaugguguuucgacggagagcgaaacaaucaaguauuagaagagaauauggauguggaaauuuggacgaaagaaggcgaaagaaagaaacuuaggccgcgaugguuggacgcaaggacuuauucugacccauuggcccuacgggaguucaaagaguucgcggcagggagacguagcguaagcggugauuuaauauuagagauaggcaaauuaccccaacaucugacgcaacgugcacagaacgcccuagacaaccuagucaugcuacauaacagcgaacagggugggagagcauaucgacacgcaauggaagaacugccugauacaauagaaacauuaaugcuuuuagccuuaauagcaguacuaacaggugggguaacuuuguucuuuuugucaggacguggacuggguaagacaaguauugguuuauuaugugucauggccucuaguguauuauuauggauggcaagcgucgaaccacacuggauagccgcuucaauaauacuggaguucuuucuaaugguauuguugauccccgaaccagacaggcaaagaacaccccaagauaaucaacuugcauacguaguaauugguuuguuguucaugauacuaacaguugcggcuaacgaaaugggauuacuggagacaaccaaaaaggaucuuggcauagggcauguggcuguagaaaaucaccaucacgcagccaugcuugacguagauuugcauccagcaucggcauggacuuuguaugcaguagcaacaacuauuauaacaccuaugaugagacacacaauugaaaauacaaccgcaaauauaagucuaaccgcaauagccaaucaggccgcaauacuaaugggauuagauaagggauggccaauuucaaaaauggacauaggagugccccuauuagcacugggcuguuauucccaaguuaauccgcugacuuuaaccgccgccguacuuauguugguagcgcacuaugcaauuaucggcccaggguugcaggcuaaggcaacgcgugaggcacaaaagaggaccgcugcaggcaucaugaaaaaccccacugucgaugguauagucgcaauugauuuagauccuguaguuuacgaugcaaaauucgaaaaacagcuaggacaaauuaugcuguugauucugugcacuagccagauacuacuaaugcgaaccacaugggcuuuaugugagucgauaacguuggcuacagguccauugaccacauuaugggaaggaucgcccgguaaguuuuggaauacaacgaucgcuguaaguauggcaaauauuuuuagagguucuuaccuagcaggagcaggucucgccuuuucgcuaaugaaaucauugggcggggguagacgagguacuggagcucaaggcgaaacuuuaggagaaaaguggaaacgacaacuaaaucaauuaagcaagucugaguucaauacauauaaaagaagcgguaucauggaggucgaucgaagcgaagcgaaagagggacuuaagaggggagaaacaacaaaacacgcaguaucacguggaacagcgaaauugcgcugguuugucgaacgcaaccuagugaagccagaaggaaaaguuauugauuugggaugcggcagaggcggcuggucguacuauugugcugggcuaaagaaagucacagaaguaaaggguuauacuaaaggcggacccgggcacgaagaaccaauaccaauggcaacguacgguuggaacuuagugaagcugcauagcggcaaagauguuuucuuuauuccacccgaaaaaugugauacguuacuaugugacauuggagaaucaucuccuaauccuacaauagaagaggguagaacguuaagaguacuaaagaugguggagccaugguugagaggaaaccaguucuguauuaagauauugaauccuuacaugccgucgguuguagagacacuagagcaaaugcagcgaaaacauggcgguaugcuuguacgaaauccauugucccggaacucgacucaugagauguauuggguuagcugcggaacggggaauauaguuagugcaguaaacaugacaagccgcauguuauuaaauagauucacgauggcacaucgaaaacccacauacgaacgcgacguagaucucggagcugggacucgacaugucgccguagaaccggaaguugcuaaucuugacauuauuggacaacgcaucgagaauauaaaacacgaacacaaaucaacguggcauuacgaugaggacaacccuuacaaaacuugggcuuaucaugggaguuaugagguuaaaccgaguggcagugcaucaucgauggucaacggaguaguaaaacugcuaacaaaacccugggacgugauaccaaugguuacucaaauugcgaugacggauaccacgccguucggacagcaaagaguauuuaaagaaaagguugauaccaggacgccuaaagcuaaacguggcacagcgcagauaauggaagugacagcaaaauggcuguggggcuuccugucacgaaauaagaaaccuaggaucuguacuagagaagaguucacucguaaggucagaucaaacgcggcaauaggugcaguauucguagacgaaaaccaguggaauagugcaaaggaggcaguugaagacgagagauucugggaucuugugcaucgagaaagagaauuacauaaacaaggaaaaugcgcgacaugcguuuacaacaugaugggaaaaagagagaagaaacuaggggaauuuggaaaagcgaaggguucacgagcuauaugguauaugugguuaggagcaagauuucuagaguucgaagcacuagguuuuaugaaugaagaucacugguucagccgagaaaacagccuaagcggcguugaaggugaaggguuacauaaauugggguauauccuucgagauauuuccaaaauaccagguggaaauauguacgcggaugacaccgcagguugggauacucggauuacagaagaugaccuacaaaacgaagcaaaaauaacugacauaauggagccugagcaugcacuucuagcgaaaagcauauucaaguugacauaucaaaauaaaguuguucgaguacaacgacccgccaaaaauggaacggucauggauguaauaucuagaagggaccagagaggcaguggacaaguaggaacauauggacuaaacacauuuacaaauauggaggcccaacuaauuaggcaaauggaaucugaaggcauauucucaccgucagagcuagaaacaccaaaccuugcaggaagaguuuuagacuggcuagaaaaacacggaguagaacguuugaaaagaauggcuauaucuggugacgauuguguggugaagccuauagaugaucgauuugcgacagcacucacagcacuaaaugacaugggaaaaguacguaaagaugugccucaaugggaaccuucaaaaggcuggaaugauuggcagcaaguuccauuuuguagccaucauuuucaccaauuaauaaugaaagacggaagagaaauaguuguuccgugucguaaucaagaugagcuaguugguagagcgagggucagucaaggugcgggauggucuuuaagagagacagcauguuuaggaaaaucauaugcacaaauguggcagcuaauguacuuucauagacgagauuuaagauuggcggcuaacgcaauuuguagugcagugccgguagauuggguaccaaccucaaggacaacauggucuauucacgcccaucaucaauggaugacuacggaagacauguuaucaguauggaauagaguauggauagaagaaaacccauggauggaggauaaaacucauauaucaucguggggagacgugccuuaucuugggaagagagaggaucaguggugcggcucuuugauaggguuaacagcuagggcgacaugggcuacuaacauacaagucgccauaaaccaaguucgaagguugauagggaaugaaaacuaucucgauuacaugacaucaaugaagcgauuuaaaaacgaaucagauccagagggugcacucugguga

SEQ ID NO: 21904 - RNA, 9879 nt, Artificial Sequence
  derived and/or modified CDS sequence (opt6) from DENV-1__EU482799__SS-prME
aguguaacaaugcuacuuauguuaaugccaacagcauuagcauuucauuuaacaacacgagggggugaaccgcauaugaucguaucuaaacaagaacgcgggaaaagccuacuauucaaaacgagcgcugggguaaacaugugcacuuugauagcaauggacuuaggugaacuaugugaagauacaaugacuuauaaaugcccgaggauaacugaaaccgaaccagaugauguugauuguugguguaaugccacugauacauggguaacauacggcacaugcagucaaacaggagagcauagaagagauaaacguaguguugcucuagcaccgcauguagggcuaggccuagaaacacgaacagaaaccuggaugucuucugaaggcgcauggaaacaaauucaaaggguagaaacuugggcucuaagacacccuggauucacuguuaucgcauuauuucuagcacaugugauuggaacaucgauaacacaaaaagggauuaucuuuauuuuacuaaugcuuguaacgccauccauggcuaugaggugcguugggauagguagucgcgacuuuguugaaggacucagcggagcgacuugggucgacguaguccuagagcacgggaguugcguaacgaccauggcuaaagauaaacccacuuuagauauagaacuacuuaaaacugaaguuacaaaucccgcaguucuuagaaaacuaugcauagaagcgaaaauaaguaacaccacaacagacaguaggugcccuacacaaggagaagcaacuuugguugaagaacaagaugcuaauuuuguauguagacgcacguuuguagauagagguugggggaacggauguggauuauucggaaaagguucacuaauaacuugcgccaaauucaaaugcguuacgaaacuugaaggcaaaauaguacaauacgaaaaccuuaaauauaguguaauaguuacgguacauacaggugaccaacaucaaguuggaaacgaauccaccgagcauggcaccacagccacuauaacaccucaggccccuacaacagaaauacaauugaccgauuauggagcccuaacacuugauuguucuccccgaacaggacuggacuucaacgaaaugguucuauugaccaugaaagaaaaaucuugguuaguccacaaacaaugguuccuagacuuaccguuaccuuggacuuccggagcauccacaucacaagaaacauggaauaggcaagaucuccuaguaacauuuaaaacagcacaugccaagaaacaggagguagucguucucgguagccaagagggagcaaugcacacugcccuaacgggagccacagaaauccaaacgagugggacgacaacaauauuugcgggacaucuuaaaugucgacugaaaauggacaaacuuacccucaaagggaugucuuauguaaugugcacugguagcuucaaacuggaaaaagaaguugcugaaacccaacacggcacggucuuaguacaaauuaaguaugaagggaccgaugccccaugcaaaaucccauuuaguacucaggaugagaaaggcguaacucaaaacggacgauuaaucacagccaacccaauagucacagacaaggagaagcccgugaauauugaggcagagccuccuuuuggugagucuuauauaauuauaggcgccggcgagaaaacuuuaaaacuaaguugguucaaaaaggguucuucuauagggaaaauguucgaagcuacggcccggggagcaagaagaauggcaauucucggggacacagcaugggauuuuggaucaauuggaggagucuuuaccucugugggcaaacuuguucaccaaauuuuuggaacagcguacggagucuuauuuucugguguaucuuggacaaugaagaucgguaucggagugcuccucacauggcuaggacuaaauucgagaaguacaucauuaucuaugaccugcauagcugucggauuaguaaccuuauaccuuggagucaugguccaagcagauucuggaugcgugauaaauuggaaaggccgagaauugaaaugugggagcgguaucuuuguaacaaaugaaauacacaccuggaccgagcaguacaaguuucaagcugauaguccuaaacgacuuagcgccgcgauaggaaaggcuugggaagaaggcguaugcggcauccgaucggccacaagauuagagaacauuauguggaaacaaauauccaaugagcuaaaccauauccuguuagaaaaugauaugaaauucaccgucguaguaggcgauguugcagguauacuagcgcaagguaagaaaaugauaaggccgcagccaauggaguauaaauauucauggaaaaguuggggcaaagcaaaaaucauuggcgccgauguccaaaauacaacguuuauaauugauggaccaaauacuccagagugccccgacgaccagagggcuuggaacauaugggaagucgaagacuauggcuuugguaucuuuacgaccaauaucuggcuuaaacugagagacuccuauacucaaguaugugaucaccgauugaugagcgcugcaaucaaagacaguaaagcaguacaugcggauaugggauauuggauagaaucagagaaaaaugaaacauggaagcuagcuagagcuagcuuuaucgagguaaaaacuuguauauggccaaaaagccauacacuguggaguaacggcguauuagaaucagagaugauaauaccgaaaauuuacggcggcccaauaucacaacauaauuaccgaccuggguacuuuacucagacggcugguccauggcacuuagggaaacuggaguuagauuucgaccuaugugaagggacuacagucgucguagacgagcauuguggaaauagaggaccaagucucaggacuacuacuguaacggguaagauuauacaugaauggugcugucguaguuguacacuuccaccuuugagauucagaggcgaagacgguuguugguauggcauggaaaucaggccaguaaaagaaaaggaagaaaaucuaguaaaaucuaugguaagugcagggaguggcgaaguugauagcuuuucauugggcuugcuuugcaucaguauuaugauagaggaaguuaugagaucucgauggagccgaaaaaugcuuaugacaggaacucuugcaguuuucuuucuauugauaaugggacaauuaacauggaaugacuuaauacgauugugcauaaugguaggggcaaaugcgucggaucgaaugggaauggguacaaccuaccuugcacuaauggccaccuuuaagaugaggcccauguuugcaguuggccuauuauuucgcagacuaacaagucgagagguauuacuacuuacaauaggccuuagucugguagcuucuguagaauuaccuaauucauuagaggaauugggagacgguuuagcaaugggcauaaugauccuuaaguugcucacggauuuccaaucucaccaacugugggccacauuacugucauugaccuucauuaagacuacguucagcuuacacuaugcguggaagacaauggcuaugguauugaguauaguuucacuauuuccguuguguuuauccaccacaagccaaaagaccacguggcugccagugcuacuugggucguuggguugcaagccauuaacgauguuccuaauagcggaaaacaagauauggggccgccgcaguuggccucuaaaugaagguauuauggcugucggcauagugucaauucuuuuaucaucguuacuuaagaacgaugugccgcuagcaggaccacuuauagccggcggaaugcuaauugcuugcuauguaauuucugguucaucagcagaccucucacuggaaaaggcagccgaggugagcugggaggaggaagcggaacauaguggagcaagccacaacauucucguugagguccaggacgauggcacaaugaaaauaaaggaugaagaacgugaugauacauugacaauucuauuaaaagcaacauuacucgcaguaagugggguauaccccuuaucaauuccagcuacauuauucgucugguauuuuuggcagaagaagaaacaaagaagcgguguacugugggacacaccgucaccaccagaaguugaacgagccgucuuggacgauggaauuuaccguauaaugcaaagaggucuguuaggacgcucucaaguaggcgugggaguuuuccaggaaaauguguuucacacgauguggcacguaacaagaggugcgguucuaauguaucaagguaaacgauuagagccaucgugggcuagugugaagaaagaccuuaucucuuacggagguggauggcgacuccaaggaucauggaauacaggagaggaagugcaagugauagcaguagaaccuggcaaaaaucccaaaaauguacaaaccgcaccuggaacuuucaagacaccugagggagaagucggugcaauugcuuuagauuuuaaaccuggaacauccggaagccccaucgugaauagagagggcaaaauuguagggcuuuaugguaacgguguagugacaaccucaggaaccuauguaucugcgauugcacaagcuaaagcgagccaggaagggccacuuccugaaauugaagaugagguuuucaggaaaagaaauuuaacuauuauggauuuacauccagguucaggaaagacuaggagguaccuuccagcaauaguacgagaagcaauaaagagaaaacuacgcacuuuaauacuagcgccuacaagaguuguagcgucggaaauggcggaagcauuaaaaggaaugccgauucguuaucaaaccacggcaguaaaaagugaacauacugguaaggaaauaguggacuuaaugugucacgcuacguuuaccaugagauuacuuucuccuguuagagugccaaauuauaauaugauuauaauggaugaagcucacuucacagacccuaguucaaucgcagcaagggguuacauuucuacgcgcguuggaaugggagaagcggcugcaauauuuaugacugcaacaccaccugguuccguugaggcauucccacagucgaaugcaguaauacaagaugaagaacgugauauaccugaacgcagcuggaacuccggauaugaauggaucacugacuuuccgggaaagacgguuugguuuguuccuucuaucaaauccggaaaugacauagcuaauuguuugcggaaaaauggcaaacgagucauucaacuaucuaggaaaacauuugauacugaauaccaaaagacuaaaaauaacgacugggacuauguaguuaccacggacauaucugaaaugggcgcuaauuuucgagccgaccgcguaauagauccaagaaggugccuuaagccaguuauacucaaagacggcccugaacggguaauucuggcuggcccaaugccgguuacuguagcuagcgcagcacaaaggagggggaggauugggcgaaaccauaauaaagagggagaucaauauauauauaugggacaaccuuuaaauaaugacgaagaccacgcacacuggacagaagcuaaaauguuauuggauaauaucaacacuccagaagggauaaucccagcacuuuuugagccugaaagggagaaaagcgcagcuauagauggagaauacagacuacgcggagaagcaaggaaaacguuuguugaauuaaugaggagaggagauuuaccaguaugguuaucguacaaaguagccuccgaaggguuucaauacucagacagacgcuggugcuucgacggugaacguaauaaucagguuuuggaagaaaauauggauguagaaauauggaccaaagaaggagagaggaagaaacucagaccucgauggcuggacgccaggacuuauagcgauccacuggcacuacgcgaguucaaggaauuugcggcgggcagaaggucugucaguggugaucuaauucuagagauagguaaguuaccacaacaucugacacaaagggcacaaaaugccuuagauaaucuggucauguugcacaacucugaacagggcgggcgggcguaccgucacgccauggaagaauuaccggacacuauagaaacucuaauguugcuugcucuuauagcaguuuuaacgggagguguaacuuuauuuuucuugagcggucguggucuugguaagacaaguauaggauuauugugugucauggcuagcuccgucuuacuauggauggcuucaguagaaccucacuggauugcugcauccaucauauuagaauuuuuccuaaugguuuuguuaauuccggaaccagacagacaaagaacaccgcaggauaaucaacuagcguacguagugauuggacucuuguuuaugauucuuacagucgcugcaaacgaaaugggauuauuggaaacaaccaagaaagacuuagggauaggucacguugcggucgagaaccaucaccacgcagccauguuagaugucgaucuccauccagcaucugccuggacacuauaugcgguggcuacuacgaucauaacaccgaugaugcgccacacaauagaaaauaccacagcuaauaucucgcuaaccgccaucgcaaaccaagccgcgaucuugaugggacuugacaaaggauggccuaucucuaaaauggauauugguguaccuuuauuagcucugggauguuacagucaaguaaaucccuugacgcuuacugccgcuguuuuaauguuagucgcccacuacgcgauuauaggacccggauugcaagcgaaagcaacgcgugaggcccagaaaaggacagcagcgggcauuaugaaaaaucccacaguugauggaauagucgcuauugauuuggacccaguagucuacgaugccaaauuugaaaaacaacuaggacaaauaaugcuccuuauccugugcacuucacaaauuuugcugaugcgaacuacaugggcgcuaugugaaucuauaacucucgcgacuggucccuuaacgacacuaugggaaggguccccggggaaauucuggaacacaacuauugcagucucaauggcaaauauauuuagagguucuuauuuagccggggcuggcuuagcauucucauuaaugaaaagccuagguggaggcagacgcggaacaggugcucaaggugaaacauuaggagaaaaauggaagagacaacugaaucaauuauccaaaucagaguucaauaccuacaagcgaaguggaauaauggaaguagauagaucggaagccaaagaaggccucaaaaggggagaaacuacgaaacaugcagucucucguggaacagcaaaacucagaugguucguugaaagaaaucuagucaaaccugaaggcaaggugauagacuuaggaugcggaaggggcggcuggucauacuauugcgcaggucucaagaaagugacagaaguaaaaggguauaccaaggguggaccagggcaugaggagccgauuccaauggccacguauggcuggaauuuaguaaagcuacacaguggaaaggauguauucuucaucccgccggaaaaaugugauacauuguuaugugacauaggugaauccucuccuaaucccacgauagaagaagguagaacacuuagaguuuugaaaaugguagagccauggcuaagaggaaaucaauuuuguauuaaaauucugaauccauauaugccguccgugguugagacccuugaacaaaugcaaaggaaacacgguggaaugcuuguaagaaauccgcuguccagaaauaguacucaugaaauguauuggguaagcugcggaacaggaaauauuguguccgcugucaauaugacaaguagaauguugcucaaucguuuuacuauggcacacaggaagccuacauacgaaagagacguagauuuaggcgcaggaaccagacacguagcagucgaaccggaaguagccaaucuugauaucauaggccaaagaauagaaaauauuaaacacgaacauaaaagcacauggcauuaugacgaagacaaucccuauaagacuugggcguaccacgguucguaugagguuaagccuagcggaagugcuagcucuaugguaaacggaguaguaaaacuauuaacaaaaccaugggauguaauuccuaugguaacucagauugcuaugaccgauaccacgcccuucggacaacagcggguuuuuaaagaaaagguggacacaagaacaccaaaagcaaaacgaggaacugcacaaauuauggaaguuacugcaaaaugguuauggggauuuuuaagcagaaauaaaaagccccguaucuguacaagagaggaauuuacuaggaaaguacggaguaacgcggcaauaggagccguuuuuguagaugaaaaccaauggaacagugcaaaagaagccguagaagaugagagauucugggauuuagugcauagagaaagagaauuacauaaacaaggaaaaugugcgacuugugucuacaauaugaugggcaagagggagaagaaacucggagaguuugguaaagcaaaggguuccagggcuaucugguauaugugguuaggagccagauuucuugaauuugaagcucuaggauuuaugaacgaagaccauugguuuagucgagagaacucauuaagcgguguggaaggugaaggacuacacaaguuggguuauaucuuacgagacauuaguaaaauccccgggggcaauauguaugcugacgauacagcggguugggacacaagaauuacagaagaugaccugcaaaacgaagcuagaauuacugauauuauggaaccugagcacgcacuccuagcgaagaguauauuuaaacuaacguaccaaaauaaaguagugcgggugcaacgaccagccaaaaaugguacagucauggauguuauuaguaggcgagaucaaagggguucugggcaagugggaacauacggccugaacacuuuuacaaacauggaagcacaacucauuagacagauggaaucggaagguauauuuucuccuagcgaacuugaaaccccgaacuuagcagagagaguucuagauugguuagaaaaguaugguguagaacgauuaaaaagaauggcaauuaguggugaugauugugucguaaagccgaucgacgaccgguuugcaacagcauuaacugcccuaaaugauaugggaaagguuaggaaagauauuccacaaugggaaccuaguaaggguuggaaugauuggcaacaggugccuuuuuguagucaccacuuucaucaguugauaaugaaagacgggcgugaaauuguaguaccaugucgaaaucaagacgagcuaguuggacgagcucgcguaucucaaggcgccggcuggucacuaagagaaacagccugucuaggcaaaucuuaugcgcagauguggcaacuuauguauuuccauaggcgugaucuaagauuagcagcuaacgcaauuuguagugcgguaccaguggauuggaucccaacgucccgaacaacgugguccauucacgcccaucaccaauggaugacuacggaagauaugcuaucagucuggaaccggguauggaucgaagaaaauccauggauggaagacaaaacgcauauuucaucauggggagacgugccauauuuaggcaaaagagaagaucaauggugcgguagucuuauuggauuaaccgcaagggccaccugggcgaccaacauucagguugcaauuaaucagguuagaagacuaauugggaacgagaauuauuuagauuauaugacaaguaugaaacgcuucaaaaaugaaagcgauccagaaggagcuuuaugguag

SEQ ID NO: 21905 - RNA, 9879 nt, Artificial Sequence
  derived and/or modified CDS sequence (opt6) from DENV-1__EU482800__SS-prME
ucgguaacaauguuacuaaugcuaaugccgacugcuuuagcuuuccaucugacgacccggggaggugaaccccauaugauuguuagcaaacaagaaagaggaaaaucuuuauuguuuaaaaccucagcaggcguaaauaugugcacuuuaauagcuauggaucuuggagaauuuugugaagacacgaugacuuacaaauguccgaggauuacagaagcggaaccagaugauguugauuguugguguaaugcuaccgacaccugggucacuuacgguaccuguucgcaaacagggcagcauagaagagauaaacgcucuguagcauuagcuccacaugugggacuuggauuagaaacaagaaccgaaacuuggaugucuagcgagggagcuuggaaacagauucaaagagucgaaacuugggcccucagacaucccggguuuaccguaauagcacuauuccuagcacaugcaauuggcaccaguauuacccaaaaaggaauaauauucauucuauugauguugguuacaccaagcauggcuaugcgauguguggguaucggcucaagggacuuuguagaaggucuguccggagcaacauggguagaugucguucuagagcacgggaguugcguaacuaccauggcaaaagauaagccgacguuggauauagaacuucucaagacagaggugacaaacccagcuguacugagaaaauuaugcauagaggcaaaaauaucuaauacuacaauugacaguagguguccgacccaaggagaagcuacucuuguagaagaacaagaugccaauuucguauguagacgaaccuuugucgaucggggauggggaaacgguuguggacucuuuggaaaagguucuuuaaucacaugugcaaaauucaagugugucacaaaauuagaaggcaaaaccguucaauaugaaaaucuaaaguacagcgucauaguuacaguccauaccggagaccagcaccagguugguaacgagucuacagaacaugggacgacugcgacaauaacuccucaggcgccaaguacagagauacaacuaacggauuauggugcacuaacacuagauugcucuccaagaacaggauuagacuucaaugaaaugguucuccugacaaugaaagaaaagucuugguuaguacauaagcaaugguuuuuagaccuaccauugccuuggacaucaggcgcaucuaccucucaggaaacauggaauagaaaagacuuauuggugaccuucaaaacggcucaugcuaagaaacaggaaguuguuguauuagggucucaagagggagcuaugcacacagcgcuuaccggugcgacggaaauacaaacaagcgggacuacuacaaucuucgcgggacaucucaaaugcagacuuaaaauggauaaacugacgcuaaaagggaugucauacguaaugugcaccgggagcuuuaaauuggaaaaggaaguugccgaaacacagcacggcacaguauuaguucagaucaaauaugaaggcacggacgcaccauguaaaauuccuuucucgacacaggaugagaaagggguuacucaaaaugguagacuaaucacagcuaauccgauuguuacagauaaagagaaacccgucaacauugaagcugaaccucccuucggugaaucauacauagugauaggagcaggagaaaaagcacuaaaguuaucaugguucaagaaaggcuccagcauagguaagauguuugaagccacagcuaggggugcacgacguauggcaauuuugggugauacagcgugggacuuuggcaguaucgggggcguguucacaaguguaggcaaauuaguacaucaaauuuuugguacggcuuacggcgucuuauucucgggagugucguggacgaugaaaaucgggauuggagugcuucuuacgugguuaggauuaaacucacggaguacaucacugucuaugacgugcaucgcgguuggauuagugacuuuguaucucggcguaauggugcaggcugacucaggcuguguuauaaacuggaagggucgagaacuaaagugcgggucagguauuuucgugacaaaugaagugcauacauggaccgagcaauacaaauuccaagccgacucaccaaaacgucucucggcggcgaucgguaaagccugggaagaggggguuugcggaauacgguccguaacuagguuggaaaauauuauguggaaacaaauaucaaaugaacucaaccauauccuauuagaaaacgauaugaaauuuacaguugucguuggugacguugcuggaauacuggcgcaagggaaaaagaugauccguccccaaccaauggaauacaaauauucauggaaauccuggggaaaagcaaaaauuaucggcgcagauguacaaaauacuacauuuauaauagauggaccgaauacaccagaauguccagaugaccaaagagcauggaacauaugggaaguagaagauuacgguuuugguauauuuacuaccaacauaugguuaaaguuaagagauagcuacacucaaguaugcgaccauagauuaaugucagcggcaauuaaagauucuaaggcuguucacgcugauauggguuacuggauugaaucugagaaaaacgaaacuuggaaguuggcaagagcuagcuuuaucgaaguaaaaacuugcaucuggccuaaaucacacacucucugguccaacggcguauuagaaucagaaaugauaauaccaaaaauauauggaggaccaauuagucagcauaacuauagaccaggauauuuuacccaaacagcaggcccauggcaucuagguaaacuagaacucgauuuugaucuuugugaaggaacuacuguagucguagaugagcauuguggaaacaggggucccucgcuaaggacaacuaccgucacaggaaaaauaauacacgagugguguugccguucaugcacuuuaccgccguuacguuuuaaaggagaggacggauguugguaugguauggaaauucgcccgguuaaagaaaaggaagaaaauuuaguaaaaucuaugguuucggcaggaaguggggaaguagacaguuucaguuuaggacucuuauguauaucuauuaugauagaagaaguuaugagaucacgcuggucccgaaaaaugcugaugacagggacgcuagcuguauucuuucugcuuauuaugggacaauugacauggaaugauuuaauucgucuauguauuaugguuggagcaaaugcuucggaccggaugggcaugggaacuacauaucuagcccucauggccacuuuuaaaaugcgaccuauguucgcggucggucuuuuauuuaggagguuaaccagcagagaaguacuacuguugacuauugguuuaucuuuaguagcuucaguagaauuaccaaauucuuuagaggaguuaggagaugguuuagcgaugggaauaaugauucuuaaauuauuaaccgauuuucaaucacaucaacuuugggcuacguuguugagucugacguuuauaaaaacuacuuuuucgcuucauuaugcguggaaaacuauggcgaugguucuaagcauugugucauuauucccgcuaugccuuaguacuacaagucagaaaacaacgugguugccaguauuacucggaucucuaggguguaaaccauuaacaauguuccuaauugcggagaacaaaauuuggggaagaaaaaguuggccacugaaugaaggaauuauggcugugggcauaguaucgauucuucuuucuucauuacucaaaaaugacguaccucucgcgggcccacuuaucgccggaggaauguuaaucgcaugcuauguuauaagugguuccagugcugacuuaucauuggagaaggcugcugagguaucgugggaagaagaagcagaacauucuggugcgucccauaauauauugguagaaguacaagacgacgggacaaugaaaauaaaagaugaagaacgcgacgauacauuaacuauucucuugaaagcgacccugcuagcaguuagcggcguauauccucucaguauuccggcaacacuuuucguaugguauuuuuggcagaagaagaaacagcgaucggguguguugugggacacaccuucaccgccagaggucgaaagagcuguguuagaugacgguauauaucgaauaaugcaaaggggucuuuuaggccguucccaaguagguguugggguauuucaggaaaauguauuccauacuauguggcauguaacgagaggugcuguuuuaauguaccaagggaaacgccuggaacccucgugggccucuguuaagaaagaucuaauuaguuacggagguggauggagacugcaagguucauggaauacaggagaagaaguucaggugauagcgguagaacccggaaagaaucccaaaaacguacaaacagcaccagguacguuuaaaacuagcgaaggugaggucggugcuauagcuuuagacuuuaaaccaggcacauccgguaguccgauuguaaaucgagaaggaaaaauaguaggacuuuauggaaauggaguuguaacaaccucaggcacguacguaagcgcgauagcacaagcuaaggcaucacaagaaggaccacuaccagaaaucgaagaugaaguauucagaaaaagaaacuuaacaauaauggauuuacauccaggcucagggaaaacacgacgcuacuuaccugcaaucguucgcgaggccaucaaacguaaacucaggacacuuauacuagcccccacucgaguuguugcuagcgaaauggcggaagcucugaaggguaugccaauacguuaucagaccacagcaguaaaguccgaacauaccggcaaggagauaguagaccugaugugucaugcuacguucacuaugagacucuuaucgcccguucgaguacccaauuauaauaugauuaucauggaugaagcacauuuuacagauccgucuucuauugcggcucgaggguacaucucaacacggguuggaaugggagaagcagcugcgaucuuuaugacugcaacaccaccaggaagcguagaagcguuuccacagaguaaugcaguuauucaagacgaggaaagagacauacccgaaagauccuggaacucggguuacgaguggauaacagauuuuccaggcaagacuguuugguucguuccgucuauaaaaagcgguaaugacaucgcaaauugccuccgcaaaaaugggaagcgcgugauucaauuaaguagaaagacauuugauacugaauaucagaaaaccaaaaauaacgauugggauuacguagugacaacggauauuucggaaaugggagcaaauuuucgagcagaucguguuauagauccacggcgauguuuaaaaccaguaauucucaaagauggcccagaacguguaauacucgcuggacccaugccgguuacggucgcuagugccgcacaaaggcguggaaggauuggucgaaaucacaauaaagagggagaucaauauauuuauaugggacagccacugaacaaugaugaagaucacgcgcauuggacggaggcaaaaaugcucuuagauaauauaaauaccccagaaggaauuauaccugcacuauucgaacccgaaagagaaaagucggcggcaauugacggcgaguauagacuacgaggagaagcccguaagacauuuguggagcucaugcguagaggugaucuaccaguguggcucuccuacaaagucgcaucagaaggauuucaauacagugauaggcgauggugcuuugauggagagagaaacaaccaaguacuagaggaaaauauggauguugaaaucuggacaaaagaaggagaaagaaagaaacuaagaccucgguggcuugaugcuagaacguacagcgauccucuagcauugcgagaauuuaaagaauuugcagcaggucggagaagcguuuccggcgauuuaauccuagagauuggcaaauuaccucaacacuuaacgcaacgcgcacaaaacgcauuagauaacuuagugauguuacacaauucagaacagggaggaagggccuaucgacaugcuauggaagaauuaccggacacuauagagacucuaaugcuucuggcuuuaaucgcgguacuuacagggggcguaacuuuauuuuuccuaucagggagagguuuaggaaaaacaucgauuggucuacuuuguguuauggcaucaagcguccuacuauggauggcgagcguagagccgcauuggauagcggccaguaucauacuugaguucuuuuugaugguauuauuaauaccugaaccagaucgucaacgaaccccgcaagacaaucaacucgcguacguugucauaggauuauuauucaugauacucacuguugcugcaaacgaaauggguuuauuggaaaccacgaaaaaggaccugggcauaggacacguagcuguagaaaaucaucaccaugcugcgaugcuagacgucgaucuucacccagcgucagcauggacucuuuaugcuguagccaccacuauaauaacacccaugaugcgacacacuauagaaaauacaacagcuaacauaaguuuaacugccauugcuaaucaggcagcgauauugauggggcuugacaaaggauggccaauaucgaaaauggauauuggcgucccguuauuggcguuaggauguuauagccaaguaaacccacuuacucugacugccgcaguguugaugcuaguugcacauuacgcaauaauuggaccaggcuuacaagcaaaggcaaccagagaagcacaaaagagaaccgcugcaggcauaaugaaaaacccgacgguugauggaauagucgcaauugaucuggacccugucguguacgaugcuaaguucgagaaacagcucgggcagaucauguuauuaauuuuaugcacaagccaaauacuacucaugaggacaacaugggcacuaugugaaagcauuacucuugcaacaggaccauuaaccacacugugggagggaucacccgggaaauuuuggaauaccacuauagcgguaagcauggcgaacauauuucgcggaaguuaucuugccggggcagggcuggcauuuucacuaaugaagucucuagggggaggaagaaggggaacaggcgcucaaggcgaaacacucggagaaaaauggaaaaggcaacuuaaucagcuaucuaaaucagaauuuaauacauauaaacguagcgggauaauggaaguagauagaagugaagcgaaggagggcuuaaaacgcggggaaaccaccaaacaugcaguaaguagggggaccgccaagcuacgcugguuuguugaaagaaacuuaguaaagccagaagggaaaguuauagauuuggggugcgguaggggcgguuggucauauuacugcgcgggacugaagaaagugaccgaggucaagggauacacuaaaggcgguccaggacaugaagaaccaauaccuauggcuaccuaugguuggaaucucguaaaauuacacagugggaaggauguguucuuuauuccuccagaaaaaugugauacauugcuaugcgacauuggagaaagcucgccaaacccuacaauugaagaaggacgcacccuacgcgucuugaaaaugguggaaccuugguuacguggaaaucaauucugcauaaaaauauuaaacccguauaugccuucagucguugaaacuuuggaacagaugcaacgaaaacacggcggaaugcuaguucguaacccauuauccaggaacagcacgcacgaaauguacuggguaucauguggaacggggaauauuguuuccgcuguaaauaugacuagcagaaugcuacuaaaucguuucacaauggugcauagaaaaccaaccuaugagagggacguagacuuaggagcgggaacacgacacguugcaguagagccugagguugcaaauuuagacauaauaggacagaggauagaaaacauuaagcacgaacauaaaaguacguggcacuaugacgaagacaacccuuauaagacuugggcguaccaugggaguuacgagguaaaaccuucaggcucggcuucaucaaugguaaauggagucguuaaauugcuuacaaaaccaugggauguaauaccuaugguaacacaaauagcaaugacugauacaaccccauuuggucagcaaagaguauuuaaagagaagguagauacaagaacacccaaagcaaaaaggggcaccgcccaaaucauggaagugacagcgaaaugguuaugggguuuccuaucccgaaacaaaaagccuagaaucuguacuagggaagaauuuacaaggaaaguaagauccaaugccgcaauuggcgcaguauucguugaugagaaccaguggaacucggcgaaggaagccguugaggacgaacgguucugggauuugguacauagggaacgcgaacuacacaagcaaggcaaaugcgccacauguguauacaauaugaugggcaaacgugagaagaaauugggugaauuugguaaagcgaagggaucucgcgccauuugguauaugugguugggcgcaagguuccucgaguucgaggcauuaggcuucaugaacgaagaccacugguucagccgugaaaauagucuaaguggagucgaaggggaaggauuacauaaacuaggauauauucuaagagauauuagcaagauaccaggaggaaacauguaugcugacgauacggcugggugggacacgagaauuaccgaagacgaucuacaaaacgaggccaaaauuacugacauaauggaaccugaacacgcccuuuuagcgaaaucuauauuuaaauuaacuuaucagaacaaaguuguuagaguacagagaccugcgaaaaaugguacuguaauggauguaauaaguagaagggaccaaagagggucuggccagguaggcacauauggacuaaacacauuuacaaacauggaagcacaacuuauucgucaaauggaauccgagggaauauucucaccguccgagcucgagaccccaaaucuagcagggagaguauuugauugguuagagaagcauggaguggagcgauuaaagagaauggcaaucaguggugacgauugugucguuaaaccaaucgaugaucgcuucgccacagcacuuacagcuuuaaaugauauggguaaaguucgaaaggauauaccgcaaugggaaccuagcaaggguuggaaugauuggcagcaaguaccauuuugcucacaccauuuccaccaacuuauaaugaaagauggcagagaaaucguggugccgugucgaaaccaagaugaacuugucggcagagcaagaguaucccaaggagcgggauggaguuuacgagaaacugccugccuaggaaaaaguuacgcacaaauguggcaguuaauguauuuccaucgaagagaccugagacuagcagcaaaugcuauauguucagcaguaccuguagauugggugccaacaagccgcacaacaugguccauucaugcacaccaucaauggaugacaaccgaggauaugcuuucaguguggaacagaguauggauagaagaaaauccuuggauggaagacaaaacacacauaucaucuuggggcgacguaccauaccuagggaagagagaagaucaauggugcgguucacuaauaggauuaacagcgagagcuacgugggcuacuaauauacaaguagcaauaaaucaagugagaagguuaauugguaaugagaauuaccuagauuauaugacaagcaugaaaagguucaagaacgaaucagauccugaaggugcgcuaugguaa

SEQ ID NO: 21906 - RNA, 9879 nt, Artificial Sequence
  derived and/or modified CDS sequence (opt6) from DENV-1__EU482801__SS-prME
uccguaacuaugcuacucauguuaaugccgacugccuuagccuuucauuuaacuacaagaggaggugaaccacauaugauagucaguaaacaagaaagagguaaaucacuccuuuuuaaaacaagugcuggaguuaauaugugcacuuugauagcuauggauuuaggagaacuaugcgaagauacaaugacauauaaaugcccacgaauaacagaaacggaaccugaugacguggacuguugguguaaugcgacugauacaugggugacguacgggacauguagucaaacaggagaacaccgacgugacaaaagaucagucgcuuuggcaccccaugugggccuaggacuugaaacgcgcacggaaacauggaugaguucagaaggcgcauggaaacaaauccaaagggucgaaacuugggcacugaggcacccagguuuuaccguuaucgcucucuuccuagcccaugccauaggaacauccauuacacagaaagggauaauuuuuauacuauuaauguugguuacuccaagcauggcgaugcgcuguguaggaaucgguucgcgagauuuuguugaaggguuaaguggagcaaccuggguagaugucguuuuagaacauggcucaugugugacaacaauggcaaaggauaagccgacucuugacauugaauugcugaaaacggaagucacaaacccagcaguacuucgaaaacuauguaucgaagcaaaaauuucgaacacaaccacagauaguagguguccgacacaaggugaagcgacgcuagucgaagaacaggaugcgaauuucguauguagaagaacauuugucgaucgagguugggguaaugguugcggauuauucggcaagggcucauuaauaacuugugcaaaauuuaaguguguuacaaaauuagaaggaaagauuguucaauaugaaaaucuuaaguacucuguaauagucaccguucauacaggugaucaacaccaagucggcaaugaauccacagaacauggcacgacagcuacaauuacgccccaagcaccgacaacugagauucaacuaacggacuacggcgcacuaacacuagacugcagcccccguaccggauuagacuuuaacgagaugguacuccuaaccaugaaagaaaagucgugguuaguacauaagcaaugguuucuugacuugccgcuucccuggacgaguggggccagcacaucucaagaaacuuggaacaggcaggacuuauuggugacuuucaaaacagcccacgcuaaaaagcaagaaguaguugugcuaggcucucaagaaggagccaugcauacagcccuuacaggagcaacagaaauacagacaaguggaacgacuacaauauucgcuggccaccuaaaauguaggcuaaaaauggacaagcucacacuuaaaggaaugucguaugugauguguacaggaucguucaaacuggaaaaagaaguugcugaaacacaacaugggacagucuugguacagauaaaauaugagggcaccgacgcuccauguaaaauaccuuucaguacacaagacgaaaaagguguaacucaaaacggcaggcuaaucacugcuaauccuauaguaacugacaaagaaaaacccgucaauauagaagcagaaccaccauuuggagagucuuauaucguaaucggcgccggagaaaaagcucugaaauugagcugguuuaagaaagguucuucuauagguaaaauguucgaagcuacugcucgaggggcgagacgaauggccauccuaggagauacagcaugggacuuuggaucaauagggggcguuuuuaccucuguaggaaaauuaguccaccaaauauuuggaacugcuuacggaguacuguuuucgggcgucucuuggacaaugaaaauuggcauuggaguacugcuaacuugguugggacuaaauucaagaaguacauccuugagcaugacguguauagcagucggauuggugacccuuuaucuuggcguuaugguucaagcagacagcggcuguguuaucaacuggaaaggaagagaacuuaaaugcggaucaggaauuuuugugacuaaugagguacacacauggacagaacaauauaaguuucaggcggauuccccaaaaagacugagugccgccauagguaaagccugggaagagggaguguguggaauaaggucagcaacccguuuagaaaacauaauguggaagcagaucucaaacgaguugaaucacauauuacuugagaaugacaugaaauuuacagucguuguuggagacgucgccgggauucuagcacagggaaagaaaaugauaagaccgcaacccauggaauauaaauauucuuggaaaucaugggguaaagcaaaaauaauaggugcugauguacaaaauacuacguuuauaauagacggaccgaauacuccagaaugccccgaugaccagcgagcauggaacaucugggagguagaagauuacggauucgguauuuuuacuacuaacauuugguugaaauugagagauagcuauacgcagguaugcgaucacagguuaaugagcgcggcaauaaaggauucaaaagcuguacacgcugacaugggcuauuggaucgaaucagagaaaaacgagacauggaaacuugcccgugccucauuuauugaagucaagacuugcauuuggccgaaaucccauacauuaugguccaacgguguucuagaaucagaaaugaucauacccaaaaucuauggaggccccauaucgcagcacaauuauagaccaggauauuuuacacaaacugcaggcccauggcauuugggaaaauuagagcucgauuuugauuuaugugaaggcacgacggucguaguagacgaacacugcggcaaccgagggcccucucuaagaacgaccaccgugacaggaaaaauuauucacgaaugguguugcagaagcugcacucuuccuccccuacguuuccgaggagaagacggguguugguauggaauggaaauuaggccagucaaggagaaggaagaaaaucuaguaaaaucgauggucucagcaggaucaggugaaguugauaguuucucuuuaggcuuacucugcauaucgauuaugauagaagaagucaugaggucaagauggucgagaaaaauguuaaugacugguacacuggcugucuucuuuuuauuaauaaugggucaauuaaccuggaaugaucuaauucgccucuguauuauggucggcgccaacgccagugaccguauggggaugggaacaacguaucuagcccucauggcaacguuuaaaaugaggccaauguuugcaguaggguuauuguuccgacgacucaccaguagagaaguucuacuuuugacgauuggauuaucguugguagccaguguagaguuaccuaauucuuuggaagaguuaggugaugggcuagcuaugggcaucaugauauuaaagcuccucacagauuuucagagccaucaacugugggccaccuuauuaucacuaacguuuauuaaaaccacauuuucauuacacuacgcguggaaaacaauggcaaugguacuaaguauagucuccuuauucccgcuguguuuaagcacuacaucacaaaagacgacguggcucccaguucuauuaggaucucuuggcugcaaaccucugacaauguuucuaauagcagaaaacaagauauggggcagacgaucuuggccucuuaacgaaggaauaauggccguuggaauuguuucaauccuccuuucaagucuucuaaagaaugauguaccauuggcggguccccuaauagcuggagggaugcugauugcauguuacgucauauccgguucuucggcagaccuaaguuuagaaaaagcagcagaggugucuugggaagaggaagcagaacauaguggugcaagucacaauauacugguagagguacaagaugauggaacaaugaagauaaaagacgaggaacgagacgauacguuaacaauacuucugaaggccaccuuguuagcugugucgggaguuuauccuuuaucuauaccagcuacauuguucguuugguacuuuuggcagaagaagaaacaaagaagcggaguacuuugggacacaccuucucccccugaaguaggaagggcaguuuuagaugauggaaucuauaggauaaugcagagaggccucuuaggacgaucgcaaguaggaguaggaguauuccaagaaaauguuuuccauacgauguggcacguaacacggggagccguacuuauguaucaagguaaaagauuagaacccucgugggccaguguuaagaaagaucucauaucuuacggugguggauggaggcuacaagggucguggaacacgggagaagaaguucagguaauagcaguggaaccugggaaaaauccuaaaaacguucaaacagcaccaggaacuuuuaaaaccccagaaggagaaguaggcgcaauugcucuugauuuuaaaccuggaacaucgggauccccuaucguaaaucgagaaggcaaaauugugggauuauauggcaauggggucguuacuacaucuggcacuuauguaagcgcaauagcucaggcuaaggcuucucaggaagguccucuaccugaaauagaagacgaagucuuucgaaagcgaaauuuaacuauuauggaccuacacccaggaagcgggaagaccagaagauaucuccccgcaauaguaagagaagcuauaaaaagaaaacucagaacguugauacuugcuccaacccgagugguugcaucggaaauggcugaagcacuaaaaggcaugcccauacgguaccaaaccacggcaguaaagagugaacauacuggaaaagagauuguggaccuuaugugucacgccacauuuacaaugcgccuuuuaucgccgguaagaguaccaaacuacaauaugauaauuauggaugaagcacauuucaccgauccuucuagcauugcugcgcgaggauauauuucgacuagaguagggaugggagaggcagcagccauuuuuaugacggcaacaccuccagggucuguggaagcauuuccacaaucaaacgcuguuauacaagacgaagaacgagauauaccagaaagaucuuggaacucugguuacgaguggauuacggauuucccuggaaagacuguaugguucguacccucaauaaagucaggcaaugacaucgcgaauugucuacgcaaaaaugggaaacgugucauucagcuaucaagaaagacauuugauacggaauaucagaaaacgaaaaacaaugacugggauuauguagucacaaccgacauuucagaaaugggagcuaacuuucgggcugaucgggugaucgacccgagacguugucuuaaaccgguuauucuaaaggaugggccagaacgcguuaucuuggccgguccgaugccaguaaccguggccagcgcagcacaaagacgcggaaggauugguaggaaucauaauaaagaaggagaucaguacauauauauggggcaaccccuuaacaacgaugaagaucaugcgcauuggacagaagcuaaaauguuacuugacaauauuaauaccccagaaggaauaaucccugcccuguuugagccagaacgggaaaaaucagcagcgauugacggugaguaucgacuuagaggagaagcuagaaaaacauuuguagagcuuaugcgucgcggugaucuaccaguguggcuaucuuacaaaguagcaucagaggguuuucaauauucugacaggcgcuggugcuucgauggugaacgaaacaaucaggugcuugaagaaaauauggauguugaaaucuggacuaaagaaggagaaagaaagaaacugaggccgagauggcuugaugcacgaacauacagcgaucccuuagcccuucgagaguucaaagaauuugcggcugggaggcggucgguaucaggagauuuaauacuagaaauaggcaaauuaccacaacauuuaacucaaagggcacagaaugcacuggacaaucuagucauguugcacaacagcgaacaggguggcagagcauauagacaugccauggaagaauuaccagacaccaucgagacacucaugcuccuagcccucauagcaguacuaacaggcggggucacacuauuuuucuuauccggacggggacuaggcaaaaccucuauuggucuauuaugcgucauggcuaguucgguacuauuauggauggcaagcguggaaccucauuggauagccgcuaguauaauuuuagaguucuuuuuaaugguauugcuaaucccggaaccggaucgacaaagaacaccucaggauaaccaacuagcuuauguugugauaggacuccuauuuaugauccuuacaguagcggcuaaugaaaugggcuuauuggagacgacuaagaaagaucugggaauuggccacguagcuguggaaaaccaucaucacgcggcaauguuagauguggaucuacauccggcuagcgccuggacucuuuaugcaguagcuacuacuauuauuaccccaaugaugagacacacaauugaaaacacaaccgcuaauauaucacugacggcuauagcaaaccaagcugcaauauuaaugggacuggacaagggcuggccgaucucaaaaauggauaucgggguaccauuguuagcauuagggugcuacucacaaguuaauccucuaacucuaacagcugcaguauuaaugcuuguagcacauuaugcaaucauagggccaggacuacaggccaaagccacaagagaagcgcagaaacgaaccgccgcggguauuaugaagaacccaaccguugacggaaucgucgcgaucgacuuagacccugucgucuaugacgcaaaguucgaaaaacaauuaggccaaauaaugcucuuaauacucugcacuucccaaauacuacucaugagaaccacaugggccuuaugugaaaguauuaccuuggcaaccggaccacucacaacauuaugggaaggcucacccggaaaguucuggaacacaaccauagcaguuagcauggcaaauauauuucgaggaagcuaucuugcuggugccggguuagccuuuagucuaaugaaaaguuuagguggcggaagacggggaacaggagcucagggagagaccuuaggcgaaaaauggaagaggcaguuaaaucaguuaucuaaaagugaguuuaacacuuacaagagaagugguauaauggaggucgauagaagcgaagcaaaagaaggauuaaagagaggagaaacuaccaaacaugcaguuucaagaggaacugcaaaauuaagaugguuugucgaaagaaaccuaguaaaaccagaaggaaaagugaucgauuugggauguggcaggggcggguggucuuacuacugugcuggacucaagaaaguuacagagguaaaaggauauacaaaagguggacccggccaugaagaaccuauaccaauggccacauacggauggaauuugguaaaacuccauagcggaaaagauguauucuuuauuccaccugagaagugugacacacuguuaugcgacauaggagagaguaguccaaaucccacaauagaagaaggacguacauugcggguucuuaagaugguugaaccaugguuaagggggaaccaguuuugcauaaaaauacuuaaccccuauaugccaucaguuguagaaacauuagaacagaugcagagaaagcauggcggaaugcuuguacguaacccucucaguagaaauucaacccaugaaauguauugggucuccugugguacuggaaauaucguuagcgccgugaauaugacaucaagaauguuauuaaacagauuuacaauggcacacagaaaaccaacuuacgaaagagauguagaccuuggagcugggacacggcacguagcaguugaaccugagguugccaauuuagacauaauaggucaaagaauagaaaacaucaaacaugaacauaaaucuacguggcauuaugaugaagacaauccauauaaaaccugggccuaucaugguuccuacgaaguuaaacccaguggaucagccagcaguaugguuaauggaguuguaaaacuacuaacaaaaccaugggacguaauaccaaugguaacgcagaucgcaaugacagauaccacaccguuuggacaacaacggguauuuaaggaaaaaguugauacgaggaccccaaaagcaaaaaggggaacugcacagaucauggaagucacagcaaaaugguuguggggauucuuaucacgcaacaagaaacccaggauauguacucgagaagaguucacaagaaaaguucgcucuaaugccgcgauaggggcuguuuucguagaugagaaucaguggaacucagccaaagaagcaguagaagaugaaagauucugggauuuaguacaccgcgaacgcgaguuacacaagcaaggaaagugcgcuacuugcgucuacaauaugaugggaaaacgagaaaagaaacuaggagaguucggcaaagcaaaaggcagucgugcaaucugguacauguggcuaggagcacgcuuucuagaguuugaagcguuaggcuucaugaacgaagaucauugguuuaguagggagaacucacuaucaggaguagagggcgaaggucuccauaaauuaggauauauccuaagagauauaaguaacauuccugguggcaauauguaugcagaugauacggcagguugggacacgcgaauaacugaagacgacuuacaaaaugaagcacguauaacggacauaauggagccagagcaugcauuacuagcuaagaguauauuuaaauugacuuaucagaacaagguuguaagagugcaaaggcccgccaagaaugggaccguuauggacguaauuucaaggcgagaccagagaggcaguggucaggucgguacauacggccuaaacaccuuuacaaauauggaagcgcaacuuauaagacagauggaaagugaaggaauauucucucccucugaauuggagacaccgaaucuagcggaacguguucuagacugguuggaaaaauacggaguugagcgucucaaaagaauggcgauaucaggugacgacugugugguuaagccaaucgaugacagauuugcaacggcacucaccgcacuaaacgacauggguaagguaagaaaagacauaccccagugggaaccgucaaaaggcuggaaugacuggcaacaagugccguucuguagccaucauuuccaucaauuaauaaugaaagacgguagggagaucgucguacccuguagaaaucaagaugagcuaguaggacgagcacgaguuagucaaggcgcuggauggagucucagggagacagcauguuuagguaaaaguuacgcacaaauguggcaauuaauguauuuucaucgaagagauuugcgauuagcagcaaacgcgauuugcuccgcggucccuguggacuggauuccaaccucaaggacaacauggucgauacaugcgcaucaccaauggaugacaacagaggacaugcuuagcguauggaacaggguuuggauugaagaaaauccuuggauggaagauaaaacacacauaagcucauggggagaugugcccuacuuaggaaaaagagaagaucaauggugugguucacuaauaggccuaaccgcacgagcaacaugggcuacaaauauacagguggcgauaaaucagguacguagauuaauagguaaugaaaauuaucuagacuauaugacaagcaugaaaagauucaagaaugaaagugacccagaaggugcacucugguag

SEQ ID NO: 21907 - RNA, 9879 nt, Artificial Sequence
  derived and/or modified CDS sequence (opt6) from DENV-1__EU482802__SS-prME
uccguaaccaugcuucuuaugcuuaugcccacagcacuagcauuucaccucacaacccgaggaggggaaccccacaugauaguaucaaaacaagaaaggggcaaaucucuguuguuuaaaacgucagcuggcgucaacauguguacguuaauugcuauggacuuaggagaauuuugcgaagauacaaugacuuauaaaugcccaaggauaacagaagcggaaccagaugauguugacuguuggugcaaugcgacggauaccuggguuacauauggaacauguagccaaacuggcgaacaccgacgagacaaaaggucuguugcucuugcaccgcauguaggauuaggucuagaaacgcggacugaaacguggaugucuucagaaggagcauggaaacaaauccaaaggguggaaacuugggcuuugaggcaucccggauuuacugucaucgcuuuauuccuugcucaugcaaucgguacgucgaucacccaaaaaggcauuauuuuuauccugcuuaugcugguaacuccuagcauggcuaugcggugugucgguauuggcucgagagacuuuguagaaggauuaaguggugcaacauggguugaugucgucuuagaacacgggaguugcgugacuacuauggcaaaagacaaaccgacuuuggacauagaauuauugaaaacagaaguuacaaauccagccguucuucguaaauuaugcauagaggcaaaaauaaguaacacaaccacggacuccaggugucccacacaaggugaagcaacgcuugucgaagaacaagacgcaaauuuuguuugccgcagaacauuuguugauagaggauggggaaaugguugcgguuuauucggcaaagguucucuaauaacuugugcaaaauuuaaaugugucacuaaguuagagggaaaaaccguccaauaugagaaccuaaaauauaguguaauuguaacuguacauacuggugaccagcaucaaguagggaacgaaucaacugaacaugguaccacagcaacgauaacaccgcaagcgccuaguaccgagauucaguugacugauuacggggcucuuacccuagauuguucaccacgaacgggacucgauuucaaugagaugguucuacugacaaugaaagagaaaaguugguuaguacacaagcaaugguuccuugauuuaccccuaccguggacuucuggugcuaguacaucacaagaaacuuggaauaggaaggaucuucucguaaccuuuaagacugcacacgccaagaaacaagaaguaguaguauuaggcucucaggaaggcgcuaugcacacugcgcugaccggagcaaccgaaauacaaacgaguggaaccacaacaauauuugcuggacacuugaaaugcaggcuuaaaauggauaaauuaacauugaagggcaugucguauguaaugugcacuggcagcuucaaguuagagaaagaaguugcagaaacacaacauggaacuguauugguccaaauaaaauacgagggcacugaugcaccauguaaaauuccuuuuagcacucaagaugaaaaaggcgugacucaaaacgggagauuaauaaccgcuaacccuauagucacagauaaagagaaaccggugaacaucgaagccgaaccuccauuuggugagagcuacauagucaucggagccggagaaaaggcacuuaaauuauccugguuuaagaaaggcucaucgaucggaaagauguuugaggcuaccgccagaggcgcgagaaggauggcuauucuaggagauacugcaugggauuucggaaguauuggaggcguauucacuucgguaggcaaauugguacaccaaauuuucggcacagcauacggaguuuuauucucugguguguccuggacgaugaaaauugguauuggaguccuacuaacauggcucggacugaauagccguucgacuagccuuucaaugaccuguauagcagugggauugguuacuuuauaucuaggaguaaugguucaagccgacucaggaugugugauaaacuggaagggaagagaauugaaauguggcaguggaauauuugugacaaaugaaguacauacauggacagagcaauauaaauuucaggccgauucuccaaaacggcuaucagcagccauaggcaaggcgugggaagaaggcguuuguggcauccgaucugcgaccagacuugaaaauaucauguggaaacaaauuucuaacgaacuuaaucacauucuauuggaaaacgauaugaaauuuacuguaguagucggagauguugcagggauucuugcgcaggguaagaaaaugauacguccccagccaauggaauauaaauacucauggaaaucguggggcaaagcgaaaauaauaggagccgauguacaaaacaccacauucauaauugacgggccaaacacaccggagugcccagaugaucaaagagcauggaauaucugggaagucgaagacuacgguuuugggauuuucacuaccaauaucugguugaaacugcgcgacaguuauacacaagugugugaucacagacuaaugagcgcugccauaaaggauuccaaagcaguacacgcagacaugggauauuggauagaaucggagaaaaaugaaaccuggaaauuggcaagagcuagcuucauagaaguaaagaccugcauuuggccgaaaucacacacacuauggucuaacggcgucuuagaaucagagaugauaauccccaagaucuaugggggaccgauaagccaacacaauuauagaccagguuacuuuacucaaacagcagggccauggcaucuuggaaaauuagaacuagauuucgaccugugugaaggaacaacaguagucguugaugaacauugcgggaauaggggucccagucuaaggaccacuacagugaccggaaagauaauacacgagugguguugcagaucuugcacauuaccuccacuaagauucaaaggagaggacggcugcugguauggcauggaaauaaggccaguaaaagaaaaagaagaaaauuuaguaaaaucaaugguuuccgcuggaagcggagagguagacuccuuuucucucggacuuuuauguauaaguauaaugauugaggagguuaugcgcucccgauggagccgcaagaugcuuaugacaggcacucucgcaguuuucuuccuacucauuaugggccagcucacauggaaugaucuaauuagauuguguauuaugguaggugcgaacgcuucagauagaaugggaauggguacuacauaucuagcacuuauggcaacauuuaagaugcgacccauguuugcaguugguuuacuauuuagaagacucacaagucgggagguuuuacuuuuaacuauagguuugagccuaguagcaucuguugaauugccuaacagucuggaagaacucggagacggacuugcuaugggaauuaugauauuaaaguugcuaaccgauuuucaaagccaucaacucugggcaacacuauuaucacuaacguuuauuaaaacaacauucagucuacauuaugcuuggaagaccauggcgaugguuuuaucaauaguaucacugcuuccucugugcuuaaguacaacuucacagaaaacuaccuggcuaccuguauuauuaggaucucuaggaugcaagcccuuaaccauguuucuaauagcugaaaauaaaauauggggacguaaaaguuggccucuuaaugaagguauaauggccguaggcauaguuucaauauugcuauccucucuuuuaaagaaugacgugcccuuggcagggccucuuauugcuggcgguaugcuaauagcaugcuacgucauaagugguaguagcgcagauuugucccuagaaaaagcggcagaaguaucuugggaagaagaagcggaacauucgggugcuagucacaauaucuugguggaaguacaagaugacggaaccaugaaaauuaaggaugaagaaagggacgauacucuaacaauccugcuuaaagcaacuuuauuggcggugagcggaguauacccauugucaauaccggcaacuuuauuuguuugguauuuuuggcaaaagaagaaacaaagaucagguguauuaugggauacaccgaguccgccugagguagaacgcgccguuuuagaugaugguauauacagaaucaugcaaagaggucuucuagggcgcucgcaagugggaguagguguuuuucaagaaaaugucuuccauacuauguggcacgucacgagaggcgcaguacuuauguaucagggaaagcguuuagaaccaucuugggcgagugugaaaaaggaccuuaucagcuauggugguggauggagacuccagggauccuggaauaccggugaagaaguacaaguaaucgcuguggaaccgggaaagaauccuaaaaauguacaaacagcgccugguacguucaagacgucagaaggcgaagucggagcuauagcgcuugacuucaaaccuggaacgucugggucuccaauugugaaucgcgaagguaaaauagugggacuuuauggcaauggcguaguaacgacaagugggacauacguuucagcgauugcacaggcuaaagcaucccaggaaggaccgcuucccgagaucgaagacgaagucuuucgcaaaagaaaucuaacgauuauggaucuucacccaggcaguggcaagacaaggagguaucugccugcaauuguuagagaagcaauaaaacgaaaacuaagaaccuuaauucuagcccccaccaggguaguugcaucagaaauggcagaagcacucaaaggcaugccgaucagauaucaaacgacggcagucaaauccgaacauacagguaaagagauuguagauuuaaugugucaugcaacuuucacuaugagauuauugagcccaguuagggugccaaacuacaauaugauuauuauggaugaggcacauuucacagauccaucaucaauugccgcccgugguuacauaucuacaagggucgguaugggcgaggccgcagcgaucuuuaugacagcaacgccaccuggaaguguagaagcauuuccacaaucaaaugcaguaauccaagaugaagaacgggauauuccugaacgaucauggaauaguggcuaugaauggauuacagauuucccuggaaagacugugugguuuguaccauccaucaagucaggaaaugacauugcuaauugucugcgcaaaaacggaaagagaguaauacagcugucgcggcgaacauucgacacugaauaucagaagaccaaaaauaacgacugggacuauguugucacuacagacaucucugaaaugggugcgaauuuccgagcagauagagucauugacccuagaagauguuugaaaccuguaauacuaaaagaugggccugaacggguaauauuggccggaccgaugccagugacaguagcuucugcagcacaacggagagguaggauaggccguaaccacaauaaagaaggggaccaauauauuuacaugggacaacccuuaaauaacgacgaagaccaugcucacuggaccgaagcaaaaauguugcucgauaacauaaauacacccgaaggcauaauaccagccuuauucgaacccgaaagagaaaaguccgcagcgauagauggagaguauagguuaaggggagaagcacguaaaacauucguagaauugaugagaagaggagaucugcccguaugguugucauauaaaguugccucugaagguuuucaauauagugaccgcagauggugcuuugacggagaaagaaauaaucaaguccucgaagaaaauauggauguagaaauauggacaaaggaaggagaaaggaagaaacuccggccgcguuggcuggacgcaagaacauacucugauccacucgcucuacgugaguucaaagaauuugcugcaggucgcagaagugucaguggggaucugauauuagaaauaggaaaguuaccgcaacaucuaacccaaagggcucaaaaugcauuagauaauuuagucauguuacauaacagcgaacagggcgguagagcauauaggcacgcaauggaagaauuaccagauaccauagagacccucauguuacuggcacugauagcuguuuuaacaggagggguaacacuauuuuucuugucuggcaggggucuuggaaaaacguccauaggccuacuuugcguaauggccucaucugccuuacuauggauggcgucaguagaaccacacuggaucgcggcgaguaucauucucgaguucuuuuuaaugguucuccucauuccagaaccggaucgccaacgaacuccccaagauaaucaauuagcauacguuguuauaggucuuuuguuuaugauucugacagucgcagcaaaugaaaugggauuauuagaaacuacgaagaaggacuuagguauaggccauguagcaguugaaaaucaucaccaugcugcaaugcuugauguugaccugcauccggcguccgccuggacgcuauaugccguagcuacgacaauaauaacuccgaugaugcgucauacaaucgaaaauacuacugcuaacaucucauuaacagccaucgcgaaccaagcggcaauauuaaugggcuuagauaaaggguggccaaucucaaaaauggauauagguguuccacuccuagcuuugggaugcuauucacaaguuaacccauugaccuugacagcggcaguguugaugcugguugcccacuacgccauuauugguccaggguuacaggccaaggccacaagagaagcgcagaaaaggacagcugccggaauaaugaaaaacccaacgguagacggcaucgucgcaauugaucuggaucccguaguuuaugacgcaaaguuugagaaacaacuuggccaaauaauguuguuaauucugugcacaucacaaauucuauuaaugcguacuacaugggcacuuugcgaaagcauuacucuagcaacuggaccauuaacuacacugugggaagguucaccaggcaaguuuuggaauaccacuauagcgguaagcauggcaaacaucuuuagagggucuuaucuagcaggagcaggauuagcauuuaguuuaaugaaaucguuagguggcggucgcagaggaacgggagcucaaggagaaacucuaggugaaaaauggaagcggcaauuaaaucaacucucuaaaucagaguucaauacguacaaacgaucagguauaauggaaguggacaggucagaagcuaaagaaggucugaaacguggugagacaacgaagcaugcaguuucuagagggacugccaaacugagaugguucguagaacguaauuuaguaaagccugaaggaaaaguuaucgauuuaggcuguggaagaggggguuggucauauuacugugcagggcucaagaaaguuacagaagugaaaggauacacaaaaggaggaccgggacaugaagaaccuauuccaauggcaacauacgguuggaacuugguaaaacuacauucgggaaaagauguguuuuucaucccgccagaaaaaugcgacacauuauugugcgauauuggggagucaucaccaaacccgacaauagaagagggacgcacguugcgagucuuaaagaugguagagccuugguuaagggggaaccaauucuguauaaaaaucuuaaacccauacaugccauccguaguugaaacacucgagcagaugcaacgcaaacauggagggaugcuaguucguaacccauugucgagaaauucuacacaugaaauguauuggguaaguuguggaaccggaaauaucgucucugcaguuaauaugaccucacgaauguuacuuaaucgcuucacgauggcacacagaaaaccaacguaugagagagauguagacuugggugcaggaacuagacacguagcuguagaacccgaagucgcuaaucuagauauaauugggcaaagaauagaaaacauaaaacacgaacauaaaucuacguggcauuaugaugaggauaauccauauaaaacuugggcauaccaugggagcuaugaaguaaaaccaagugggucagcaucaucuaugguaaacggaguaguuaaauuacuaacuaagccgugggacguuaucccuaugguaacccaaauagcaaugacugauaccacaccguucgggcaacaacgaguauucaaggagaaaguugauacgcgcacgccuaagagcaaaagaggaacugcccagauuauggaaguaacugcaaaaugguuauggggauucuugucuagaaacaagaaacccagaauuugcacucgagaagaguuuacccggaaaguaagaucgaaugcugcuauuggugccguauuuguagaugaaaaucaauggaacuccgcaaaagaagccguagaggacgagagauuuugggauuuaguacaccgagaaagagaguuacauaaacaggguaaaugugcaacaugcguauacaacaugauggggaaaagggagaagaaacuuggugaauuuggaaaagccaaaggaucgagagcuaucugguauauguggcuaggugcgcgcuuucuugaguuugaagcgcuaggcuucaugaacgaagaucauugguucucccgcgaaaauucucucucaggggucgaaggggaagggcugcacaaacuaggauauauccuaagggauauaaguaaaaucccgggaggaaauauguacgcugaugacacugcaggaugggauaccagaauaacugaagacgaccuacaaaacgaagccaaaauuacagacauaauggagccagaacaugcccuacucgcaaaaaguauuuuuaaauuaaccuaucaaaauaaaguaguacguguacagcggcccgcgaaaaacggaacuguuauggauguuauuagcagacgugaucagcgugguucggggcaaguuggaacauacggauuaaacacauuuacgaacauggaggcgcagcuaauacggcaaauggaaagugaaggaaucuucuccccaagcgagcuagaaaccccaaacuuggccgguaggguacuagauugguuagaaaaacaugggguagagagauugaaaaggauggcuauaaguggagacgauuguguaguuaagccuauugacgacagauuugcaacagcauuaacagcguugaacgacaugggaaagguaagaaaggacaucccccaaugggaaccgucaaagggcuggaaugauuggcaacaaguacccuuuuguagucaccacuuccaccagcuuaucaugaaagaugguagagagaucgucguacccugucguaaccaagacgaauuaguugggcgcgcacgagucucccaaggagcuggcuggaguuugagggagacagcgugucuaggaaaaucauaugcacaaauguggcagcuaauguauuuucaucgaagggaccucagauuagcugcaaacgcgauuuguagcgcuguaccaguggacuggguuccaacgaguagaacuacauggagcauccaugcacaccaccaauggaugacaacggaagauaugcuuaguguauggaaccgcguauggauagaagaaaauccguggauggaagauaaaacucacaucagcagcuggggugauguaccauaccuaggcaaacgagaagaucaaugguguggcagcuugauaggauuaacggcucgggcgacaugggcuacaaauauccaaguugccauaaaccaagucagaagacuaauaggaaaugagaauuaccuagauuauaugacuucaaugaagcgcuuuaagaaugaaucagauccagaaggagcuuuaugguaa

SEQ ID NO: 21908 - RNA, 9879 nt, Artificial Sequence
  derived and/or modified CDS sequence (opt6) from DENV-1__EU482804__SS-prME
uccgugacuauguuacugaugcuaaugccuacagcauuggccuuucaucuaacgacaaggggaggugaaccgcauaugaucgucucaaaacaagaaagggguaaaucauugcuauuuaaaaccucagcuggugucaacaugugcacacuaauagcaauggacuuaggagaauuuugugaagauacaaugaccuauaaaugcccaaggauaacggaagcugaaccagacgacguagacuguugguguaacgcuacagacacauggguaacauacggcacauguucucaaaccggugaacaccggcgcgauaaacguagugucgcauuggcaccacacguuggcuugggauuagaaacccgcacagaaacuuggaugucaucagaaggcgccuggaaacaaauccaacgaguugaaacuugggcacuaaggcacccgggauucacagucaucgcccuauuucuagcccacgcaauaggaacauccaucacgcaaaaagguauuauauuuauacuacuaauguugguaacgccuagcauggcaaugagaugcguugguauaggaucucgagacuucguugaaggccugaguggagcuacuuggguagauguuguucuggaacauggaaguuguguaaccacuauggcuaaagauaaaccgacacucgacaucgaacuacuaaaaacagaaguuacgaauccagcaguccucagaaaauuguguauugaagcuaaaauuaguaacaccacgacagauucuaggugcccuacccaaggagaagcaacauuaguagaagaacaagacgcaaacuuuguuuguagaaggacauucguugauaggggaugggguaaugguugcgggcuguucggaaaaggaucuuuaauaacaugugcuaaauucaaauguguuacaaaauuagaagguaaaguaguacaauaugaaaacuuaaaauauucagugaucgucaccguacacacaggggaucaacaccaaguugguaaugaaucgaccgagcauggaacaacagcaacuaucacaccacaagcaccaucaacagaaauucaacuuacagacuacggagcucuuacacuggauuguucaccucgaacuggacuugauuuuaacgaaaugguuuuacugaccaugaaagaaaaaucguggcuagugcacaaacaaugguucuuagacuugccauuaccuuggaccuccggcgcaucaaccagccaagaaacauggaaucgcaaagaucuauuaguuacuuucaaaacugcacaugcuaaaaagcaagaaguagugguucugggcucacaagaaggagccaugcacacagcgcuaacuggcgccacagagauucaaacgucgggaacaacuaccauuuucgccggacaucuaaaauguagacuaaaaauggauaaauuaacccuuaaagguaugucuuaugucauguguacuggaaguuuuaagcucgaaaaagaaguagcagagacccaacacgggacuguacucguccaaauaaaauaugaagguacugacgccccguguaagauuccuuucucaacccaagaugaaaaagguguaacgcaaaaugggagauugauuaccgcgaacccaauuguuacggauaaagagaaaccuguaaacaucgaagcugaacccccuuucggagaaaguuauaucguaauuggcgcaggagaaaaagccuugaaauugucaugguucaagaaaggaucaucaauuggcaagauguucgaagcaaccgcccguggugcgcgccgaauggcaauacugggcgauacggccugggacuucggcucaauagguggcguuuuuacgagugucgguaaguuaguacaucaaauuuuugggacggcauauggaguauuguuuagcggcguauccuggacaaugaaaauagguauagguguacuacugaccugguuaggauuaaauagcagaagcacaucucuaucuaugacauguauagcggucggcuugguaaccuuauauuuaggaguuaugguacaagcugauucagggugcguuauaaacuggaaaggcagagaacuuaaauguggcucuggaauuuuuguuacuaacgaaguucauaccuggaccgaacaguauaaauuccaggcugacucaccaaagcgauuaucagcggcuauaggcaaagcgugggaggaaggaguguguggcauucgcucaaccacgagacuugaaaauauaauguggaaacaaauuaguaacgaacuuaaccacauccuccuggagaacgauaugaaguuuaccguaguuguaggagauguugcaggaauacuagcacaagguaagaaaaugauucggccucaaccuauggaauauaaauauucauggaagucuuggggaaaggcuaaaauuaucggcgcagauguccagaauacgacguuuauaauagacggaccgaauacaccugaaugccccgaugaucaacgagccuggaauauaugggagguugaggauuacggauuuggaauuuucacaacaaauauauggcugaaauugagagauucauacacacagguaugugaucauagguugaugucggcugcgauuaaggauucuaaagcaguucacgcggauaugggauauuggauagaaagugagaaaaaugagacuuggaaacuagcaagggcuucauucaucgaaguuaaaacgugcauuuggccaaagucacacacccuauggagcaacggugugcuagaaucggaaaugaucauaccuaagaucuacggaggaccgaucucgcagcauaauuauagaccaggcuacuuuacacagacugcagggccauggcaccuuggaaaauuagagcuagacuuugacuugugugaaggcacaacuguuguaguugaugaacauuguggcaaccgggggccgagcuuacguacaacuacuguuacaggaaaaauaauacacgaaugguguugccgaagcugcacauuacccccgcucagauucaaaggagaagacgguuguugguaugguauggaaauccgccccguuaaagaaaaagaagagaaccucgugaaaucgaugguaucagcgggcucuggagaaguagacaguuucaguuuaggcuuauuauguauaaguaucaugaucgaggaaguaaugaggagucgauggucccgcaaaauguuaaugacugguacucucgcagucuucuuucuauuaauaaccggacaauugacauggaacgaccuaauacgauuaugcauaauggugggagcaaacgcaucagaucggaugggcauggguacgaccuaccuggcacucauggcuacguuuaaaaugcguccaauguucgcuguugguuuacuuuucagaagacucacaaguagggaaguauuauuauuaacaaucgguuugagccuagucgcaucgguugaacugccgaacucauuagaggaauugggagacggauuagcuauggguauaaugauuuuaaaacugcuuacagauuuccaaucacaccagcuaugggcuacacuuuugagucuaacauucauaaaaacaacguucucuuuacacuaugcguggaaaacuauggcaaugguuuuaaguauuguaucguuauuuccuuuaugucuaaguacaacgagccaaaagacaacauggcuccccguguuauuagggucucuaggauguaaaccucuaacaauguucuuaaucgcggagaauaaaaucugggguagaaaaaguuggccauuaaacgaagguauaauggcgguuggaauaguuucaauuuugcuuucuucccuguugaaaaacgacguaccucuggcaggucccuuaaucgcggguggcaugcuaaucgcaugcuaugucauaucaggaucaucggcagauuuaagucuagaaaaggcagcagaaguuaguugggaagaagaagcagaacauucuggcgcgagucauaacaucuuaguagaaguacaagaugacgguacuaugaaaauaaaagaugaagagagagaugacacacuaacgauccuuuuaaaagcaacauuauuagcaguaucggggguguaucccuuaaguauaccagcaacuuuauucguaugguacuuuuggcagaagaagaaacagaggagugggguauuaugggacacgccaucaccuccugagguagaaagagcaguuuuagaugaugguaucuauaggauaaugcaaagagggcuucuuggucggucucagguaggagucgggguuuuucaagaaaacguauuucauacuauguggcaugugacacgcggugcaguuuuaauguaccaagguaaaagauuagagccuucgugggccucaguuaagaaagaucucauuucguaugggggcgguuggagacuacaaggcagcuggaacaccggagaagagguacaagucauugcaguugaaccuggcaaaaauccaaagaauguacagacagcgccugggaccuucaaaaccucggaaggagaaguaggcgccauagcucuugauuuuaaaccaggaaccaguggaucaccuauuguaaaucgagaaggaaaaaucguagggcucuauggcaacggcgucguaaccacuagcggaacauauguguccgcgauagcucaagcgaaagcaucacaagaagggccccuccccgaaauugaagaugaaguuuucagaaaacgcaacuuaacaauaauggaccuccauccgggcucugggaaaacucgaagauacuuaccagcuaucgugcgagaagcgauaaaaaggaaacuuagaacccugauuuuagcccccacccgaguaguugcaucagaaauggcagaggcuuuaaaagguaugccaauuagauaccagacuacagcaguaaagucagaacauacagggaaagaaauaguggaucucaugugccacgcaacuuucaccaugcgcuuacuaucaccuguacgcguaccuaauuacaauaugauaaucauggaugaagcccacuucacugaccccaguagcauagcggcucgaggcuauauaaguacccgagucgggaugggagaagcagcagcaauuuuuaugacugcaacgccuccaggcucaguagaggcuuuuccacaaaguaaugcgguaauccaagaugaggaacgugauauaccugaaagaaguuggaacucgggauacgaauggaucacagacuuuccagggaagacugugugguucguuccuucgauaaaaucaggaaaugauauagccaacuguuuaaggaaaaacggaaaacgcguuauccaguuaagucguaaaacauuugauacagaauaucagaaaacgaaaaacaacgauugggauuacguuguaaccacagauauuagugaaaugggcgccaauuuccgugcggauagaguaauagacccucgcagauguuuaaaaccggucaucuuaaaagacggaccagaaagaguaauacuugcagguccaaugccgguuaccguugcuagugcugcucaaagacgcggacgcauugggcggaaucauaauaaagagggagaccaauauauuuacaugggucaaccucuaaacaaugaugaagaucaugcacauuggacggaggcaaaaauguuauuagauaauauaaauacaccggaaggaaucaucccagcguuauucgaaccagagcgagaaaaaucagcagcuauagauggggaguacagauuaagaggagaagcuaggaagacauuuguagagcuaaugaggagaggagauuuaccagucugguugucauacaaagucgccucagaaggguuucaguacucugaccgacgcuggugcuuugacggugaaaggaauaaucaagugcucgaagagaauauggacguagagauauggaccaaagaaggagaacguaagaaguuaaggcccaggugguuggaugcacgaacguauuccgacccucuugcuuuaagagaauuuaaggaauuugccgcagggcgcaggucuguuucgggugaucugauacuagaaauuggcaaauuaccucaacacuugacacaaagggcacagaaugcauuggauaauuuggugaugcuucauaacucagaacaagggggacgggcuuaucggcacgccauggaagaguuaccugacacaauugaaacacucauguuacuggcacucauugcuguccuuacaggcggaguaacucuuuucuucuuauccggaagaggacuaggaaaaaccucaauuggcuuacuuuguguuauggcuucaucaguacuacuuuggauggcgucgguagaaccgcauuggauugcagcaaguauaauacuagaauuuuucuugauggugcucuuaauacccgaacccgaucgacaaaggacuccacaggauaaucaacuugcuuauguuguaauaggucugcuauucaugaucuuaacaguagcggcaaacgaaaugggacuacucgagacuacgaaaaaggaccugggcauaggucaugucgcagccgaaaaucaccaccaugcagcaauguuggauguagaucuacauccagccagugcguggacgcuauacgcagucgcaacaacuauaauuacacccaugaugaggcauacuauagagaauacuacugcaaauauuucacuuaccgcuauugccaaccaggccgcuauacugaugggccuagauaagggauggccaauaaguaaaauggauauugguguuccccucuuagcacucggauguuauucacaagugaacccauuaaccuuaacugcagcgguauuaaugcuuguggcucauuaugcaauaaucggaccagggcugcaggcgaaggcaacgagagaagcucagaaaaggacggcagccggcaucaugaaaaaucccacaguggauggaauaguagcuauagaucuagauccuguagucuaugaugcuaaauucgagaaacaauuaggccagauaauguugcuaauccuuugcacaagucagauuuuacuuaugcgaaccacgugggcauuaugugaaucgaucacgcuggcaacuggcccacuaacuacacuuugggaaggaucuccuggaaaauucuggaacacgacgauagccguuuccauggccaacauauuuagagguagcuauuuagccggcgcaggccucgcuuuuaguuuaaugaaaucguuaggaggcggaagacguggaacaggcgcacagggagaaacauugggagaaaaauggaaacgucaauuaaaccaguuaucuaaaagugaauuuaacaccuacaaaaggucagguauaauggaaguugacagauccgaagcuaaagaaggacucaaaagaggagaaacgacaaaacaugcggugucgagagggacagcuaaauuacggugguucguggaacgcaaucucgugaaaccagaaggaaaaguuauagacuuagguugcgguagagguggcuggaguuauuacugugcuggccugaagaaaguaacagaagucaaaggauacacaaaaggcgguccgggccaugaggaacccauuccgauggcaacguauggcuggaaccuuguuaagcuccauagugguaaagacguauucuuuauacccccagagaaaugugauacauugcuuugcgacaucggugagucgaguccaaauccuacaauagaagaagggagaacacugagaguguuaaagaugguagaaccguggcuucgaggcaaucaauucugcaucaagauucuaaauccauauaugccuucaguuguagaaacgcuggaacaaaugcaacguaaacacggaggcauguuaguaaggaaccccuuaagcagaaauucaacucaugaaauguauuggguaaguugcggaacaggcaacauaguauccgcuguaaacaugacuucacguaugcugcuaaacagauuuacuauggcacacagaaaaccuacuuaugaaagagauguugauuuaggugcgggcacuagacauguugccgucgaaccagagguugccaaccucgacauaauaggccaacguaucgagaauauaaaacaugaacacaaaaguacguggcauuaugaugaggauaauccauacaaaaccugggccuaucauggaucauacgagguuaagccaagcggaucggccuccucaauggugaacggaguuguuaaacuauuaacaaaaccuugggauguaauaccuaugguuacgcaaauagcaaugacagauacgacaccuuuuggucagcaacgaguauuuaaagaaaaaguagacacacguaccccaaaagccaaaagaggaacagcacaaaucauggaggucaccgcuaaauggcuauggggguuuuugucccggaacaagaaaccgcggauuuguacaagagaagaguuuacgcggaaggucagaaguaacgcagcaauaggugcagucuuuguugaugaaaaccaauggaacucagccaaggaagcaguagaagaugaaagauuuugggaucucguucaucgagagcgugaguuacacaaacaagguaaaugcgcuacauguguauacaauaugauggguaaaagagagaagaaacuaggcgaauuuggaaaagcgaaggggucaagggcuaucugguauauguggcuuggcgcucgcuuccuugaguucgaagcauuagguuucaugaacgaggaucauugguuuucacgggaaaauucauuauccggaguagaaggagaaggccuucacaaacucgguuacauucuacgagacauuucaaaaaucccagguggaaauauguaugcugacgacaccgcagguugggauacacggaucacugaagacgacuugcaaaaugaagcuaaaauaacugacauaauggaaccagaacaugccuugcuagccaaaaguauauuuaaauuaacuuaucagaacaagguugucaggguucagcggccggcaaagaaugguacugugauggacguaauuucucgcagagaucaacguggcaguggccaaguagguacguauggucuaaacacuuucaccaauauggaagcacaacuuauuaggcaaauggagucggaagguauuuucaguccaucagaauuagaaacacccaaccuugcuggacgaguauuggauugguuagaaaaacauggaguagaacgauuaaaaagaauggcgaucucuggagaugauugcguuguuaaaccaaucgaugacagguucgcaacugcucucacggccuuaaacgauaugggaaaaguaagaaaagauaucccucagugggaaccuuccaaaggauggaacgacuggcaacaaguucccuucuguucacaucauuuucaucagcugauaaugaaagacgguagagaaauagucgucccuuguaggaaucaagaugaauuaguuggacgcgcgagggugagccagggagcggguuggucacuacgugaaacagcguguuuggguaaaucguaugcccaaauguggcaauuaauguauuuccauagaagggacuuaagauuagcugccaacgcaauauguucagcgguaccaguagauugggugccaacaucccgcaccacuugguccauucaugcacaucaccaauggaugacuacagaagacaugcuaucuguuuggaacaggguuuggauugaggaaaauccguggauggaggauaaaacucauauuucaucauggggugauguccccuauuuaggaaaaagggaagaccagugguguggaaguuuaauaggacuuacagcgcgugccacuugggcuacaaacauccaaguugcaauuaaccaaguacgaagauuaauagggaaugaaaacuacuuagauuacaugacuucuaugaaacgauuuaaaaaugaaucagacccagaaggagcguuaugguaa

SEQ ID NO: 21909 - RNA, 9879 nt, Artificial Sequence
  derived and/or modified CDS sequence (opt6) from DENV-1__EU482806__SS-prME
uccguaacaaugcuauuaauguuaaugccuacagcuuuggcauuucaucugacaacgagagguggugaaccacacaugauagucacaaaacaagaacguggaaaaucacuccuuuucaaaacaagcgcgggugugaacauguguacucugauagcaauggaucuaggagaacucugugaagauacgaugacuuauaaaugcccacguauaacagaagcagaaccugaugauguugauugcugguguaaugcaacagacacauggguuacauacgggacuuguagucaaacuggagagcacagaagagacaaaagauccguagcauuagcaccccauguagguuugggacucgaaacuagaacugaaaccuggaugaguagcgagggcgcauggaaacaaauacaaagaguagagaccugggcucuacgacaccccggauucacaguuauugcguuauuucuugcacacgcaauagggaccucaauaacucaaaaagguauaauauuuauacugcugaugcuugucacaccuagcauggcuaugcgaugcguggguauagggucgcgggauuuuguagaaggauugucaggagcaacguggguagauguaguacucgaacauggaucauguguuacuacaauggcuaaagauaaaccaacgcuugacaucgagcuacucaaaacagaaguaaccaauccugcaguguuacgaaaacuauguauagaagcaaaaaucagcaacaccacaacugauagccgguguccaacgcaaggugaagcaacucuaauggaagaacaagaugcuaauuucguuugcagacgcacauucguagacagaggaugggggaauggaugcggguuauucgggaaagguagccuaaucacaugcgcaaaauuuaaaugugucacgaaauuagaggggaaaauaguccaauaugaaaacuuaaaauacucaguaauaguaacgguucauacaggagaucaacaccaaguggguaaugaauccacggagcauggaacuaccgccacgaucaccccucaagcuccaacaucagagauacaacuuaccgacuauggggcacuaacauuagauuguagcccccggaccggccuagauuuuaaugaaaugguuuuauuaacgaugaaagaaaaaucgugguuagugcauaagcaaugguucuuagaccuuccacuuccauggacuuccggagcaaguacgagccaagaaacauggaauagacaagaucuauuaguuacauucaaaacagcgcaugcaaagaaacaagaagucguaguuuuggggucucaagaaggugcaaugcauacugcccuaacaggagccacugagauucagacgucaggaacaacaacaauauuugcagggcaccugaaaugccgguugaagauggacaaauuaacucuaaaagguaugagcuacguuauguguacaggauccuuuaaacuagaaaaagaaguugccgagacucagcacgggacuguguuaguucaaauaaaauacgaagguacugaugcaccauguaagauuccuuuuaguacacaagacgaaaagggaguuacccaaaauggucgccugauaacagcaaacccaauuguaacugauaaggagaaaccgguaaauauagaagcggaaccacccuuuggagaaagcuauauaguaauuggagcaggagagaaagcacugaaacuaaguugguuuaagaaagggaguagcaucgguaagauguucgaagcuacagcucggggagcucgaagaauggcuauuuugggagacacagcuugggauuucggcuccaucggugguguuuuuaccucuguaggaaaguuaguacaccaaauauucgguacggcguacgguguccuauuuaguggugucucauggacuaugaaaauaggaauagguguguuauuaacuugguuaggacuaaacucuagaaguacaucguuaaguaugacuuguauagccguaggauugguaacucuuuaccuaggagucaugguacaagcagacucaggaugugugauuaacuggaaggggagagagcuaaagugugggagugguauauuugugaccaaugaaguacacaccuggacggagcaauauaaauuucaagcagauucaccuaagcguuugagugccgccauaggaaaagccugggaagagggaguguguggcauuagaucagcaacacgacuagaaaacauuauguggaaacaaauaucaaaugagcucaaucauauacuacuagaaaaugacaugaaauucacaguaguuguuggagacguaguaggaauacucgcccaagguaaaaagaugauacgaccacaacccauggaacacaaguauaguuggaagaguuggggaaaagcuaaaauuauuggugcugacgugcaaaauacaaccuuuauuauagauggacccaauacaccagaauguccagaugaccaacgagcauggaauauuugggaaguagaagauuauggauucggaauauuuacuacuaauaucuggcugaaauuaagagauucguacacacaaguaugugaccauagauuaaugagugcggcaaucaaagacucaaaagcuguccacgccgauaugggguacuggauagagagugaaaagaacgaaacguggaaacuagcaagagcuagcuucauugaaguaaagacguguauauggccgaaaucacauacccucuggucaaacggaguacuagaaagcgagaugauaauuccuaagaucuaugggggcccgauuucgcagcauaauuauagacccggauauuucacccaaaccgcagggccauggcauuuaggaaagcuagaauuggacuuugaucuuugcgagggaacgacgguaguaguugaugagcauugugggaaucguggaccaucacuccguacuacaacuguuacugguaagauuauacaugaauggugcuguagaagcugcacuuuaccaccccuaagauucaaaggugaagaugguuguugguacggaauggaaauaagaccuguuaaagagaaagaggaaaacuuaguaaagucaaugguaagcgccggaaguggagaggucgauucauuuagccucggucuauuauguaucucaauaaugauagaggaaguaaugagaaguagguggagcagaaaaaugcuaaugacaggaacauuagcuguauuucuccuuuugaucaugggucaacuuacuuggaaugaccuaauaagauuaugcauuauggugggcgcgaaugcaucagauaggaugggaaugggaacaaccuaccuagcacuaauggcaacauuuaagaugaggcccauguuugcaguaggucugcuuuuccgacgacuaacgucucgcgaaguucuacuacucacuauagggcucucgcucgucgcgaguguugaacuaccuaauucgcuggaggaacugggggacggauuagcgaugggaaucaugauauuaaaauuauugacugauuuccaaucacaccaguuaugggcgacauugcuuucccuuacuuuuauaaagacaaccuuaucuuugcacuacgccuggaaaacaauggcgaugguucuaucaauagugucucuauucccuuuauguuuaaguacuaccucgcagaaaacaacuuggcuaccaguacuucuuggaucauuaggauguaaaccuuugacaauguuuuuaaucgcugaaaacaaaauauggggaagaaagagcuggccacuuaaugaagguauaauggcagugggaguggucaguauccuauuaaguucccucuugaaaaacgacguaccacuggcuggaccacuaauagcugggggcauguuaauugcuugcuaugugauuagcggaucuucggcagacuuaagccuggagaaagcugcagaagugucuugggaagaggaagcggaacauucaggagcaucacacaauauucuuguugaaguucaagaugauggaacaaugaaaauaaaagaugaagaaagagaugacacccuaacgauacuguuaaaggcaacacuucuugcaguaaguggcguguacccccuuucaauuccagcaacccucuucgugugguacuucuggcagaagaagaaacaacgcucagguguccuaugggacacaccuucgccacccgaaguugaacgugcugucuuagaugacgggauuuacaggaucaugcaaagaggucuccuaggaagaagucagguaggcguuggaguguuccaagagaacguauuucauacgauguggcaugucacacggggagcuguauugauguaucaaggaaagagacuagaacccucuugggcaucaguaaagaaagaccuaaucagcuauggaggugguuggagauugcaggguaguuggaacaccggagaagaaguucaggucauugcuguggaaccuggcaaaaaucccaaaaauguacagaccgcucccgggacuuuuaaaacaccggagggugaagucggugcaauugcccuagauuucaaaccagggacuagcggauccccaauagugaaucgagaaggaaaaauuguaggucuauauggaaauggaguuguaacaaccucagguacauauguauccgcgaucgcgcaagcaaaagcuagccaggaagguccuuuaccagagauagaagaugaagucuuccguaaacgaaaucuaacaauaauggacuuacauccuggaaguggaaaaacaagacgauacuuaccugcuauuguuagagaagcuauuaaaaggaaacuaagaacacuaauucuagcuccaacuagaguaguugcuucagaaauggccgaggcauuaaaagguaugcccauaagauaucaaacuacugcaguuaaaagugaacauaccggaaaagaaauuguagaccuaaugugucacgcaacauuuacgaugcgauuguuaagucccgucagaguuccgaauuacaacaugauuauaauggacgaagcucauuucacagaccccucaucaaucgcagcaaggggguacauauccacuagagucggaaugggugaagcugcugcgaucuucaugacugcuacaccaccaggaucaguagaggcuuuuccgcaauccaacgccguaauacaagacgaagaaagagacauaccagagagguccuggaacagcggguaugaauggauuacugauuuuccugguaaaacugucugguuugugccaagcaucaaaagcggcaacgauaucgcgaauugcuuaaggaaaaaugguaagcgugucauacaguuguccaggaaaacguuugauacagaauaucagaaaacgaagaacaaugauugggauuaugucgugacaacugacauuucggaaaugggugcgaauuuuagagccgauagaguaauagacccacgaagaugucuaaaacccguuauccuaaaagaugguccagaacgaguaauucuagcaggcccgaugccagucacaguugcaucagcagcacagagacgcggaagaauugguaggaaccauaauaaagaaggggaucaguacaucuauaugggacagccuuuaaacaaugaugaagaucaugcacauuggacggaagcaaaaauguuacuugacaacauaaacacaccugaagguauuaucccagcauuguucgaaccggaaagagagaaaagcgcggcaaucgacggcgaguacagauuacgaggugaagcucgcaaaaccuuuguagaguuaaugagacgaggggaucuaccaguauggcuuaguuacaaggucgccagcgaagguuuucaauacucagaccguagaugguguuucgacggagaacgcaauaaucagguguuagaagaaaauauggauguagaaauuuggaccaaggagggggaacguaaaaaguuacgaccucgauggcuggaugcuaggaccuauucugauccgcucgcacucagggaauuuaaagaguuugccgcgggaagaagaucugugagcggagaucuuaucuuggaaauuggaaaacugccccaacaucuaacacaacgugcgcaaaaugcuuuagacaauuuaguuaugcuccauaauuccgaacaggguggucgcgccuacaggcaugcaauggaagaacuaccagauacuauugaaacccuaaugcucuuggcauuaauagcgguauugacaggcgggguaacacuguucuucuuaucuggccguggauuaggaaagacauccauugggcuguugugugugauggccucaucuguacuucuuuggauggcaucaguggaaccccauuggaucgcugcuucuauuauccuagaguucuuccucaugguguuacuaaucccggaaccugauaggcagcgaacaccgcaagauaaucagcuggcuuauguaguaauaggacuauuauucaugauacugacaguggccgcgaacgaaauggguuuacuggagacaaccaagaaagauuuagguauaggccaugucgcaguagaaaaucaucaucacgcuacaaugcuagauguugaucuucauccugcaucagcauggaccuuguacgcuguugcaacaaccauaaucacaccuaugaugagacacacaauagaaaacacaacugcgaauaucagcuugacagcgauagcuaaucaggcggcaauccuuauggggcuggauaagggauggccuauaagcaaaauggauauaggagucccacuguuagcauuaggauguuauagucaggucaacccacuuacgcuaaccgccgccgugcuaaugcuugucgcacacuacgcuauaauuggccccggcuuacaagcaaaggcaaccagagaagcacagaaaaggacagcagcaggaauuaugaagaacccuacaguagaugggauuguugccauugauuuagauccgguuguauaugaugccaaauucgaaaaacagcuuggucaaaucauguuacuuauccuuuguacuagccaaauacuauugaugagaaccaccugggcuuuaugugagagcauaacauuagcaacggggccacuaaccacgcuaugggaagguagcccaggaaaguuuuggaacacaacaauugcggucucaauggcuaacauauuuagagggaguuaccuagccggugcuggguuggcauuuucucugaugaaaagccucggggguggaagaagagguacgggcgcacaaggagaaacucuuggagaaaaauggaaaaggcaacugaaccaacugagcaaaagcgaguucaacauauacaagagaagcgguauuauggaaguugauaggagugaggcaaaagaaggcuugaaacguggagaaacgacaaggcaugcaguuucaaggggaacugcaaaacugcgaugguucguagaacgaaauuuaguuaaaccugaaggaaagguaaucgauuuagguugcgggagaggaggcuggagcuauuauugugcagggcuaaagaaaguuacggaaguaaaaggauacaccaaaggcggacccggucaugaagaaccaauaccaauggcuacauauggauggaaucuaguuaaacuacauucaggaaaagacguuuucuuuacaccuccggagaagugugauacuuuacuaugcgauaucggagaaucaucuccgaauccuacuauugaagagggaagaacauugagaguuuugaagaugguagaaccuuggcuaagaggaaaucaauuuuguauaaaaauacuuaacccuuacaugccaucggucguagaaacguuggagcagaugcagcgcaaacauggaggaaugcucguacggaacccauugagucgaaauaguacacaugaaauguacugggugucuugcggaacuggaaacauugugucagcuguuaacaugacaucaagaaugcuccuaaauagguuuacaauggcgcacagaaaaccgacuuacgagcgagaugucgauuuaggagcugguacaaggcacgucgcagucgaacccgaaguggccaaucucgauaucauuggacaacguauagaaaacaucaaacacgaacauaaaucaacauggcacuacgaugaggauaauccuuauaaaacgugggccuaucacgggucauacgagguaaaaccuagcggcagugcauccucaaugguaaauggggucguaaaguuacuaacuaaaccgugggacguaauaccaauggugacucaaaucgcaaugacggacacuacacccuuuggucaacaaagaguuuucaaagaaaagguagauacucgaacuccaaaagcgaaaagaggaacagcacaaauuauggaaguaaccgcgcgcuggcuauggggguuucugagucgaaauaagaaaccccgaauuuguacacgagaggaauuuacuagaaaaguccgcucaaacgcggcuauaggugcuguauuuguugacgaaaaucaauggaauagcgcuaaagaagcuguggaagacgaaagauuuugggaccuuguccagaaggaaagagaauugcauaaacaaggcaaaugugccacguguguauauaacaugaugggaaaaagagaaaagaaacuuggagaauuuggaaaagcuaaaggcucgagggcaauuugguacaugugguugggugcacgauuucuagaguucgaggcgcuuggguuuaugaacgaggaccacugguuuucaagagaaaauaguuuaagcggugucgaaggugaagggcuccacaagcuaggauacauacuccgugacaucaguaaaauuccgggugggaauauguaugccgacgauacagcggguugggauacaagaauaacugaagacgaccuucagaacgaggcaaaaauaacugauaucauggaacccgaacaugcccuguuagccacgucuauauucaaauugacauaccagaacaaaguaguuaggguucaacgaccggcuaaaaacgguacaguuauggacgucauaucucguagagaucaacgaggaucuggccaagucggcacauacggucuuaacacauucacuaauauggaggcgcagcuuauacgacaaauggaaagcgaagguauauucucacccugugaacuagaaauuccuaaccuugcggagagaguauuagauugguuagaaaaauauggcguagaacgucuaaaaagaauggccauuucaggcgacgauugugucgucaaaccuauugacgauagauuugcaacagcacuaacugcacuaaacgauauggguaaaguccgaaaagauguaccgcaaugggaacccucgaaaggguggaacgacuggcaacaaguucccuuuuguucccaccauuuucaucaguuaauaaugaaagauggucgagaaaucgucguaccaugucguaaccaagacgaacucguaggccgugcgcgagugucccaaggggcuggcuggaguuuaagggaaacugcuuguuuaggcaaaucguaugcgcagauguggcaacucauguauuuccauagaagagaucuacgucuggcggcuaaugcgauauguagugcaguccccgucgauuggguacccacaucgagaacaaccuggagcauucacgcucaucaccaauggaugacgacggaagauauguuaucgguauggaaccguguauggauugaagagaauccuuggauggaagacaaaacacaugucaguucauggggugacguaccguacuuggggaaaagggaagaucaauggugcgggagucugauaggacucacugcgagggcuacaugggccaguaauauucaaguagccauaaaccagguaagaagauugauugguaaugagaacuaucuagacuauaugacuucaaugaaacgauucaagaaugagggcgauccugagggcgcuuuaugguaa

SEQ ID NO: 21910 - RNA, 9879 nt, Artificial Sequence
  derived and/or modified CDS sequence (opt6) from DENV-1__EU482807__SS-prME
agcgugacuaugcuacucaugcucaugccgacugcuuuagcuuuccauuuaacuacacguggaggagaaccgcauaugauaguuuccaaacaagaacgagguaaaucuuuauuauucaaaacauccgccgguguaaauauguguacauugguagcuauggaccuuggagaguucugugaagauacuaugaccuacaaauguccucguauaacugaagcggagccugacgacguugauugcuggugcaacgcaacagauaccuggguaacauacgggacuuguucucagaccggggaacauagacgagauaaacgaucuguugcauuagcaccucauguaggccucggacuugaaacacggacagaaacguggaugucaagcgaaggagccuggaaacaaauccaacgcguggagacuugggcguuacgacaccccggauuuaccgugauagcucuauuuuuggcucaugcuauagggacuagcaucacccaaaaaggaaucauuuucaucuuauuaauguuaguuacuccuaguauggcaaugagaugugucgguaucgguagccgagauuucguagaaggacuuagcggugcaacuugggucgauguaguauuggagcaugggaguuguguaacaacuauggccaaagauaaaccaacguuggauaucgaauuacuuaaaacagaaguuacuaauccggcgguacuaagaaaacuauguauagaggcuaagaucucaaacacuacuacggauagucguugccccacucaaggagaagcuacguuaguggaagaacaagaugcgaauuuugucuguaggcgcaccuuuguagacagagguuggggcaacgguuguggauuguuugguaagggauccuugaucaccugugcaaaauucaaauguguaacaaaacuagaaggaaaaacuguucaauaugaaaauuuaaaauauucaguaauaguaaccguccacacuggugaccagcaucaaguuggaaaugagaguaccgaacauggcaccacugccacgauaacgccacaagccccaagcacagaaauucaacuaacggacuacggagcccuaacacuugauuguucgccaaggacaggucuugacuucaacgaaaugguguuauuaacaaugaaagaaaaauccugguugguucacaaacagugguuucuagauuugccguuaccuuggacuagcggggcauccacaagucaagagaccuggaauagaaaagaucuccuagucacauuuaagacggcacacgcuaaaaagcaagaaguugucguuuuagguagucaagaaggcgcuaugcauaccgcucuuaccggagcuacugagauacaaacaagugggacuacaacuauauuugcuggacauuuaaaaugucgcuuaaaaauggacaaacucacacuaaaagggaugaguuacgugauguguacaggcucguucaaacucgagaaagagguagcagaaacacagcacggaacaguacuuguacaaauaaaauaugaagguacugaugcucccuguaagauaccuuucaguacgcaagacgaaaaagguguaacucaaaacggaagacuuauaacggccaacccaaucguaacugauaaggaaaagccaguaaauauagaagcugaaccaccauucggagagagcuauauagugauaggugcaggggagaaagcauuaaaacuaaguugguucaagaaaggcaguaguauugguaaaauguucgaagcaacagcccgaggagcaagaaggauggcgauacucggagauacagcaugggauuuuggaucaaucggaggaguauuuacuucaguuggcaaauuagugcaccagaucuucggaacugcauauggagucuuauucaguggaguuucuuggaccaugaaaauaggaaucggagugcuacuaacguggcuuggauuaaauagucgcagcacaagucuaucaaugacaugcauagcgguaggacucgucacacuauaucuuggaguuaugguacaagcggacucagguuguguaaucaacuggaaagguagggaacuaaaaugcggaucaggcauuuucguaacaaaugaaguucauacauggacagaacaauauaaauuccaggcugauaguccgaagcgacugagcgcugcuauaggaaaggcaugggaagaggggguuugcggaauuagaucugcaacaaggcuagaaaauauaauguggaaacaaauuaguaacgaacuaaaucacauucuauuggaaaaugauaugaaauuuaccgucgugguuggggauguggcuggaauccuagcucaggguaagaaaaugaucagaccacaaccgauggaauacaaauacaguuggaaaucaugggguaaagcgaaaauuauaggagcagauguacagaacacgacauuuauaauugauggccccaacacuccagaaugccccgaugaccaacgagcuuggaacauuugggaagucgaagauuaugguuucgggauauuuacaacaaauauauggcuuaaacugcgcgacucauacacucaaguuugugaucaccgguuaaugagugccgcgaucaaagauagcaaggcuguccaugcggacaugggcuauuggauagagagugagaaaaaugaaacuuggaaacucgcacgugcaaguuuuauagaaguaaaaacaugcauuuggcccaaaagucauaccuuguggagcaauggaguauuagaaucagaaaugauuauaccaaagauauauggggguccuauaucucaacauaacuaucgacccggauauuuuacucaaacagcuggccccuggcacuugggcaaacuagaacuggauuuugacuuaugugaaggaaccacuguggucguagacgaacacugcggcaauagggguccaucauuaagaaccacaacaguaacggggaagauaauucacgagugguguugucgaagcuguaccuugccaccacuaagauuuaagggagaagauggcugcugguaugggauggaaauccgacccgugaaagaaaaagaagaaaacuuaguuaaaucaaugguuucagcugguagcggggaaguagauucuuuuucacuaggcuuacuguguauaaguauaaugaucgaggaaguuaugagaucucgauggaguagaaaaaugcugaugacaggcacucuugccguuuucuuuuuacuaauaauuggacaauugaccuggaacgauuugauacggcugugcauaaugguaggagcuaacgcaucugauaggauggguauggggacaaccuaccuagcauugauggcgacuuucaaaaugaggccgauguuugcagugggacuauuauuuaggagacucacaaguagagaaguauuacuauuaacaauaggacuaucacugguagcuucuguagaauuaccgaauaguuuagaagaacucggagauggacuagcaaugggaaucaugauacuuaaauuacuuacagacuuccaaucacaucagcuaugggcaacccuucuaucccuuacauuuaucaaaacgaccuucuccuuacacuaugcauggaagacaauggcuaugguuuuaucaaucgugucuuuauucccguuaugcuuaucaacaacuucucaaaagaccacauggcuuccaguauuauuagguucuuuaggaugcaaaccauuaacaauguuuuugauagcugaaaauaaaaucugggggcgaagaucuuggccacucaacgaagguauaauggcaguuggaauuguuucgauccuauugucuagucuuuugaaaaaugacgucccucuagcaggaccucuaauagccggcgguauguuaauagcuuguuacgucauaagcgguucgagugcagaccuaucguuagaaaaagcagcagaagugucaugggaagaagaagcagagcauagcggagccucucauaauauucuuguagaaguacaagaugauggaacuaugaaaauaaaagacgaagaacgagaugauacgcucacgauccuuuuaaaagccacuuuacucgcgguaucagggguauacccauuaucaauaccagcuacauuauucgugugguauuuuuggcagaaaaagaaacaacgaaguggaguguuaugggauacucccucaccgccagaaguagaaagagcuguacuagacgacgggauuuauagaauaaugcaaagggggcuauugggucgaucucaaguuggggucggcguuuuccaagaaaacguguuccacacaauguggcauguuacacgaggagcgguacuuauguaccaaggaaaacgauuagaaccaucaugggcuaguguaaagaaagacuugauuagcuacggugguggguggagacuacagggcucauggaauacuggugaagagguccaaguaauagcaguggaacccggcaaaaauccgaaaaauguacaaacagcaccuggaaccuuuaaaacgagugagggagagguaggugcuauugcauuagacuuuaaacccggaacuuccggaagcccaauagucaacagagagggaaagaucguaggucuguauggaaacggagucgugaccaccagugggaccuacgugagugcaauagcgcaggcgaaagcaucgcaagaaggaccuuuaccggaaauagaagaugaaguguucagaaaacgaaauuuaacaauuauggauuugcacccaggaaguggaaaaacucgcagauauuugccggcuauuguccgugaagcaauaaaaagaaaacucagaacauuaauacuagcaccaacuagaguuguugcguccgaaauggcugaagcacuaaaggguaugccaauacgcuaccagacaacugcgguuaaaagugagcacacagggaaggagauaguggauuuaaugugucacgcgacuuucacuaugagauuacugucgccaguaagagugccgaacuauaauaugauuauuauggaugaagcucacuuuacugacccaucgucaauagccgccaggggauacauuucaacuagagucggaaugggugaagccgcugcaauuuucaugacugcuaccccgccaggaaguguugaagcauuuccucagaguaaugcagugauacaggaugaagaacgggacaucccggaaagaucauggaacucagguuacgaguggauuacugacuuuccaggcaaaacuguaugguuugucccaucgauuaaaagcggaaacgauaucgcaaauugucuacguaaaaacgggaagagaguuauucagcuaucgagaaaaacauuugauacagaauaucagaaaaccaaaaauaacgacugggauuaugucguuaccaccgacauaucagaaaugggcgcgaauuuuagggccgaccgaguaauagacccaagacgaugcuuaaaaccaguuaucuuaaaagauggcccggaacgugucauacuagcgggacccaugccaguaacaguugcgagcgcagcacaaagacgagguagaaucgggagaaaucacaauaaagaaggagaccaauacauuuauaugggucagccuuuaaauaacgacgaagaucaugcucauuggacagaagcuaaaauguuacucgauaauauuaauacaccugaggguauaaucccagcauuauuugaaccagaaagagaaaagagcgcggcuauagauggugaauaucgucuuaggggugaggcaaggaagaccuuuguugaguuaaugcgaagaggagauuuaccgguguggcucuccuacaaaguagccagcgagggcuuucaguacuccgauagacguugguguuuugauggagaacguaauaaccaaguccucgaagagaacauggacguugaaaucuggacaaaggaaggagaaagaaagaaauugaggccgagguggcuagacgcuagaacauacucagauccucuugcauuaagagaguuuaaagaguuugccgcugguagaaggucagucucgggagauuuaauacuggaaauuggaaaauuaccucaacaucucacacaacgagcgcagaacgcccucgauaacuuaguaaugcugcauaauucagaacaagguggacgugcguaccggcaugcaauggaggaacuaccagauacuauugagacacuuauguuacucgcacuaauagcuguguuaaccggaggagucacgcuguucuuccuaucuggucgcggauuaggaaaaacaucaauaggcuuacuaugugucauggcaaguucuguauuauuauggauggcaaguguggaaccucauuggauagcagcuuccauaauucuugaguucuuucuaaugguccuccucauuccagaaccagauaggcagagaacaccucaagauaaucagcucgcauauguagugauaggauuauuauucaugauccugacaguggcugcuaacgaaaugggacuacuagagacaaccaagaaggaccuggguauuggucaugucgcuguagagaaucaucaccaugcagccaugcuagacguagaccuccauccagcaagcgccuggacccuuuaugcuguagccacaacgaucauaacaccuaugaugcgccauacuauagagaauacuacugcaaacauaucacuaacagcgauugcaaaucaagcggcgauccugaugggauuagacaaagguuggccaauaucaaaaauggacauuggagugccacuacuagcacuuggauguuauucucagguuaaccccuuaacuuuaacagccgcagucuuaaugcuaguagcucacuacgcgauuauuggcccgggguugcaagccaaggcaacaagggaagcgcaaaagcgaaccgccgcuggcauaaugaaaaaucccacaguagacggaaucguugcuauugaccuagacccagucgucuaugaugcaaaguucgagaaacaacuaggucaaaucauguuauugauuuuauguacaagucaaauacuucuuaugcgaacuacuugggcuuuaugugaaucaauaacuuuagcgacaggaccauugaccacucugugggaagggucaccuggcaaauucuggaacacaaccaucgccguuaguauggcuaauauauucaggggaagcuauuuagcaggggcggguuuggcguucucacuaaugaaaucgcuagggggaggacguagaggcaccggagcccagggggaaacauuaggcgagaaauggaaaagacaguuaaaucaauuaucaaaaucagaguuuaauacauacaaaagaucggguauaauggagguagaccguagugaggcaaaagagggucuaaaacggggagaaacaaccaagcacgcagucucgaggggcaccgccaaauuacgcugguuuguugagagaaacuuggugaagccggaaggaaaaguaauugaccuagggugcggacgaggaggaugguccuacuauugcgcuggccuuaagaaaguuacagaaguaaaaggauauaccaaaggggguccuggacacgaggaaccuauccccauggcaacuuauggguggaaccuuguaaaacuccacagugguaaggacguguucuuuaucccaccagaaaaaugugauaccuugcuuugugauauaggcgaaagcagccccaauccaacgauugaagaaggaaggacauuaagaguguuaaagaugguagaaccuugguuacgagguaaccaguuuuguauaaaaauccuuaacccguauaugcccucgguugucgagacacuugaacggaugcaacgaaaacacggggguaugcuggugcggaauccccugagucgcaauaguacccacgagauguacuggguuucuugugguacaggaaauauaguaagcgcagugaauaugacaagcagaaugcugcucaaccguuucaccauggcccacagaaaaccaacauaugaacgcgaugucgauuuaggggcgggaacacgucacgucgcugucgaacccgaaguugcgaauuuagauaucaucggccaacgaauugaaaacauaaaacaugaacacaaaagcaccuggcacuaugacgaagauaaucccuauaaaacuugggcauaucauggcagcuacgaaguaaaaccuucagguuccgcaagcucuauggucaauggaguuguaaaacuauugaccaaacccugggaugugauaccaaugguaacccaaaucgcaaugacugacacaacgccuuuugggcaacaaagagucuuuaaggaaaagguggacacuagaacgccaaaagcgaaaagagguacggcgcaaaucauggaggugacggcuaaguggcucuggggauuucuuaguagaaacaagaaaccacgaauauguaccagggaagaauuuacacgaaagguacgaagcaaugcagcuauuggcgcuguauuuguggaugaaaaccaauggaacucugcuaaggaggcgguggaggaugaacgauuuugggaucuaguacaccgugaaagggaacuucacaaacaaggaaaaugugcuacgugcguguauaacaugauggguaaaagagagaagaaacuuggcgaauuugggaaagcaaaagguagccgagcaauuugguauauguggcugggagcaagauuuuuggaauuugaagcacuaggguuuaugaacgaagaucacugguuuagucgagaaaauucauuaagcgggguggagggagaaggccuacacaaacuagguuacauacuaagagacauuagcaaaauaccaggagguaauauguaugcagaugauacggcuggaugggauacgcggauuaccgaagaugaucuccagaaugaggccaaaauaacagacauaauggaaccagagcacgcuuuacucgcuaagucaaucuuuaagcucacauaucaaaauaaaguaguuagaguacaaagaccagcuaagaacgggacuguaauggauguaauaucucgaagagaccaaagagggucaggucaaguaggcacguauggacuuaauacuuuuacgaauauggaagcccaacucauuagacaaauggaaucugaaggaauauuuucaccaucagaguuagagacuccaaaucuagcggggcgagugcucgacuggcucgaaaaacauggagucgagcgacuaaagcgaauggcgauaucgggagaugacuguguagucaaacccauugacgaucgauuugcuacagcacuuaccgcauugaacgacauggguaaagucagaaaagauauaccacaaugggaacccaguaaagguuggaacgacuggcagcaaguaccauucuguagucaccauuuccaucaauuaauaaugaaagacggacgagagauuguuguaccauguagaaaccaagaugaguugguuggccgugcaagaguaucccaaggagcuggauggaguuuacgagagacugccuguuuagguaaaucuuaugcucaaauguggcaacugauguauuuccaucguagagaucuaagauuggcagcaaaugcaauuuguagcgcugucccuguagacugggucccaaccucgagaacuacauggucaauucacgcacaccaucaguggaugacgacagaggacaugcuuaguguguggaaucgaguauggauagaagaaaauccauggauggaagacaaaacacauaucucaucuuggggcgaugucccguauuuaggaaaacgagaagaucaauggugcgguucucugauaggccuaacagcuagagcgacaugggcgacgaauauacaaguugcgaucaaccagguacguagacuaaucgggaaugaaaauuaccuugauuacaugacauccaugaaacguuuuaagaaugaaucagaucccgagggggcacuuugguaa

SEQ ID NO: 21911 - RNA, 9879 nt, Artificial Sequence
  derived and/or modified CDS sequence (opt6) from DENV-1__EU482808__SS-prME
ucuguuacuaugcuacuaaugcuuaugccgacggcacuagcauuccaccuaacuacaagagguggugaaccacacaugauuguuuccaaacaagaaagagguaaaucacuacuauuuaaaacaagugcgggcguaaacaugugcacacuuauagcaauggaccuaggggaguucugcgaagacacaaugacuuacaaauguccacggauaaccgaagcagaaccggaugacgucgacuguuggugcaaugcuaccgauacuuggguaacuuaugggacguguucacaaaccggugaacaccgacgagauaaaagauccguugcacuagcuccacaugucggacuaggacuggaaacaagaacagaaaccuggaugaguucagaaggcgcuuggaaacagauucaaagaguugaaacgugggcauugagacauccaggguuuacaguaauugcauuauuucuagcacaugcgauagggacuucaauuacucagaaaggcauuauauuuauacuacucauguugguaaccccuuccauggcgaugagauguguaggcauagguucacgcgauuucguagagggacucucuggagcaacguggguagauguuguauuagaacacggcaguuguguaacuacgauggcaaaagacaaaccgaccuuagacauagaacuauuaaaaacggaaguaacaaacccagcaguauuacgcaaacucugcauugaagcgaaaauuagcaauacgacaacugauucuagguguccgacacagggugaagcgacccuaguugaggaacaagacgccaacuuuguaugccgacguaccuuuguagacagaggaugggguaacgguugcggccuguucgggaaagggagccucauuacuugcgccaaauucaaauguguuacuaaauuagaaggaaaaaccguacaauaugaaaauuuaaaauacagugugauuguuacuguucacacuggggaucaacaccaggucggaaacgaaucaacagagcauggaacaacagcgacaauuaccccucaggcuccuucaacggaaauucaauuaacugauuacggcgcgcugacguuagauuguaguccacguacaggacuugauuuuaaugaaaugguccuucucacgaugaaagagaaaucuugguugguacacaaacaaugguucuuagaucugccauuacccuggacuucuggugcaaguacaagccaagagacauggaaccgaaaagaucuuuuaguaacauuuaaaacagcucaugccaagaaacaagaaguagugguucuagggagccaagagggagcaaugcauaccgcauugacgggugccacugaaauccaaacaagugguacaaccacaauuuuugcuggccauuuaaaauguaggcuaaaaauggacaaacuuacuuuaaaggguaugucuuacguaauguguacagggagcuuuaaacuagaaaaagaaguagcugaaacucaacauggaacgguuuuagugcaaauaaaauacgaagggacggacgcaccuuguaaaauuccauucuccacucaagacgaaaaaggcguaacacaaaauggccguuuaauuacggccaacccaauuguaacagauaaagaaaaaccgguaaauauugaagcugaacccccauuuggcgaaaguuauauagucauaggcgcaggcgaaaaggcuuuaaaacuuaguugguucaagaaaggaucguccauaggaaaaauguuugaagcuacggcacgaggggcuagaagaauggcgauuuugggcgacacugcaugggauuuuggaaguauaggagguguauucacgaguguuggaaagcuaguucaccaaauuuucggaacagcguacggaguguuauucuccggcgucaguuggacaaugaagauuggaauuggggucuuguuaaccugguuaggccuaaacagucgaucaacgucauuaucaaugaccuguauugcuguuggucuugugacauuauaucuuggggucaugguacaagcagacucagguugugucauuaacuggaaaggacgagaauugaaaugcgguucuggcauuuucguaacaaaugaaguacauacuuggaccgaacaauacaaauuccaagcagauaguccuaaacgacugagugcggcuaucggaaaagcaugggaagaaggaguaugugguauaagaucugcuacucgauuagaaaacauuauguggaaacaaauaucgaaugagcugaaccauauacuacuugaaaacgacaugaaauucacaguugugguaggagacguugcagguauacuagcccagggcaagaaaaugauacguccacagccuauggaauauaaauauaguuggaaaaguugggggaaagcgaaaauaauaggagcggacguccagaauacuaccuucauuauugacgggccgaauacgccugaaugcccugacgaucaaagagcuuggaacauaugggaaguggaagauuacggguuuggaauauucacaacaaauauuuggcuuaaacuacgagacucuuacacucaagucugugaucaucguuuaaugucugcagcaauaaaggauucaaaagcuguacacgcugacaugggauauuggaucgaauccgagaaaaaugaaacauggaaacuggcucgcgcuucauucaucgaaguuaaaacuuguauauggccaaagucgcauacgcuauggagcaacggagucuuagaaucagaaaugauaaucccaaagauauacggugguccuauuucacagcacaauuauagaccaggauauuuuacccagacugcagggccuuggcacuuaggcaaacuagaacuagauuucgacuuaugcgaggguaccacgguaguuguugaugaacauugcgguaacagaggccccucgcuacguaccacuacugucacaggcaaaauaauucaugagugguguugccgcaguuguacacuuccuccuuugcgauuuaaaggagaagacgggugcugguauggaauggaaauuagaccggucaaagaaaaagaggaaaaucucguuaaaaguauggucucugcgggaaguggggaaguugauuccuuuagccuuggguuacuguguauaucuauaaugauagaggaaguaaugagaaguagauggucaagaaaaaugcugaugacuggaacguuagcuguguucuuucuacucaucaugggacaacugacauggaacgaucuaauacgcuuguguauuaugguaggagccaaugccucagaucgaaugggcauggggacuacguaucuggcauuaauggcaacuuuuaaaaugagaccuauguuugcgguagggcuauuauuuagaaggcugaccaguagagagguauuacuuuuaaccaucggcuuaagucuugucgcaaguguggaguuaccaaacucacuagaggaacuaggagauggacucgcgaugggaauaaugauacuaaaauugcucacagauuuccaaucacaucaauuaugggcuacucuccugucacuaacauuuauaaaaacuacauuuaguuuacacuaugcauggaaaacuauggcaaugguacuaaguauagucagucucuuucccuuaugcuuaaguacuacaucucagaaaacuacgugguuaccuguuuuacugggcucucuaggauguaaaccgcuuacaauguuuuuaaucgcugaaaauaaaauaugggggcgcaaaagcuggcccuuaaacgaagguauaauggcuguugguauuguaaguauauuacuuucaagucuauugaaaaacgacguaccacuagcugguccucucauagcaggcggaaugcuaauugcguguuauguaauuuccgggaguagcgcugacuugagccuagaaaaagcagcagaaguaucaugggaagaagaggcugaacacucuggagccucccauaauauccuaguagagguacaagaugauggaacaaugaaaauuaaagacgaggaaagagacgacacgcuaacgauacuguuaaaggcaacgcuccuggcagugagcggaguuuauccauuaucaauaccugcuacgcucuuuguuugguauuuuuggcaaaagaagaaacaaagaucagggguucucugggacacuccgucaccgccugaaguugagagagcagucuuagacgacggaaucuauagaaucaugcaaagaggguuacuaggaagaucacaagucggaguuggaguguuccaggaaaacguuuuccacaccauguggcaugucacacgcggugccguacugauguaccaaggaaaaagacucgaaccuaguugggcaagcgucaagaaagaucuuauaaguuauggaggaggguggcgacuacagggaucauggaacaccggagaagaaguacagguaauagcaguggaaccggguaaaaaccccaaaaauguucaaacagccccggguacauuuaaaaccagcgaaggggaaguaggagcuauugcgcuagacuucaaacccggaacgagcggaucuccgauugugaaucgagagggaaaaauaguaggauuguacggcaauggcgucguuacaacuucuggcacauauguuagugcgauagcucaagccaaagccucgcaagaagguccucuucccgagauagaagacgaaguguuuagaaaaagaaaucuaacgauuauggaucuucaccccggcuccgggaaaacuagaagguauuuacccgcuauagucagagaagcgaucaagagaaaacuaaggacacuaauauuagcuccaacacgcguuguggccucagaaauggcagaagccuuaaaaggaaugccuauacguuaucaaacuacggcuguuaaaagcgagcauacgggaaaagagauuguagaucuuaugugucaugcgacauucaccaugagauuauuaaguccagugcguguuccaaauuacaauaugauaauuauggaugaagcucacuucacagauccuaguagcauagcagcaagaggcuauauuucaaccaggguaggcaugggggaagcagcagcuauuuucaugaccgcgacucccccaggauccgucgaagcauuuccucaaagcaaugcaguaauacaggacgaagagagggacauaccagaacgcagcuggaacucuggauaugaauggauuacagauuucccaggaaaaaccgugugguuuguucccucgauaaaauccggcaaugauaucgcgaauugucuccgcaaaaauggaaaaagaguaauucagcuuaguagaaaaaccuuugauaccgaauaccaaaagacgaagaauaaugacugggacuacgucguuacgacugauauaagugaaaugggagcgaacuuuagggcagaucgagucauagaucccagaagauguuuaaagccgguaauucuuaaagacgggccugaacguguaauuuuagcaggcccgaugccaguaacgguggccagugcagcgcaaagacgaggccguauuggcaggaaccauaauaaagaaggugaccaauauaucuacaugggacagccacuaaauaacgacgaagaccaugcacauuggacagaagcuaaaauguuauuagacaacauaaauacuccagaagguauaauuccugcauuauuugaaccagagcgcgagaagucagcggcaauagacggugaauauaggcuaaggggugaagcacggaaaacuuuuguagagcuuaugaggagaggugacuugccuguauggcuuucuuacaagguggccagugaaggauuucaauauucggaucgacggugguguuuugauggugaacguaacaaccaaguuuuggaagaaaauauggacgucgaaauuuggacaaaagagggcgaaagaaagaaauugagaccccgaugguuagacgccagaacuuacucagacccauuagcucucagggaguuuaaagaauuugcugcuggccguaggagcguaaguggagauuuaauuuuggaaauaggaaaacuaccgcaacaccuuacacaacgagcacaaaacgcauuagacaacuuaguuauguugcacaauagcgaacaagguggucgagccuaucgacacgccauggaagaacuuccugauacuauugaaacacuaauguuacuagcacuuauagcagugcuaaccgggggagucacuuuauuuuuccuaaguggaagggguuuagguaaaacauccauagguuuauuguguguaauggcaucuagcguuuuacuauggauggccucgguagagccacauuggaucgcagcuaguaucauacuagaguuuuucuuaauggucuuacuaauuccagaaccagaucggcaacgcacgccucaagacaaccagcuagcuuacgucgucaucgggcuccuauucaugauuuugacuguagcagcaaacgaaauggguuuauuagaaaccacaaagaaagauuuaggaauuggccauguagccguugagaaucaucaccaugcugcaauguuagauguagauuugcauccggcuagugcauggacccuauacgcaguagcgacgacaauaauuacuccaaugaugcgacauaccauugaaaauacaacugcuaauaucucccugacagccauugcuaaccaggcugcaauacuaaugggcuuagauaagggguggccaaucucaaaaauggacaucgguguuccauugcuugcucuaggaugcuauagccagguaaauccauuaacguuaacagcugcagugcuaaugcuuguggcacacuacgcaauaauagguccugguuuacaagcuaaagccacccgagaagcacagaagagaacugcggcggggaucaugaaaaaucccaccgucgacggaaucgucgcaauagaccuagauccggugguauaugacgcaaaguuugaaaaacaacuagggcaaauaauguuacuaauccuaugcacuucucaaauucuuuuaaugagaacgacaugggcguugugcgaaucaauaacacuggcuacuggaccauugacaacuuuaugggaaggaagcccggggaaguucuggaauacaacaaucgcuguaucaauggcaaacaucuuccgagguuccuaucuugccggugcaggcuuagccuuuucauuaaugaagucacuuggggguggccguaggggaaccggugcgcagggggaaacguuaggugaaaaguggaaacgacagcuuaaccaacuaucaaagagugaguucaauacuuauaaaagaaguggaauaauggaggucgaucggucagaagcaaaagaagggcuuaaacgaggggagacaaccaaacacgcgguaucuagaggaacagcuaaacuaagaugguuuguagaaagaaaucuaguuaaaccagaggguaaaguuauagauuuaggguguggaagggguggauggucauauuauugugcaggacuaaagaaaguuaccgaagucaaaggauacacaaaaggcgggccugggcacgaagaaccaaucccuauggcuacuuacggguggaauuuggucaaauuacauucagggaaagauguauucuuuaccccaccugaaaaaugcgauacacuuuuaugcgauauuggcgaaucaucuccuaacccgacaauugaagaagguaggacguugcguguucugaaaaugguagaaccuugguuacgaggcaaucaauuuugcauaaaaauuuugaacccauauaugccuuccguuguagagacucuagaacaaaugcaaagaaagcauggcggcauguuaguacguaacccccuuagccgcaauaguacucaugaaauguauugggugucauguggaaccgguaauauaguaagcgcgguuaacaugacgagucgaauguuauuaaaucgauucacgauggcgcauaggaaacccacuuaugagagagauguagacuuaggagccgguacacgacacgucgcaguugaaccagaaguagcaaauuuagacauuaucggccaacgaauagaaaacauaaaacaugaacacaaaucuacauggcauuacgaugaagauaauccauauaaaacaugggccuaccacggaucauaugagguuaaaccgagugggagugccucuucaauggugaaugggguaguaaaauuauuaacuaagccaugggauguaaucccaaugguaacgcagauagcaaugacagacacaacuccauuuggucaacaaagagucuuuaaagaaaaaguugacacacguacaccgaaggcuaagcggggaacggcucaaauaauggagguuaccgccaaauggcuaugggguuucuuaagcagagacaaaaagccgcgaaucuguacacgagaagaguuuacacgaaaaguuaggucuaaugcugcuauaggagccguauucguugacgaaaaccaauggaacucagcaaaagaggcuguggaggaugagcgcuuuugggaucugguacaccgcgaacgcgaacuacacaaacaaggcaaaugugccacuuguguguauaauaugauggguaaacgggagaagaaacucggagaguucgguaaagcuaaaggaagucgagcaaucugguacauguggcugggcgcaagauuucucgaguuugaggccuuaggcuucaugaacgaagaucauugguucucuagagaaaauucacuuucgggaguagagggcgagggacuacauaaauuaggguauauucuucgcgacauaaguaaaauaccgggugggaauauguaugcugaugacacagcgggcugggauaccagaauaacagaagacgacuuacaaaacgaagcaaaaauuacagacauuauggaaccugagcaugcucuccuugcgaagucaaucuucaaacuaacauaucaaaacaaaguagugcgaguacaacgcccugccaaaaaugggacgguuauggacgugaucucaagacgggaccagagaggauccgggcagguaggcacuuacgggcugaacacauuuacaaacauggaggcucaacugauucgacaaauggaaucagaagggaucuuuaguccaucagaauuagaaaccccuaaucuugcgggaaggguacuggacuggcuagagaagcauggcguagaacgccugaaaagaauggcaauaagcggagacgacuguguaguaaaaccuaucgacgacagguucgccaccgcccuuacugcacuaaacgauaugggcaaaguccgaaaagauauuccacaaugggaaccuucaaaagguuggaaugacuggcagcagguucccuucuguucucaucauuuucaucaauuaauaaugaaagauggaagagaaaucguugugccaugcagaaaucaagaugaauuaguagguagagcgagggucucacaaggcgcuggauggagucuuagagaaacagccugcuuagggaaaucuuaugcccaaauguggcagcuuauguauuuccaucgcagagaucugcgccucgcugcgaacgcaauauguagcgcaguuccaguagauuggguaccuacuucaagaacuacauggaguauacaugcacaucaccaauggaugacgacagaggacaugcuuaguguuuggaaucguguauggauagaagaaaacccguggauggaagacaaaacacacaucucaucuuggggagauguaccauaccuggggaaaagggaggaucaauggugcgguagccucaucggacuaacagcccgugcuaccugggcgacaaauauccaaguugccauaaaccaaguaaggagacuaauagggaaugaaaauuauuuagacuauaugacaucaaugaaaagauucaagaaugaaagcgacccugaaggagcacuaugguag

SEQ ID NO: 21912 - RNA, 9879 nt, Artificial Sequence
  derived and/or modified CDS sequence (opt6) from DENV-1__EU482809__SS-prME
ucaguaacuauguuauuaaugcuaaugccaacggcguuagcauuucaucuaacaacgaggggaggagaaccucacaugaucguuucgaaacaagagcgagggaaaucacuacuguuuaaaacaagugcgggaguuaauaugugcacauuaauagcuauggaccuaggagaauuuugugaagauacuaugacuuauaaauguccacgaaucacagaagcugaaccugacgauguagauuguugguguaaugcgacagauacauggguaacguacggaacgugcucucaaacaggagaacacaggagggauaaaagaucaguggcguuggccccacaugugggacuaggucuggagacaaggacagagacuuggaugaguucagaaggagcauggaaacaaauucaaagagucgagacaugggcacugcgacauccaggcuuuaccguaauagcguuauuuuuagcgcacgcgaucgggaccucaauaacacaaaaagggauuauuuuuauacugcuaauguuagugacaccauccauggcgaugagaugcgucgguauaggaucuagggauuuugucgaaggacuuucaggugcaacaugggucgacguaguacuugagcaugguuccugcguaacaaccauggccaaagauaaaccuacacuagacauagagcuucuaaaaacagaagugacaaacccagcgguauuaagaaaacuuuguauagaagcaaaaaucucgaacacuacuaccgauucucgaugcccgacccaaggagaagcaacauuagucgaagaacaagaugcuaauuuugucuguagacguacauuuguugaucgaggguggggcaauggguguggcuuguuuggcaaagguaguuuaaucacaugugcuaaauuuaaaugcguaacaaaauuggagggcaaaaucguucaguaugaaaaucucaaauauaguguaaucguaacaguacauacgggcgaucaacaccaggugggaaacgaauccaccgaacacgguacaacugcaaccauuacuccacaggcaccaucuacagagauacaauuaaccgauuacggggcauuaacauuggacuguucaccgcgaacagggcuagauuuuaaugagaugguauuguuaacuaugaaagagaaaagcugguuaguccacaaacaaugguuucucgaucuaccucuaccguggacgucaggcgcuucuacaucgcaagaaacauggaaccggcaagacuugcuugucacuuucaaaaccgcucaugcaaagaaacaagaagucgugguccuagggucgcaagaaggagcgaugcauaccgcguuaacaggggccacugaaauucagacaucuggaacuacuacuauauuugcuggccaccuuaaauguagacugaaaauggacaaauuaacccuuaaaggaauguccuacguuaugugcacaggcucuuuuaaacuagaaaaagaaguagcagaaacccaacaugguacgguauuaguucaaauuaaauacgagggaaccgacgcgccauguaaaauaccauucaguacgcaggaugagaaagguguuacacaaaacggaaggcuaauuacugcaaaucccauagucacugauaaagaaaaaccaguaaauauugaagcugaaccgccauucggugagucauacauagugaucggggcaggagaaaaagcauuaaaacucagcugguuuaagaaaggcucaaguauuggaaaaauguucgaagcaacugcacgcggugcgcgaagaauggcuauucuaggagacacagcuugggacuucggaaguaucggaggcguuuuuacaucaguagguaaauuaguccaccaaauauuugguacggcuuauggcguccuauuuagugguguaucuuggacuaugaaaauaggaauagguguuuuauugacaugguuaggacuuaauucacggagcaccagcuuaaguaugacgugcauugcaguagguuugguaacacuauaucuggggguaauggugcaagcugacagcggguguguuaucaacuggaaaggaagggaacugaagugcggguccgggauauuuguuacaaaugagguacauacuuggacugagcaauauaaauuccaagcagacuccccuaaaaggcugucagcagcgauaggaaaagcgugggaggaaggaguauguggaaucagguccgccacucguuuagaaaacauuauguggaaacaaauaucuaaugagcuaaaucacauauuguuggaaaaugauaugaaauuaacagugguuguaggugacguugcaggcauccuugcgcaaggaaagaaaaugauacgcccacagccaauggaauauaaauacucauggaaaucauggggaaaagcgaaaauaauaggggcugauguccagaacacgacauucauaaucgacggaccgaauacaccggaaugucccgacgaccaacgugccuggaauauaugggaaguggaagauuaugguuucggaauauucacaacaaauauauggcugaagcucagggacucuuacacgcaagugugugaccauagacuuaugagcgcugcaauuaaggauuccaaggcuguacacgccgauaugggguacuggauugagagugagaaaaaugagacuuggaaauuagcaagagcguccuucauagaaguaaaaaccugcauauggccaaaaagucauacauuauggucuaauggaguccuagaaucagaaaugauaauuccuaagauuuacggagguccaauaagucaacacaauuaucggcccggguacuuuacacagacugcuggaccguggcauuuagggaaauuagaacucgauuuugaucuuugugaaggaacaacugucguaguggaugagcacugugguaauagagggcccaguuuacgaacaacgacugugacaggaaaaauuauucaugaauggugcuguaggagcuguacguugccaccucugagauucaaaggagaagauggcugcugguacggcauggaaauaagaccuguaaaagagaaagaagagaacuuaguaaaaucuauggugucagccgguucuggugaaguagauaguuuuagcuuaggacuguuauguauaaguauaaugauagaagaaguaaugcguaguagguggucucguaaaauguuaaugacuggaacucuagcagucuucuuucuauugauaaugggucaauuaacuuggaacgauuugauaagacuuugcauuaugguaggagcaaacgcaucagacagaaugggcaugggaaccacuuauuuagcacuuauggcaacauucaaaaugcguccuauguuugcgguaggcuuguuguuuaggagacuuaccucccgcgaaguacuacuuuuaaccauaggauuaucauuaguagcgucaguagaacuacccaacuccuuggaagaacuuggggauggacuagccaugggaauaaugauuuugaaauugcuaacugauuuucagagucaccaauuaugggccaccuuacuaucauuaaccuuuauuagaacaacauucucgcuacauuacgcauggaaaacaauggcgaugguccuguccauaguuucgcuauuuccccugugcuuaucuaccacaucgcagaaaacuacuuggcuuccuguuuuauuaggaucccuaggguguaaaccacuaacaauguuuuuaauagcggaaaacaaaauauggggcaggaagucauggccuuuaaaugaagguauaauggccgugggaauuguaucaauacuuuuaucaucucuacucaaaaaugaugugccacuggccggaccacucauagccgguggaaugcuaauugccuguuauguaaucagcggaucaucugcagaucucagcuuggaaaaagcugccgaagucagcugggaggaagaagcagaacauucgggagcaucacauaauauucugguagaagugcaagacgauggaacgaugaaaaucaaagaugaagaaagagaugauacacuaacaauccuauugaaagcuacacuauuagcuguuagugggguuuauccgcuaucuauccccgcaacacuauucguaugguauuucuggcagaagaagaaacagcgaucaggaguacuaugggauacaccgucaccaccagaagucgaacgugcuguucuagaugacgguaucuacaggauaaugcaaaggggacuuuuaggacgaucucaggucggaguaggaguauuucaagaaaacguuuuccauaccauguggcacgucacaaggggugcaguauuaauguaucaaggcaagcgccuagagcccuccugggcauccguaaagaaagauuuaauaaguuauggcggggguuggcgccuacaaggauccuggaauacuggcgaagagguucaaguuaucgcagucgagccaggcaaaaaccccaaaaacgugcagacugcaccuggcacguucaaaacaagugaaggugaagugggugcaauagccuuagacuucaaaccggguacgucugggucuccuauagugaauagagaagggaaaauaguaggauuauacgguaaugggguaguuacgaccucugggacuuacguuagugcaauugcgcaagcaaaggcaucucaggagggaccacuaccggaaauagaagacgaaguuuuuagaaaacguaaucuuacaauuauggauuugcauccagggaguggaaagacacggagauacuuaccugcaaucguaagagaagcgauaaaaagacggcuacgcacacuuauacuagcucccaccagagugguagcgucagagauggcagaggcauuaaaaggaaugcccauucgcuaccagacgacugcaguaaaaucagaacacacagggaaggaaauaguagauuuaaugugccacgccaccuuuaccaugagacuguuaucaccuguacguguuccuaauuauaauaugauaauaauggacgaagcacauuuuacugacccgucaagcauagcggcccgaggauauauuagcacaagaguagguaugggggaagcagcagcaaucuucaugacggccacgccaccugguucgguugaagcauucccacaaaguaacgcggugauacaggacgaagaaagagauauucccgaacguucuuggaacucugguuacgaguggauaacagacuuuccgggaaaaacaguuugguucguacccaguaucaaaagcggaaaugacaucgcgaauugucuacggaaaaacggcaaaagaguuauucaacuuucaagaaagacuuucgacacugaauaccagaaaacuaaaaacaaugacugggacuauguuguuacaacagacauauccgaaaugggagcgaacuuucgagcagauagaguaaucgacccuaggagaugcuuaaaaccugugauccuaaaagacggaccugaaagaguuauccuugcgggaccuaugccuguaacaguugcuucugccgcacaacgacguggaaggauuggccgaaaucauaauaaagagggagaucaguacauauauaugggacaaccucuuaauaacgaugaagaccaugcgcacuggacugaggcgaagaugcuauuagauaacaucaauaccccggaaggaauaauaccggcacuguucgaaccggaaagagaaaaaucagcugccauagauggagaauauagacugcgaggagaggcgaggaaaacuuuuguggaacucaugcgucgaggagauuuaccgguguggcucucauacaaaguagcaagugagggauuucaguacucagauagacguugguguuucgauggagagaggaacaaucagguauuggaagagaauauggauguagaaauuuggacaaaagagggagaacgaaagaaacuaagacccagaugguuagaugcacggacuuauucagaucccuuggcguugcgggaguuuaaagaauuugcagcaggcagacgaucuguuagcggagaccuaauauuagagauaggaaaacuuccacaacaucuuacucaacgagcgcaaaaugcacuugacaaucucguaaugcuacauaauucugagcaagggggucgggcguauaggcaugcaauggaggaacuaccugacaccauagaaacauuaaugcuauuagcguugauugcagugcuuaccgguggggugacguuguucuuucuaucagggcgagggcucggaaagacaagcauuggccuauugugcguuauggcaucuucaguuuuguuauggauggcaucagucgaaccacacuggaucgcagcgucaaucauacuugaguucuuucuaauggucuuauuaauaccugaaccggacaggcaaagaaccccacaagauaaucaacucgccuauguaguaaucggauuacuauucaugauuuuaacaguugcagcuaaugaaaugggacuauuagaaacgaccaagaaagauuuggggauuggucacgucgcgguggaaaaccaccaccaugcugcuauguuagauguugacuuacacccagcgagugcuuggaccuuguacgcuguagcgacaacuauaaucacuccaaugaugcgucauacaauagaaaauacuacggcuaauauuucccuuaccgcgaucgcgaaucaagccgccauuuugaugggguuggauaaggguuggccgauuucuaaaauggacauagguguaccccuuuuagcucuuggauguuauagucaagucaauccacuuacuuuaacagcggcaguauuaaugcuuguagcccauuaugccauaauaggaccuggucuccaggcuaaagcaacacgcgaagcccaaaagcgcacugccgcagguauaaugaaaaaucccacaguagacgggauuguugccauagacuuagacccagucguguacgaugccaaauucgaaaaacaguuaggucaaauuauguuauuaauauuaugcacuucucaaauucuacuuaugagaaccacaugggcuuuaugcgagaguaucacuuuggcgacaggcccuuugacuacguuaugggaggguucucccgguaaauucuggaacacuacaaucgcaguuuccauggcgaacauuuuccgaggaucguaucuugccggugcuggauuagcauucucauugaugaaaucccugggaggcgggcgaagaggaacgggagcacagggggaaacccuuggugaaaaauggaaacgucaacuaaaucaacuuucaaaaucagaauuuaacacuuauaagcgauccggaauuauggaaguagaucgcucggaagcaaaagaaggacuuaagagaggugaaacaacuaaacaugcuguaucuagagggacagcuaaguuacgaugguuugucgaacguaacuugguaaagccagaaggaaaaguaauagaucugggauguggacgaggcgguuggagcuauuauugugcaggacucaagaaaguaaccgaaguaaaaggcuacacuaaaggcggucccgggcaugaagaacccauuccuauggcuaccuauggauggaaccugguaaaacuacauagugggaaagauguguucuuuauuccucccgaaaaaugcgacacucugcuaugugacaucggugagucgucgccaaauccaacgauagaagaaggacgaacccucagaguucuaaagaugguagaacccuggcuucgcgggaaucaauuuugcauaaaaauacugaauccauauaugccuucgguuguggaaacguuagagcagaugcaaagaaaacauggugggaugcucguaagaaauccacugucacguaauucaacucacgaaauguauuggguuagcuguggaacugguaauaucgucagugcaguaaacaugaccucaagaauguuacugaaucgcuuuacaauggcacaucgaaaaccaacuuacgagcgagacguagaccucggagcagguacacgacaugucgcuguggaaccugaaguggcaaaccuagauauaauaggucaacguauugaaaauaucaaacaugaacauaaaaguacauggcauuaugacgaagacaacccguauaaaacaugggcauaucacggcucauacgaggugaaaccgucaggauccgcauccucuauggugaacgguguagugaaacuuuuaacaaaacccugggauguaauuccaaugguuacacaaauagcuaugaccgacaccacaccuuucggacaacaacggguauucaaagaaaaaguugacacgagaacuccaaaggcgaagcgaggcacagcucagaucauggaaguaacugcgaaauggcuuuggggauuucuaagccgaaacaagaaaccuagaauaugcacaagggaagaguucacuaggaaagucagaucaaacgcugcaauuggugcaguguuuguagacgaaaaccaauggaauagugccaaggaagcaguagaagacgaaagauucugggauuuaguacacagagaacgugaguuacauaaacagggaaaaugcgcaacaugcguauauaacaugaugggcaaacgggagaagaaauuaggagaauuuggcaaagcuaaggggucucgagcuauaugguacauguggcuaggagcacguuucuuagaguuugaagcauugggcuuuaugaacgaagaucauugguucucgagagaaaacucacuuucagggguagaaggcgagggauugcauaaauuaggauacauccugagagauauuucuaaaauaccaggugguaauauguaugccgaugacacggcaggaugggacacacgcaucacagaggaugauuuacaaaacgaagcuaaaauuacugauauuauggagccggagcaugcauuauuagcuaaaucaauuuuuaaauuaacuuaccagaauaaaguuguaaggguacaaagaccagccaaaaaugguacggugauggacguuauuucaagacgagaucaacgcggauccgggcaaguagguacuuauggccuaaauacauuuacuaauauggaagcacaauuaauacggcaaauggagucugaaggcauauucucgccgucagaauuagaaacgcccaaccuggccggucgcguccuugauugguuagaaaaacaugguguagagcgacuaaagcggauggcuauuagcggugaugacuguguaguaaaaccaauagaugacagauucgccacggcauuaacggcccucaacgacauggguaaaguccgaaaagacaucccucaaugggaacccuccaaaggcuggaacgacuggcaacaaguacccuucugcucccaccauuuucaucagcuaauuaugaaagacggaagggaaauagucguuccuugucguaaccaagaugagcuuguaggacgagcgagaguuagccagggcgcaggauggucguugagggaaaccgcgugccuaggcaaaagcuaugcgcagauguggcaacuuauguauuuucaccgacgagaucuacgucuugcugcuaacgcaaucuguuccgcaguaccaguugauugggucccuacuucucguacaaccuggucaauccaugcacaucaucaauggaugacgacagaagauaugcucaguguauggaaucggguauggauugaagagaaucccuggauggaggacaaaacacacguaaguucguggggcgacguuccguaccuaggaaagagggaagaucaaugguguggcucacuaauaggucuaacagcgcgagcaacgugggcuaccaauauucaaguugcuauaaaucaaguucgaagacuacuggguaacgaaaauuaucuggauuauaugacuucuaugaaaagauuuaaaaaugaaucugauccggaaggggcuuuaugguaa

SEQ ID NO: 21913 - RNA, 9879 nt, Artificial Sequence
  derived and/or modified CDS sequence (opt6) from DENV-1__EU482810__SS-prME
ucgguuacaauguuacugauguuaaugccaacagcacuagcauuucauuugacaacaagaggaggagagccacauaugaucguaucgaaacaagaaagaggaaaaagccuacuuuucaaaacaagcgcaggcgugaacauguguacgcuuauugcaauggacuuaggugaauuuugugaagauacuaugacauauaaauguccgagaauaacggaggcagagccagaugauguggacuguuggugcaacgcaacagauacauggguuacguauggaaccuguagucaaacgggggaacauagaagagauaaaaggucaguagcgcuagcgccacacgucggccucggguuggaaacuagaacggaaacuuggaugagcagcgaaggcgcauggaaacaaauccaacgcguagaaacaugggcgcuaagacauccaggguucacaguaauagcauuguuucuagcucacgcaauagggacuuccauuacgcaaaaaggaauaauauuuaucuuacuuaugcuagugacucccagcauggcaaugcgcuguguggggauaggaucacgagacuuuguagaaggacugagcggagcaacaugggucgacguaguacuugaacacggaaguugcgugacaacaauggccaaagacaaaccuacuuuggauauagaauuauuaaaaacagaagucacaaacccggcaguacuaaggaaauugugcauagaagcaaaaauaucaaauaccacaaccgacagucgaugcccaacacaaggagaagccacauugguugaagaacaagacgcaaauuucguaugcagacgaacauuuguagauagaggauggggaaaugguugugguuuguucggcaaagggucauugauuacuugugcuaaauucaaauguguuacaaaauuggagggaaaaauaguacaauaugaaaaucucaaauauagugucauaguuacuguacauacaggagaucaacaucaaguaggaaacgaaaguacagaacauggaaccacagcaacgauaacaccacaagcucccucuaccgagauacaauugacggauuauggcgcauuaacccuagauuguagcccgcgaacuggucuggacuuuaaugaaaugguacuacugacuaugaaagagaaaucgugguugguacauaaacaaugguuuuuagaucugccguuaccauggaccucaggagcaucuacgagucaagaaacauggaacaggcaagaucuucugguuaccuucaaaacugcacaugcaaagaaacaagaagucgucguguuaggcucacaagagggagcuaugcauacagcguuaacgggagcaacagagauacaaacuucaggaacuacuacuauauuugcaggacaucucaaauguagacugaagauggauaaauuaacacuuaaaggcaugaguuacguuauguguacugggucguuuaaauuggaaaaagaggucgcagaaacccagcauggcacaguccuugugcaaaucaaauaugaagggacugaugcgcccuguaaaauaccguuuuccacccaagacgaaaaaggugucacucaaaacgggcgauugauuaccgcaaaccccauaguuacggauaaagaaaaaccagucaacaucgaagcugaaccuccauuuggugaaucguauauagucaucggagcuggagagaaagcauuaaaacugaguugguuuaaaaagggauccucuauuggaaaaauguuugaagcuacagcuagaggggcccgucgaauggcgauacucggcgauacugcuugggacuucgggaguaucgggggaguuuuuacaucuguagguaaguuaguacaucaaauuuuuggcaccgcauacgguguccuguuuuccggcguaaguuggacgaugaaaaucggaaucggaguauuauuaacaugguuagguuuaaauucaagauccaccucauuaagcaugacuuguauugccguuggacucguuacacuauauuuaggugucaugguacaagcagacucagguuguguaauaaacuggaaaggcagagaacucaaaugugguuccgggaucuuuguaacuaaugaagugcauaccuggacagaacaauacaaauuucaggcugacucgccuaagaggcuaagcgcugcaauaggcaaagccugggaggaaggagucuguggaauacgaagcgcgacuaggcuugagaacauaauguggaagcaaauaucaaaugaacuuaaccauauacuauuggaaaacgauaugaaacuaacaguuguugucggagauguggcgggaauuuuggcccaaggcaaaaagaugauucgaccacaaccaauggaauacaaauacaguuggaaaagcuggggcaaagcgaaaauaaucggagcagacguacaaaauaccaccuucauuauugacggaccaaauaccccggaaugcccagaugaccaaagagcuuggaauauaugggaaguagaggacuauggauucggaauauuuaccacuaauauuugguuaaaauugagggauucuuauacacaaaugugcgaucauagacugaugucagcugccaucaaagauucaaaagcaguccacgcagauaugggauauuggauagaaucagagaaaaaugaaacuuggaaacuagcuagagcaaguuucauugagguaaaaaccugcaucuggccaaaaagucacacacuauggagcaaugguguauuagaaucagaaaugauaauacccaagauauaugguggaccaauuagucaacauaauuauagaccaggcuacuuuacccaaaccgcuggcccuuggcauuugggaaaacuggagcuagauuuugaucuaugugaaggaacaaccguugucguagaugaacauugcggcaaccgggguccgaguuuaagaacgacuaccguaacagguaaaauaauacaugagugguguugucgaucguguacuuuaccgccauuaagauuuaagggcgaggacggaugcugguauggcauggaaaucagaccaguaaaagaaaaagaagaaaaucuaguuaaaaguaugguaucagcuggcuccggugaaguagauucuuuuagcuuaggacuguuauguaucagcauaaugauagaggaagucaugcguucacgguggucucgaaaaaugcuaaugacuggcacgcuugcggucuucuucuuacuaauaaugggacaacugacauggaacgauuuaauacgacucugcauaaugguaggagcuaaugcaagugacagaaugggcauggguacaacauaccucgcccugauggcaacuuucaaaaugcguccuauguuugcugucggccuauuauuuagaaggcucacuagccgcgaaguucuacuucuuacgaucggacuaagccugguugcaagcguagaguuaccaaauagccuugaggagcucggcgacgggcuugcaauggggauaaugauacucaaacuguuaacugauuuucaaucgcaucaauuaugggcuacccucuuaaguaugacguuuauucgcaccacauuuuccuuacauuaugccuggaaaacuauggcuaugguuuugucaaucgucucgcuauucccauuauguuuaucuacaaccucucagaaaacaacauggcuuccuguucuucuagguucauuggggugcaaaccgcucacuauguucuugauagcagagaauaaaaucuggggccgcaagaguuggcccuuaaaugaagguauuauggcgguagguauaguaaguauacuacuaucgucauuauugaaaaaugacguaccacuagccggaccacucauagcaggaggaaugcuaauugccugcuacguuauuucagguagcucggcagacuuaagccuugaaaaggcagcugaaguuucaugggaagaagaagcagaacauucuggagccucacacaacauauugguggaaguacaggaugaugggaccaugaaaauuaaagaugaagaacgugaugacacacuuacaauacuucucaaagcuacauuacuagcagucucugguguuuauccuuuaucgauuccugcgacucucuuuguaugguauuuuuggcagaagaagaaacaacgaaguggaguccuuugggauacuccgaguccaccugagguccaaagagcaguguuagaugacgggauuuaucgaaucaugcagcguggacucuuaggaaggucacagguaggaguggguguauuucaagaaaaugucuuucauacuauguggcacgucacuagaggagcaguucuuauguaccaaggaaaacgauuagagccuagcugggcuucaguuaagaaggacuuaauuagcuaugguggcggguggcgccugcaaggaagcuggaauacaggagaggaaguacaaguaauagcaguggaaccaggcaaaaaucccaaaaauguacaaaccgcaccgggaacauucaaaacgagcgagggggagguuggugcuaucgcauuagauuuuaagcccgggacaucaggaagccccaucguuaaccgcgaagguaaaaucguaggucuauauggaaauggaguggucacaacgucagguacauacguuucagcaaucgcgcaggcgaaggcaagccaagaaggaccuuugcccgagaucgaagacgagguauuuaggaagagaaauuugacgauaauggaccugcauccaggauccgguaaaacaagaagauaccugccagcuauuguacgagaagcaauaaaacguaaacuucgaacucuaauucuagcaccaaccagggugguagcuucagaaauggcagaagcucucaaaggaaugccuauuagguaucaaaccacagcaguaaagagugagcacacaggaaaagaaauagucgaccuuaugugucaugcuaccuuuacgaugcgauugcuuaguccuguacgaguaccaaauuauaauaugauaauaauggacgaggcccauuuuacugauccauccagcauugccgcaagaggguauauaaguacuagagugggaaugggggaggccgcagcaauauucaugacugcgacacccccagguaguguugaggcauuuccacaguccaaugcugucauccaagaugaagaaagagacauuccagaacguucuuggaacucaggauaugaguggaucacagauuuccccggaaagacagucugguuugugccuaguaucaaaagugguaaugacauugcgaauugucuaaggaaaaaugguaaacgugugauucaacucagcagaaagaccuuugacacagaauaccagaaaacgaaaaauaaugauugggauuacguaguuacgaccgauauaucagagaugggugcaaauuuucgagcggaucgaguuauagaucccagaagaugucuaaaaccaguaauuuugaaagacgguccugaacgugugauacuagcugggccaaugccagucacgguagcuucugcagcacaacguagaggccgaauuggaagaaaucacaauaaagaaggugaucaauauauuuauauggggcaaccccugaauaacgaugaggaucaugcacacuggacagaagcaaaaaugcuccuagacaacauuaauacaccggagggaauuauaccagcucuauuugaaccagagcgagaaaagucagcugcuauagauggagaauacagacugagaggcgaagcgcgcaaaacuuucguagaacuaaugagacgaggagauuuaccugucuggcuaucacauaaaguagcaucggagggguuucaauauagugaccgccguuggugcuuugauggugaaagaaauaaccaagucuuggaagaaaauauggauguugaaauauggacaaaggaaggagagcguaagaaauugcgcccuagaugguuagaugcaagaaccuauucggauccgcuggcauugcgcgaguuuaaggaguuugcugcuggcagaagaagugugaguggagaucugauuuuggagauaggcaaacuaccucaacaucucacucaaagagcgcaaaaugcacuagauaacuuaguaaugcugcauaauagugaacaagguggacgugcuuauagacacgccauggaggaacuaccagauacgauagaaacuuuaauguuguuagcuuuaauagccguucugacugguggaguuacguuguucuuuuugucuggacgaggucuagggaaaacauccaucggacuacuaugcguuauggcuucaagugucuuacuuuggauggcauccguagaaccacacuggauugcugccucaaucauucuagaguucuuuuuaaugguacuacuaaucccggaaccggacaggcagagaacaccacaagauaaccagcuggcuuacguaguuaucgguuuauuauuuaugauacuaacaguagcggccaaugaaaugggucugcuagagacuaccaagaaagaucuggguauaggucauguugcuguagaaaaccaucaucacgcugcuaugcucgauguagacuugcauccagcuagcgcauggacgcuauaugcugucgcaacaacaauaauaacaccgaugaugcggcacacuauagaaaacacaacagcuaauauaagucuaacggcaauagcgaaucaagcagcaauauuaauggguuuagauaaaggcuggccgauaagcaagauggauauaggaguuccuuuauuggcacuaggaugcuauucacaaguaaacccgcuaacucucacugcugcuguacuaaugcuaguggcacacuaugccauaaucggucccggccuacaggcaaaagcgacaagagaagcgcaaaagagaacugcagcugguauuaugaagaauccaacaguagaugggauagucgccauagaucuugacccgguuguauaugacgcaaaauucgaaaaacagcuugggcagauuaugcuucuuauucuaugcacuucccaaauuuuacucaugaggacgacaugggcccuaugcgaauccaucacucucgccacaggcccucuuacaacucucugggaagguucgcccgguaaauuuuggaauacuacaauagcaguaucaauggcaaacauauuuagaggaucuuaucuugcuggagcuggauuagcauuuucuuugaugaaaucacuaggggguucccgaagaggaacuggugcccaaggagaaaccuugggggagaaguggaagagacaacuuaaucaauugagcaaaucagaauuuaauacauauaaacguucagguaucauggagguagauaggucagaagcaaaagaagguuugaaaaggggagaaacaacaaaacacgcgguaucaagaggaacugcuaaacucagaugguuuguagagcgcaauuugguuaagccugaagguaaaguaaucgauuugggcugcggaagagguggauggaguuacuacugcgcuggauuaaagaaaguaacugagguaaaaggauauacgaaaggcggaccgggacacgaggagccaauuccgauggcgacguacgguuggaaccuagugaaacuacacucaggaaaggacguauucuuuauaccuccugaaaaaugugauacgcugcugugugauauaggagaaucuucaccaaaccccaccauagaagaagguaggacauugcgaguauugaaaaugguagaaccaugguuaaggggaaaucaauuuuguauaaaaauacuuaacccguauaugccgaguguaguggaaacguuagaacaaaugcagagaaaacauggcggaaugcucguaagaaauccauugucgcggaacagcacacaugaaauguauuggguaucuugcggaaccgguaacaucguuuccgcuguaaauaugacaucaagaauguuauugaauagauucacaauggcucauagaaaaccgacauaugagagagauguggaccuuggcgcuggaacucggcauguagccguugagccggaaguagcaaacuuagacauaauaggacaacgaauagaaaauaucaaacaugaacauaagucgacguggcauuaugaugaagacaaucccuacaaaacaugggcuuaucacgguucuuacgaagucaaaccguccgguagcgccucaucaauggugaauggaguuguuaagcucuuaacgaagccaugggacguaauacccaugguuacacaaauagcuaugacagacacgacacccuuuggccaacaaaggguauuuaaggagaagguagauacgaggacuccgaaagccaaacgaggaacagcacaaaucauggaaguaacagcuaaauggcuguggggcuuuuugucgagaaacaagaaaccccggauuuguacuagagaagaauuuacacgaaaaguacgcucaaaugcagcaauuggugcuguauuuguagaugagaaucaguggaacuccgcaaaagaagcuguagaggaugaaagauuuugggaccuuguacacagagaaagagaguuacauaaacaaggaaaaugugcgacaugcguguauaauaugauggguaaacgagagaagaaacucggagaguuugguaaagcaaaagguuccagagccauaugguacauguggcuaggagccagguuucuugaauuugaagcauugggauucaugaaugaggaucauugguucaguagagaaaauaguuuaaguggugucgaaggagagggcuugcacaaacuuggcuacauucuucgugauauuucuaaaauaccgggaggcaauauguaugcagaugauacugcugggugggauacucguauuacagaggacgaucuucagaaugaagcgaaaaucacagauaucauggagccagaacaugcacuccuugccaagagcauauucaaguugaccuaccaaaacaaggucguccguguacaaagacccgcuaaaaauggaacuguaauggacgucauaaguagacgugaccagcgcgguaguggucaagucggaaccuauggucuaaauacauuuacgaauauggaagcacagcuuauacgucagauggaaagugagggcauauuuucaccaucagaauuagauacuccuaaucucgcgggcagaguucuugauuggcuagaaaaacauggaguagaacguuuaaaaagaauggcaauuuccggagaugauugcguugucaaacccaucgacgacagauuugcgacggcucucacugcacugaacgacaugggaaaaguacgaaaagauaucccacaaugggaaccuagcaaagguuggaacgacuggcaacagguaccauuuugcucgcaccauuuucaucaacugauuaugaaagaugggagagagauagucgucccauguagaaaccaagaugaauugguaggucgcgcgaggguuucacaaggagccggauggucacuaagagagacggccugccugggaaagucuuacgcgcaaauguggcaacuaauguauuuccaucggcgggaucuaaggcucgcugcuaacgcuauaugcucagccguuccagucgauugggugcccacgucaagaacaacguggucuauacacgcccaucaccaauggaugacaacggaagacauguugaguguuuggaauaggguauggauugaagaaaauccguggauggaagacaaaacccauaucaguagcuggggagacguacccuacuugggaaagcgagaggaccaauggugugguucauuaauuggucuaaccgcccgagcuacuugggcgacaaauauacaaguggcgaucaaucaagugagaagauuauuaggaaaugagaacuaccuagauuacaugacaucuaugaaaagauucaaaaacgagucuggacccgaaggagccuugugguaa

SEQ ID NO: 21914 - RNA, 9879 nt, Artificial Sequence
  derived and/or modified CDS sequence (opt6) from DENV-1__EU482811__SS-prME
aguguaacaaugcuauugaugcuaaugccaacugcguuagcguuccauuugacuacaagaggaggagaaccccauaugaucgucucuaaacaagaaagagggaagucauuauuauuuaaaacauccgccggaguaaauaugugcacauugauagcaauggacuugggugaauuaugcgaagauacaaugacauauaaauguccgcguaucacagaagcagaaccugacgacguagauugcugguguaaugcuacggacacgugggucacauauggaacaugcucucaaaccggagaacauagaagagagaaaagaucaguugcgcucgcaccccaugugggauuaggacuagaaacuagaacagaaacuuggaugucgucagaaggagcuuggaaacaaauacagagaguagaaacaugggcgcuaagacauccuggauucacugugauagcgcuauuccuggcgcacgccauagguacaucaauuacccagaaaggaauaauuuucauacuccuaauguuagugacaccaucgauggcuaugcgauguguaggcauagguucgagagauuucguagaaggcuuaaguggagcgaccuggguagauguaguauuggaacacggcucaugugugacuaccauggcgaaagauaaaccgacauuagauauugaauuacuuaaaacugaaguuacaaacccugccguuuugagaaaauuaugcaucgaagcgaaaaucuccaacacuacuacagacagcagauguccuacacaaggggaagccaccuuaguggaagaacaagacgcuaacuuuguaugccgucgcacuuucguagaccgcggcugggguaaugguuguggcuuauucgggaaaggcagucuacugacaugcgcuaaguuuaaaugcguaacuaaacucgaagggaagauuguccaauaugaaaacuuaaaguauucaguaauugucacuguacauacaggggaccagcaucaaguagguaaugaaaguaccgaacaugguacaaccgcaaccauaacaccacaggcucccacuacagagauccagcuuacagacuacggcgcacuuacccuugauugcucuccacgaacuggcuuagauuuuaacgaaaugguacuucugacuaugaaagaaaagucuugguuggugcauaagcaaugguuucuugauuugccucuaccguggacgaguggagcaucuacgucucaagaaaccuggaaccggcaggacuuacucgugacuuucaaaacagcccacgcaaagaagcaagaggucguaguguuagguucacaggaaggagcaaugcacaccgcacugacaggagccacagaaauccagacuagcgguacaacgacuaucuuugccgggcaccuaaaaugccgacuaaaaauggauaaacuuacccuuaaggguaugaguuacguuaugugcaccggaaguuuuaaacuggaaaaagaaguagcugaaacucagcacggaaccgugcuagugcaaauuaaauacgagggaacagaugcaccuugcaaaauuccuuucagcacucaagacgaaaagggagucacccaaaacggacgucugaucacagccaacccaaucgucacagauaaagagaagccaguaaauauagaggccgaaccgcccuuuggugagagcuauauuguaaucggagcuggagaaaaagcucuaaaauuaucuugguucaagaaaggaucuucaaucggaaagauguuugaagcgacagcaagaggugcuagacgcauggccauuuuaggcgauacugcuugggauuuuggaucaauaggaggaguauuuacaagcguuggcaaauugguacaucaaauauucgguacagcauacggaguucuauuuucggguguaagcuggacuaugaaaauagguauaggaguacuguuaaccuggcucggacuaaacagccguagcaccucgcuaucaaugaccugcaucgcaguaggauugguaacuuuguaucuuggcgugaugguccaagcggauaguggcugcguaauaaauuggaaaggacgcgaacugaaauguggaucgggaaucuuuguaacuaacgaaguucauacauggacggaacaauacaaguuucaggccgacagucccaaaagauuaucugccgcaauaggcaaggcuugggaggaagguguguguggaauaaggucggcaacucguuuggaaaauauaauguggaaacagauaaguaacgaauugaaccauaucuuauuagaaaaugauaugaaauuuacugucgugguuggugauguugcagguauucuaguccaaggaaagaaaaugauccgcccgcaaccgauggaauauaaauacucauggaaaagcugggguaaggcgaaaauuauaggggcggacguucaaaauucaacauuuauuauagacgggccaaauacuccggaauguccagacgaucaaagggcauggaacauaugggaaguagaagauuacggguucgguauauuuacaacaaacaucuggcucaaauugcgcgacucguacacacaaguaugcgaccauagauuaaugucagcggcuaucaaggauaguaaggcuguucacgccgauaugggcuacuggauugaaucagagaaaaaugaaacuuggaaacuggcaagagcgucauuuaucgaaguuaaaacgugcauauggcccaaaucacacaccuuauggucuaaugggguucucgagagugaaaugauuauaccuaaaauacauggcggcccuauaucacagcauaauuauagaccugguuauuuuacucaaacagcgggucccuggcacuugggaaaauuggaacuagauuuugacuuaugugaaggcacuacagucguuguagaugagcacugugguaaccgcggaccuucacuuaggacuacaacugugaccggaaagauaauccaugaaugguguugcaggagcugcacucuaccaccccucagauuucgaggagaagacggauguugguaugguauggaaauuaggccagugaaagaaaaagaggagaacuuaguuaaaucgaugguuucagcaggaucgggugaaguagauuccuucucuuugggauugcucugcauaucaauaaugauagaagaaguaaugcgaucaagaugguccagaaaaaugcucaugaccgguacacucgcuguauucuuucuccuaaucaugggccaauuaaccuggaaugaccuaauaaggcuuugcauaaugguaggugcuaacgcaagugauagaauggguaugggaacuaccuacuuggcauuaauggcaacauuuaaaaugagaccaauguuugccguaggauuguuauucagaaggcuuacgucacgagaaguacuauuauuaacuauuggccuuucgcucguugcuucaguugaacugccaaacagcuuagaggaauuaggcgaugggcuagcaaugggcauaaugauuuuaaaacugcuaacagacuuucagaguuaccaacuuugggcaacauuacucagccuuacauucaucaaaacuacguuuucauuacacuaugccuggaaaaccauggccaugguauuaucgaucguaagccuauuuccgcucugucuuaguacuaccucgcagaaaacuaccuggcucccaguauuacuaggaucacuagguuguaagcccuuaacaauguuucuuaucgcagaaaacaaaaucuggggaagaaaaucguggccccuuaaugaaggcaucauggcaguugguauugucaguauacuauugagcagcuuacucaaaaaugauguuccucuagcgggcccucuaauagcgggaggaaugcuaauugcuugcuacgucauaagugguuccagcgcggacuuaucacuagaaaaggccgcagaaguuuccugggaagaagaagcugaacacuccggagcuagccacaacauuuuaguugagguccaagaugaugguacaaugaaaaucaaagacgaagaaagggacgauacucuuacuauacuauugaaagcaacacuauuggcagugucaggugucuaccccuuaucgauaccagcaacucuuuuuguguggcacuuuuggcaaaagaaaaagcaaaggagcggcguccucugggacacgccaaguccaccggagguagaacgagcuguccuagacgauggaauauacagaauuaugcaacgaggacuuuuaggccgaucacaagucggcguugggguuuuccaagaaaacguauuucacacaauguggcaugucacgcgaggagcgguacuuauguaccaagggaaaaggcuagaacccucuugggcuucagucaagaaagaucuuauuaguuacgggggaggcuggcgguuacaagguuccuggaauaccggagaagaaguucagguuaucgcagucgaaccaggaaagaaucccaaaaauguacaaacggcaccaggaacuuuuaaaacgccugagggugagguuggagcaauagcguuagacuuuaaacccgguacaaguggaaguccuauagucaaccgugaggggaaaauagucggacuguaugggaacggaguagucacaaccagcggcacauauguuucggcgauagcgcaggccaaagccagucaagaagguccucuaccagaaauagaagaugaaguauuucguaaacgaaaccuaacgauaauggacuuacacccaggaucaggaaaaacgagaagguaccuuccggcaauaguucgugaagcuaucaaacgaaagcuaagaaccuuaauccuugcucccacuagaguagucgccagcgaaauggccgaagcgcuaaaagggaugccuauacguuaucaaacgacugcggugaagagugaacacacugguaaagaaauagucgaccugaugugucacgcaaccuuuaccaugagauuauugagcccgguuagggucccaaauuauaacaugauaaucauggaugaggcccauuucacagauccaucauccauugcugcgcgaggauauaucagcacacgugugggcaugggagaggcggcagcaauuuucaugaccgcaacaccaccaggcucuauggaagccuucccgcaaagcaaugcuguaauacaagacgaagaacgugauaucccugaaagaaguuggaauaguggauaugaauggaucacugauuuuccggggaaaacaguuugguucgucccuuccaucaaagcaggcaaugacauagcuaauuguuuacgaaagaauggcaaacgaguaauucagcuaagucguaagacauucgauacagaguaucagaaaacuaagaauaaugauugggacuacgucguuacaacagacauaucggaaaugggugcuaauuucagggcagaccgcgugauugauccucgacguugucuaaagccaguaaucuuaaaagaugguccagagagaguaauuuuggccggaccaaugccgguaacaguugcaagugcugcucaacgacguggaaggauugggagaaaccacaauaaagaaggugaucaguauauauauaugggccagcccuugaauaaugaugaggaucacgcacauuggaccgaagcaaagaugcuucuagauaacauuaauacuccugaaggaauaaucccagcacuguuugaaccagaaagagagaaaucagcugcuauagauggagaauauagguuaagaggagaggcaagaaagacguucguagaacuaaugagacguggagauuuaccgguuugguuaaguuacaaaguagcgucagaagguuuucaauauucggacagacgaugguguuuugauggggaacguaauaaccaagugcuagaagaaaauauggauguagaaaucuggacaaaagagggugaaagaaagaaauuaaggccgcgcugguuagacgcaagaacauauuccgauccacuagcauuaagagaauuuaaagaguucgcugcaggaagacguucagucucaggagauuuaauccuagagauaggaaaauuaccccaacauuuaacacaaagagcccaaaaugcuuuagauaaucuagucauguuacauaauucagagcagggaggcagagcuuaccgccaugcgauggaggaacuaccagauacaauagaaacucuuauguuauuagcuuugauugcuguauuaacaggaggaguaacuuuguucuuccuaucugguaagggccuugguaagacuagcaucgggcuuuuguguguuauggcuucaaguguguuacuauggauggccucaguagaaccacauuggauagcagccucuauaauuuuagaguucuucuuaaugguacugcuuaucccggagccggaccgacaacggacaccgcaagauaaucaacuagccuauguagucauagguuuacucuucaugauacuaaccguggccgcaaacgaaauggguuuauuggaaacgacaaagaaagaucucgggauaggucacgucgccguagagaaucaucaccaugcagcaauguuagauguggaccugcaucccgcaucggcuuggaccuuauaugcaguugcuacaacgauaauuacccccaugaugagacacacuauugaaaauacuacagcuaacaucagccuaacggcuauagcaaaucaagcggccauccucaugggauuagauaaaggcuggccaaucaguaaaauggauaucggagugccccuauuagcacuaggguguuacucucaaguaaacccucuaacucucacagcagcggucuuaauguuaguugcacauuacgcuauuauugggcccggguuacaagccaaagcaacgcgcgaagcccagaaacgaacugcugcaggaauaaugaaaaauccgacuauugauggcauaguugcuauagacuuggacccuguaguauacgaugcuaaguuugaaaaacaacucggacaaauaaugcuucuaauauuguguacaucacaaauacucuuaaugagaaccaccugggcacugugugaaaguauaacgcuagcaaccggaccauuaacaaccuugugggagggauccccagguaaauucuggaacacuaccaucgcuguuucgauggccaauauuuuucgaggaucauaucuggcaggggcagggcuagcauucucuuuaaugaaaucuuuaggaggaggacgacgcggcacgggugcacaaggagaaacacuuggagaaaaauggaaacgacaauugaaccaacuuucaaaaucagaauuuaacacuuacaaaagaagcggaaucauggagguggacagaucugaggcaaaagaagggcuuaaacgaggagagacaacaaagcacgcaguauccagagguacagcuaaauuacgaugguuuguggaacgaaaccuggugaaaccagaagguaagguaauugaccucggaugcgggagaggggguuggucauauuauugugcugggcuuaagaaaguaacagaagucaagggauauacuaaaggugggccuggucacgaggaaccaaucccuauggcgaccuaugguuggaaccuuguuaagcuacauucaggaaaggauguauucuuuaucccaccggaaaagugugauacuuuguugugugacauaggagaguccaguccaaauccgacuaucgaagaagggcguacauuacgaguauugaagaugguggaaccguggcuuagaggaaaccaauucugcauaaagauuuuaaacccguacaugccaucagugguggaaacacuggaacagaugcaaaggaaacauggagguauguuaguaaggaacccacuuucgcgcaauaguacgcaugaaauguacuggguaucaugugguacagggaauauugucagcgccgucaauaugacaucucgaaugcuccugaacagauuuacuauggcacauaggaaaccaacauacgaaagggacguagaucugggggcaggaacuagacacguagccguagaaccugaagucgcuaaccuugauauaauaggacaaagaauagaaaacauaaaacacgaacacaaaucgacauggcacuaugaugaggacaauccauauaaaacgugggcuuaccacgguucauaugaggugaaaccuucagggagcgcuaguaguaugguuaacgguguaguuaaacuuuuaacaaaaccuugggacguuauuccaaugguaacgcaaauugccaugacugauacaacgccauucggacaacaacgaguauuuaaggaaaaaguugacacaaggacaccaaaagcaaaacgugguacagcacaaauaauggaaguaacggcgaggugguuauggggauuuuuaagccgaaacaaaaagccaagaauuugcacacgcgaagaguucacccgaaaagugagaucuaaugcugcgauaggcgcaguauuuguagaugaaaaccaguggaacucagcuaaagaagccguagaagaugauagauuuugggacuugguucauagagaaagggaacuucauaaacaagguaaaugcgcaacguguguuuacaacaugauggggaaaagggagaagaaauuaggagaguucggaaaagcaaaaggaucgagagcuauaugguacaugugguuaggggcuagauuuuuggaauuugaggcguuaggauucaugaaugaagaccacugguucucaagagagaacucauuaucgggagucgaaggagaagggcuucacaagcugggcuauauucuuagagauauaaguaaaauacccggugguaauauguaugcugacgauaccgccggaugggauaccagaauuacagaagacgaucugcaaaaugaagcgaaaauuacagacauaauggagccagagcaugcauuacuugcgaaaaguauauuuaagcucacauaccagaauaaaguugucagaguucaaaggccggcuaaaaacgguaccguuauggauguaaucagcagacgugaucagaggggcucuggccaaguuggaaccuauggcuuaaauacauuuacgaacauggaagcacaauuaauucgacagauggaaagugaaggaauauucuuaccgaaugaacuagaaacaccuaaccuagccggacgaguuuuagacugguuagaaaaauauggaguggaacgguuaaaaaggauggcuauaucaggagaugacugugucgugaagccuauagacgauagauuugcuacagcauuaacagcccuaaaugauaugggaaaaguaagaaaagacaucccacaaugggaaccaaguaaggguuggaaugacuggcaacaaguaccuuuuugcagccaucauuuucaucagcucauuaugaaagacggaagagagaucguuguuccaugucgaaaccaagaugaauuaguagguagagcaagaguuucccaaggcgcaggcuggucgcuucgagaaacugcuugcuuaggaaaaucauaugcccaaauguggcaacuaauguauuuucaucgcagggacuuaagacucgcugcaaacgcuauauguuccgcaguuccuguugacugggucccaacaaguagaacaacguggucgauccaugcgcaucaucaauggaugaccacagaagauaugcuaucggucuggaaucgaguguggauugaagagaaucccuggauggaagacaagacacguauuucuagcugggaagauguaccauaucugggaaaaagagaagaucaaugguguggcagcuuaaucggauuaacugcaagagcaacaugggccacaaauauucagguugcuauaaaccaagugaggagauuaauuggcaaugaaaauuacagugauuacaugaccaguaugaagcgauucaaaaaugagucagaaccagagggagcuuuaugguaa

SEQ ID NO: 21915 - RNA, 9879 nt, Artificial Sequence
  derived and/or modified CDS sequence (opt6) from DENV-1__EU482812__SS-prME
ucggugacgaugcuacuaaugcuuaugccaacggcacuugcuuuucauuuaacaacacguggaggggagccacauaugauaguaagcaaacaagagcgugggaaaucuuuacuauuuaaaacaucggcaggcguaaauaugugcacuuuaauagcaauggaucuuggggaauuaugugaagauacaaugacauauaaaugcccaagaaucacagaaacggaaccagaugacguggauugcugguguaaugcaacagacacaugggugacauauggaacauguucucaaacuggagaacauagaagagauaaaagaucgguagcccuagcuccucauguagggcuaggacuagaaacucgaacagaaacguggauguccucugaaggagcauggaaacaaauucaacggguugaaacuugggcacuccgacacccaggauuuacagugauugccuuauuuuuagcccacgcaauugggacaucuauuacacagaaaggcauaauuuuuauuuugcuuaugcuaguaacaccaaguauggcuaugagaugcguuggaaucggaagucgagacuuugucgaaggacuaucaggagcaacuuggguagauguaguacuugaacauggcaguuguguuacuacaauggcaaaggauaaacccacucuagacauugaacuucuuaaaacugagguuaccaacccggcugugcuaagaaagcuaugcaucgaagcgaaaauaaguaauacaacuacagacucaagauguccaacucaaggagaagcuacucuuguagaggaacaagacgcaaauuuuguuuguagaaggacguuuguagaucguggcuggggaaacggcugcggcuuguuugguaaaggaucucuaauuacaugcgcgaaauuuaaguguguaaccaagcuggaagggaagauuguucaguacgagaacuuaaaguauucaguaauuguuacggugcauacuggagaucaacaccaaguagggaaugaaaguacagaacaugguacuacagcuacaauuacaccgcaggcuccgacgacagagauacaacucacagauuacggagcauuaacucuugauuguaguccgagaacuggucucgacuucaacgagauggucuuauuaacuaugaaagagaaaaguuggcuuguacacaagcaaugguuuuuggaccucccuuuaccauggacuucaggagccucuaccagucaggaaacauggaacaggcaagaccuauuaguuacauuuaagaccgcccaugcaaagaagcaagaaguuguaguacuaggaucacaagaaggugcuaugcacacugcacugacaggagcgacggaaauacagacaagugguaccacgaccauuuucgccgggcaucuuaaaugucgguuaaaaauggauaaauuaacacuaaaagguaugagcuauguuaugugcacaggaucguucaaauuggaaaaggagguagcugaaacgcaacaugguacaguguuagugcaaauuaaauacgaaggaacugaugcaccauguaaaauaccauucagcacgcaagaugagaaaggagcuacucaaaacggaagguugauaacagcaaauccgauaguaaccgauaaagaaaaaccagugaauauagaagccgaaccaccuuucggcgaauccuacaucguuauaggagcaggagaaaaagcgcugaaacuuagcugguuuaagaaagguucaagcauaggaaagauguuugaagccacagcaaggggagcucguagaauggcuauauuaggagacacagcaugggacuuuggcaguauaggagguguguuuacgagugucggaaaauuaguacaucaaauauuugggaccgccuauggaguacuauucucuggugugucauggacaaugaagauaggaauagggguucuacuaacauggcucggauugaauagucgcagcaccucacuaaguaugacuuguauugcgguaggauuaguuacauuauauuuaggugugaugguucaagcggauucugguuguguaauuaauuggaaaggaagagaguuaaaaugcggaucggggauauucgugaccaacgaggugcacaccuggaccgagcaauacaaauuccaggcugauucaccaaagagacugagcgcggcgauagggaaggcaugggaggaaggggucugcggaauaaggagcgcaacgagacucgagaacauaauguggaagcaaauauccaacgagcucaaucauauccuguuagaaaaugacaugaaauucacuguggugguaggagacguugcaggaauacuugcacaaggcaagaaaaugauucguccacaaccaauggaauacaaauauaguuggaaaucauggggaaaagcuaaaauaauuggugcagauguacagaacacuacguucauuauugauggaccuaacacaccagaauguccagacgaccaacgggccuggaacauuugggaaguugaagauuacggauuuggaauuuuuaccacaaauaucuggcuaaagcuaagagauucauauacacagguaugugaccauaggcuuaugucggccgcaauaaaagauucgaaggccguacaugcagacaugggguauuggauugaaagugagaagaaugaaacauggaaacuagcaagagccaguuuuauagaaguaaagacgugcauauggcccaaaucgcacacacuuuggucuaacgguguauuagaaagugaaaugauaauaccuaaaauuuacggaggaccgauuagucaacauaauuauagaccgggguauuuuacucaaacagcaggcccauggcauuuagggaaauuagagcuagauuucgaucuuugugaagggacgacagucguaguggacgaacacugugguaaucgagggccaucauuaagaaccacuacagugacaggaaaaauaauucaugaauggugcugcagaagcuguacauuaccaccacucagguuccgcggugaagauggauguugguauggaauggaaauuagaccaguaaaagaaaaagaggaaaauuuaguaaagucgauggugucagcugggaguggagaaguugauaguuuuucgcucggccuguuauguaucagcaucaugauagaagaagugaugagaucaagauggucacgaaaaauguuaaugacaggcacgcuagcagucuucuuuuuacucauaaugggacaguugacauggaacgauuuaauuagacuguguauaauggugggagcuaacgcgucagacagaaugggaauggggacuacauacuuggcucuuauggcaacauucaagaugagacccauguucgcgguagguuuauuauuucgacgcuuaaccuccagggaaguacuucuucuaacuaucggucugaguuuagucgcaucagucgaacuacccaauagucuagaagaacuuggcgacggacucgcaaugggaauaaugaucuugaagcuccuaacggauuuccaaucucaccaacuaugggcaacucuacuaagucuaaccuucauuaaaaccacauuuagccuucauuaugcauggaaaacgauggcgaugguacuaagcauuguuagcuuauucccacuaugucuaaguacaaccagccagaaaacgacauggcuuccuguguuguuaggaucacuuggcugcaaaccauuaacaauguuucuuaucgcugaaaauaagauauggggccguagaagcuggccguugaaugaagggauaauggcuguuggaauugugucuauauuacuaagcucauugcugaaaaaugacgucccacuggcagguccuuuaaucgcaggagguauguuaaucgcuuguuauguaauuucuggaucuagugcagaucucagucucgagaaggcagcagaagugucaugggaagaagaggcagagcauuccggggcuagucauaauauucuuguagaagugcaagaugauggaacaaugaaaauaaaagacgaagaacgggacgauacauuaacuauucuguuaaaagcgacguuguuagcaguaucuggagucuaucccuuaucgauuccggcaacucuuuucguuugguauuuuuggcaaaagaagaaacaacgguccggaguauugugggauacaccgaguccgccagagguugaacgugcuguuuuagaugauggcauuuaucgaauaaugcagagagggcuauuaggaagaucacaagugggagugggcgucuuucaggaaaacguauuccauacaauguggcacguuacgcggggagcaguguuaauguaucagggcaagagauuagagccuucaugggcgucggugaagaaagacuugauaagcuacggaggaggcuggcgcuuacagggaaguuggaauacuggugaagagguccagguaauagcugucgaacccgguaaaaacccgaagaauguacaaacagcuccugguacauuuaaaaccccggaaggggaagugggcgcaauagcccucgacuucaagccugguacaucgggauccccaauugucaaccgcgaagggaagauugugggacucuaugguaauggugugguaacaaccagcgguacauacguuucggcuauugcacaagccaaagccucgcaagagggcccucuccccgaaaucgaagacgagguauuccgcaagcggaaucuaacuaucauggauuuacauccggggucggguaaaacgcgacgcuaccucccagcaaucguaagagaagcaauaaaacggaaauuacguacauuaauacuagcgcccacgcgagugguagccuccgaaauggcugaagcgcugaaaggaaugcccauacgauaccaaacuacugccguaaaaagugaacacacuggaaaggagauuguagauuuaaugugccacgcuacauuuacuaugagauuacuuucgcccguaagggucccaaauuacaauaugauaauaauggacgaagcgcacuucacagaccccucuucgauagcagcaagaggauauaucaguacuaggguagguaugggugaagcagccgccaucuuuaugaccgcaaccccacccggaaguguagaagcauuuccacaaucaaacgcgguaauucaagacgaagaaagagacauuccugaaagaucauggaauagcggauacgaauggauaacggauuuuccagguaagacugugugguuuguacccucaauuaagagcggcaacgacauagcuaacugccuacgcaaaaaugguaaacgaguaauucaguugucgcguaaaaccuuugauacagaauaccagaaaacuaaaaacaaugauugggauuacguagucaccacugauauuucagaaaugggagcaaacuuuagggcugauagaguuauagacccccgcagaugucugaaaccgguaauacuaaaggauggacccgagagaguuauacuagcaggucccaugccaguaacgguugcuucggcagcacaaagaagaggcaggauaggaagaaaucauaacaaagagggugaucaauauaucuauauggggcaaccauugaacaaugaugaagaccaugcacacuggaccgaagcuaaaauguuauuagacaacauaaacacucccgaaggcauaauuccugccuuauucgagccagaaagagaaaagucugcagcuaucgacggggaauauagacuacguggagaagcaagaaaaacauuuguagagcuuaugaggaggggugaucuaccaguaugguugucauauaaaguugcauccgagggauuccaauacuccgaucgucgaugguguuuugauggagagaggaacaaccaaguguuagaagaaaauauggauguggaaauauggacaaaagaaggggagcguaaaaagcuccggccuagaugguuggaugcaagaaccuauucagacccucuugcacugcgugaauuuaaagaauuugcagcagguagaagaagugucaguggagaucuuauccuagaaauagggaaauuaccccaacaucuaacacaaagagcgcaaaaugcauuagauaauuuagucaugcuucauaacuccgagcaaggcggacgagcauaccgacacgccauggaagaacucccagacacgaucgaaacacugauguuacuugcacuaauagccguuuuaaccgguggcgugacauuguucuuucugaguggaaggggucuugguaaaacaaguauuggacuacuguguguaauggcuucaucuguauuacuuuggauggcgucaguagagccucauuggauugcggcaucuauaauucuagaguucuuuuugaugguucuucuaauuccagaaccugaucgacaaagaaccccucaagacaaccaauuggcauacguaguaauaggucugcuauuuaugauauuaacaguagcggcuaaugaaaugggacuguuagaaacaaccaaaaaggaccuagggauuggacauguggccguagaaaaucaucaccaugcggccauguuagacguggacuuacauccugcaucagcuuggacucuuuacgcagucgcgacaacaauuauaaccccaaugaugcgccauacaauagaaaacaccacggcaaacauaucccuaacagcuauagcuaaccaagcagcgauuuugaugggauuagacaaagguuggcccaucucgaaaauggauaucggaguuccacucuuagcuuuaggauguuauucgcaaguuaauccgcuuacuuugacggcugccguacuaaugcuggucgcccacuaugcaauaauuggaccaggacuccaggcuaaagcaacacgggaagcacagaaaaggacugcagcagguauaaugaagaacccuacaguagauggaauaguugccauagaccuggacccggucguguaugaugcaaaauuugagaaacagcuugggcagaucaugcuccugauacuaugcaccagucaaauacuucuuaugagaacgacaugggcucuaugugaaucaauaacauuagcuaccgguccccuuacuacucuuugggaggguucaccaggcaaauucuggaacaccacaauugcagugucuauggcaaacauuuuucgugggucuuaucucgcgggggcaggacucgccuuuaguuuaaugaaaucauuaggagggggaaggcggggcacaggugcucagggcgaaacuuuaggggagaaauggaaacgccaacuaaaucaguuaucaaagucugaauuuaacacauauaagcgaagcggaauaauggaaguggauaggucagaagccaaagagggacuuaaaaggggagagacaacaaaacacgcaguaaguagggguaccgcaaaacuacguugguucguagaaaggaaucuaguuaaaccagaagguaaaguaauugacuugggcuguggaagggguggauggucguacuauugugcaggccuaaagaagguaacugaagucaagggauacacuaaaggaggcccaggucacgaagaacccauaccaauggcuacauacgguuggaaccugguaaaauuacauucaggaaaagauguauucuucauaccgccggaaaaaugugacacauuacuaugugauauuggagaaagcucaccgaauccgacuaucgaagaaggucgaaccuuacgcguacucaaaaugguagagccuugguuaagaggaaaucaauuuuguauaaaaauacucaauccauauaugccuucggucguugaaacauuagaacaaaugcagaggaaacaugguggaauguugguuagaaauccacucagcagaaacaguacgcaugaaauguacuggguaaguuguggaacgggaaauauaguaucagcgguaaauaugacauccagaaugcuacucaauagauuuacgauggcccacaggaaaccgacauacgaaagagacguagauuugggagcagguacccggcacguugcugucgaaccugaagucgccaaucuugauauuauaggacaaagaauugaaaauaucaaacacgaacauaaaucaacauggcacuaugaugaagacaacccauacaagacuugggcuuaucacggaagcuaugagguuaagccaucugggucugcgagcaguaugguuaaugguguaguuaaacuacucacgaagcccugggacgugauuccaauggugacacaaauagcuaugacagauacgacgccauuuggucaacaacgggucuucaaggaaaaagucgacacuagaacaccuaaggcaaaacggggcacagcucagauaauggaagucacagcgaaauggcucuggggauuucucagucguaacaagaaaccuagaauaugcacccgcgaagaauuuacuagaaagguaaggaguaaugcugcaauaggcgcaguuuucguggaugaaaaccaauggaacuccgcgaaagaagccguugaagaugaaagauuuugggaccuuguccacagagaaagggaguuacacaaacaggguaaaugugcuacauguguauauaauaugaugggaaagagagagaagaaacuuggagaguuuggaaaagcgaaaggaucaagagcuauaugguacaugugguuaggagcacguuuccucgaauuugaagcgcuuggauuuaugaacgaggaucacugguuuaguagggaaaauucacuuagcggaguagaaggagaaggccuccauaaguuaggguacauucuuagggauaucucaaagaucccaggggguaauauguaugcagacgacacggcuggaugggauacaaggauaacagaagaugaucuucaaaaugaagcacgcauuaccgauauaauggaaccugaacacgcgcuacucgccaaaaguauauucaaacuuacauaccaaaauaaggugguaagaguccaacgaccagccaaaaaugguacagugauggauguaauaucuaggcgagaucagcgagguaguggccaagugggaacguauggacugaacacauuuaccaauauggaagcucaacuaauccgacaaauggaaucggaaggaauauuuucaccgucggaauuggaaaccccuaacuuagcagaaaggguucuugauugguuagaaaaauauggugucgaaagguuaaaacgcauggcuauuaguggagaugauugcguaguaaagccgauugaugauagauucgcgaccgcgcuuacugcacuaaaugacaugggaaagguaaggaaagacaucccucagugggaacccucaaaggguuggaaugacuggcaacaaguuccauucugcucucaccauuuucaucaacuaauaaugaaagauggaagagaaauaguagugccaugucgaaaucaagaugaacucguuggccgagcucgcguaucacaaggagcaggauggucauuacgagagacggcaugucuugguaaaucauaugcacaaauguggcaacugauguacuuucaccgaagagaccuccgacuugcagcaaaugcgauaugcucagccguuccaguugauuggaucccaacaaguaggacuacauggucgauccaugcacaccaucaguggaugacaacagaagauauguuaagcguguggaauagaguauggauagaagaaaauccuuggauggaagauaaaacccacauaaguuccuggggugauguacccuaccuagguaaaagagaagaucaauggugugguagccucauaggacuaacggcgagagcaacuugggcgacuaauauacaaguagcuauaaaucagguacgucggcucauugggaacgaaaacuaucucgacuacaugacgucgaugaaacgauuuaaaaaugaaagugauccugaaggugcgcugugguga

SEQ ID NO: 21916 - RNA, 9879 nt, Artificial Sequence
  derived and/or modified CDS sequence (opt6) from DENV-1__EU482813__SS-prME
ucgguuaccaugcucuugauguugaugccuacagccuuagcuuuccauuuaaccacacggggaggagaaccccauaugauuguuucuaaacaagaacgaggaaaaucauuacuauuuaagacaagugcaggagucaauauguguacccucauugcgauggaucucggggaauuuugugaagauacaaugacauauaaauguccacggauuacugaagcggaaccagacgauguggauugcuggugcaacgccacggauacguggguaaccuauggaacaugcucgcaaacaggugaacauaggcgcgauaaaagaaguguugcguuggcaccccacgugggauuaggacuagagacuagaacagaaaccuggaugagcagugagggggcauggaagcaaauccaaagaguggaaaccugggcgcuaagacauccagguuuuacggugauagcuuuauuccucgcccacgcuauagggacaucuauuacccaaaaggggaucaucuucauuuuacuaauguuagugacuccgucuauggcaaugagauguguggggaucggcucgcgagacuucguggaagguuuaaguggugcuacguggguagauguaguacuugagcauggaucgugugugacuacuauggcuaaagauaaaccgacucucgauauugagcuacuaaaaacagagguaacgaauccugcgguccugagaaaauuguguauugaagccaagauuucgaauacaacaacagacagccgauguccgacccaaggcgaagcaacuuuggucgaggaacaagaugcaaauuuuguuugccgacggacauuugucgaucggggcuggggaaacggauguggauuauucggcaaggguaguuuaauuacuugcgccaaguuuaaaugcguaacaaaguuagaagguaaaacugugcaauaugagaaucucaaauauagugucauaguuaccguucauacgggcgaucagcaucagguagguaaugaaucgacagaacauggaacaacggcaaccauuacaccccaagcccccaguacugaaauucagcugacagauuauggugcacuuacacuggacuguucaccaagaacuggauuggauuucaacgaaaugguuuuauuaacuaugaaggagaaaaguuggcuaguacauaaacaaugguucuuggaucugccguuaccauggacauccggagcgucuacaucgcaagagacguggaacagaaaggauuuacuugugacuuuuaagacggcucaugccaagaaacaagaaguagucguauugggaagccaagagggugcaaugcacacugcauuaacaggagcaacugaaauacaaaccucugguacaacuacuauauuugcaggacacuuaaagugucgucucaagauggauaaauugacucucaaaggcaugucuuaugucaugugcacggguagcuuuaagcuggaaaaggaaguagccgagacgcaacacggaacaguuuuaguacaaauuaaauacgaggggacggaugccccauguaaaauuccauuuucuacccaagaugaaaaagggguuacgcaaaacggacgcuuaauaacugcaaacccaauagugacagauaaggagaaaccgguaaacauugaagcagaaccgccguucggagaaaguuacauaguaauaggcgcuggagaagaagcucuuaaacuauccugguuuaagaaaggcaguuccaucgguaaaauguuugaagcuacagcaagaggagcacgacgaauggcgauacuaggugauacagccugggauuuuggcagcauaggcgguguauuuacaucuguuggcaaacuuguccaccaaauuuuuggaacagcauauggaguucucuuuaguggugucaguuggaccaugaaaauagguauagguguacuacuaacgugguuaggacuuaauagcagauccacaucuuuauccaugacauguaucgcagugggcuuagucacacuauacuuagguguaaugguccaagcggauucggguuguguuauaaauuggaagggacgcgaauuaaagugcggcagcggaauuuucgucacaaacgaaguccauaccuggacggagcaauauaaguuccaagcugauaguccuaagagacucuccgcugcaauugggaaggcaugggaggagggaguguguggaauaagaagcgccacacgccuagaaaacauuauguggaaacaaaucucaaacgaguugaaccauauuuuacuagaaaaugacaugaaauuuacgguugucguuggugauguagcaggaauacuagcccaaggcaagaaaaugauaagaccacaaccaauggaauacaaauacagcuggaaaucuugggguaaagcaaagauaauuggggcggauguacaaaauacuacauuuauaauugacggacccaauacgccggaauguccagacgaucaacgagcauggaauauaugggagguagaagauuauggauuugggauauuuacaacuaauauaugguuaaaacuuagagauucauauacccaaguuugugaucacagacuaaugucagcugccauaaaggauaguaaagcuguccacgcugacauggguuauuggauagaaucugagaaaaaugagacauggaaauuagccagagcaaguuuuauugagguuaaaacauguauauggccaaaaucgcacacucuuuggaguaauggcguucuagagagugaaaugauuauuccaaaaauuuacggaggcccaaucagccaacauaacuacagaccgggguauuuuacccagacugcaggaccuuggcauuuagguaaauuagaauuagacuuugaucuaugcgaggggacuaccgucgugguugacgagcacugcggcaaucgaggaccaaguuuaagaacaacuacaguaaccggaaaaaucauacaugaguggugcugcagaucgugcacccugccaccacuacgauucaaaggcgaggauggaugcugguauggaauggaaauaagaccugucaaggaaaaagaagaaaaucuaguaaaaaguaugguaucagcuggauccggagagguagauuccuucagucucggacucuuauguauaucaauuaugaucgaggaaguaaugcggucaagauggucaaggaaaauguuaaugaccggaacauuagcaguuuucuuuuuacuuauaaugggccaauuaacuuggaacgacuuaauucgauuaugcauuauggucggugcgaaugcuucagauagaaugggaaugggcacaaccuaccuugcacucauggcaacuuuuaagaugagaccaauguuugcuguugggcuucuguucagaaggcucacaagccgugagguuuuauuacuaaccaucggacuuagucuugucgcgucugucgaauugccuaauucucucgaggagcuuggcgauggccuugcuauggggauaaugauuuugaaacuuuuaacagauuuucaaagccaccaacuuugggcaacccuauugucccuaacuuuuauuaaaacaacauucucacuacauuaugcguggaaaacaauggcaaugguacugagcauaguuagucuguuuccguuaugucuaaguacaacaucgcagaaaaccacauggcuaccaguucuauuaggcaguuuaggauguaagccacuuaccauguuuuuaauagcugaaaauaaaaucuggggacgaaaaagcuggccucugaaugaaggaauaauggccgucggaauugugaguauauugcucucuucauuauugaaaaaugauguuccucucgcagggccauuaauugcaggagggaugcuuaucgcaugcuauguuauuucuggaaguucagcggacuuaagccuagagaaagcugcagaagucaguugggaagaagaagcggaacacucuggagcaucgcacaacauucuuguggaggugcaggaugauggcacuaugaagauuaaagacgaagagagagaugauacacuaacgauauugcuuaaggcuacccuauuagcgguaucaggaguuuacccgcuaaguauacccgcaacauuauuuguaugguauuucuggcagaagaagaaacaaagaaguggaguacucugggacacaccgucuccgccggaaguagaaagggcaguguuagacgacggaauuuacaggauaaugcaaagagggcucuuaggcagaucgcaaguuggaguugggguguuucaagaaaacgucuuucauacaauguggcaugucacaagaggggcgguuuuaauguaucaaggaaaaagauuagagccaaguugggcauccgucaagaaagauuugauaucauauggaggaggauggcgccuucagggaaguuggaauacaggagaagaaguucaagugauagcaguggaaccaggaaagaauccgaaaaacguucaaacagcaccagguaccuuuaagacgucagagggcgagguaggugcuaucgcccuagauuuuaaaccuggaacuuccggauccccuauaguuaauagagagggcaaaaucguaggacuauaugguaaugguguaguuacuacaucagguaccuacguuucugcaauagcccaggcaaaagcaucgcaagaagguccauuaccagaaauagaagaugaaguauuuagaaaaagaaauuuaacgauaauggaucuccauccgggcagugggaagacucgcagauaccuaccggcaauugugcgugaagcaauaaagagaaaacuucgaacuuuaauucuagcaccuacaaggguugucgcuagcgaaauggccgaagcauuaaaagggaugccgauaagguaucaaacaaccgcggugaaauccgaacacacaggaaaggaaauuguugauuugaugugucaugcuacuuuuacgaugcgucuucuuucacccguucgugucccgaacuauaacaugauaauuauggaugaagcgcauuucacugacccuaguaguauagcagcucgaggcuauaucucaacacgaguaggaaugggagaagccgcugcaauauuuaugacagcaacaccgccugguaguguagaggcuuuuccccaaucuaaugcgguuauacaagaugaggaacgagacauaccugaaagaagcuggaauagcggauaugaauggauaacagacuuuccugguaagacuguaugguuuguaccuuccauaaagucaggcaaugauauugcaaacugccuaaggaaaaacggaaaacgaguaauacaacuaucgaggaaaacguuugacacugaguaucagaagaccaaaaauaacgacugggacuauguaguaacgacggauauuucggagaugggugcuaauuuucgugcagauagaguuauagauccuagaagauguuuaaaaccggugauacuaaaggacggaccggaacgagugauauuagcaggaccuaugccggugacugucgcaagcgcagcgcaaaggcgaggcaggauuggacgaaaucauaacaaagaaggagaucaguacaucuauaugggccaaccacugaacaaugaugaggaucaugcacauuggaccgaagccaagauguuacuagauaacauaaacacgccagagggcauuauaccagcacuuuuugaaccagaacgagagaaaucagcugcaauagauggggaauaucgucugcgaggagaagcgcggaaaacguuugucgaauugaugcgccgaggggaccucccgguuuggcuuaguuacaaaguagcuucugagggauuccaguauucugaucguagguggugcuucgauggagaaagaaacaaccaaguauuggaagaaaauauggauguagaaauauggacaaaagaaggugaaaggaaaaagcuacgaccgagguggcucgacgcuaggaccuauucagaucccuuagccuuacgagaguuuaaagaauuugccgcgggaagaagaucaguaaguggugaucuuauacuagaaaucggaaaguuaccucaacauuugacacaacgagcccaaaaugcccuagauaaccuaguaaugcugcauaauucggaacaagguggacgugcuuauagacacgcaauggaagaacuucccgacacaaucgagacuuuaauguuacuggcguuaauagcaguauuaacuggcggagugacccucuucuuuuuaucagggagaggguuaggcaaaacaucaauagggcuauuaugugucauggcuuccucgguucugcuauggauggcaucugucgagccccauuggaucgcagcaagcaucaucuuggaguucuuuuuaauggugcuucuuauaccggaaccugacagacaaaggacgccacaagauaaucaauuagccuacgugguuauaggacuguuguucaugauucuuacggucgccgcaaacgaaaugggucuauuagagacaaccaaaaaggauuuaggaauugggcacguagccgucgaaaaucaucaccaugcugcuauguuagauguugaucugcacccagcgagugcuuggacuuuauacgccguugcaacgaccauaauaacaccaaugaugagacauaccauugagaacaccacugcaaauauaucccuaacagcaaucgcaaaucaagcagcuauuuuaaugggauuagauaaaggguggccuauaucaaaaauggauaucggcguuccucugcuugcccuuggcuguuacucacaagugaauccacucacguugacugcggcgguacucaugcuagucgcacauuaugcaauuauagggccuggauugcaagcgaaagcuacuagagaagcacaaaaacgaacugcagcugggauaaugaaaaauccgacuguagauggcauuguagccaucgacuuagacccaguaguauaugauacaaaguuugaaaaacaauuaggccagauaauguuauugauauuauguacgucucagauucuacuaaugagaacuacgugggcgcuaugcgaaucuauaacacuggcgacgggcccucuaacaacguugugggaaggcaguccggguaaguucuggaacacgacaaucgcgguaagcauggcaaauauauuucggggcucguauuuagcgggagcuggacuagcauucagccuaaugaaaagucuagggggagguaggcgcggcacuggcgcacagggagagacauuaggggagaaauggaaaagacaacucaaucaguuauccaagagcgaauuuaauacuuauaaaagaucagguauuauggaagucgaucguucagaggcaaaagaggggcuaaagagaggagagacaacaaaacaugcaguaaguagagggacagcaaaguuaaggugguucguugaaaggaauuuaguaaaaccagaagguaaaguuaucgauuugggguguggucgaggagguuggaguuauuauugcgcugggcuaaagaaagucaccgaggugaagggguacacgaaagggggaccaggccaugaagaaccaauuccuauggccacguacgguuggaauuuggugaagcugcacucuggaaaggauguauuuuucauaccaccugaaaaaugugacacacuauuaugugauaucggggaauccucaccuaacccuacaauugaagaagguagaacacuaagaguacugaagaugguagagccauggcuacgaggaaaucaauuuuguauaaagauauuaaauccuuauaugccgaguguaguggagacacuagaacaaaugcaaaggaagcauggagggaugcuuguaagaaacccccuuucaagaaauucgacgcaugaaauguauugggugaguugugguacagggaauauaguaucagcaguuaauaugacaucaagaaugcuauuaaaucgcuuuacgauggcccacagaaaacccacauacgaaagagauguugauuuaggagcaggcacaagacauguggcuguagagccagaaguagcaaauuuagauaucauaggccagcguauagaaaacauaaaacaugaacacaaaaguacuuggcauuaugacgaggauaauccuuacaaaacuugggcauaucaugggaguuacgaaguaaagccaucaggaucagcaucuaguauggugaacgguguuguuaagcuauuaaccaagccaugggauguaauaccgauggucacgcaaauagcuaugacagauacgacgccauuuggccaacaaaggguauuuaaagaaaaagucgacacgcgaacaccaaaagccaaaaggggaacagcacaaauaauggaaguuacagcaaaauggcuuuggggauuccugucaagaaauaagaaaccgaggauauguacacgcgaagaguucacaaggaaaguuaggucaaaugcagcaauaggcgcgguuuucguagaugaaaaucaauggaacucugcaaaagaagcuguagaagaugagagauucugggauuugguacaccgugagcgggagcuacauaagcaagggaaaugcgcaacauguguauacaauaugaugggcaaacgcgaaaagaaauugggagaauuugguaaagcaaaggggagccgagcaauaugguauauguggcuaggagccagauuccucgaauuugaggcauugggguuuaugaaugaagaucacugguucagcagagaaaacucauuaucaggaguugaaggagagggauugcauaaacuaggcuauauacuacgugacauaucgaagaucccaggugguaauauguacgccgacgacacggcaggcugggauacaagaauaacggaagaugauuugcaaaacgaagcaaaaauaacagauauuauggaaccugaacaugcauuauuggcaaaaucuauauucaaauuaacuuaucaaaauaaggucguccgagugcagcguccagccaaaaacggaacugucauggauguaauaucgagacgugaucaacgggggucuggacagguugguacuuacggcuuaaacacauuuacgaauauggaggcgcaacugauucgacaaauggaauccgagggcauauucagcccaucagaauuggaaacaccaaauuuagcuggacgcguacuagauugguuagaaaagcaugguguagaaaggcuuaaaaggauggccauuucaggcgacgacuguguuguaaaacccauugaugauagauuugcuacggcucuaacugcgcugaaugauaugggaaagguaagaaaagauaucccacaaugggaaccaaguaaaggauggaaugacuggcaacagguaccauucugcucucaccacuuucaucagcuuauaaugaaagacggaagagagaucguaguuccaugcaggaaucaggaugaauuaguggggagagcccgcgucagccaaggagcaggauggucauuaagagagacagccugucugggaaaaagcuaugcgcaaauguggcaacuaauguacuuucauagaagagauuuaaggcuugcugccaaugcgauuuguagcgcaguaccaguagauugggugccaacuagcagaacuaccuggucaauacaugcacaccaccaauggaugacaacagaagacaugcuuucgguauggaauagaguuuggauagaggaaaaucccuggauggaggauaaaacgcacauuucgaguuggggagacgugccauacuugggcaaaagagaagaucaaugguguggaucauuaauuggauugaccgcccgagcaacuugggcaacuaacauacaggucgcaaucaaccaaguccgcagauugauaggaaaugaaaauuauuuagauuauaugacaucaaugaagagauuuaaaaacgaaucagacccggaaggagcacuaugguaa

SEQ ID NO: 21917 - RNA, 9879 nt, Artificial Sequence
  derived and/or modified CDS sequence (opt6) from DENV-1__EU482814__SS-prME
ucaguaacaaugcuccuaauguuaaugccuacagcuuuagcauuccaucugacaacucgagguggagaaccacauaugauuguuucaaaacaagaaaggggaaaaucacuguuauucaaaacaagugccggcguaaacauguguacacuaauugcuauggaccuaggcgaauuuugugaagauacaaugacuuacaaauguccacgaauaacugaagcagagccugacgauguagauuguugguguaaugcuacagauacauggguuacauacggaaccuguucacagaccggcgaacauagacgugacaagaggucaguugcgcuggcuccacauguggguuuuggacuagagacccguacugaaacuuggaugucaagcgaaggcgcuuggaaacaaauccaaaggguggagacuugggcguuacgucauccgggauucacuguaaucgccuuauuccucgcacacgcuauuggaacauccauuacacaaaaaggaauuauauuuaucuuacucaugcugguaacgccuuccauggcgaugagaugugugggaauaggaucccgagacuuuguggaaggucuauccggggccacauggguagacguaguuuuagaacacggcucuuguguuacgacaauggcgaaggauaaaccuacauuagacauagaauuacuuaagacggaagucaccaacccagcaguucuaagaaaauugugcaucgaagccaaaauuucaaacacgacaacugauucaagauguccaacacagggugaagcuacucuugucgaagagcaagaugccaauuuuguguguagacgaacuuuuguagaccgugguugggggaauggguguggauuguuugggaagggcucauuaauuaccugugcgaaguuuaagugcgucacgaagcuugaagggaagacaguacaauacgagaaccuaaaguauucgguuaucguaacaguccauacgggugaccaacaucaagugggaaaugaaucuaccgagcacggaacuacagcaaccauuaccccccaagcucccucuaccgaaauacagcuaaccgauuacggcgcauugacauuagacuguucaccacgaacggguuuggauuucaaugagaugguauuguuaacgaugaaggagaagagcugguugguucacaaacaaugguuuuuagaucugccauugccauggacuaguggugcgaguacaucccaggaaacuuggaaucggaaagaccuauuagucacauuuaaaacugcccaugcgaagaaacaagaggugguaguguuaggaucucaggaaggagcaaugcauaccgcucugacuggggcuacggaaauccaaacaaguggaacgacuacaauuuuugcuggacaccuuaaauguagauuaaaaauggacaaacuaacuuugaaaggcaugucauacguaaugugcaccggaucauuuaaauuagaaaaagaaguggcagaaacacaacaugguacaguacuugugcaaauuaaauacgagggaacagacgcacccuguaaaauuccuuuuucaacgcaagaugaaaaaggaguuacucaaaauggccgucuaauuacagcaaauccuauuguaacggauaaggaaaaaccgguuaacauugaagcugagccuccuuuuggugaaucauauauagucauuggugcaggagaaaaagcguuaaagcuaagcugguucaaaaaaggcagcaguauaggcaagauguucgaagcaacggcuagaggcgcucguaggauggcgauacugggagauaccgcuugggacuuuggaucaaucggugggguauuuaccagugucgguaaguuaguucaccaaauuuuuggaacagcguacggagucuuauucucaggaguaucauggacaaugaaaaucggaauuggcgugcuccuaacauggcuuggauuaaauucccgaucgaccucgcuaaguaugaccuguaucgccguaggucugguaacacuuuaucuggggguaaugguucaggcggauucagguuguguaauuaacuggaaagggcgcgaauuaaaaugcgguucuggcauauucguuacuaaugaagugcauacuuggacagaacaauauaaauuccaagcugacucacccaaacgacuaucagcagcaauuggaaaagcgugggaggaaggagucuguggcauacguucggcaacucgucuugaaaacauaauguggaaacaaauaaguaaugaguugaaccauauacuucucgaaaacgauaugaaguucacaguaguugucggcgauguugcggguauacuagcgcaaggaaaaaaaaugauuagaccacaaccaauggaauauaaauauaguuggaaaucaugggggaaagcaaagauaaucggcgcagauguacagaauacuaccuuuauaauagacggaccgaauacacccgagugcccagaugaccagagagccuggaauauaugggaaguggaagacuacgguuucggcauuuuuacaacuaauauuuggcuaaaacuuagagacucguauacgcagguaugcgaccaucgauuaaugagcgcugcgaucaaagauaguaaagcuguccaugcagacauggguuauuggaucgaaagcgaaaaaaacgaaacguggaaacucgcucgugcgaguuuuauagaaguaaaaacauguauauggccaaagucccacacacuauggucaaauggaguauuagaaucagaaaugaucauacccaaaauuuacgggggacccauaucacaacacaacuauaggccgggauauuucacccaaacagcuggcccauggcaucugggaaaguuagaauuagauuucgauuuaugcgaaggaacaacggucguagucgacgaacacugugggaauaggggaccaucccuuaggacuaccaccguuacgggaaaaauuauccaugaauggugcugcagaucauguacgcuaccaccucuaagauuuaaaggcgaagauggauguugguacgguauggaaauaagacccguaaaagagaaggaagaaaaucucguaaaaaguauggucucagccgguagcggagaggucgacucauuuagccuuggccuuuuaugcauuucaauuaugaucgaagaagugaugcguucgagguggucaagaaaaaugcuuaugacgggaacacucgcaguguuuuuuuuguugaucauggggcaacucacauggaacgaucuaauuagacuuugcauaauggucggagccaaugcgagugauagaauggggauggguacaacauaucucgcauuaauggcaacauucaagaugcgaccaauguuugcaguaggauuacuguucaggcguuuaacuucgcgagagguacuauuacucaccauuggccuaucauuaguggcauccguggaauuaccgaacucauuggaagaacugggugaugggcuggcaaugggcaucaugauccuuaaauugcuuacugauuuccaaucgcaucaauuaugggccaccuuguuaucgcugacauuuauuaaaacaacauucagucuacauuaugcauggaaaacuauggcaaugguuuuaagcaucguaaguuuauuuccuuuaugccucuccacuaccucacaaaaaacaacuuggcucccuguguuauuagggucgcucggaugcaaaccacuaacuauguuccugauugcugaaaacaaaauaugggguagaaaaaguuggccuuuaaaugaagggauuauggcaguaggaauagugucaauucuucucucaucacuguuaaaaaacgaugugccguuagccgggccuuugauagccggugguauguuaauagcguguuacguuauuaguggcaguucugcagauuugucacuggagaaagcagcggaaguaaguugggaggaagaagccgaacauaguggcgccagccauaauauacuuguagaaguccaagacgacggaacuaugaaaaucaaagaugaagagagagacgauacauuaacaaucuuauuaaaagcgacauuauuagcgguaagcgguguuuauccacucucgauucccgcaacccuuuuuguaugguacuucuggcaaaaaaaaaaacaaaggucagguguacuuugggacaccccuucgccucccgaagucgaaagagcaguauuagacgacggaauauauagaauuaugcaaagagggcuauuaggacggucgcaagugggaguaggagucuuccaagaaaauguauuucauacuauguggcauguaacaagaggcgcuguuuuaauguaucagggaaaaagauuggagccaaguugggccucggucaaaaaagauuuaauuucauauggaggagguuggagacugcaaggaucuuggaauacaggggaggaaguacaagucaucgccguugagccuggaaaaaacccaaagaauguucaaaccgcgcccgggacauuuaaaacauccgaaggggaaguuggcgcaauugcuuuagacuuuaaaccagguaccaguggaucaccaauuguuaaucgggaaggcaaaauaguaggccucuaugguaauggagugguaaccaccucaggaaccuauguauccgcgauagcccaagcaaaagcuucucaagaaggcccucuaccagaaauagaagaugaagucuuuagaaaaagaaaccuaacuauaauggauuuacacccugggaguggaaaaaccagacgauauuuaccagccaucguucgagaggccauaaaaaggaaauuacgaacauuaauacucgccccuacacguguuguugcuagugaaauggcagaagcacuaaaagggaugccuaucagguaccagaccaccgcuguaaaauccgaacauacugguaaagaaauagucgaucuaaugugccacgcaacguuuacgaugcgacuguuauccccagugaggguccccaauuacaacaugaucauuauggacgaagcacacuuuaccgauccaucuucaaucgcagcacgaggguauauauccacacgaguaggaaugggagaagcugcugcaauauuuaugaccgcaacaccaccaggaucagucgaggcauucccacagucaaacgcaguaauucaggaugaggaaagagauauuccggaacgaaguuggaacucaggauacgaauggauuacggacuucccaggaaaaacaguaugguucgucccuaguauaaagagcggaaaugauaucgcuaauugucuaaggaagaaugggaaacgagugauucaauugucacgaaagacauuugauacagaguaucagaaaacuaaaaacaaugauugggacuacguugugacaacggauauaucagagaugggugcgaacuuuagagcugaucgagugauagaucccagacggugccucaagccggucauauugaaagacggcccggagcgaguuauuuuagcaggaccuaugccuguuacuguugcuucagcugcucaaagaagaggcagaaucggucgaaaccacaacaaggaaggggaccaauacauauacaugggucaaccccugaauaacgacgaagaccaugcucauuggaccgaagcaaaaaugcuacuagacaacauuaauacaccugaaggaauuaucccggccuuauucgaacccgagagggaaaaaucagcugccauagauggagaguaucggcuaagaggugaagcccguaagacguucguagaacuaaugagacgaggggaucuaccugucuggcucucuuacaaaguggcuagugaaggguuucaguauagugaucgucguugguguuucgauggagagcggaacaaccagguuuuagaagaaaauauggacgucgaaaucuggacuaaagaaggugaacguaaaaaacugaggccaagguggcuagacgcuaggacuuacucagaucccuuagcacuccgagaauuuaaagaauucgcagcgggucgucgguccgucucuggugauuuaauacuagaaauuggaaaacuaccucaacacuuaacucaacgagcacaaaacgcuuuagacaaucuuguaaugcugcauaacagugagcagggcggcagagcauacagacacgccauggaagaauuacccgauacuaucgaaacauugaugcuauuagcauuaaucgccgucuugacgggaggcguuacacuauucuuuuuaaguggaagaggucuuggaaaaacuucgauaggacuauuguguguaauggcuuccucgguucuucuauggauggccucuguagaaccccacuggaucgcugcuucaauaauacuagaauuuuuccugauggucuuacuaauaccagagccggaucgccagcgaacuccccaagauaaucaauuagccuacguaguaaucggacuacuguucaugauacuaacuguugcagcaaacgagaugggucuauuagaaacaacuaaaaaggaucuugggauaggucauguagcaguagaaaaucaucaccacgcagcaaugcuggacgucgacuuacauccagcuucggcauggacgcuauacgcagucgcuacgaccauuauaaccccaaugaugcgccauacaauagaaaauacgacugcaaauaucagucucacagcuaucgcuaaccaagccgcuauucuaaugggccuggacaagggguggcccauuucuaagauggauauagguguuccccuacuggcccuaggauguuauucgcaaguuaacccgcuaacuuugacagcggcgguucugaugcuagucgcucacuaugcuaucauugguccuggccuacaggcaaaagcaacuagagaggcacaaaaacgaacggcugccgguauaaugaaaaauccuaccguugauggaauuguugcuauugaccuagacccugugguuuaugaugcuaaguucgagaaacaauugggacaaauaauguugcuuauccuuugcacuucgcagauauuauuaaugaggacuacuugggcccugugugaaucaauaacucuugcaacagguccucuuacuacguuaugggagggaucaccuggaaaauuuuggaauacaacuauagcaguuucaauggcuaacauuuuucgggggaguuauuuggcuggugcagguuuagcauuuucucuaaugaaaucauuaggaggaggacgaagggguacaggagcacaaggagaaacauuaggugaaaaauggaaaaggcaauugaaucaacuaucgaaaagugaauucaauacguauaaaagaaguggaaucauggaaguugacagaucagaagcgaaggaaggucucaaacgaggcgaaacaacaaagcacgccguaucaagaggcaccgcaaaacuaagaugguucguagaaaggaauuuaguaaaaccggaggggaaaguuauugaccuaggauguggaagaggaggauggaguuauuacugugcaggacucaaaaaaguaacagaagugaaagguuauacuaaaggugggccuggacaugaagaacccauaccuauggcuacuuacgguuggaauuugguaaaacuucacagcggcaaagaugucuuuuucauuccaccagagaaaugugauacauuauugugcgauaucggagaaaguaguccaaacccaacaauugaagaaggacgaacacuuagagucuuaaaaaugguggaacccuggcuucgcgguaaccaguuuugcauuaaaauucucaauccauauaugccaucugugguagagacuuuagagcaaaugcaacgcaaacacggugguauguuaguacguaacccacuuagucguaacuccacccacgaaauguauuggguaagcugcgguacaggaaauauagugucugcaguaaauaugacuucgcgcaugcuauuaaaccgauucacgauggcgcaucgaaagcccaccuacgagagagacguagaucugggugcaggcacaaggcauguugcaguugaaccugagguagccaauuuagacaucauaggacaaaggauugaaaauauaaaacacgaacacaagucaacauggcacuaugaugaagacaacccauacaaaacuugggcuuaccauggaucauaugaaguuaaaccuagcggaucagcaucaaguaugguuaauggaguagugaaauugcucacuaaaccgugggauguuauacccauggucacacaaauagcaaugaccgauacgacaccauucggccaacagaggguauucaaagaaaaggucgauacaagaacaccaaaagcuaaaagaggaacggcccagauaauggagguaacagccaaauggcuauggggcuuucuaucuagaaacaaaaaaccucggauaugcaccagagaggaauuuacccguaaagugcguucaaacgcagcgauaggugcaguguuuguugaugaaaaucaguggaauucagcaaaagaagccguagaggacgagcguuuuugggauuuaguucauagagaacgagaauuacauaaacaagguaagugcgccaccuguguuuacaacaugauggggaaaagagaaaaaaagcuaggagaguuuggcaaagcaaaagggucucgugcaauaugguauauguggcuuggagcaagauuccucgaauuugaggcccuaggguuuaugaacgaagaucauugguucucaagagaaaauucccugucuggcguggaaggugaaggauuacauaaguugggguacauuuuacgagacauuuccaaaauuccaggaggaaacauguacgccgaugauacagcugguugggacacuagaaucacagaggacgaucugcaaaacgaggcaaaaaucacugauauaauggaaccugaacacgcacuacuagcaaaaagcauuuucaagcuaaccuaucaaaacaaaguaguuaggguucaacgcccagcuaaaaaugguacugugauggacguuaucaguagacgugaucaaagaggaucuggacaagucgguacuuacggucuaaacacauucacaaauauggaggcucaauugauuaggcagauggaaucagaggggauuuuuucucccagcgaguuagaaacucccaauuuggccggacgugugcuagacuggcuagaaaaacaugguguagaaagauuaaagagaauggcaaucucuggagacgauugcguuguaaagccaauagacgaccgguucgcaaccgcauugaccgcacuaaacgauaugggaaaaguccguaaagauaucccgcagugggaaccuaguaaagguuggaaugacuggcaacaaguacccuuuuguucgcaucacuuccaccaguugauaaugaaagaugguagagaaauaguugucccaugcagaaaucaagaugaacuaguuggucgagcuagaguaucucaaggcgcagguuggaguuuaagggaaacugcaugccuuggaaaaucauaugcacaaauguggcaacuuauguauuuucaccgcagagaucuuagacuagcugcuaaugcaauuugcagcgcugugccuguggacugggucccaacgaguagaaccacauggucuauccaugcacaucaccaguggaugacaacugaagacaugcuaagugucuggaaccgggucuggauagaagaaaacccauggauggaagauaaaacucauauuucuaguuggggugauguccccuaccuagggaaaagggaagaccagugguguggcucacuaauaggacucacagcucgugcaacgugggcgacaaacauacagguagcuauaaaucaaguuaggagacugauagggaaugaaaauuaccuagauuauaugacaucaaugaaacgauuuaaaaaugaaagcgauccagagggggcuuuaugguag

SEQ ID NO: 21918 - RNA, 9879 nt, Artificial Sequence
  derived and/or modified CDS sequence (opt6) from DENV-1__EU482815__SS-prME
ucggugacaauguuguuaaugcuaaugccagcugcucuagcguuucauuugacaacccgcggaggugaaccacauaugaucguaucaaaacaagaaagagggaaaucguuacuauuuaaaacuucugccggugugaacaugugcaccuugauagcuauggacuuaggcgaauuuugugaagacacaaugacuuacaaauguccgagaauuacggaagcagaaccagacgaugucgacuguugguguaacgcaaccgauacuuggguaacuuaugggaccugcagucaaacuggcgaacauagaagagauaaaagaucuguugcucuugcaccucacguaggccuagggcuagaaacaaggacagagacuuggaugucgagugaaggugcauggaagcagauacaaagaguugaaacgugggcacuuagacauccaggauucacaguaauagcucucuuccuggcacacgcaauuggcaccucaauaacacaaaaaggaauaauauucauuuuacuuaugcuagucaccccaucgauggcuaugagauguguuggaauaggcaguagagauuuugucgaaggguuaaguggggcgacaugggucgacguaguacuagagcauggaaguuguguuacaacuauggcuaaagauaaaccgacacuagauauagaacugcugaaaacagaagugacuaacccggcaguauuacgaaaacuuuguauagaagcaaaaaucucaaauacaacaacagacucaagguguccuacccaaggagaagcaaccuuaguggaagaacaagacgcaaacuucguaugucgacgcacuuucgucgaucgggguugggguaauggauguggacuauucggaaaaggaucacugaucacaugugcaaaauucaaaugcguaacgaaacuugaggggaaaacaguacaauaugagaauuuaaaauacucuguaacuguaacuguacacacuggagaccaacaucaaguaggaaaugaaagcacagaacaugggacuacagcgacgaucacaccacaagcaccaucgaccgaaauacaauuaacagauuauggugcacuuacacucgauugcucaccuagaacgggauuagacuucaaugaaaugguucuguugacuaugaaagaaaaauccuggcugguacacaaacaaugguuucuagaucuuccccuaccuuggacaucaggggcaagcacuucacaagaaaccuggaaccgaaaagaucugcuaguuacuuucaaaacggcucaugcuaagaaacaagagguaguugucuuaggaagucaagaaggagccaugcauacagcauuaacgggcgcaacagaaauacagacaucggggacaacaaccauuuuugcuggucacuuaaaauguagacuaaaaauggauaaacucacauuaaaggguaugaguuauguaauguguacuggaaguuuuaaacuugaaaaggaaguagcugagacacaacacgguacgguucuaguccagauuaaauaugaggguacugaugcaccauguaagauaccguucucuacucaagacgaaaagggaguaacgcaaaauggacgacuaauaacugcaaacccaauagucacagauaaagagaaaccagucaauaucgaagcugagcccccauuuggggaaucauauauugucaucggggcuggagaaaaagcucuaaaauuaaguugguuuaagaaagguucuuccauagggaaaauguuugaagccacagcacguggagccagaagaauggcaauuuuaggcgauacugcaugggauuucggcaguauuggcggcguauuuacaagcguaggaaaguuaguacaucaaaucuuuggaacagccuacggcgucuuauuuucaggaguuucguggacaaugaagauaggaauaggagugcuacuaacuugguuaggacuaaacucaagaucgacaaguuugagcaugacaugcauagcagucggacuugugacucuuuaccuaggugucauggugcaagcugacagugguuguguuauuaauuggaaagggcgcgaauuaaaauguggcagcggaauuuucguaacaaacgaaguacauaccuggacggaacaauacaaauuucaggcagauaguccuaagagauuaucugcugcaaucggaaaagcaugggaagaaggaguauguggaauacgaagugcaaccagauuagaaaauauaauguggaaacaaauaaguaaugaacucaaccauaucuuauuagagaacgauaugaaguucaccguagucguuggagaugucgcaggaauauuagcacaggggaaaaagaugauacguccccaaccaauggaauacaaauauuccuggaagaguuggggaaaagccaaaauaauaggagcugauguucagaauacgacuuucauaauagauggaccaaauacuccagaguguccagaugaccagcgcgcauggaacauaugggagguggaggauuacggauuuggaaucuuuaccacaaauaucugguugaagcucagggacuccuauacgcaaguaugcgaccauagacugaugagugcugcuauaaaagauaguaaggccguacacgcagauauggguuacuggauugaaagcgagaaaaaugaaacauggaaacucgcucgugcuaguuuuauagaaguaaaaacuuguauuuggccaaagucucacacgcuguggucgaauggaguacuggaauccgaaaugauuauaccaaaaauauacggcggcccgaucagucaacacaauuaccgaccgggauauuuuacucaaacagccggcccuuggcaccuuggaaaguuagaauuggacuuugaccuuugcgagggaacgacagugguagucgacgaacacugugggaauagaggaccaucauugcguacuacaacagucacugguaaaauaauacaugaauggugcugccguucaugcacguugccuccucugagguucaaaggagaagacggaugcugguacggaauggagaucaggccaguaaaagagaaagaagaaaaccucguaaaauccaugguaucugcaggaagcggcgagguugacagcuucagucuaggacuauuguguauuaguauuaugaucgaagaggucaugagauccagauggucacggaaaauguuaaugacaggcacauuagcaguauucuuccuucuaauaaugggacaauuaaccuggaaugaccuuaucaggcuguguauaaugguaggugcaaaugcaagugacagaauggggauggggacaacuuauuuagcacuuauggccacuuuuaaaaugcggccaauguuugcaguuggucuucuuuuuagacgacugaccagccgugaagucuuauuacuaacuauaggcuugucccuaguugcaagcguggaauuaccuaacucacuggaggaauuaggagauggacuagccaugggcauaaugauacucaaacuucugaccgacuuccaaagccaccaauuaugggcaacguugcucagcuuaacauucauuaaaacuacuuuuagccuccauuacgccuggaaaacaauggcaauggugcuuucgaucguuagccuuuuuccgcuaugccuauccacaacaagccagaaaacaacauggcugcccguacugcucgggagcuuaggaugcaaaccacuaaccauguucuucaucgccgagaauaagaucuggggaaggaaguccuggccacucaacgaagggauaauggcugucgggauagucaguauauuacuuucaucacuccuuaaaaaugauguuccacuagcgggaccauuaaucgcuggaggcaugcuuauugcaugcuauguaauaagcgggucaagcgcagauuuaagucuagaaaaagccgcagaagugucaugggaagaagaagcggaacauagcggcgcuucgcauaacauucuugucgaaguacaggacgacggaacuaugaaaauaaaggaugaagaaagggaugacacauugacuauacuuuugaaggcaacccugcuagccguuucaggggucuacccacuuaguauaccagcaacucuuuucguaugguauuucuggcagaagaagaaacaacgaagcggugugcucugggacacuccgagcccuccagagguugaacgggcaguccuugacgauggaauuuacagaauuaugcaaaggggucuucuaggccgaagccaagucgguguagggguuuuccaagaaaaugucuuccauacuauguggcacguuacaagaggugcuguacuuauguaccaaggaaaaaggcuugaaccgucaugggcaaguguaaagaaagaucuuaucucguauggaggaggcuggcguuuacaagguucauggaauacuggcgaagaaguacaaguuauagcaguagagccagggaaaaacccuaaaaauguccaaacagcaccaggaacauucaaaacaucugagggcgaggucggagccauugcacuagauuucaagcccggaacaaguggcuccccuaucguaaauagagaagguaagauagugggucuguacggaaaugguguaguaaccaccaguggcaccuacguaagcgcuauagcacaagccaaagcaagccaggaaggucccuuaccagaaauugaagaugaaguauucagaaaacguaaucuuacuauaauggauuuacauccggggagcgguaaaacaagacguuaccuuccugcaauaguaagggaggcaauaaaacggaaguugcgaacccuaauuuuagcaccgacaagggucguugcuucagagauggccgaagcccuaaaagguaugccuauucgauaucagacaacggcaguaaaaagugaacacacgggaaaagagauaguugauuuaaugugucaugcaacauuuacaaugagauuauugaguccugucaggguuccuaacuacaauaugaucauaauggacgaagcgcauuuuaccgacccaagcucaauagcugcacguggauauauuucaacacgagucggcaugggggaagcagccgcaauauucaugacagcaaccccaccuggaucgguagaggcuuuuccacaaaguaacgccgucauacaggaugaagaacgagacauuccugaacguaguuggaacucagguuaugaauggauaacugauuuuccgggaaaaaccguuugguuugugccaagcauaaaaucaggaaacgauauagccaauugucucaggaaaaacggcaaacguguaauucaguuaaguagaaaaacauuugauacugaguaucagaagacaaagaacaacgacugggauuaugucguuaccacggauauuucagaaaugggugcuaacuucagagccgacagaguaauagauccgcgucgaugccugaaaccaguaauacugaaagauggacccgaacgaguaauauuagccgggccgaugccaguaacaguagcaucagcagcacaaagaagaggacgaauagguagaaaucacaacaaagagggggaccaauauaucuauaugggacaaccguugaauaacgaugaagaucaugcucacuggacagaagcgaaaaugcuauuggauaacauuaauacgccggagggaauuaucccugcacuuuuugaacccgagagagagaaauccgcggcaaucgacggagaguacagacuucgaggagaggcccgaaagacauucguugagcuuaugcgacguggugacuugcccguaugguugucauacaagguagcgucagaaggguuucaauacagugauagacgauggugcuucgacggugagaggaauaaucaagugcuagaagaaaacauggauguagaaauuuggacaaaagaaggagaacguaagaaacuacguccacgcuggcuagaugcaagaacauacagugacccucuugcacuccgcgaauuuaaagaauuugcagcaggacgacguucgguaucaggagauuuaauucuggagauugguaaacugccccagcaucuuacucaacgagcccaaaaugcccucgacaacuuagugaugcuacacaauucugagcaaggaggacgagcauaucgucaugcuauggaagaauugccggauacaauagaaacauuaauguuguuggcguuaaucgcaguccuuacaggagguguuacgcuguucuuucuauccggucgcggucuaggaaagacaagcauaggguuauuauguguaauggcaucaucagcacuauuauggauggcuucaguagaaccacacuggauagcagccucaaucaucuuggaguucuuccucaugguucuacuaauccccgaaccggauaggcaaagaacaccccaagacaaucaacuugcuuauguugugauugggcuacuauucaugauccuaaccgucgcagcaaacgagaugggccuacuagaaacaacuaagaaagauuuggggaucgggcauguagcagucgaaaaucaucaucaugcugcaauguuagacguggaucuacauccagcgagugccuggacccuguacgcuguggccacaacaauaauaacaccaaugaugagacauacaaucgaaaauacuaccgcaaauauuucuuugacugcaaucgcuaaucaagcagcaauacuaaugggcuuagauaaggguuggcccauaaguaagauggauaucgggguaccacuucuggcauuaggauguuacagucaaguaaaucccuuaacacuaacugcugcuguacuaauguuaguagcgcauuacgcaauaaucgggccaggguuacaagcuaaagcaacaagggaggcucagaaaagaacugcugcagguauaaugaaaaaucccacaguugaugguauaguugcgauagaucucgacccaguagucuaugaugcuaaauucgagaagcaauugggucaaauaaugcuccuuauuuugugcaccagucagaucuuacucaugagaacgacaugggcacucugcgaaucgauaacucuggcuacagguccacuuacuacccuuugggaaggcucaccaggaaaguucuggaacacgacaauugcaguaaguauggcuaauauuuucagagguuccuauuuagcuggggcuggguuagcauucucucugaugaaaucguuaggaggagggaggaggggaacuggggcucagggagagacucuuggugaaaaauggaaacgacaguuaaaucaauuaucuaaaagcgaauuuaacacuuacaaacguagugguauaauggaaguggauagaagugaagcuaaggagggucuuaaaagaggagaaacuacaaagcacgcaguaucgaggggaacggcaaaauugagaugguucguagaaagaaacuuagucaaaccggagggaaaaguuaucgacuugggaugcgggagaggcggcuggaguuauuacugcgcgggacucaagaaagugaccgagguaaaaggauauaccaaaggcgguccaggucaugaagaacccauaccaauggccacuuacggauggaacuugguuaaacuucacucuggaaaagauguauucuuuauaccaccagaaaaaugcgauacguuauuaugugacauuggggaaucaaguccuaauccaacgauagaggaaggacgcacauuaaggguucugaaaaugguugaaccuugguuacgagggaaccaauuuuguauuaaaauauuaaauccguauaugcccuccguuguggaaacauuagaacaaaugcaacgaaagcacggugguaugcuaguuagaaacccauuaagucgaaacucaacucaugaaauguauuggguuagcuguggaaccggaaauauaguaagugcaguuaauaugaccucacgcaugcuauuaaauagguuuaccauggcacaccgcaagcccacauaugaacgagacguagaccuuggagcugguacaagacauguggcagucgaacccgaaguugcaaaucuggauaucauaggccaaagaauugaaaacauuaagcacgagcacaaaucaaccuggcacuaugaugaagacaaccccuacaagacgugggcuuaucaugguagcuaugaaguaaaacccucugguuccgcaucaaguaugguuaacggaguagucaaacugcuuacaaagccuugggauguuauaccaaugguuacucaaaucgccaugacggacacgaccccauuuggacaacaaagaguauuuaaagaaaagguugauacaagaaccccgaaagcaaaaagaggaacggcucaaauaauggaaguuaccgcgaaauggcuguggggauuucugagucgaaauaaaaagccacguauaugcacacgcgaagaauuuacgagaaaagugagaaguaacgcagcaaucggcgcaguauuugucgacgaaaaucaauggaacucugcaaaagaggcaguggaagacgaaagguuuugggauuugguacaucgcgaacgugaauuacacaaacaagggaaaugugcuacuuguguuuacaauaugaugggcaaaagagagaagaaauuaggagaguucggaaaagccaaggguucaagagcgaucugguacaugugguuaggugcacgauuccuggaguucgaagcacucgguuuuaugaacgaagaucauugguuuuccagagaaaacucacuaagcggaguagaaggagaaggccuacacaaacuaggauauauucugcgagauauaaguaaaauccccggcggcaacauguacgcagaugacacugcgggcugggacacuaggauaacagaggaugaucugcaaaaugaggcaaaaauuaccgacaucauggagccagagcaugcacuucuggcaaaaaguauauucaaacugacuuaucaaaauaaaguaguaaggguacaaagacccgccaaaaacgguacugugauggauguaauuucucguagagaccaaagaggaaguggacaaguagggacuuauggacugaacaccuuuacaaauauggaagcucaauuaauaagacaaauggagagcgaaggaaucuucucaccaucagaauuagaaacaccgaaccuggcuggaagaguccuugacugguuagaaaaacacgggguagagagacugaaaaggauggccauaagcggcgaugauuguguaguaaaaccaaucgacgauagauuugcaacagcucuuacagcucugaacgauaugggcaaaguacgaaaagauauuccucaaugggaaccgucaaagggauggaaugacuggcaacaggugccauuuuguagccaccacuuucaucaguuaaucaugaaagauggacgugaaaucgucgucccuugcaggaaucaagacgaacuuguuggcagagcucgcguuagccaaggugcugguuggucauuaagagaaacugccugcuuaggaaagaguuaugcacaaauguggcaacuuauguauuuccauagacgagaucuuaggcuagcugcaaacgccauuugcagcgccguuccgguugauugggucccaacgaguagaacaacauggucuauccaugcacaucaccaguggaugacgacggaagauauguuaaguguguggaacaggguuuggauugaagagaauccuuggauggaagacaagacacauauaucuuccuggggagauguucccuauuugggaaaaagggaagaucaauggugcggcucacuuauaggucuaacagcacgugccacuugggcaacaaauauccaaguagcaauaaaccagguacgucgucuaaucggcaaugaaaauuauuuagacuacaugacgucuaugaaaagauucaaaaaugaaucagaccccgaaggugcccuaugguga

SEQ ID NO: 21919 - RNA, 9879 nt, Artificial Sequence
  derived and/or modified CDS sequence (opt6) from DENV-1__EU482816__SS-prME
uccguuacgaugcuucucauguuaaugccaacagcucuugcauuccacuugacuaccagagguggagaaccgcauaugauaguuucaaaacaagaaagaggaaaaagucuccuguucaaaacaagugcugguguaaauauguguacacucaucgcaauggauuuaggagaauuuugugaagauacuaugaccuacaaaugcccacgcauuacugaagcagaaccggacgacguggauugcugguguaacgcaacugauacauggguuacauacggaacgugcagucaaacaggagagcauagaagggacaaaagaaguguagcauuagcuccucauguugguuuagguuuggaaaccagaaccgagacuuggaugucaucugaaggagcauggaaacagauccagaggguugaaacaugggcacucagacauccugguuucacggugaucgcucuguuucuagcgcaugcaauagggacgagcauaacgcagaaaggaauuauauuuauccuucuaaugcuagugaccccaucgauggcaaugcgauguguagggauuggaaguagagauuucguugaaggcuuaucgggagcaacguggguugacguaguacuugaacauggaucaugcguuacuacaauggcuaaagacaaaccaacacuagauauagaguuacuaaaaacugagguuacaaauccagcuguucugaggaaacucuguauagaggcaaagauaucaaacacuacaacagacagucggugccccacacaaggagaagcuacccuaguugaagaacaggaugcgaacuucguauguagaagaacguuuguugaucgggguuggggaaacggaugugguuuauucggcaaggguucacugauaacaugugcuaaauuuaaauguguaacaaaacucgaagggaaaacuguccaguaugaaaaucuaaaauacucgguuauaguaacaguacacacuggagaccaacaucaaguaggaaaugaaucuaccgaacacggcaccacagcaacaauaacuccucaagcuccaagcacagagauacaguuaacugauuacggcgcccuaacguuagauugcucaccaaggacgggucuagauuucaacgaaaugguacuucuuacaaugaaagaaaagaguuggcuaguacacaaacaaugguuucuugaucuuccauuaccauggaccaguggagcaaguacgucacaagagacauggaaccgaaaagauuuacuugucacuuuuaagacagcacaugccaagaaacaagaaguggucguccuggggagucaagaaggagcaaugcacaccgcucucacaggcgcuacggaaauccagacauccgggacaacuacaauauucgcuggacaucuaaaaugcagacuaaaaauggauaagcucacccuaaagggcaugaguuauguaaugugcacggggucuuuuaaacuggaaaaagaaguagcagaaacccaacacggcacugugcuagugcaaauuaaauaugaaggcacagaugcuccuuguaaaauaccguuuagcacucaggaugaaaaaggcguuacucagaauggacgccuaauaacagcaaaccccauaguaacagauaaagagaaaccuguuaauauugaagcggaaccuccuuucggagaaucguauauugucauuggcgcaggcgagaaggcauuaaaguugucuugguuuaagaagggaucuagcauugggaaaauguucgaagccacagcaaggggagcaagacguauggcuaucuuaggcgacacggcaugggacuucgggucuauuggaggggucuucacaaguguaggaaaacuuguacaccagauauucggcacagcguacggaguccuauuuuccggaguaucuuggacaaugaagauaggcauaggcguccuacuuaccuggcuagggcuaaauucucgcagcacgucucuuucaaugaccugcauagcuguaggucuuguaacuuuguaucucggcgugaugguccaggcggauucagguuguguaauaaacuggaagggaagagaauuaaaauguggaucgggcauuuuugugacaaacgaaguacauacauggacugagcaguauaaauuccaagcagacaguccuaaacgacuaagugcagcuauaggcaaggcuugggaggaggggguaugcggcauucgaucugcaacuagacuagaaaauauaauguggaaacaaauaagcaaugaacugaaccacauacuucuagagaacgauaugaaauuuacggugguuguaggagauguggcaggcauuuuagcacaaggcaagaaaaugauacgaccucaaccgauggaguauaaauauaguuggaaaaguuggggaaaagcuaaaauaauuggagcugauguccaaaauacuacuuuuauaaucgaugguccuaacacuccagaauguccagacgaccaacgagcuuggaacauuugggaggucgaagauuacggauuuggaauauucacaacuaacauuugguuaaaguuaagggauucauacacucaaguaugugaucauagacugaugagcgcugcuauuaaagauucgaaagcagugcaugccgauaugggauacuggauagaaucggagaaaaaugaaacauggaaauuagcacgagcauccuuuauugaaguuaaaacaugcauauggcccaaaucucauaccuuguggucgaauggaguucucgaaucagaaaugauuauucccaagauuuaugggggcccgauaucucaacauaacuaccgaccagguuauuucacacaaacagccgguccuuggcaccugggaaagcuagaacuagauuuugauuuaugcgaagggacaacuguagucguugaugagcauugugggaauagaggaccaucgcuuaggacgaccaccguuacaggaaaaauaauacacgaauggugcugcagaucauguacauuacccccauuacgauuuaaaggugaagauggcuguugguacgguauggaaauaagacccguaaaagaaaaagaagaaaaucuuguuaagaguaugguuucugcaggaucaggugaaguggauucauuuaguuuaggucuauuaugcauaucaauuaugauagaagaaguaaugagaaguagaugguccaggaaaaugcuaaugacaggaacacucgcggucuucuuuuuauuaauuaugggacaguuaaccuggaaugaucucauacgucucugcauuaugguaggagcuaaugcaucagauagaauggguauggguaccacauacuuagcucuaauggcuacuuuuaagaugagaccgauguucgcaguaggacucuuauucagacggcucacaucaagggaggugcuguuauuaacaauaggacucagucuaguagcuagcguagaauuaccuaauucgcuugaggaguugggcgaugguuuggcuaugggcauaaugauucugaaauuauuaacagacuuucaaagucaccaauugugggcgacuuuacucucgcucacauuuauuaaaacaacuuucucauuacacuacgcauggaagaccauggcaauggugcugaguauugugucuuuguuuccucucugccuaucuacaacgucccagaaaacuaccuggcuaccaguccuacuuggcagucuugggugcaaaccacucacaauguucuugauagcugagaacaagauuuggggccgaaagaguuggccuuugaaugaagggauuauggcaguuggcauaguuaguauucuguuaagcagccuacuuaaaaacgacgugccguuagcaggaccacuuauugcaggaggcaugcuuauagcuuguuaugugauaucaggaaguucagcugauuuaucccuagaaaaggcagcggaagucucuugggaagaggaagcagaacauucuggagcuagccacaauauauugguagaaguucaagaugaugggacaaugaaaauuaaagaugaagaaagagacgauacauuaacaauacuuuuaaaggcaacguuacuggcugugucagguguauacccguuaucgauaccugcuacucuuuuuguuugguacuucuggcaaaagaagaaacaacguagcggaguucuuugggauacgccaucaccaccugaaguggaacgugcgguacuagacgacggaauauacaggauaaugcaacgaggcuuacuaggacgaagucaagucgguguaggcguauuccaagagaaugucuuccauacgauguggcacguaacgaggggugcaguacuuauguaccaagggaaaagguuggaaccaucuugggcuuccgucaaaaaggacuugauuucuuauggaggaggguggagacugcaagguucguggaacacgggugaagaaguucaagugauagccguagagccgggcaagaacccuaaaaauguacaaacagccccugguacuuucaagacgagcgagggcgaagucggggcaauugcuuuagauuuuaaacccggaacaucaggcucuccaauaguaaaccgugaagggaagauugucggcuuauacggaaacgguguaguuaccacgucuggaacuuacgucucggcgauagcacaagcaaaagccucacaagagggcccauugcccgaaauagaagacgaaguauuucguaaacgaaaccuuacuauaauggacuuacacccggguaguggaaaaacgcgcagauaucuaccugcaauugugcgcgaagccauaaaacgaaaauuacguacauugauucuggcaccuaccagaguugucgcuuccgaaauggcugaagcauuaaaaggaaugccuauuagauaucaaacaacggcagugaaaagugaacacacugggaaagaaauaguagauuuaaugugccaugccacauucacgaugagauuacuaucaccaguaaggguaccaaauuauaacaugauaauuauggacgaagcgcauuuuacagacccaagcucuauagccgcccgcggauauauaucgacuagaguagguaugggagaagcagcugcuauuuuuaugacagccacaccaccaggcucuguugaggcuuucccacaaucgaaugccguuauacaagaugaagaacgagacauuccugaaaggucauggaacucgggauacgaguggauuacugauuuccccgguaaaacgguaugguuuguaccgucuauaaaauccggaaaugacauugcuaauuguuuaaggaaaaaugguaaaagaguuauacagcuaucaagaaaaacguuugauacagaauaucaaaagaccaaaaauaaugacugggacuaugugguuacaacagacauaucagaaaugggagccaauuuccgggcugaucggguaauagaucccagaagaugccugaagccagugauacuuaaagauggaccagaaagaguuauucucgcuggaccaaugcccgucacaguagcaucggcugcucaaagaagaggucguaucggaagaaaucauaauaaagagggagaucaauacauuuacaugggccaacccuuaaacaaugaugaagaucaugcucauuggacagaagcaaaaaugcugcuggauaacauaaauacaccggaaggaaucauaccggcucuguuugaaccugaaagggaaaaaucugcagccaucgacggagaauaucgacuuagaggugaagcacggaaaacguuuguugaacuaaugcgacgaggggauuugccuguauggcuaucguacaaaguagcuagcgaaggcuuucaauauagugauaggcguuggugcuuugauggugaaaggaacaaucaaguuuuagaagagaauauggauguggagauuuggaccaaggaaggagagaggaagaaauuacgaccgcggugguuagacgccagaaccuauucggacccuuuagcacuacgcgaauuuaaagaauuugcagcaggacgaagaagcgucaguggagacuugauacuagaaauaggaaaacuuccgcaacaucucacacaaagagcccagaacgcacucgacaaccuaguaaugcuacauaauucagaacaagguggcagagcuuauagacaugcaauggaagaauuaccagacacaauugaaacauuaaugcuauuagcgcucauagcuguuuuaacggguggaguuacacucuuuuucuugucaggacggggcuuagggaaaacaaguauuggucuauuauguguaauggccaguucaguucuacucuggauggccucaguugagccacacuggauagcggcaaguauaauauuagaguucuucuugaugguucuauugaucccagaaccggauagacagcgcacaccccaggacaaucaauuagcuuauguuguuauaggucuauuauuuaugauauugacaguugcagcgaacgaaaugggauuauuagaaaccacaaagaaagaccuugguauuggucacguagcaguagaaaaucaucaucacgccgcaaugcucgauguggaucugcacccugcuucggcauggacucuauacgcuguagcgacgacuauaauuacgccuaugaugcgccauacuauugagaauacuacugcuaacauaaguuuaacugcaauugcaaaucaggcggccauccuaaugggacuagauaaaggguggcccaucagcaaaauggauaucggagugccacuacuggcccuaggaugcuauucucaagucaacccuuuaacuuuaacagcagcuguccugauguuaguagcgcauuaugcuauaauaggcccagguuugcaagcaaaagcaacgcgagaagcgcagaaaaggaccgcagcugguauaaugaagaauccuacgguagaugguaucgucgcuauugaccuugacccgguggucuaugaugccaaauucgaaaaacaacuaggacaaauaauguuacucauacuguguacaucacaaauccuauuaaugaggaccacgugggcccuaugcgagucgauaacauuagcgaccgggccacuaacuacacugugggaaggaaguccaggaaaauuuuggaauacgacgauagccguaucuauggcgaacaucuuuaggggaaguuauuuggccggugcagggcuugcguucucacuaaugaagucauuagggggcggucguaggggcacaggcgcacaaggagaaacucuuggugaaaaguggaagagacaguuaaaucaguuaucuaaaucagaauuuaauaccuauaaaagaucagguauuauggaaguagaucgaagcgaagcaaaagaagggcuuaagcgcggagagacaacuaaacacgcaguuaguagagguacugccaaguuaaggugguuugucgagagaaaccuaguaaagcccgaaggcaagguaauagaccuggguuguggacgcggagguuggucauauuacugcgcgggacuaaagaaaguaacugaagugaaaggcuacacaaagggaggucccggucaugaagaacccauucccauggccacauauggcuggaauuuagugaaacuucauucaggaaaagacguauucuuuacuccgcccgaaaaaugugauacauugcuuugcgauauuggugagaguagcccuaauccaacaauugaagagggacggacacugagaguauuaaagauggucgaacccuggcuucguggaaaucaguucugcauaaaaauucuuaaccccuacaugcccucagucguggagacacuugaacaaaugcaaagaaaacauggcgguaugcugguuagaaacccacuuucgagaaauucgacucacgagauguauuggguaucgugugguacaggaaauauaguaucagcgguuaauaugacaagccgaauguuauuaaaucgguuuacaauggcgcauagaaaaccuacguaugaacgcgacguagaucuaggagcggguacuagacacgucgcaguagaaccagaggucgcaaaccucgacauuauuggacaaagaauugaaaacauaaaacacgagcauaagucaacguggcauuaugaugaggauaauccuuacaaaacgugggcauaucacggguccuaugaagugaagccaaguggaagcgcuaguucuauggugaaugguguagugaaacuccuuaccaagccaugggaugucauaccaaugguaacgcaaauugcaaugacagauacgacgccauucggccaacaaagaguuuuuaaagaaaaaguagacacccgaaccccuaaagcaaaacgcggaacugcacaaaucauggaggucacagcaaaaugguuauggggauuucuuucaagaaacaagaaaccgagaauaugcacccgugaggaguucacaagaaaggucaggucaaacgcagccauuggggcuguguuuguggacgaaaaucaguggaacucggccaaagaagcaguugaggaugagagauucugggacuuaguccaccgagagagagaguuacauaaacaaggcaaaugugcaaccugugucuauaacaugaugggcaaacgggagaagaaacuaggugaguucggaaaagccaaagguucaagagcuauaugguacauguggcuaggugcaagauuccuagaguucgaggcacuuggauucaugaacgaggaccauugguuuagcagagaaaauucucuuucgggcguagagggagaaggucuacacaaacugggauacauacuacgagauauaucgaaaauuccaggaggaaauauguaugcagaugauacggccggaugggauacaagaauaaccgaagacgaccuucaaaacgaagcaaaaauaacggauauaauggaaccagaacacgcucuacuugccaaaaguaucuuuaaauuaacuuaucaaaacaagguugugcgaguacaaagaccugccaaaaacgguacgguuauggacgugauuagcagaagggaccaacgugggagcgggcaaguagguacauauggccuuaauacauucacuaacauggaggcacaacugauacgccaaauggaauccgaaggaauuuuuagccccucugaauuagaaacgccuaauuuagcaggaagaguacuagauuggcuagaaaaacauggaguggaacggcucaaacggauggcaauaaguggagacgacuguguaguaaaaccuaucgaugauagauucgcaacugcauuaacggcguuaaaugauaugggaaaaguccgaaaggauauuccgcaaugggagccuucaaaggguuggaaugacuggcaacaaguuccuuucuguagccaucauuuccaccaauuaauuaugaaagacgguagagagauaguggucccgugucguaaucaggaugaauugguuggacgugcuagagucagucaaggagcuggauggagccuacgugaaacagccugucuuggaaagaguuacgcacaaauguggcaacucauguauuuccacaggagagaucuccgauuagcagcgaaugcuauuugcagcgcggucccaguagauuggguuccaacaucgaggacuaccuggucaauacaugcccaucaucaauggaugacuacugaagauaugcuaucaguauggaaucggguuuggauagaagaaaaccccuggauggaggauaaaacucauauuaguagcuggggugauguucccuaucucgggaaacgagaggaucaguggugugguucccucauagguuuaacagcacgggccacaugggcaacgaauauucaaguugcaauaaaucaagucagaagacuaauagguaacgaaaauuauuuagacuauaugacguccaugaaacgcuuuaaaaaugaaucagaccccgaaggagcguuaugguag

SEQ ID NO: 21920 - RNA, 9879 nt, Artificial Sequence
  derived and/or modified CDS sequence (opt6) from DENV-1__EU482821__SS-prME
ucagugacuauguuacugaugcugaugccgacggcucuggcguuucauuugacgacgagagguggggaaccgcacaugaucgugucgaaacaagaacguggaaaaucacugcuuuuuaaaacauccgcuggagucaauauguguacccuuauugcuauggaucucggugaauugugugaagauaccaugacuuacaaauguccacggauaaccgaaacagaaccagacgacguugauugcugguguaacgcaaccgauaccugggucacguaugguacuuguagucaaacgggagaacauagaagagauaaacgcuccguugccuuggcuccacauguaggccuagguuuagaaacccgaaccgaaaccuggaugucgucagaaggugcuuggaaacagauacaaagaguagaaacgugggccuuaagacacccggguuucacugugauagcacuauucuuagcgcacgcuauuggaacgagcauuacucaaaaaggaauuauauucauccuucuuaugcuaguaacaccuucaauggcaaugcgaugcguaggaauagguaaccgggauuuuguagaaggucuaucaggggcaacauggguugauguagucuuagaacacggguccuguguaacuacuauggcuaaagacaaaccaacacuagauauagaacuacucaaaacugaagucacgaauccagcaguauuaagaaaacuauguaucgaagcaaaaauauccaacacaacgacugauucaagauguccuacgcaaggugaagcuacucuuguagaagaacaagacgcgaacuuuguaugucgucgaacauucguagauagagguuggggcaauggaugcggauuauucggaaaaggaagccuaauaacaugugcaaaguuuaaaugcguuacaaaacuugaaggcaaaauaguacaauaugaaaauuugaaauacucagugauaguaacagugcacaccggagaucaacaucaaguuggcaacgaaagcacagaacauggaacaaccgcaaccaucacuccucaagccccuacaacggaaauacaacuaaccgacuacggggcauuaacccucgauuguagcccccgaacaggguuagacuuuaaugaaauggucuuacucaccaugaaagaaaagucguggcuaguacauaaacaaugguuucuagaucuaccucuacccuggacaucgggggcuuccacaagucaggaaacauggaauagacaagaccuuuuaguaacguucaaaacagcucaugccaaaaagcaggaagugguuguauuaggcucacaagaaggagccaugcacacggcgcuaacaggagcaacugagauucaaacaagugggacgacgacaauuuuugcgggucaccuuaaguguagauuaaagauggauaaguuaacgcuuaaagguaugaguuaugugauguguacagggucuuucaaauuagaaaaagaagucgcugaaacacagcacggaacaguauuaguacaaaucaaguacgagggcacagacgcgccauguaaaauuccuuuuagcacccaggaugagaaagggguaacacaaaacgggagacuuauaaccgcaaaccccauuguaaccgacaaagaaaagccagucaauauagaggcagaaccgccuuuuggugagaguuacauaguaauaggagcaggagagaaagcacucaaacuaaguugguuuaagaaagguagcuccauaggaaagauguucgaagcaaccgccaggggcgcucgcagaauggcuaucuuaggcgauacagcaugggacuucgguucuauuggagggguauuuacaucuguagguaaacugguucaccaaauauuuggcacggcauacgguguuuuauuuucaggugucuccuggacaaugaaaauuggaauaggagugcuacugacuugguugggacuaaauucacgcucaaccagucucagcaugacgugcaucgcugugggauuagucacauuauaucucggaguaauggugcaagccgauuccggaugugugaucaacuggaaaggucgagagcuaaaguguggcaguggaauauuugugacaaaugagguacauaccuggacugagcaauauaaguuucaagccgauagccccaaacgcuuauccgcagcuauagggaaagcaugggaagaaggcguauguggaauuagaucagcuacaagacucgaaaauauuauguggaaacaaauaucaaaugaacucaaccacauacuacuugaaaacgauaugaaauucacaguugugguuggagacguggcugguauauuggcacaggguaagaaaaugauacgaccacagccaauggaguacaaauauaguuggaagaguuggggaaaagcgaagauuauuggggcugauguccaaaauaccacguuuaucauugacggaccaaauacucccgaaugcccagaugaucaacgagcuuggaacauuugggaaguagaagacuauggguucggaauuuuuacaacaaacauuugguuaaaguuaagggauucguacacacaaguaugugaucacaggcuaaugagcgcggcgauaaaagauucgaaagccguccaugcagacaugggauauuggauagaaucagagaaaaacgaaacuuggaaacuugcgagagcgucuuuuauugaaguaaaaacuuguauauggccaaaaucacacacacuauggaguaaugguguccuagagucagaaaugaucauaccaaaaauuuauggaggaccaauaucacaacacaacuacaggccaggauauuucacucaaaccgcaggaccauggcaucuaggaaaacuugaauuggacuuugaucuuugcgagggaacuacagucgucguagaugagcauugugguaauagagggccaagccuaagaacgacaacggucaccgggaaaauuauccaugaauggugcuguagaaguuguacucuaccaccuuuacguuucagaggggaagauggcugcugguaugggauggagaucagacccguaaaagaaaaggaagaaaaccugguuaaaucgaugguaagcgcugguuccggagagguagacucauucuccuuagggcuucuauguauaaguauaaugauugaagaaguaaugcggagcagauggucaagaaaaauguuaaugacugggacgcuugcgguauucuuuuuauugauaaugggucaauuaacuuggaacgacuuaaucagacugugcaucaugguuggcgcaaacgcgucagaucgaauggggaugggaacaacguauuuagcgcuaauggcaacauuuaaaaugcguccaauguuugcggucggguuacuauucaggagauuaacaagcagagaagugcuauuguuaacaauugggcucagcuuaguagcaucaguggaacuacccaauagcuuggaagaacuaggggauggacuggcuaugggaaucaugauauuaaaauuacucacagauuuucaaucgcaucagcuaugggcuacacuauuaagccuaaccuucaucaaaacaacauucagucuacauuaugcuuggaaaacaauggcgaugguauuaaguauugucucccuguucccuuugugucugaguacaacgagucagaaaacuaccuggcucccuguucucuuaggcagccucggcugcaaaccccugacuauguuucuuauagcagagaauaaaauauggggaagacguagcuggccauuaaaugagggaauaauggcuguuggaauaguaaguauacuacuaucaucacuacugaagaacgauguaccacuugcuggucccuuaauagcgggaggcauguuaauagccugcuacguuauaagcggaaguucugccgaccuuaguuuggaaaaagcagcagaaguuucuugggaagaagaagcugaacacucuggugcgucccacaauaucuuaguagaaguucaagaugaugggacaaugaaaaucaaagacgaagaacgagaugauacccuaacuauccuacuuaaggcaacuuuacuagccgucagugguguguauccacuaagcauuccggcaacccuauuuguaugguauuucuggcagaagaagaaacaaagaaguggagucuugugggacacaccgucaccacccgagguuggaagggcuguauuggacgauggaauuuauagaaucaugcaacgaggguugcugggaaggucgcaggucgguguagguguauuucaagaaaaugucuuucacacaauguggcacguuacgcggggagcaguauuaauguaucaggggaaacggcuagaaccauccugggcaucuguaaagaaagaucugauaucauaugguggagguuggcgauuacagggaucuuggaauacuggagaggaaguacaaguaauagccguagaaccggggaaaaaccccaaaaauguacaaacagcucccggaacuuuuaaaacgccugagggugaaguuggcgcaauagccuuagacuucaaaccgggaaccagcgguagucccauuguaaaucgugaagggaaaauagugggauuauacgguaauggaguagucacuacaagcggcacguacguuucagcaauagcucaggcuaaagccagccaagaggguccauuaccagaaauagaagacgagguauucagaaaacggaaccuuacaauuauggaucuacauccgggcagcggcaaaacucgccgauacuuaccugcaauagugcgagaagccauaaaaagaaaacuaagaacgcugaucuuagcuccgacaaggguuguagcaucggaaauggcugaagcauuaaaaggaaugccaauccguuaucagacaacugcagugaaaucagaacauacaggaaaggaaauaguggaccuaaugugccacgcaacuuuuacaaugagguugcuuagcccagugagaguaccaaauuacaacaugauaauuauggaugaagcucauuuuacagacccuuccucaauugcagcacgaggauacauaaguacacgcgugggcaugggagaggcagcggcaauauuuaugaccgcgacacccccuggaagcguugaagcauuuccgcagaguaaugccgucauucaagacgaagagagagauauuccggaacguucuuggaacuccggauaugaauggauuacugacuucccuggcaagacuguuugguucguaccaaguauuaaaucgggaaacgacauugcaaacugucucagaaagaacgggaaaagggucauacaauugucacggaagacauucgacacugaauaucagaagacuaaaaacaacgacugggauuauguuguaaccacugauaucagugaaaugggugcuaauuucagggcggauagaguaauugacccaagaagaugccucaagccagugauucuuaaggaugguccagagagagugauacuugcuggaccaaugccugucacagucgcauccgcggcucagagacgaggcagaauuggcagaaaucacaauaaggaaggagaccaauacaucuacaugggacagccacuuaauaaugacgaagaccaugcucauuggacugaggcaaagaugcuguuggauaauaucaauacaccagagggcauuauaccagcgcuauuugagccagagagagagaaaagugcagcgauugauggagaauaucgguuacgcggggaagcucgcaagacuuuuguagaacucaugagacgcggugacuugccggucugguuaaguuauaagguagcuucggaaggcuuccaauauagugacagaagaugguguuuugacggugaaagaaacaaccaaguacuagaggagaauauggacguagaaauuuggacgaaggaaggagaaaggaagaaacuaaggccacguugguuggaugcucggacauauagugacccguuagcucuacgcgaauuuaaagaguuugccgcaggaagaagaucaguuucaggagacuugauacuggagauaggaaaacuaccacaacaucuuacccagcgcgcucaaaaugcauuagacaaccuaguuauguuacacaauagugaacaaggcggcagagccuaucgucaugcaauggaggaauugccagacacgauagagacauuaaugcuacuugcucuaauagcugucuuaacgggaggaguuacacuauucuuucuaaguggacgaggcuuaggaaaaacaucaauaggacuacuauguguaauggcuagcuccguacuguuauggauggcauccguugagccgcauuggauagccgcaucgauaauauuagaauuuuuccuaaugguucucuugauacccgaaccagauagacaacgcaccccacaagauaaucaauuagcuuauguagucauuggacuuuuauucaugauauugacagucgcagcaaaugagaugggacuuuuagaaacgacuaagaaagauuuaggaauaggucauguagcagucgaaaaucaucaucaugccgcgauguuagacguagauuuacauccugcuagugcuuggacauuauaugccguagcaacaaccaucauaacuccaaugaugaggcauacuauagaaaauacuacugcgaauauaagucugacagcaauagcaaaucaagccgccauccucauggguuuagauaagggguggccaauaucgaaaauggauauugguguaccacuuuuggcuuuggguugcuacagucaagucaacccacuaacacugaccgcagcagugcuaauguuaguagcacauuacgcaauaaucggucccggacuacaggcaaaagcaacucgugaggcacaaaagagaacagccgcuggaauuaugaaaaauccuacuguggacggaauuguugcgauagauuuagacccaguuguguacgacgcaaaguucgaaaaacaacugggacaaauaaugcuauugauuuugugcaccucacaaauauuacuuaugcgaacuacaugggcauuaugugaauccauaacgcuagcuacaggaccuuuaacaacauuaugggaaggauccccagguaaguuuuggaacacaacgauugcaguaaguauggcuaauaucuuucgagguagcuacuuggcaggagcaggguuagcauuuucgcucaugaaaagucuaggaggaggacguagagguacaggugcgcaaggagaaacacuaggagaaaaguggaaacggcaacuaaaucaacuaaguaaaagcgaguuuaauacauacaaaagaucaggaauaauggaagucgaucguucggaagcgaaagaaggguuaaaaagaggagaaacuacgaaacacgcagucucgagggguacggcuaaacuuaggugguucgucgaacguaacuuaguuaaaccugaagggaaaguaauagaucugggcugcggucgcgggggauggagcuauuauugcgcaggauuaaagaaaguuacggaaguaaaaggauauacgaaaggugguccuggucaugaagaaccgauacccauggcuacuuauggauggaacuuaguuaaauuacauagcggcaaagacguauucuuuauaccaccugaaaaaugcgauacccuacuaugugauauuggcgaaucgucaccuaauccgaccaucgaagagggaagaacucuucgcguauuaaagauggucgagccuugguugcgaggaaaucaauucuguaucaaaauauugaaccccuacaugccuagcguaguugaaacucuagaacaaaugcaaaggaagcacggagggaugcuuguaagaaauccuuuaaguagaaacucuacacacgaaauguauuggguaucuugugggacgggaaacaucguaucagcugucaauaugacaucaagaauguugcugaaucgauucacaauggcucaccgaaagccgaccuaugagagagauguugaccugggcgcugggacacgacauguagccguugaaccggaaguugcuaaucuagacauaauagggcaaagaauugaaaauauuaaacaugaacauaaaucgacguggcauuacgacgaagacaacccguacaaaacuugggcauaucacggaagcuaugaaguaaagccuagcgguagugcaucaagcauggucaacggaguugucaaacuucuaacuaaacccugggacguaaucccaaugguuacucagauugccaugacugacacgacaccuuucgggcaacaacgugucuuuaaagaaaaaguagauacccgcaccccaaaagccaagagaggcaccgcccaaauaauggaaguaaccgcaaaauggcucugggguuuccuaucuagaaacaagaagccaagaauaugcacacgagaagaguucacuaggaaaguacgaaguaacgcagcaauaggcgcuguauucguggacgagaaccaguggaacuccgcaaaggaagcaguggaagaugaacguuuuugggauuuaguucaucgcgaaagggaauuacacaagcaagguaagugcgccacgugcguauauaauaugaugggaaagcgugagaagaaauugggcgaguucggaaaagccaaaggcagucgagcgauuugguauaugugguuaggggcacgauuccucgaguucgaagcgcuaggguucaugaacgaagaccacugguucucccgagaaaauucucuuucgggcguagaaggagagggccuucauaaacuugguuauauauuaagagacauaagcaacauaccaggaggaaacauguacgcggaugauacagccggaugggacacgcgaaucacggaagaugaucuacaaaaugaagcuaggauuaccgacauaauggaaccggaacaugcauuacuugcuaagagcaucuuuaaacuaacguaccaaaauaaagugguacgcguccaaagaccagcgaaaaaugguacugugauggauguaauaucccguagagaucaaagaggaaguggacaagucggaacuuacggauuaaacacuuucacaaauauggaagcacagcuuauuagacaaauggagucagaagguauuuucucaccauccgaacuagaaaccccuaaucuggcagaaagaguucuagacugguuggaaaaauauggaguagaaagguuaaaaagaauggcaauuuccggcgaugacuguguggugaaaccuauugacgauagauuugcaacagcauuaacugcucuaaaugacaugggaaaaguacgaaaggacaucccacaaugggagccaagcaaaggauggaaugauuggcaacaaguuccauuuuguucucaccauuuucaucaauugauaaugaaagauggacgugaaauaguggucccauguagaaaucaagaugaguuagugggcagagcaagagugucucaaggugcgggauggagcuugagggaaaccgcauguuugggcaagagcuacgcacaaauguggcaacuuauguauuuucaucggcgagaucuuagauuagcagcaaaugcaauaugcuccgcuguacccgucgauuggauuccuacgaguagaacaacguggucuauacacgcacaccaccaauggaugaccacagaggacauguuaagugucuggaauagaguuuggaucgaagaaaauccauggauggaagauaaaacacacauuagcaguuggggagauguuccauacuuaggaaagcgagaagaccaguggugugguucccuuauaggacuaacggcuagagcgaccugggcgacgaauauucaaguugcaauuaaccagguacgacgccucauugggaacgaaaacuacuuagauuauaugaccucuaugaaacgguucaagaaugaaagcgaucccgaaggugcucuaugguaa

SEQ ID NO: 21921 - RNA, 9879 nt, Artificial Sequence
  derived and/or modified CDS sequence (opt6) from DENV-1__EU482822__SS-prME
ucuguaacuaugcuguuaauguuaaugccaacggcucuugcguuccacuuaacuacuagaggaggugaaccacauaugauaguuaccaaacaagaacgagguaaaucucuucucuucaaaacaagugcaggaguaaauaugugcacuuuaauagcgauggauuuaggugaauuaugugaagacacaaugaccuacaaaugcccuagaauaacagaagcagaacccgaugaugucgacuguugguguaaugcaaccgacaccugggucacauauggaacuuguucgcaaacaggggaacacaggcgggacaaaagaucuguggcucuagcgccacauguaggacuuggauuagagacuagaacggaaacuuggaugaguucugaaggggcauggaaacaaauucaacgggucgaaacaugggcacuuagacaccccggauucacugugauagcacuauuuuuagcacaugcgauagggacaucaauuacgcaaaaagguaucauauuuauuuuauuaauguuaguaaccccuucgauggcgaugcgauguguggggauaggcucgagggacuucgucgaaggcuuaucaggggcgaccuggguugauguuguacuugaacauggaucaugcguaacaacgauggcuaaagacaaaccuacgcuagauaucgaacuacuuaaaacagaaguaacaaaccccgcaauuuuacgaaaacuuugcauagaagcaaaaauuucgaauacaacgacagauaguagaugucccacccagggugaagcaacacuuauggaagaacaagaugcaaacuuuguuugcagaagaacguucgucgauagaggguggggaaacggcuguggguuguuugguaaaggaagucugauuaccugugcuaaauucaaguguguuacuaagcuagaaggaaagauaguccaauacgaaaaccuaaaauauagcgugauaguaacagugcauacaggggaucaacaucaagucggaaacgaaucaacugaacauggaacuacagcaacgauaaccccucaagcgccuacaagcgaaauacaauuaacagauuauggagcguuaacacuagacugcucaccccggacaggacuagacuucaaugaaaugguuuuacuaacgaugaaagaaaaauccuggcucgugcauaaacaaugguuucuagauuuacccuuaccauggacuucuggugccaguacaagucaggaaacuuggaaccggcaagaucuauuaguuacguuuaagacggcucacgccaagaaacaagaaguagucguacucgguucacaggagggggcuaugcacacggcucuuacaggagcaacggaaauacaaacaaguggaacaacaacaauauucgccggacauuuaaaguguaggcuaaaaauggacaaauuaacacucaaagggaugaguuacgugaugugcacggggagcuuuaaacuagaaaaggaaguggcggaaacacagcauggaacgguguuaguccaaauuaaguacgaagguacggaugcaccuuguaaaaucccguuuuccacucaagaugaaaaagggguuacacaaaauggacgauuaaucacagcuaaccccaucgucaccgauaaagaaaaacccguaaacauugaagccgaaccaccuuuuggugaaagcuauauuguaauaggagccggugaaaaagccuuaaagcuaaguugguuuaagaaaggaucuagcaucggcaaaauguuugaggcaacagcacguggugcucgaagaauggcgauacuaggugauaccgcuugggauuucggauccauuggagggguauucacgaguauugggaaacuuguacaucagauauuuggaacagcauauggaguguuauuuucuggcguuucuuggacuaugaaaauaggaauaggcguauuacuaaccugguuagggcucaauucucgcuccacaagccuaucgaugacuuguauagcaguuggccuaguaacacuuuauuuaggaguaaugguucaagcugauagcggauguguaauaaauuggaaaggccgagaauugaaauguggaagcgguaucuucgugacgaaugagguccauaccuggacagaacaguauaaauuucaagccgacuccccuaaacguuuaagcgcagccaucggcaaagcaugggaagaggggguaugugguauaagaucggcgacaagacuugaaaacauaauguggaaacagauuucaaaugaacuuaaucauauauuauuagagaacgauaugaaguucacuguugucguuggugauguagugggaauauuggcgcaagguaaaaagaugauaagaccacagcccauggagcauaaauacaguuggaagucguggggaaaagcaaaaauaauuggcgcagauguucagaacacgacauuuauaauagauggaccuaacacgccugaauguccagacgaccaaagggcuuggaacauuugggaagucgaagauuacggauuuggcauauuuacuacuaacaucugguuaaaaaugagggacucauacacacagguuugugaucaccggcugaugagugcggccauaaaagacucaaaggcuguccaugcagauauggguuauuggauugaaagcgagaaaaaugaaacuuggaaauuagcuagagcgucuuuuauagagguuaaaaccuguauauggcccaaaucccacaccuuauggaguaaugguguacuggaaagugagaugauuauaccgaaaauuuaugggggaccuauaagucaacauaauuacagaccagguuacuuuacgcaaacugccgguccuuggcacuuaggaaagcuagaacuagauuucgaccugugcgaaggaacaacugucguagucgacgaacauuguggaaaccgagguccaaguuugagaacuacaacugucaccggcaagauaauacacgaauggugcugcagaucgugcacguuacccccuuuaagauuuaagggcgaggacggaugcugguacgggauggagaucagacccguuaaagaaaaagaggaaaaccuaguaaaaaguaugguuuccgccgguagcggagagguagacucuuucagucuaggacuuuuauguaucucaauaaugauugaggaaguuaugagaucaagguggagucgaaaaauguuaaugacagggacguuagcgguauuuuugcuacugauaaugggucaacuaacguggaacgauuuaauaagauuguguauaaugguaggagcuaaugcgucagauagaauggggauggguacuacuuauuuagcauuaauggcgacguuuaagaugagaccgauguucgcagucgguuuauuguucaggaggcucacaucccgugaaguccuucugcuuaccauaggccuaucguuagucgcaucgguagaacuaccuaacagcuuggaagaguugggugaugguuuggcaaugggcauuaugauacuaaaacuauuaacugauuuucaaagccaucaauugugggcuacucuauuaucacuaacauuuauuaaaacuacacugagcuuacacuaugcguggaagacaauggcaaugguucuaucaauaguaucauuaauuccacuguguuuaagcacgacaucgcagaagacuacuugguuaccaguucugcuuggaucuuuaggcuguaaaccacuuaccauguuucuaauugcggaaaacaagauuuggggaagaaaaaguuggccacuaaaugaaggaauaauggcgguaggugugguaucaauacuucuaagcagcuuacuaaagaaugauguuccgcuggcuggacccuuaauagccgguggaauguuaaucgcgugcuacguuauuaguggaucuucagcggacuuaucauuggaaaaagcagcagaggucucuugggaagaagaagcagagcauaguggcgccagccauaguauucuuguggaaguacaagacgacggaacaaugaaaauaaaagaugaagagagagacgauacgcucacuauauuguugaaagcgacguuguuagcaguuucaggaguguauccucuauccauuccugcuacacuguuugugugguacuucuggcagaagaagaaacaaagguccgggguauuaugggauacuccuaguccaccugaaguagagagagcagugcuugacgauggaauuuaucgaauaaugcaacgaggucuauuaggccgcucucaggucggaguggggguauuucaggaaaauguuuuucacaccauguggcaugugacacggggcgcugugcucauguaucaggguaaaagacuugaaccaaguugggcaucaguaaagaaagacuuaaucaguuauggaggugguuggcggcuacaggggucauggaauacgggcgaagaaguacaagucauagcuguagagccugggaaaaacccuaaaaauguccaaacugcuccagggacauucaaaacgccugaaggugagguuggcgcgauagcuuuagauuuuaaaccaggaacaagcgggaguccuaucguaaauagggaagggaaaaucgucggcuuauauggaaacggaguaguuacaacuucaggaacauacguaucugcaauagcccaggccaaggcuucccaagaaggcccgcugcccgaaauagaagaugaaguuuuccgaaagagaaacuuaacgauuauggaucuacacccagguucaggaaagacccgacguuacuuaccugcaauaguuagagaagcaauuaagcguaaacuuaggacuuuaauccuugcuccaacaagaguugucgcaagugaaauggcagaagcgcuuaaagguaugccgauacgguaucaaacuacggcaguaaaaagugaacauacuggaaaagagaucguagaccucaugugccaugcaacauuuacaaugcgucuuuuaucgccagucaggguaccgaauuauaauaugauaauuauggaugaggcacacuuuaccgauccaucgucgaucgcagcacggggauacauaagcacgagaguaggaaugggggaggcugcugcaauauucaugacagcaacaccaccggguagcguugaagcauucccccaaaguaacgcaguuauacaagacgaagaacgagauauuccagaacgcucuuggaacaguggauaugaauggauuacugacuuucccggcaaaacuguaugguuuguuccuaguauaaagagcggaaaugauauagcuaauuguuuaaggaaaaauggaaaaagagugauccagcuaagccggaaaaccuuugauaccgaauaccagaaaacgaaaaauaacgauugggauuauguuguuacaacugacauaagugaaaugggggcuaauuuucgagccgaccgaguaauagacccgcgacguugcuuaaagcccgucauauuaaaggauggaccagaaagaguaauauuagcagguccgaugccaguaacugucgccagugcagcgcaaagaagaggacgcauuggaagaaaucacaauaaggaaggagaucaauacauuuauaugggacagccuuuaaauaacgacgaagaucaugcucacuggaccgaggcaaagaugcucuuggacaauauaaauacaccagaaggaauaauuccagcauuauucgaaccugaaagagagaaaagcgcugcuaucgauggcgaauaucgauuaagaggagaagcacguaaaacauucguugaacuuaugcgacguggagaccugcccguguggcucucauacaaaguggcaucugagggcuuucaauauucugacagaagauggugcuucgacggagaacgcaacaaccaagugcucgaagagaauauggauguugaaauuuggacuaaggagggugaacggaaaaaguuaaggcccagaugguuagaugcucgaacguacucagauccacuggcacuccgagaauuuaaggaguuugcggcaggaaggagaucaguuaguggagauuugauucuagaaauaggaaaauugccucaacauuuaacucagagggcacaaaaugcauuagauaaucucguaaugcuccauaacagugaacaaggagguagagccuauagacaugcuauggaagaauugcccgacacaaucgaaacucuaaugcuacucgcuuuaauagcugucuugacugguggaguaacgcuauucuuccuaagcggaaggggauugggaaagacuucuaucggucuacucuguguaauggcaaguuccguccuuuuguggauggcaucagucgaaccccauuggauagcagcaaguauuaucuuggaguucuuuuuaaugguauugcuaauacccgaaccugaucgacagaggaccccucaagauaaucagcuugcauacguaguaauuggacugcuguucaugauauuaacaguagcagcaaacgaaaugggacuuuuagaaacaacgaagaaagaccucgguaucggucacguagcggucgagaaccaucaucaugcaacaaugcuagauguagauuuacauccagcgagugcuuggacauuauaugcuguugccacgacuauuaucacacccaugaugcggcauacgauagagaauacaaccgcaaacauaagccucacggcaauagcaaaccaggcagcgaucuuaaugggcuuagauaaaggauggccgauaucaaaaauggauauaggggucccacuacuagcgcuagguugcuacucgcaggucaacccguuaacauugacugccgcuguuuuaauguuagucgcacauuaugcgaucauagggccuggucuacaagccaaagcaaccagagaggcacagaagcgaacagcagcaggaauaaugaagaauccgacuguggacgggauaguagcgauagacuuggauccugugguguacgaugcuaaauucgaaaaacaacuaggacaaauuauguuauuaauauuauguaccucucagauauuauuaaugcgaacuacaugggcucuaugcgaaaguauaacauuagcaacggggccacuuacaacgcuuugggaagguagcccaggaaaauuuuggaacacaacgauugcgguaucaauggcgaacauauuuagaggauccuaccuugccggagcuggguuggcauuuuccuugaugaaaucucuagggggaggacgcagagguacuggcgcucaaggagaaacacucggugaaaaauggaagagacaacuuaaucaguuaucaaaaagcgaauuuaacaucuauaaaaggucugguauuauggaaguagauaggucugaagccaaggaagggcuuaaaagaggcgagacuacccggcaugcugucuccagaggaacagcgaaacugcgcugguuuguagaaagaaaccuggucaaacccgaaggaaaaguuauugacuugggauguggucgaggagguuggaguuacuauugugcagguuugaagaaagugacagaaguaaaagguuauacuaaaggcggcccgggccaugaggaaccaauaccuauggccacguauggauggaaucugguaaaacuucauucaggaaaggauguauucuuuacaccaccggagaaaugcgacacacuacuaugugacauaggggagucuucacccaauccuacaauugaggaagggagaacuuugcgcguuuugaagaugguugagccaugguugagggguaaucaauucuguauaaaaauacuuaaucccuauaugccaagcguggucgaaacacuagagcaaaugcaaaggaaacacggcgguauguuaguucguaacccgcuaagccguaauucaacgcaugaaauguauuggguuaguugcggcacugguaacauaguaagcgcugugaauaugacaagccguaugcuucuaaacagauucacuauggcacauagaaaacccacuuaugaaaaagacgucgauuuaggcgcagggacgagacaugucgccguggagccagaaguugcgaaccuagauauaauagggcaacgaauugaaaauaucaaacaugagcauaaauccacuuggcauuaugacgaagacaacccguacaaaacaugggccuaucacggaucauaugagguaaagccgucugguuccgcaucuucaauggugaauggugucguuaaacuacuaacaaaacccugggacgugauacccauggugacucaaauagcuaugacggauacuacacccuuugggcaacaaagagucuucaaagagaaggucgauacucguacuccuaaggcgaagcgagggacgguccaaauaauggaaguaacugcccgguggcuauggggauuuuugaguagaaacaagaaaccaaggauauguacgagagaagaauuuacaagaaaagugcgcaguaaugcagcaauaggggccguuuucguggaugaaaaccaauggaacucggcaaaggaagcaguugaagaugagcgauuuugggaccuugugaaaaaggaaagggaauuacacaagcaagguaagugcgcuaccugcguuuacaauaugaugggaaagagggagaaaaaguuaggagaguucggaaaggcaaaaggcagcagggcgauaugguauaugugguuaggugcaagauuucuggaauuugaggcccuuggguuuaugaaugaagaucacugguucucacgggaaaauucucuaucuggaguagagggugagggacuccauaaacucgguuacauucuaagagacauaucaaagauuccugguggaaacauguaugcggacgacaccgcagguugggacacucgaauaacagaagacgaccugcagaacgaggcuaaaauaacagauauaauggagccggaacaugcccuauuagcuaccagcauuuucaagcuaacguaucaaaacaaaguaguaagaguacagcgucccgcuaaaaacgguacuguuauggauguuauuagccgcagagaucaacgaggcucgggucaaguugguacuuauggauuaaauacuuuuacuaauauggaggcacaacuuauaagacagauggaaagcgaagguaucuuuuuaccaucagaacuugaaacuccgaaucucgcagaaagaguuuuagacuggcuagaaaaauauggagucgaacgauuaaaaagaauggcuauaucaggggaugacuguguaguaaagccaaucgacgaucguuucgcaaccgcgcuuacagcacugaacgauaugggaaaagugagaaaggauaucccucaaugggagccgucaaaaggauggaaugacuggcagcaaguccccuuuugcucacaccauuuccaucaacugaucaugaaagauggccgugaaauuguaguaccauguagaaaccaagaugagcuuguugggagagcacgaguuucgcagggagcugguugguccuuacgagaaacugcauguuuagguaaaaguuaugcucaaauguggcagcuuauguauuuucaucgaagggaccucagacuggcggcuaaugccauaugcucggcggucccuguagauuggguaccaacaagucggacaacauggagcauucacgcacaucaucaauggaugacaacugaagauauguuaucaguguggaauagaguuuggauagaagaaaacccauggauggaggacaaaacgcaugugucaaguuggggagaugugccauaucuagguaaaagagaagaucaaugguguggcucguugauaggacuaacugccagagcgacaugggcaaguaauauacaaguggcaauaaaucaggugcguagacuuauuggcaacgagaauuaucuugauuauaugaccucaaugaaaagguuuaagaaugaaggagauccagaaggugcuuugugguaa

SEQ ID NO: 21922 - RNA, 9879 nt, Artificial Sequence
  derived and/or modified CDS sequence (opt6) from DENV-1__EU482476__SS-prME
ucuguaacuauguuacuuaugcucaugccuacagcacucgcauuucauuuaacgacgcguggaggagaaccucacaugauaguuacaaaacaagaacggggaaagagcuugcuuuuuaaaacaagcgcagggguaaauauguguacacucauugcaauggaccuuggugagcuuugugaggauacuaugacuuacaaaugucccagaaucacugaagcugaaccagacgauguggacuguuggugcaaugcaacagauacauggguuacguacggaacuuguucacaaacaggagagcaccggagagauaagaggaguguggcuuuggcaccccacguaggacuaggauuagagaccaggacagaaacuuggaugagcuccgaaggagcuuggaaacaaauacagaggguagagacaugggcacuucgucacccaggguucaccguuauugcucucuuccuugcccacgccauagguacaaguauaacacaaaaaggaauaauauuuauucuccuaaugcuagugacaccuucgauggcaaugagauguguaggaauuggaucacgagacuucguagaaggucuaaguggagcuacguggguagacguaguacuugagcacggaucgugcguuaccacaauggccaaagacaaacccacacucgacauagaacuuuuaaaaacagaaguaaccaauccagcuguauuaagaaaacuuuguauagaagcuaaaauuucaaacacaaccacugauucacggugucccacucagggcgaagcaacacucauggaagaacaagaugcuaacuuuguuugucgaagaacauucguggacagaggaugggggaaugguugcggacuuuucgggaaaggaucuuuaauaacaugugcuaaauuuaaaugcgucacgaaacuagaaggaaaaauaguucaauaugagaacuuaaaauacaguguaauaguaacaguacauacaggugaccaacaucagguugguaaugaaucuacagaacacggaacgaccgcaacuauaaccccacaagcgcccacgucggagauccaacugacugauuauggugccuuaacccuugauugcucuccgagaaccgguuuggauuuuaaugagaugguacuccuaacuaugaaagaaaaaucauggcugguucauaagcaaugguuucucgaccuuccucugccguggacauccggagccuccacaagucaagaaaccuggaaccggcaagaucuucuaguaacguucaagacugcacacgccaagaaacaagagguugugguccugggaucacaagagggcgcaaugcauacugcgcuaacaggagcuaccgagauacaaacaagugguacgaccacaaucuuugcagggcaucuuaagugcaggcuaaagauggauaagcuaacuuuaaagggaaugucguacguaauguguacuggcaguuuuaaauuagaaaaagaaguagcagaaacgcaacauggaacaguguuaguccaaauuaaauaugaaggcacagaugccccgugcaaaaucccuuuuucgacacaggaugaaaaggguguuacacaaaaugggagguuaauuaccgccaacccgauaguaacugauaaagaaaagccaguaaauauagaagcggagccaccguuuggagagaguuauauagucauaggggcaggcgaaaaggcuuuaaaauugucuugguucaagaaggguucaucaauaggaaaaauguuugaagcgacugcaagaggugcucguagaauggcgauacucggagauacggcuugggacuucggaucaauagggggaguauuuacgaguguuggaaaacuuguucaccaaauauuuggaacagcguacggcguuuuauucucuggaguaucguggacaaugaaaaucggaaucggcguauugcuaacuuggcuaggauuaaacagcagaucaacuagcuuaaguaugacuuguauagcagucggguugguuacacuauaccuagggguaaugguucaggccgauucagguuguguaauuaacuggaaaggaagggaguuaaaauguggauccggaauuuucguaacaaaugagguacauacuuggacugaacaguacaaauuucaagcugauucuccgaaacguuugucagcggcgaucggaaaagcaugggaagagggcgucuguggcauaagaagcgccaccagguuagaaaauaucauguggaaacagauaucuaaugaauuaaaccacauucugcuggaaaauggcaugaaauuuacagugguaguaggcgacgugguaggaauccuugcgcaagggaagaaaaugauaagaccacaaccaauggaacacaaauacuccuggaaaagcugggguaaagcuaaaauuauaggggcggauguacaaaacacaacauucauaauagauggccccaauacacccgaaugcccagacgaucaacgggcauggaauaucugggaggucgaagauuacggguuuggcauauucacgacaaauauuugguuaaaacugcgggacucuuauacacaaguuugcgaucauagauuaaugagugcagcaauaaaagauucaaaggcagugcacgcagauauggguuauuggaucgagucugagaaaaacgaaacauggaagcuagccagagccaguuucauagaagugaagaccuguauauggccaaagagccauacccuguggaguaacggcguguuagaaucugagaugaucauaccuaaaauuuaugguggccccauuucacaacacaacuacagaccaggcuauuucacacaaacggcaggcccguggcaccuaggaaaacuugaacuagauuuugaccugugugaagguacuacaguuguugucgaugaacacuguggaaauagagggccgucuuuacgcacuacaacuguaacaggaaaaauuauucacgaauggugcugccgaaguuguacacuaccacccuuaagauucaaaggggaagauggguguugguaugguauggagauaagaccugucaaagaaaaagaagaaaaucuagugaaaucgaugguaagugcuggaaguggagagguugacagcuuuagucuagggcuuuuauguaccaguauuaugauagaggaaguaaugcgaucaagaugguccagaaagauguuaaugacagggacuuuagcaguauuccuguuguugauuaugggucaacuaacguggaaugaucugauaagacuauguaucaugguuggggcgaaugcaagugacagaaugggcauggguacaaccuaucuagcucucauggccacauuuaaaaugaggccuauguucgcaguugguuuauuauuucgucgacuaacaucaagggagguccuccuauuaacaauuggauugucgcuaguugcauccguugaacuuccuaauucacuggaagaacuaggugauggccuagcaauggggauaaugauccucaaacuuuuaacagacuuucaaucgcaucaacuuugggccacccuacuuuccuugacguucauuaaaaccaccuuaucauugcauuaugcauggaaaacuauggcuaugguacuaucaaucguaaguuuauuuccacucugccuuucaacuacgucucagaaaacaacuuggcuacccguacuauuaggaaguuuaggcuguaaaccauuaacgauguuccucaucgcagagaauaaaauuuggggcaggaaauccuggccguuaaaugaagguauaauggcaguugguguuguaagcauauuacucucaucacuucucaaaaacgaugucccgcuagccggaccacuuauagccggagguaugcugauugcuuguuacgugauuaguggaagcuccgcugaucuaucacuagaaaaggccgcugagguaucuugggaagaggaggcagagcauucaggagcuucacacaacauauuaguagaggugcaagacgacgguacuaugaagauaaaagaugaggaaagagacgacacacuaacuauucuccuaaaagcaacuuuacuugcugucagugguguauauccauuaucuauaccugcaacacuguuuguaugguacuuuuggcagaaaaagaaacaacgaucugguguauugugggacacgccaucuccuccugaagucgagagagcuguauuagaugacggaaucuaucggauaaugcagcggggauuauuagggcguucucaagugggagucgggguguuucaagaaaauguauuccauacgauguggcacgucacacguggagcaguauuaauguaccaaggaaaaagacuggaaccuucgugggcauccgugaagaaagaccucaucucauauggagguggauggcgcuuacaaggaucuuggaauacuggugaagaaguacaggucaucgcuguagagccaggcaaaaacccaaagaauguccagacggcacccggaacauucaaaacgccugaaggcgaggugggcgcuauagcuuuagauuuuaaaccuggaacaucagguagucccauuguaaauagggagggcaaaauagucgguuuauaugguaacggcguuguuacaacaagugguacauacgugucagcgaucgcucaagcgaaagcaucacaagaagggccgcuacccgagauugaagaugaaguuuuccgaaaaaggaaccuuaccauuauggaccugcacccuggaagcggaaaaaccaggcgauacuugcccgcuauuguacgugaagcaauaaaaagaaagcuaagaacucuuauauuagccccuacaagaguuguggcaagcgaaauggcggaggcccuuaaaggaaugcccauacgauaucaaacaacagcaguaaagucugagcauacagguaaggagauaguugaccugaugugccaugcuacuuuuaccaugcgacuuuuaagcccaguuaggguuccaaauuauaauaugauaauaauggaugaagcucauuuuacagacccaucgucgauagccgccagaggguauaucagcacuaggguugggaugggugaagcagcugcuaucuuuaugacugccacaccaccggguucuguugaagcauuuccucaaagcaacgcugugauacaagacgaagaacgugacauuccagagcgauccuggaauagugguuaugaauggauaaccgauuuuccuggaaaaacgguaugguuuguacccuccaucaaaucaggcaaugauauugcaaacugucuuaggaaaaauggaaaaagaguaauacagcuuaguagaaaaaccuucgacacugaauaccagaaaacuaaaaauaaugacugggacuauguaguaacuaccgacaucucagaaaugggcgcgaauuuuagagcagaucguguuauugauccacggcguuguuuaaagcccguaauauugaaagaugguccugagagagucauacuagcaggaccaaugccaguuacuguggcauccgcugcucaaagacgcggacgcauagguagaaaucauaacaaagagggggaucaauacauauauaugggucagccacuuaauaaugacgaagaccaugcacacuggacggaggcaaaaauguuacuugauaacaucaauacaccugaaggcauuauccccgcucuauuugaacccgagcgggaaaagucagcagcaaucgauggggaauauagacuuagaggagaggcuaggaagacauuuguagaguuaaugcggcguggagauuuacccguaugguugagcuauaagguugcaagugagggauuccaguacagugauagaagaugguguuuugauggugaaaggaauaaucaaguacucgaagaaaauauggauguggaaauuuggacuaaggaaggagagaggaaaaaguuaagacccagauggcuggaugccagaacuuauagcgauccauuggcacugcgugaauuuaaagaauuugcagcaggccggcgaucuguaagcggggacuuaauacuggaaauugguaagcuaccucaacaccuaacacaaagggcacagaaugcacuggauaauuuagucaugcuacauaauuccgagcagggcggcagagcauauagacacgcaauggaagaguuaccagauacaauagaaacuuugauguuauuagccuuaauugcaguucuaaccggagguguaacccuauucuuucuaucaggacgaggauuagggaaaaccucaauugguuuacuauguguuauggcaucaagcguguugcucuggauggccucaguugaaccccacuggauagccgccucgauaauuuuagaauuuuuccucaugguucuguugaucccagagccugauaggcaacgcacaccacaagacaaucaacuggcguauguuguaauagguuuauuauuuaugauacuaacugucgccgcaaaugagaugggguuacucgaaacaacaaagaaggauuugggcaucggacauguggcaguggagaaucaccaccaugcaacgauguuggacguggaccuacacccagcaucagccuggacgcucuaugcgguggcaacgacuauaaucacuccaaugaugcgccauacgauagagaauacaacggcaaauauuaguuuaacggcuauagcaaaccaagcagcaauauuaauggguuuagacaaagguuggcccauaucuaaaauggauauaggcgucccacuauuagcucuuggauguuacucacaagugaacccucuuacguuaacagccgccguacugauguuaguagcacauuacgcgauaauagguccaggauuacaagccaaagcaaccagggaagcucagaaaagaacagcagcuggaauaaugaaaaauccaacaguagauggaauaguagcuauagaucuagauccaguuguauaugaugcaaaguuugaaaaacaacugggccaaaucaugcucuuaauuuuaugcacaucccaaauacuccuaaugcgaacuacaugggccuuaugugaaucuauaacccucgccacgggaccacuuacaacauuaugggaaggaagcccaggaaaguuuuggaacacaacaaucgcaguuagcauggcaaacauauuuagagguucauauuuagccggugcggguuuagcguuuucacuuaugaaauccuuagguggaggaagacgaggaacgggugcucaaggagaaacauugggugaaaaauggaaacgacaacugaaucagcuuucaaaauccgaguuuaauauauauaaacggagugggauaauggagguugaccgcucagaagcaaaagagggccuaaaaagaggugaaacuacuaggcacgcaguuaguaggggcacggcuaaacuuaggugguuuguggaacgcaauuuagugaaaccagaagguaaagucauagaucuaggcugugggcgagguggguggucauacuauugugcugguuugaaaaagguuacugaagugaaagguuauacgaaagguggaccaggucaugaagaaccuaucccgauggcuaccuauggauggaacuugguaaagcuacauagugggaaagacguauucuuuacuccaccagaaaaaugugauacauugcuaugugacaucggggaaucaucgccaaaccccacgauagaggaaggcagaacguuaagagugcucaagaugguggaaccaugguuacgcggaaaucaguuuugcauuaagauccuaaauccuuauaugccaagcgugguugaaacacuugagcaaaugcagcgcaagcauggugguauguuaguaagaaauccgcugucccgcaauucuacacaugaaauguauuggguaagcugcgguacgggcaacauaguaagcgcggugaacaugacaagucgaaugcuccugaaucguuuuacaauggcgcaucguaaacccacuuaugaaagagauguugaucugggagccggaacaagacacguagcaguggagccugaaguagcgaacuuagacaucauaggacaacguauugaaaauauaaaacacgaacacaaaagcacauggcauuacgaugaagacaacccguacaaaacgugggccuaccauggaucuuacgagguuaaaccaaguggaucagcaucaaguauggucaacgguguugucaaacuacuaacaaaaccaugggauguaauuccaauggucacucagauugccaugacggacacgaccccauuuggacaacaaagagucuucaaggagaaaguugauacacgaacuccgaaagcuaaacgugguaccgcacaaaucauggaagucacugccagaugguuguggggauuucuuaguagaaauaagaaaccccguauauguacacgagaggaguuuacucgcaaaguuagaagcaaugcggcaauuggcgcuguauuuguagacgaaaaucaauggaauagcgcaaaagaagccguggaagaugagagauucugggaucuuguacagaaagaaagagagcuccacaaacaagguaaaugcgcaacaugcguauauaauaugaugggaaaacgcgagaagaaauuaggcgaauuuggcaaagcaaaaggcaguagggcaauuugguauauguggcucggugcgcgguuucucgaguucgaggcuuuaggguuuaugaaugaagaucacugguucagcagagaaaauaguuuaaguggaguagaaggggaaggacuccauaagcucggauacauauugagagauauuucaaaaauuccuggaggaaacauguacgcagaugauaccgcuggaugggauacucgaauaacggaagaugauuuacaaaaugaggcuaaaauuacagauauaauggaaccugaacaugcauugcuagcaaccaguauauuuaaacuaacuuaccagaauaaaguaguucgaguccagcgaccggcuaaaaacggcacgguaauggaugucauuucgcgucgugaccagagagggaguggucaaguagguaccuacggccucaacacauucaccaauauggaagcacaguugauaagacaaauggaaagugaagguauuuuccucccgucagaacuugaaacuccaaacuuagcagaacgaguccuagacugguuggaaaaauauggcguugaacgccuaaaacggauggcuauuaguggagacgauuguguagucaaaccuauugaugaucguuuugccacugcguuagcagcccuaaaugauaugggaaaggucagaaaagacauaccacagugggaaccuaguaaagguuggaacgacuggcaacaagucccauuuugcucccaccauuuccaccaguugauuaugaaagauggacgagaaauaguagugcccugcaggaaccaagacgagcuaguagguagagcccgaguaagucaaggagcuggcuggucucuacgugaaaccgcaugcuuagguaagaguuaugcacaaauguggcaacuuauguauuuucaccguagagaccuuagacuagcagcaaaugcaauaugcucggcgguuccuguagauuggguacccacuuccagaacaaccuggucuauucacgcacaccaucaauggaugacaacggaggauauguugagugucuggaauaggguauggauagaagagaaccccuggauggaagauaaaacgcauguaagcuccuggggugaugugcccuacuuggguaaaagagaagaccaaugguguggaucauuaauaggacuuacagcacgagcuacgugggcauccaacauacaaguugccauaaaucaaguacgucgguuaauagguaaugaaaauuauuuggauuauaugacauccaugaaacgguucaaaaaugagggagauccugaaggagcucugugguga

SEQ ID NO: 21923 - RNA, 9879 nt, Artificial Sequence
  derived and/or modified CDS sequence (opt6) from DENV-1__EU482477__SS-prME
ucgguaacuauguuguuaaugcugaugccaacagcauuggcauuucaccuaacaacaaggggaggagaaccgcacaugauuguaucuaaacaagaaagaggaaaaucauuacuuuucaaaacaagcgccgguguuaauauguguacacuaauugcgauggauuuaggagaacuaugcgaagacacaaugacuuacaaaugcccuaggaucacggaggcugagccagacgacgucgauugcuggugcaaugcgacagauaccuggguuacauacggaaccuguagucaaacgggugaacaucgacgagacaaacggaguguagcccucgcgccucacguugguuuggguuuggagacaagaacugagacauggaugaguagcgaaggagcauggaaacagauacaaagaguugaaacgugggcacuaagacauccaggguuuacuguaauugcucuguuuuuagcacaugcaauuggaacaagcauaacccaaaaaggaaucauauuuauauuauuaaugcuaguaacaccuucuauggcgaugagauguguaggaauaggaaguagggacuuuguagaagggcucaguggagcaacuuggguagacgucgucuuagaacacggaucaugugugacaacgauggcaaaagauaaaccuacccuagauauagaacuacugaaaacagaaguaacgaacccggcuguacuccgcaaacuuuguauugaagcuaaaaucuccaauaccacgacagauucuagauguccuacacaaggugaggcaacucuaguugaggaacaagacgccaauuuuguaugucgacggacguuuguggauagagguugggggaacggaugcgggcuauuuggaaaagguaguuuaaucacuugugccaaauucaaaugugugacaaaauuagagggaaaaauaguucaauaugagaaccucaaauauagugucauagucaccguucauaccggagaccaacaccaagugggaaacgaaucgaccgaacacggaacgacagccacuauuacaccgcaagccccaaguacagaaauacaauuaacggacuauggugcacuaacgcuugacuguucaccgcgaacuggauuggauuuuaaugaaaugguacuucuaacaaugaaagagaaaagcuggcucguacauaaacagugguuuuuagaccugccuuugccauggaccaguggugcaaguacuagccaagaaacauggaaucggcaagacuuacuuguaacauuuaaaaccgcgcacgcuaagaaacaagaaguagucguauuaggaagucaggaaggagccaugcauacagccuuaacuggggcaacagaaauacaaacuucaggaacuacuaccaucuuugcuggacacuugaaauguagacuuaaaauggacaagcucacccuaaaagguaugucuuauguaauguguacuggcagcuuuaaacuagaaaaagaaguagcagagacgcaacauggaacuguuuuagugcaaaucaaguaugagggaacagaugccccuuguaaaauacccuuuucaacgcaggaugaaaaagguguaacccagaauggcagauugaucaccgcaaacccgauagucacugauaaagaaaaaccaguaaacauugaagcugaaccaccuuuuggagaaagcuauauaguuauaggggcaggggaaaaagccuugaaauuaaguugguuuaagaaagguaguaguauaggaaagauguuugaagcaaccgcaagaggugcccguagaauggcaauucucggagauacagcaugggauuucggcagcauaggcgggguuuucacgucuguaggaaaauuggugcaucaaauauuuggcacugcauauggaguauuguuuagcggaguaagcuggacaaugaaaauuggaaucggaguauuacuuacguggcuaggcuugaacucccguucuaccagcuuaucuaugacuuguauagcaguuggacuuguaacauuauauuuaggggucaugguucaagcagauucagguugcguaauuaauuggaaaggcagggagcuuaaaugugggaguggaauuuucgugacgaaugaaguacauacuuggacagagcaauauaaauuucaagccgauucuccaaaaagacugucagcugccauaggcaaagcgugggaggagggaguuuguggaauuagaucagccacuaggcuugagaauauaauguggaaacaaauaagcaaugaacucaaccauaucuuacucgaaaaugauaugaaauucacugugguuguaggcgauguagcgggcauucuugcacaaggcaaaaagaugaucagaccucaacccauggaauacaaauauaguuggaaaucaugggguaaagcuaaaauaauaggagcagacgugcagaauacgacuuuuauaauagacggaccgaauacaccugaguguccagaugaccaaagagcauggaacauaugggaaguagaagauuauggauucgggauauuuacuacaaacauaugguuaaaauuacgcgacucauauacacagguuugugaucaucgguuaaugucagcagcaaucaaagacaguaaagcaguucaugcagauauggguuacuggaucgaaucagagaaaaaugaaacuuggaaguuagcaagagcgaguuuuaucgaaguuaaaacuuguauauggccaaaaucacacacucuauggucuaauggcguucucgaaucugaaaugauuauucccaagauauacgguggaccgauaucacaacauaauuauagaccuggauauuuuacucaaacagcuggcccuuggcaccuagguaaacuggaacuugauuuuaaccuuugcgaagguacuacaguaguuguagaugaacacugcggaaaucgagguccaagccuuagaacaacuaccguuacaggaaaaauuauccacgagugguguugucguucuuguacacuuccgccccugagauuuaaaggggaggaugggugcugguauggaauggaaauacguccagugaaagaaaaggaagaaaauuugguaaaaucgaugguaagugcagguuccggggaaguagauucuuucucguuagguuuauuauguauuucuauuaugaucgaagagguuaugcgaucuagauggagccgaaaaaugcucaugacaggaacauuagcugucuuuuucuuacucauaaugggacagcucacauggaaugaccuaauccgguuauguauaauggucggggcuaacgcuuccgaccguauggggaugggaacaacuuauuuggcauuaauggcaacuuuuaaaaugcgaccuaugcuggccguuggucuuuuguucaggagacuaacuucucgagaaguacuguuguuaacaauagggcugagcuuaguugcuaguguugaauuaccuaauucacuagaagaauuaggggacgggcuagcuauggguaucaugaucuuaaaacuccugacugacuuccagagucaucaacuaugggcaacacuucuaucauuaacuuucauaaaaacgacauacucgcuccauuacgcuuggaaaaccauggcuaugguacuuaguauuguuucuuuauuuccuuuaugcuuaucaacuacuucucagaaaacgacaugguuaccaguccugcuaggaucauuagguuguaagcccuuaacuauguuuuuaauugcagaaaacaaaauauggggucguaagaguuggccuuugaacgaggggauaauggcagugggaauuguuucuauauuacuaucgagucuauugaaaaaugacguaccguuggcaggaccauuaauagcaggcgggauguuaaucgcuuguuacgucauaucaggaaguucagcagauuuaucauuggaaaaagcugccgaagucucuugggaagaagaagcggaacauaguggagcaucacauaauauacuuguagaagugcaagaugaugguaccaugaaaauuaaagacgaggaacgugaugacaccuuaacaauuuuauuaaaagcaacacuguuggcuguuucaggaguauauccacuuucuauaccugccacccuauucguaugguacuuuuggcagaagaagaaacaacgaucagguguacuaugggauacuccaagcccgccugaaguagaacgggcgguauuagacgacgguauauauaggauaaugcaacgcggucuucuaggaagaucucaagucggcguaggaguauuucaagagaauguauuccacacgauguggcacguaacgagaggagcuguacugauguaucaaggaaaacgucuagaaccuucgugggcaagcguuaagaaagacuuaaucucguacggagggggauggcgcuuacaagguuccuggaauacgggugaagaaguccaagucauugccguugaaccgggcaaaaaccccaaaaacguacaaacugcacccggaacguucaaaacaagugaaggggagguuggugcaaucgcacuagacuucaaacccggaaccagugguucuccgauaguuaaccgugaagguaagauagucggauuauaugguaaugguguagugacgacgucuggaacuuauguaagcgcaaucgcgcaagcuaaggcuucacaggaaggaccacuuccagaaauugaaaacgaaguauucagaaagagaaauuuaacaauuauggaucuacaucccggcucgggcaaaacacgaagauaucuuccagcaauagucagggaagcaaucaaacgaaaacucagaacccucauacuagcgccgacucguguagucgcaucagagauggcagaagcacuaaaaggaaugccaauucguuaccagaccaccgcuguuaagagugaacacaccggaaaggaaauaguagaccucaugugccaugcgacuuuuacuaugagauugcuuucaccaguuagagucccuaacuauaauaugauaauaauggaugaggcacacuucacugacccaucaaguauagcugcacguggauauauuucuacgcgugugggcaugggagaagcagcugcuaucuucaugacagcuacaccuccagggucaguugaagcauuuccacaaucaaacgcggucauucaggaugaggaacgagacauaccagagcgaagcuggaauagcgguuaugaauggauaacggacuuuccuggaaagacggucugguucguaccaucaauaaaaucgggaaacgauaucgcuaauugccuucgaaagaaugguaagcgaguaauacaauuaagccgaaaaaccuuugacacugaauaccagaaaacaaagaauaaugauugggauuauguaguaaccacagauauaucggaaaugggggcuaauuucagagcugaucguguuauagauccgagaaggugccuaaaaccgguuauauuaaaagacggaccugagagaguaauucuagcuggaccaaugccuguaacagucgcuucugcagcucagagaagagggagaauugguagaaaucacaacaaggagggagaccaauacauauacaugggucaaccacuuaacaaugaugaggaucacgcacacuggacggaggcaaaaaugcuacuagauaacauaaauacuccugaaggcaucauaccagcauuauuugaaccugaacgcgagaaaagugcagcuauugauggagaauaucgccuuagaggggaagcaagaaaaaccuucguagaacugaugagaagaggagauuuaccagucugguuaucguauaaaguagcaagcgaaggcuuucaauauuccgaccgacguugguguuucgacggggaacguaacaaucaaguacucgaagaaaauauggacguugaaauauggacuaaagaaggcgaacggaaaaagcuacgaccccgcuggcuugaugcaaggacguacucggauccacuagcacuccgugaauuuaaagaguucgcugccggaagacgaucuguuucgggagaccuuauauuagagaucggaaaauugccucaacaucucacacaaagagcacaaaaugcacuggauaaccuaguaauguuacauaauagcgaacaaggcggccgagcauaccgccacgcuauggaggaauuaccugauacgauagaaacauuaauguugcuagccuuaaucgccguucucacagguggugugacacuguucuuccuaagcggacgcggucucgggaagacaucaauaggauugcuauguguuauggcaagcagcguacuacuguggauggcuagcguagagccucacuggauugcagcaucuaucauauuagaguucuuucuuaugguauuacuuauccccgaaccagauagacaaagaacgccacaagauaaucaacuggcguacguuguaauaggucuauuauuuaugauuuugaccguugccgcaaaugagaugggacucuuagaaacgacgaagaaagaucuugguauuggacacguggcugucgaaaaccaucaccaugcagcaauguuagacguugaucugcaucccgcaagcgcauggacacuauacgcagucgcgaccaccauaauaacccccaugaugcgacacacuauagaaaacaccacagcaaauaucucauuaacagcgaucgcuaaucaggcugcaauccucaugggguuagauaaaggauggccuauaagcaagauggacauugggguacccuuauuagcgcuaggaugcuacagucaagucaauccucucaccuugacggcugcaguucuaauguuagucgcacacuaugcuauaauaggaccaggauuacaggcuaaagcaacuagagaagcccagaagagaacagcggcaggaauaaugaaaaauccaacuguugauggaauuguugcgaucgacuuagauccaguaguuuaugaugcaaaauucgaaaaacaguuagggcagauuauguuauuaauuuuaugcacaagucaaauuuuacuuaugcgcaccacuugggcuuuaugugaaaguauuacccuagcgacagguccuuugacaacuuugugggaggguuccccgggaaaauucuggaauacaacaaucgcgguaucaauggcaaauauuuuuaggggcuccuaccucgcuggagcuggguuggcuuuuagcuugaugaaaucucuaggaggcggaagacguggaacaggagcacaaggcgaaacguuaggagaaaaauggaaaaggcaauuaaaccaauuaucaaagucagaauuuaauacauacaaaaggucggguauaauggaagucgaucggucggaggcaaaagagggacuaaaacgaggugaaacuacuaaacacgcgguaucuagaggaacagcaaaacuaagaugguuuguagagagaaaucuugucaaaccagaaggaaaagugauugacuuaggaugcggccguggaggguggucuuacuacugugcgggacuaaagaaaguaacagaaguuaaaggcuauacuaaaggaggcccagggcacgaagaaccuauaccgauggcgacauauggcuggaauuuagucaaauuacacucagggaaggacgucuucuuuauucccccugaaaaaugugacacccuauugugcgacauuggggaaucuagcccaaaucccacgaucgaggaagguaggacacuaagagucuugaaaaugguagagcccugguugagagguaaccaauuuuguauaaaaauacuuaaccccuauaugccaucagugguagaaacacuugagcaaaugcagagaaaacacggcggcaugcugguacgaaauccauuaaguaggaacuccacacaugaaauguacuggguuaguugcggcacugguaacauuguaagugcgguaaauaugacauccagaaugcuuuuaaacagauuuacaauggcccauagaaagccaaccuaugaaagagauguagacuuaggagcggguacaaggcacguagcuguugaacccgaaguagcaaauuuagauauaauaggacagaggauugagaacauuaaacaugaacacaagaguaccuggcauuacgaugaagauaaccccuacaagacuugggcguaucauggaaguuaugaaguuaaaccaucaggaagugccuccucuaugguaaauggcguaguaaaguugcuuacaaagcccugggaugucauaccaauggucacgcaaauagcaaugacagauacgacaccauucggucaacaaagggucuucaaagaaaaaguggacacgaggacaccuaaagccaaacgcgguacagcacaaauuauggaggugacagcuaaauggcuuuggggguuucuuucccgcaacaagaaaccacgcaucuguacucgggaagaguucacacguaagguacgaaguaacgcugccauaggagcuguauucguagacgaaaaccaguggaacuccgcuaaagaagcaguggaagaugagcgcuucugggaccuuguacaccgagagagagaauuacauaaacagggaaagugcgcaaccugcguuuacaacaugauggggaaacgggagaagaaacuuggcgaauuugggaaagcuaaaggcucuagggcaaucugguauauguggcuuggagcccgcuuucuggaguucgaagcguuaggauuuaugaacgaagaucacugguucagccgggaaaauaguuuaagcggaguagaaggugaaggucuacauaaauugggauauauauuacgcgauauaucuaaaauuccaggagggaacauguacgcugaugacacagcggggugggacacacguauaacugaagacgauuugcaaaacgaggcaaaaauaacagacauuauggagccggagcacgcucuccuugccaaaucuauuuuuaaauuaacauaucaaaauaagguugucagaguacaaaggcccgcuaaaaauggcacugugauggaugugaucucgaggagagaccaaagaggaucggggcaagugggaacauacggcuuaaauacguucacuaacauggaggcacagcuuauucgacagauggaaagugaaggcauauuuaguccaucugaauuagaaacgccuaaucucgcgggacgaguacucgacuggcuggaaaaacacggaguugagcgauuaaaaaggauggcuauaagcggugacgauuguguuguaaaaccuauugaugacagauuugcgaccgcucuaacagcauuaaaugauauggggaaagugcguaaagauauaccacaaugggaaccaucaaagggauggaaugauuggcagcaagucccguuuugcucacaccauuuccaccaauugauaaugaaagacggccgagagaucguagugccaugucgcaaccaagacgagcucgucggcagagcacgaguaagccaaggugcuggcuggucacuacgagaaacagcuuguuuagguaaaucauacgcgcaaauguggcaacuuauguauuuucaccgacgcgaucugagauuagccgcuaacgccauuugcucggcggugccagucgacuggguaccaacuucccgaacuacuuggucgauucaugcacaccaccaauggaugacgacugaagauauguuaucgguguggaaucgcgucuggauugaagaaaaucccuggauggaggauaaaacccauauuagcagcuggggugauguuccguaucuaggaaaacgagaggaucagugguguggaucacuaauaggacuaaccgcuagagcuacaugggcgaccaacauccaaguagcaauuaaucaggucagacgcuugauaggaaacgaaaacuaucucgauuacaugacuuccaugaagcgauucaaaaaugaaagcgacccggagggagcuuugugguaa

SEQ ID NO: 21924 - RNA, 9879 nt, Artificial Sequence
  derived and/or modified CDS sequence (opt6) from DENV-1__EU482478__SS-prME
agcguaaccaugcuuuuaaugcuuaugccuaccgcgcuagcuuuccaucuaacaacaagaggaggagaaccccacaugauuguaagcaaacaagaacgagguaaauccuuacuauucaaaacuucagcaggaguaaacauguguacccuaauugcaauggauuugggggaacuaugcgaagacacaaugacuuauaaaugcccuagaauuacugaaaccgaaccagaugauguagacuguuggugcaaugcaaccgacacauggguaacauacggaacauguagccaaaccggugaacacagacgagauaaaagaucagucgcccucgcuccccacgugggucuugggcucgaaacgagaacugaaacauggaugagcuccgaaggugcuuggaaacaaauacaaaggguagaaacaugggcacuacgacauccagguuuuaccguaauagcacuauuccuggcacacgcaauaggaacgucuaucacacaaaaaggaauuauauuuaucuuauugauguugguuacaccuucaauggcgaugaggugcguuggaauuggaucuagggauuucguugaagggcuaucuggagcuacuuggguugacguaguucuagaacacggaucaugcguuacgacuauggcuaaagauaaaccaacccucgauauugaacuuuuaaaaacggaaguaacuaacccggccguccuaagaaaacuauguauagaagcaaaaauaucuaacacaacuacagauucaagauguccaacucaaggagaagcaaccuuaguugaagaacaagaugcgaacuuugugugccgacggacauucguagaccgaggauggggaaaugggugcggguuguuuggaaaaggaucuuuaauaacaugugccaaauucaaauguguaacuaaacuagaaggaaaaauagugcaauacgaaaaucuuaaauacucggugauagucacuguacacacaggcgaccagcaucaggugggaaaugagaguacugagcacggaacaacagcuacgaucaccccucaagcaccaacaacagagauacaauuaaccgacuacggggcacuuacgcucgauuguuccccuagaacugggcuugacuuuaacgaaauggugcucuugacaaugaaagagaaaagcugguuaguacauaaacaaugguuuuuagaucuaccacugccauggacgucaggcgcuucgacaucgcaggaaacauggaaccgccaggacuuacuuguaacuuucaagacagcccacgcgaaaaagcaggaagucguugugcuuggaucacaagaaggagcaaugcauacugcuuuaacaggugcuacagagauacaaaccucggguacaacgacaauuuuugcuggacaucuuaaaugucguuugaaaauggauaaacuaacacuuaaagguaugaguuacguuauguguacuggguccuuuaaauuagagaaggaaguagcggaaacacagcacgguacaguacuuguccagauaaaauaugaagguacagacgcacccuguaaaauaccuuuucuaacccaagacgagaaagggguaacacagaaugguagacugauaaccgcaaacccgauagugaccgauaaggagaaaccugugaacaucgaagcagaaccucccuucggcgaauccuauauaaucaucggugcaggagaaaaagcacucaaauugaguugguucaaaaaggguucaaguauagguaaaauguuugaagcgacugcucgcggugcacgcagaauggccauucugggcgauacagcaugggacuucggauccauugggggugucuucacgaguguaggaaaguuaguucaucagauuuucgguacagcauauggcgucuuauuuucaggugugucauggacaaugaagauagggaucgggguauugcuuacuugguugggucuaaauucuagaucaacuucauuaucuaugacauguauagcuguaggcuuaguuacuuuauacuugggugucaugguacaggcugauaguggaugugucaucaacuggaaaggacgugaauuaaaguguggaaguggcauauucguuaccaacgaaguacauacguggaccgaacaauacaaauuccaggcagacucgccaaaacgucugucagccgccauaggaaaagcaugggaagagggggucugugguauccguagcgcaacaagacuagaaaauauaauguggaaacaaauaaguaacgaauuaaaucacauauugcuagaaaaugauaugaaguuuacgguaguaguaggagauguagccggaauuuuggcacaaggcaagaaaaugauuagaccucagccgauggaguacaaauauucuuggaaaucuuggggcaaagcaaagauaauaggcgccgauguccaaaauacuacguuuauuauagaugggccuaacacaccagagugccccgacgaucagagagcuuggaauaucugggagguagaggauuaugguuuuggaauuuuuacaacaaauauuuggcuuaaacuucgggauucgcauacacaaguaugugaccauagacucaugucggcugcuaucaaagacuccaaagcuguacacgcggacaugggcuacuggauugaaucggagaaaaaugaaacguggaaauuagcccgcgccucauuuauugaaguaaaaaccuguauauggcccaaaucacacacuuuauggagcaauggaguauuggaaucagagaugaucauacccaaaauauacggaggcccgauuucucaacacaacuaucggccaggguauuuuacccaaacggcgggcccauggcauuuaggaaaacuugagcuagauuuugacuuaugcgaaggaacaacuguaguagucgacgaacauuguggcaacagaggccccagucuucgcacgaccacuguuaccgggaaaaucauucaugaauggugcuguagaucauguacacuaccacccuuaagguuuagaggugaagaugguuguugguauggaauggaaauuagaccaguaaaggaaaaagaagaaaauuuagucaagucuaugguuuccgcaggaucaggagaagucgacucauucucccucggucuacuguguauaucuauaaugauagaggaggugaugagaucacguuggucgagaaaaaugcuuaugaccggaacauuagcgguguucuuuuugcuuaucaugggacaacugaccuggaacgaucuaaucagguugugcauaauggucggugccaaugccuccgaucgaaugggcauggggacaacauauuuagcacucauggcgaccuuuaaaaugcgcccaauguuugcagucggacuacuauuucgucgccugacaucaagggaaguguuacuuuuaacaauuggccuaucguuaguugcauccgucgagcucccaaauagucuggaagaauuaggugacgggcucgcuaugggcauaaugauccuaaaauuacuaacagauuuucagucgcaucaacugugggcaacuuuacuuaguuuaacauuuauuaaaacuacauuuucuuugcacuaugccuggaaaacuauggcaaugguacuaucgauagucagcuuauuuccccuaugucuaucuacaacuucacagaaaacaacaugguuaccgguuuuacuaggaaguuuaggaugcaaaccauuaacaauguuccugauagcagagaacaaaauauggggaagaagauccuggcccuugaaugagggaauuauggcgguuggaauagugagcauacucuuaucgucacucuugaaaaaugaugucccucuagcugguccacuaauagccgguggaauguuaauagccuguuaugugauuucuggaucaagcgccgaccuuucauuggaaaaagcugcagaaguuucgugggaggaagaagcagagcauaguggagcuucgcauaauauauuaguagaaguccaggaugaugggacgaugaaaaucaaagaugaagaacgcgaugacacuuuaacuauccuguugaaggcaacacuuuuggcuguaucuggcguauauccuuuauccauaccagcgacuuuauuuguaugguauuuuuggcagaaaaagaaacaaaggucugggguacucugggauacuccguccccgccagagguagaaagagcaguauuagaugacggaauuuauaggaucaugcagcgcggacuccuuggaagaagucaaguugggguaggaguauuccaagaaaaugucuuccauacuauguggcacguuacacgaggugcaguucucauguaccaaggcaaacgucuugaacccucuugggcauccgugaagaaagaucucauauccuauggagggggauggcgccuacaaggaucauggaacacaggagaagaaguucaggugauagcgguugaacccgggaaaaauccuaaaaauguucagacagccccuggaacguuuaaaacaccagagggagagguuggcgcaaucgcgcuagacuuuaagccggggacgaguggcucuccgauuguaaacagagaaggcaagauuguaggguuauauggcaacggaguggucacuaccuccggaacuuacguuagugcuauugcccaggcuaaagcaucucaagaaggcccuuuaccugagauugaagacgaggucuuccgaaaaagaaaucuaacaauuauggaucuacacccaggaucgggaaaaacaagaagauaucuaccagcaaucguacgagaagcgaucaaaagaaaacuacggacacuaauacuugcuccuacucgugucguagcgagugaaauggccgaggcauuaaaaggcaugccuauaagguaccaaacuaccgcagucaaaucggaacacacagggaaagaaauaguggacuugaugugccaugccacauuuacaaugagacuuuugagcccaguaagaguuccaaauuauaauaugauaauaauggaugaagcucauuucacggauccaagcucaauagccgcgagaggauacauaaguaccagaguaggcaugggcgaagccgccgcuauauuuaugacagcaacacccccuggcagcguugaagcauucccacagaguaacgccguuauacaagacgaagaaagggauaucccugaaagaucauggaacucgggguacgaguggauuacagauuuuccgggaaagacgguaugguucguaccgaguauuaaaaguggcaacgacaucgccaauuguuuaaggaaaaauggcaaacggguaauucaauuaucuaggaaaacguuugauacagaguaccagaaaacaaagaacaaugauugggacuacguaguaacaacagacauaucagaaaugggagcuaacuuuagagcggauaggguuauagauccacggagaugccuaaaaccaguuauccucaaagaugguccagagagggugauccucgcaggaccaaugcccguaacagucgcaucggcagcacagagaaggggucguaucgggcgcaaccauaauaaggaaggagaucaauacauauacaugggacaaccucugaacaacgaugaagaccacgcucauuggaccgaagcaaaaauguugcuagacaauauaaauacuccagaaggaauaauacccgcauuauucgagccugaacgugaaaaaucagcggcaauagauggagaauauagacuucgaggagaagcacggaaaacuuuuguggaacucaugaggagaggggauuuaccugucugguuaucuuacaaaguugcaucagagggcuuccaguauagugacagacgcugguguuuugacggagaaaggaauaaucaagucuuagaagaaaauauggacgucgagaucuggacuaaggaaggugaaaggaaaaagcuccgcccacgauggcuagaugcucgcacauauucagauccuuuagcauuaagagaguuuaaagaauuugcugcagggagaagauccguaucaggugauuugauccuugaaauaggaaaauuaccucaacauuuaacgcaaagagcccaaaaugcuuuggauaaucuagucaugcuccacaacagcgaacagggagggcgcgcuuauagacaugccauggaggaacuaccagauaccaucgaaacuuuaauguuauuagcauuaaucgcuguacugacagguggaguaacacuguuuuuccuuaguggccguggauuggguaaaacaucaauaggacuuuuauguguaauggcuuccucuguacuacuauggauggcaucaguagaaccacacuggauagcagcgucaaucauacuggaguucuuucuaaugguauuacugauaccagagccagaccgacaacguacgccacaagauaaucaauuagcguaugucgucauaggauuacuauuuaugauucugacaguagcagcgaaugaaaugggacugcuugaaacaaccaagaaggaccuaggcauaggacauguagcaguagaaaaucaucaucacgccgccaugcuugauguugaccuccauccggcuucggcguggaccuuauacgcaguagcaacaacuauaauaacaccaaugaugcgucacacaauagaaaauacaacagcaaauauuucucuaaccgcgauugcgaaccaggcagcgauccuaaugggacuugacaaagguuggcccauuucaaaaauggacaucggcguaccacuacuggcgcuagguuguuauagucagguaaacccgcucaccuugaccgcggcaguauuaaugcuaguagcacauuaugccaucauugguccuggacuacaggccaaagcaacgcgagaagcucaaaagcgaacggcagccgguauaaugaaaaauccuacaguagauggaauuguugcaauagaucuagacccugucguuuaugacgcaaaauucgaaaaacaacucggacagauaauguuauugauacuuuguacgucacaaauacuacucaugagaaccacgugggcauugugcgagucaauaacacuagcuacaggaccccuaacuacuuuaugggaagggagcccugguaaauucuggaauacgacaauagcagugaguauggcaaauauuuucaggggcaguuaucucgcuggagcaggucuagcauucagucuuaugaagaguuuaggagguggacgacguggcaccggagcccaaggugaaacucuuggagaaaaguggaaacgacaacuaaaccaauuaagcaaaagcgaguucaauacguauaagagaagugggauaauggaggucgacaggucugaagccaaagaaggacucaaaagaggcgaaacuacaaagcaugcaguaucacgaggaaccgcaaaauugagaugguucguagaaaggaaucucguaaaaccagaaggaaaaguaauagacuuaggguguggaagagguggauggagcuauuacugugcagggcuuaaaaaggucacggaaguuaagggguauacuaaaggcgggcccgggcaugaagaaccaaucccaauggcuaccuaugguuggaauuuagugaaauuacacagugguaaagacguguucuuuauuccgcccgaaaaaugcgacacacuauugugugauaucggcgaaaguaguccaaauccaacuauagaagaaggaaggacuuuacgaguacucaaaaugguggagcccuggcucagagguaaucaguuuuguauaaaaauauugaauccuuauaugcccaguguaguggaaacacuagaacagaugcaaagaaagcacggcggaaugcuuguaaggaauccucucucccgaaauaguacacacgagauguacuggguaagcuguggaaccggaaauauagucuccgcuguaaauaugacguccagaaugcuacuaaacagguucacgauggcccaccgcaaaccuacauaugaaagagacguagauuuaggagcugguacaagacacguagccguagaaccagaaauugcuaacuuagacauaauuggucaacgcauugaaaauauaaaacaugaacacaaaaguacuuggcacuaugacgaagacaauccauacaaaacaugggcuuaucauggaucuuacgaagugaaaccuuccggcagcgcaaguucuauggugaacgggguuguaaaguuacugacaaaaccgugggauguaauaccaaugguaacucaaauagcaaugaccgauacuaccccuuuuggccaacagcguguuuuuaaagaaaaaguagauacaaggacacccaaagcgaaaaggggaacagcucaaaucauggaaguuacagccaaguggcuauggggcuuccucagucggaauaagaaaccucguauauguacacgagaagaauuuacacgcaaggugagaaguaaugccgcaauuggagcugucuucguugaugaaaaccaauggaacucagcaaaggaagcaguugaagaugaaagguuuugggaccucgugcaucgcgaacgggaguuacauaaacaaggaaaaugugcuacaugcguauacaauaugaugggcaaacgugagaagaaauuaggagaguucggaaaagcuaaagguagccgagcaauaugguacaugugguuaggagcucgguuucuggaauuugaagcacuaggauuuaugaaugaagaccacugguucucucgggagaacagccuaagcggcgucgagggugaaggacuacacaaauuaggauauaucuugagagacauuuccaaaaucccuggcgguaauauguacgcggaugauacagcuggaugggacacgagaauuacugaagacgauuuacaaaacgaagcaaggauaacagauauaauggagccggaacaugcucuccuagcaaaaucuauauuuaagcuaaccuaucagaacaaaguuguacgaguacaaagaccagccaagaauggaacuguaauggauguaauauccagaagggaucaaagagguagcggacaaguggggacauauggacuuaauacuuuuacaaacauggaagcacaauuaauacgacagauggagagcgaagggauauuuuccccaagcgagcucgaaacuccgaaucuagcugagagggugcuggacugguuagagaaauauggaguugagagacuaaaaagaauggcaauaagcggagacgacuguguugucaagccgauagacgaccguuuugcaaccgcucuaacugcauuaaacgacauggggaaaguucguaaagauauaccacagugggagccaucaaagggauggaacgauuggcaacaaguuccauucuguucccaucauuuucaccagcuuauaaugaaggauggaagagagauagugguaccguguagaaaccaagaugagcuaguagggagggcucgugucagucaaggggcaggcuggagcuuaagagaaacagcguguuuagguaaaucuuaugcccaaauguggcaacuaauguauuuucacagacgagaccuccgcuuagcagcaaacgccaucuguucagcugucccuguagauuggauaccgacuuccaggacuaccuggagcauacaugcccaccaucaauggaugacaaccgaagacaugcuuaguguauggaacagaguuuggauagaagaaaauccuuggauggaggacaaaacgcacaucaguaguuggggugacguuccuuaucucgguaagcgagaagaucaauggugcggcagccugauaggauuaacggcaagagcgacaugggcaaccaacauacaaguagccauuaaccaagugcgaagacuaauagguaacgaaaacuaccucgacuauaugacgucaaugaagagauuuaaaaacgaaggagauccagaaggcgcccugugguag

SEQ ID NO: 21925 - RNA, 9879 nt, Artificial Sequence
  derived and/or modified CDS sequence (opt6) from DENV-1__EU482479__SS-prME
ucuguuacgaugcugcuaaugcuuaugcccacugcauuagcauuccaucuaacuacaagaggaggggaaccccacaugauagugaguaaacaagaacgaggaaaauccuuacucuuuaaaacaucugcugguguuaauauguguacauuaauagcgauggaucuaggagaacuaugcgaagauacuaugaccuacaaaugucccagaauuacagagacagaaccggaugauguggauugcugguguaaugcgacagauaccugggucacuuaugguacaugcucacaaacuggggaacaccgacgagauaaacgcucuguagcgcuagcaccacauguuggcuuaggcuuagagacacguacagaaacauggaugucaucggagggggcauggaaacaaauacaacguguagaaacaugggcauuacgacaccccggauuuacaguaaucgcucucuuucuggcucacgcgaucggaacaaguauuacucaaaaaggaauuauuuuuauuuuacucauguugguaacuccaucaauggccaugcgauguguggguauaggaagcagggacuucgucgaaggacuuucaggagcaacauggguagauguuguuuuagaacauggaaguugcguaaccacuauggcgaaagauaaacccacacucgacauugaacuucuaaaaacugagguaacaaauccugcaguucugcgcaaauuguguaucgaagcgaaaaucucaaauacaacaacggauagccgcugccccacucaaggagaagcaaccuuggucgaagaacaagaugcgaauuucgugugucggagaacauucgucgaccguggcugggguaauggaugcggccuuuucggaaaaggcagcuuaaucacgugcgcgaaauuuaaaugcgucacgaaauuggaggggaaaaucgugcaguaugagaaucuuaaauauagcguuauaguaacaguacauacuggugaucaacaucaagucggcaacgaaucaacagaacauggcacuacggcuaccauaacgccccaagccccaacaaccgagauccaauuaacagauuacggcgcccuuacacuagauuguaguccccgaacugguuuggauuuuaaugaaaugguacuauuaacaaugaaagagaaaaguuggcuaguacauaaacaaugguuucucgacuugccacuaccuuggacaucaggcgcaucaacaucucaggaaacguggaacagacaagaucuacucguaaccuucaaaacugcacacgccaagaaacaagagguagucguacuaggaucacaagaaggggcaaugcauaccgcguugaccggagccacugaaauucaaacaagcgguacaacgacaauauuugcaggacacuuaaaauguagacucaaaauggacaaacuuacucuaaagggaaugagcuauguuauuuguacuggcucauuuaagcucgaaaaagaaguggcugagacucaacauggcaccguucuuguucaaauuaaguaugaggggacagacgcgccguguaaaauaccauuuagcacacaagacgaaaaaggcguaacccaaaaugguagacucaucacagccaauccaauaguaacagacaaagagaaacccguaaauaucgaggccgagcccccguucggagagagcuauauaauuaucggggcgggagagaaagcacuaaaguuauccugguuuaagaaaggcagcaguauugggaaaauguuugaggcaaccgcaaggggagcgcgccgcauggcaauauuaggcgacaccgcaugggacuucggcuccauuggagguguguuuacuucaguggguaaauuaguacaccaaauauucgguacugcguauggggucuuauucagcggcgucucauggaccaugaaaauagguaucggcgugcuacugacuuggcuuggccuuaauagccguucaacaagucuaagcaugacgugcauagcaguugguuuaguuacacucuaucuaggaguuauggugcaagcugauagugguugcguuauuaauuggaaaggaagagagcuuaaaugcggcucuggcaucuucgugacaaaugaaguccauaccuggacagaacaauacaaauuucaagcagacucacccaaacgauugucggcagccaucggaaaagcaugggaagagggaguuuguggcauaagaucagcaacaaggcucgaaaacauuauguggaaacaaauuucaaaugaacuaaaucauauauuacuggaaaacgauaugaaguuuacuguuguaguuggagauguagcggggauacuagcacaagguaagaaaaugauuaggccgcagccaauggaguauaaauauuccuggaagaguuggggaaaggcuaaaauaauuggcgcagaugugcaaaacacgacguuuaucauagacggcccuaauacgccugaaugccccgacgaucaaagagcauggaauauaugggaaguugaagauuauggguuuggaaucuucacgacaaauauauggcuaaaacuucgagauucccauacccaaguaugugaucauaggcuuaugagcgcugcaauaaaggacagcaaagcgguucaugcagauauggguuauuggauagaguccgagaaaaaugagacauggaaauuggcaagggcuucauuuauugagguuaagacauguaucuggccuaaaucucauacguuauggaguaacgguguauuagaaucugaaaugaucauucccaaaauuuacggagguccaaucucacaacacaacuauagacccggauacuucacucaaacugcagguccauggcaucuagguaaacuagaacucgacuucgaccuuugugaaggcacuacuguaguaguggaugaacacuguggcaaucgggguccgagucuacguacgaccacagugaccggaaaaauaauucacgaguggugcugucgcucaugcacccuaccaccgcugagguuuagaggagaagaugguugcugguacggcauggagauaagaccaguaaaagaaaaagaagaaaaucuagugaaaucaaugguguccgcuggaaguggugaaguagauaguuucucauuggggcuacuuuguauuucuauaaugauagaagaagugaugcgauccagguggagcaggaaaaugcugaugacgggaacucuagcaguauucuuuuuauuaauuaugggccaacucacauggaaugauuuaauuagauuguguauuaugguaggcgcgaaugcuucugauagaaugggaaugggaaccacuuaucuagcgcugauggcaaccuuuaaaaugagacccauguuugcaguagguuuguuguuucgaagauuaacuucccgugaagugcucuuauuaacaaucggauuaucguuaguggcuagugucgaacuuccuaacagucuugaagaguuaggagacggcuuggcuauggguaucaugauucuaaagcuacucacugauuuucagucucaucaauuaugggcgacucuauuaucuuuaacuuucauaaagaccaccuuuucuuugcauuaugcauggaaaacgauggcaaugguacuaagcauugucucauuguucccauuaugucuuucgaccacgucucagaaaacuacauggcuccccguauuacuuggcucacucgguuguaagccgcugaccauguuucugauagccgagaauaagauuuggggacggagaucuuggccguuaaacgaaggcauaauggcuguggguauagucaguauucuuuuaaguucuuuacucaagaaugacguucccuuagccgggccacugauugcaggagggaugcuaauagcguguuacguuaucucugguucuagcgcugaucuuucucuagaaaaagcagcagaaguuucaugggaagaggaagcugaacacuccggugcuucacacaauaucuuaguagaaguacaagaugacggaacuaugaaaaucaaggacgaggaacgugaugacacacucacaauucuacuaaaggccacgcuccucgcgguuucagguguauacccacuuuccauaccagcuacacucuucguaugguacuucuggcaaaagaagaaacaaaggucaggcguguugugggauacuccaagcccuccggagguugagcgggccguauuagaugauggaauauaccgaauaaugcaacguggacuacuugguagaagucaaguugguguagguguauuccaagaaaaugucuuucauacaauguggcauguaacacgaggagcuguccucauguaucaagguaaaagguuagaacccagcugggccaguguuaagaaggaccuaauuucauacggcggaggcuggcguuugcaagguagcuggaacacuggagaggaaguccagguuaucgcgguugagccaggcaaaaauccuaaaaauguucaaacggcaccuggcacuuuuaaaacaccugaaggugaagucggggcgauagcauuggacuuuaaaccggguacgucugggucuccuauugugaauagagaggguaaaauaguaggauuauaugggaacggcgucgugacuacaagugggaccuaugugucagcaauagcacaggcaaaagccagccaagaaggccccuugcccgaaauagaggaugaaguuuuuagaaaaagaaauuugaccaucauggacuuacauccuggauccggaaaaacaagaagauaucuaccagcaauugugagggaagcaauuaagagaaagcuacguacuuugauuuuagccccaacaaggguugucgcaucagaaauggcagaagccuuaaaagguaugccaauaagauaccaaaccacugcagucaagucagaacauacaggaaaggaaauuguagauuuaaugugccaugccacguuuacgaugagacuacucucaccagucagaguaccaaauuauaauaugauaaucauggacgaagcucauuuuacagaucccuccucuauagcagcuagaggcuacauuucaacaagaguaggaaugggagaagcagcggcaauuuucaugacugcaacucccccuggaucgguggaagccuucccacaaaguaaugcagucauucaagaugaagaacgcgauauuccugaacggagcuggaacagcggcuaugaauggauaaccgacuuuccugggaagacaguuugguuugugccaucuaucaaaaguggcaacgauauagcaaacugucugaggaaaaaugguaaaagaguuauucagcucucacggaaaacauucgacacagaauaucagaaaaccaaaaacaaugauugggacuacguuguuacaaccgauauaagugagaugggggcuaacuucagggcugacagggugauagacccacgucgcuguuugaaaccagucauauuaaaagacgguccagaacgaguaauacuugcagguccaaugccgguuaccguagcuagugcagcacagagaagaggaaggauaggaagaaaucacaauaaagaaggugaccaguauaucuauaugggccaaccuuuaaauaaugaugaagaucaugcccauuggacggaagcuaagaugcucuuagacaauauuaauaccccugaaggaauaauaccugcacuauuugagccagaaagagaaaaaucugcagcuauagauggagaguaccgauugcguggggaagcaagaaagaccuucguugaauuaaugagacgaggagauuuaccaguguggcuuucauacaaaguagcaagugaaggcuuucaauacagcgauagacgcugguguuuugauggugaaagaaauaaccaaguccuagaggaaaacauggacguagagauauggacuaaagagggcgaacguaaaaagcucaggcccagauggcuagacgccagaacauauagugauccgcuggccuuacgcgaauuuaaggaauuugcagccggacgcagauccguaucaggagauuuaauucuagagauaggaaaacuuccacagcaucuaacacagcgggcccaaaacgcuuuagauaauuugguaauguuacauaacucagaacaggguggucgagcauauagacaugcuauggaagaacuaccugacacuauagaaacacuaauguuauuagcccuaaucgcuguauuaacuggaggaguuacacuauucuuuuuaagcggaagaggacucgguaagacgucaaucggauuacucugcguuguggccucaagcguacuucuauggauggcauccgucgagccgcauuggauagcagcgucgauuauccuugaauuuuuccuaauggugcuucucaucccagaaccugauagacaaagaacgccacaagacaaccaacuugcguaugucguuaucggccuucuauuuaugauucugacuguagcugcaaaugaaaugggacuauuagaaacaaccaagaaagaucucgguaucggacauguagcgguugaaaaucaccaucacgcggcuauguuggauguagaucuacauccggcuucagccuggacacuuuacgcaguggcuacaacuauaaucacaccuaugaugagacauacuaucgaaaacacaacagcuaauauaagccuuacagcaauugccaaucaagccgcaauuuuaaugggucuggacaaaggguggccaauauccaaaauggauaucggaguuccauuacucgcucuuggcuguuauucgcagguuaacccauuaacucuuacagcagcuguucuaaugcuuguagcucauuaugccauaauaggcccgggacuacaagcaaaagccacccgagaagcacaaaagagaacggcggcuggaauuaugaaaaauccaacuguagacgguauuguagcuaucgacuuggauccuguuguauaugacgcuaaguuugaaaaacaacuaggacaaauaaugcuguugauacuuugcacaucgcaaauacucuuaaugagaacaacgugggcacuaugugaauccaucacacucgcaacagggccguugacuacauuaugggaaggcucgcccgggaaauuuuggaauaccacaauagcgguuaguauggcaaauauuuuuagaggcucuuaucuagcuggagcaggacuugccuuuucacuaaugaagucacugggcgguggaagaagaggaacuggagcacaaggugaaacuuuaggggaaaaauggaagagacaacugaaucaacucucuaaaagugaguucaacacauauaaaagaucggguauuauggaggucgacagaagugaagcaaaagaggguuugaaacgaggggaaacaaccaaacacgcuguaaguagaggaacugccaaguuaagaugguuuguagaaagaaaucucguaaagccagaagguaagguaauugauuuagguugcggccgagguggguggucauacuacugcgcaggacucaagaaaguaacagaagugaaggguuauacaaaaggaggaccgggccaugaagaacccauuccaauggccacauacgguuggaaccugguaaaauuacacucuggcaaagacguguucuuuaucccacccgagaaaugugacacgcuauuaugcgacaucggugaaucgucgccaaacccaacuauugaagaggguagaacuuuaagaguguuaaaaaugguagagccguggcugcgaggaaaucaauuuuguauaaaaauucuuaacccguauaugccgucggucguggaaacauuagagcaaaugcaaagaaagcacggugggaugcuuguaagaaacccgcuuucccgaaacuccacgcaugaaauguacugggucucauguggaacagggaauauagugucugcgguuaacaugacaucccggaugcuacugaaccgcuucacaauggcacaccguaagcccacauacgaaaaagauguagauuuaggugccggaacgagacacguugcagucgaaccggaagucgccaaucuagauauuauaggccaaagaauagaaaacauuaagcaugaacacaaaucgacuuggcauuaugacgaggacaauccuuauaaaacuugggcauaccauggaucauacgaaguaaaaccaagugguuccgcuuccuccaugguuaauggugugguaaaacuacugacuaaacccugggacguaauuccaaugguuacgcaaauagcaaugacagacacaaccccuuucggacagcagagaguauucaaagaaaaaguagauacaagaacacccaaggcaaagagaggaacugcucaaauaauggaaguuaccgcaaaaugguuauggggcuucuugucccgcaauaagaaaccgcgcauuuguacucgggaagaguuuacacguaaggucagaucaaacgcagcuauaggggcaguuuuuguggaugaaaaucaauggaacucagcaaaagaggcuguggaagacgaaagauucugggaccuaguacauagagaaagagaacuucauaaacaaggcaagugugcgacauguguauauaauaugauggguaaacgagagaagaaacuuggagaauuuggaaaagcaaaagguucaagagccauaugguauaugugguuaggugccagguuccuugaauuugaagcauugggauuuaugaaugaagaucauugguuuucccgcgaaaacagcuuaagcggaguagaaggagaaggacuacacaaacugggauauauacuucgugacauaucuaaaauccccggagggaacauguaugcugaugauaccgccggaugggauacuagaauaacugaagaugaucuccagaacgaagcacgaauuacugacauaauggagccagaacaugcguuacuagccaagaguauauuuaaauugacuuaucagaauaaagugguacgcguccagcguccggcuaagaacgguaccguaauggaugugauaagcagaagagaccagagaggaagcggacaagugggaacguauggcuuaaauacauuuacaaauauggaagcccaacugauccgacaaauggaauccgaggggauauucucgcccuccgaacuagaaacacccaaucucgccgaaagaguacuagauuggcuaaagaaauacggaguagagaggcuuaagagaauggcgauuaguggugaugacugcgucguuaaaccgauagaugaucgauuugccacagcacuaacagcguugaacgauaugggaaaggugcguaaagacauaccucaaugggaaccauccaaagguuggaaugauuggcaacagguccccuucugcucucaucauuuccaucaauuaauuaugaaggauggaagagagauuguaguaccaugucguaaucaagacgaauuaguuggucgagcaagaguuucacaaggagcagguuggagucugagagaaacggcaugccuuggaaaaucauacgcacagauguggcaauugauguacuuucauagacgcgaucuaagguuagcagcuaacgcuauuuguuccgcgguacccguugacuggauaccuacaagcagaaccacuuggaguauucaugcccaccaucaauggaugacuacagaggauaugcuaucaguguggaacagggucuggauugaagaaaauccauggauggaggauaaaacacauauuaguucguggggugaugugccauaucucggaaaacgagaagaccaaugguguggcucuuuaauaggucucacagcaagggcaacuugggccacgaauauucaaguagcaaucaaucaaguacgucggcuaauaggaaacgaaaacuaccuagacuacaugacguccaugaaaagauucaaaaacgaaggcgacccagaaggugcgcugugguaa

SEQ ID NO: 21926 - RNA, 9879 nt, Artificial Sequence
  derived and/or modified CDS sequence (opt6) from DENV-1__EU482480__SS-prME
ucaguaacgaugcuucucauguuaaugccaacugcauuggcguuucaccuaacgacgagagggggagaaccacacaugauaguuaguaaacaagagcgcggaaaaucauuauuauucaaaacauccgcuggaguaaauaugugcacguuaaucgccauggauuugggagaguuuugugaagauacgaugacuuauaaaugcccuagaaucacggaggccgagccagacgacguugacugcuggugcaaugccacugacacuugggugacuuacgguacuuguacccaaauuggagaacaccgaagagauaaacguucgguugccuuggcaccucauguuggguuggggcuugaaacuagaacagaaacauggaugaguucugagggagcuuggaaacaaauacaaagaguggaaacuugggccuugcgacaucccggcuuuacagucaucgcccuuuuccuugcacacgcaaucgguacaucaauaacacaaaaaggaauaauauuuauucuucuaauguuagcuaccccuagcauggcuaugcgaugcguggguauagggucccgugauuuuguugagggacuauccggagcgacguggguagauguaguacucgaacacggcucuugugugacaacaauggcaaaagauaaaccgacgcucgauaucgagcuauuaaaaacugaagucacaaauccagcaguguugagaaaacuauguauagaggccaaaaucuccaauacaacgacugauucgaggugcccaacgcaaggggaagcaacauuaguagaggaacaggaugcaaauuuuguaugcagacgcaccuuuguagaucgaggcuggggaaaugggugugggcuauuuggaaaagguagucugauaaccugcgccaaauucaaauguguuacaaaguuagaaggaaaaauuguccaguaugaaaauuuaaaauacucaguaauuguuacgguacacacgggggaucaacaucaaguaggaaaugaaucaaccgagcauggcacgauagccaccauuacaccccaagcuccuagcacugaaauucagcucacugacuauggugcuuuaacccuagauuguucaccaagaacgggacuagacuuuaaugaaaugguacuacuaacuaugaaggagaaaucauggcugguucauaaacaaugguuccuagacuuaccauuaccuuggaccagcggugcaaguacaucacaggaaacguggaacagacaagaucuucuuguaacuuuuaaaacagcacaugccaagaaacaagaaguggucguauuaggcucucaagagggggcgaugcacaccgcgcuaaccggagccacagaaauucaaacaucgggaacaacaacgaucuuugccgggcaccucaaauguagguuaaaaauggacaaacuaacauuaaaaggcaugaguuacguuauguguacaggaucauuuaaauuagaaaaagagguagcugaaacgcaacacggaacuguauugguucaaaucaaauaugaggguacugacgcaccuuguaaaauucccuuuucaacucaagacgaaaaaggagucacucaaaauggacgucuuauaacugcuaauccuaucgucaccgauaaagaaaagccgguuaacaucgaagccgaaccuccuuucggugaaaguuauauuguuauuggagcuggggagaaggcacucaaauuaucaugguucaaaaagggaucaucaauuggcaagauguucgaagcuacugcacggggagcacgaagaauggcaauauuaggcgauacggcaugggacuuuggaaguauagguggaguauucacuagcguggguaaacuugugcaccagauauucggcaccgcuuacggaguuuuguuuaguggugugucauggacaaugaaaaucgguauuggaguguuauuaacauggcuaggguuaaauucaagaucaacaagucuuucgaugaccuguauagcuguaggguuagugacgcuauaccuuggaguaauggugcaagcggauucaggaugcgugauuaauuggaaaggacgagaacuaaaaugcgguagcggaauuuuugugacaaacgaaguccacacauggacugagcaauacaaauuccaagcagacucacccaaacgauugucugcugcaaucggaaaagccugggaggaaggcguaugugguauucgcucagcaacgcgauuagaaaauaucauguggaagcaaauaucuaacgaauugaaucauauccuuuuagaaaaugauaugaaacucacagugguuguuggggacguagcagguauucuugcccaagguaagaaaaugauaagaccacagccaauggaauauaaauauagcuggaaaaucuggggaaaagcaaaaauaauuggcgcugacguccaaaauacuaccuucauaaucgacggaccuaauacaccagaauguccggacgaucaaagagcauggaacauuugggaaguugaagauuauggcuucgguauauuuacgacaaauauauggcuaaaacugcgugauucauauacccagguaugugaucaccggcucaugucagcugcuauaaaggacagcaaggcaguacaugcggacaugggauacuggauagaaagcgagaaaaaugaaaccuggaaauuagcgagagcaaguuucauagaagucaaaaccuguauauggcccaaaucacauacacuuugguccaauggaguacuggaaucagaaaugauuauaccaaaaaucuacggagggccuauaucucaacauaacuaucgucccggauauuuuacucaaacugcgggaccuuggcauuugggaaaauuagaauuggauuuugauuuaugugaagguacaacagugguuguagacgaacacugcggcaacaggggaccaucuuuaagaacaacaacugucacugggaagaucauucacgaaugguguugucguucauguacccuaccaccuuuaagguuuaaaggagaagaugggugcugguaugguauggaaauuagaccugugaaagaaaaggaagaaaaucuuguaaagucaaugguaucggccgguucaggagaaguugauagcuucucacuaggacuuuuauguauuaguauuaugauagaagaaguuaugaggaguagguggucucgaaaaaugcuaaugacugguacgcuugccguauucuuucucuuaaucauggggcaauuaacuuggaacgauuugauuaggcuaugcauuaugguaggagcaaacgcaagugaucggaugggaauggggacaacuuauuuagcucuaauggcaaccuuuaaaaugaggccuauguucgcaguuggccucuuguuuagacgauugaccuccagggaagugcuucuucucacgaucggauuaagccuaguagcuucaguagaacuaccaaauagucuagaagaacugggggacggccuagcuaugggaauuaugauucuuaaguuacuaacggauuuccaaucucaucagcucugggcaacacuacuuucacucaccuuuauuagaacgaccuucagucuacauuacgcauggaagacaauggcgauggucuuaagcauaguuucccuauuuccauuaugccuaucuacuacaagccagaaaacaacuugguuaccaguuuuacugggcucuuugggguguaaaccauuaaccauguuucugauagcagaaaacaaaaucuggggccguaagucuuggcccuuaaaugaagguauuauggccguagguauagugaguauucuccuaucuucuuuacugaaaaaugacguaccacuagcaggaccauuaauugcaggggguaugcugauugccugcuacguuauaucaggcucaucugcagaucuuuccuuagaaaaagccgccgaaguaucuugggaggaagaagccgaacauucuggggcgagucacaauaucuuaguagagguacaagaugacggaacaaugaaaauuaaagaugaagaaagagaugacacccuaacaauacugcuaaaagcaacacuacuugccguaagugguguguaucccuuaucuauaccagcuacacuuuucgucugguacuuuuggcagaaaaagaaacaacgguccggaguacugugggacacucccucgcccccugaaguagaacgugcggugcuagaugaugggauuuauagaauaaugcaaaggggauuacuggguagaagccagguugguguaggaguguuucaggaaaauguauuucauacuauguggcacguaaccagaggggcuguacuuauguaccaagguaaaagauuggaaccuaguugggcauccgucaagaaagaucuuauuucguacgguggcggauggagacuacaagguagcuggaacacgggagaagaaguccaagucauagcaguagagcccggcaaaaacccgaaaaauguacaaacggcuccaggaacauuuaaaacgucggaaggagaaguaggagcuauugcacuagauuuuaaaccggguacaucuggcuccccaauagugaaucgcgaaggaaagauagugggucuauaugggaauggaguaguaacgacaagcgguaccuauguaucggcuauagcccaagcaaaggcuucacaagagggaccacuaccugaaauagaggacgaaguuuuucggaagcguaauuugaccauaauggaccuucauccagggucagggaaaacacguagguacuuaccagcuauaguacgagaagcaauuaaaaggcgccuuaggacccuaauacuagcccccacacggguaguugccucagaaauggcagaagcguuaaaagggaugccuauccgguaucagacaacagcagugaagucagaacacaccggcaaagagaucguggaucuuaugugucacgccacauuuacuaugaggcuucuuagucccguccgaguaccaaauuauaauaugauaauuauggacgaagcacacuuuacagacccaaguucaaucgcagcacguggauacaucucaacccgagucgggaugggagaagcagcggcaaucuuuaugaccgcaaccccgcccgguucgguagaagccuucccacaaucaaaugcggugauucaagaugaagaacgggacaucccagaaagaucauggaacucaggguacgaauggauaacagauuuuccgggaaaaacaguuugguuuguaccuagcaucaaaagugguaaugacauugcaaacuguuuacguaaaaaugguaaacgagugauccagcucuccaggaagacuuuugauacugaguaucagaaaacuaaaaacaacgacugggacuacguaguaacuacagacauuagcgagaugggagcaaacuuuagagcggauagaguaaucgauccgcgaaggugcuugaaaccagucauacuaaaagaugggccagagaggguaauacuagccgguccaaugcccgucacuguagcaagugcugcacagcggagaggaaggauaggacgaaaccauaauaaggaaggagaucaauacauauauaugggacaaccacucaauaaugaugaggaucaugcccauuggacugaagccaaaaugcuguuagacaauaucaauacgccggaaggaauuauucccgcacucuuugaaccggaaagagagaaaucugccgcuauugauggugaauauagauuacguggagaagcuaggaaaaccuuuguggaacugaugaggcgcggcgauuuacccguaugguugaguuauaagguggcuucggagggauuccaauacucugauagacgcugguguuucgauggagaaaggaacaaucaaguacuagaggaaaacauggauguagaaauauggacaaaggaaggagaaagaaagaaguuacgcccuagaugguuagacgcaagaacguauagugacccacucgcgcuucgagaauuuaaagaauuugcugcgggaagaaggucaguguccggugaucugauauuggaaauagguaaauuaccccagcacuuaacacaacgagcucaaaaugcccuagacaaccuaguaaugcuccauaauucagaacaaggugguagagccuaccgacaugcgauggaggaacucccagauacaauagaaacccuaaugcucuuagcacuuauagcuguguugacaggagguguaacacuauucuuucuuaguggaagaggacuagguaaaacaucaaucggacuuuuaugcgugauggcauccucaguacuacuguggauggcaucaguagaaccccauuggauugcugcaucgauaauacuagaguucuuucuaaugguucuucucaucccggaaccagaccgacaaaggacaccccaagauaaucaauuagccuauguuguaauaggccuacucuucaugauacugacaguggcagcaaaugaaaugggccuacuggaaacuaccaagaaagaucuaggaauaggacauguugcaguugagaaccaccaucaugcagccaugcuugacguggacuugcauccugcuucagcuuggacccucuacgcgguagcuacaacgaucauuacuccgaugaugcggcacacuaucgagaacacaacugcgaauaucaguuuaacagcgauagcaaaccaggcugcaauacugauggguuuagauaaagguuggccgauuaguaaaauggacauuggcguaccacuacuagcguuggguuguuauucccaggucaauccccuuacauugacagcugcgguguugaugcugguugcccacuaugccauaauuggaccaggauugcaggcuaaggcaaccagagaggcgcagaaaagaacagcggcuggaauaaugaagaacccaacuguugacggaauaguagcaauagauuuagauccaguuguauaugaugcaaaguuugaaaaacagcucggucagaucaugcuguuaauauuguguacaagucaaauuuuacucaugcgaaccacaugggcacuaugcgaaucaaucacuuuagcaaccggaccgcuaacuacuuugugggaggguucuccggguaaauuuuggaacacaacuauagcaguaucgauggcaaauauuuuuagaggguccuauuuggcuggagcuggacuagccuucucauuaaugaaaucauuggguggaggacguagaggaacaggagcucaaggagagacuuuaggugaaaaguggaaacgacagcuaaaucaacuaucaaagucagaauuuaauacauacaaaagaagcggaaucauggaagucgacaggucugaagccaaagagggcuugaagagaggugaaacgacuaagcaugcaguuaguaggggcaccgcaaaacuucgaugguuuguagagcgaaaccugguuaagccagaagguaagguaauugauuuaggaugcggacgaggcggcuggucauacuacugcgcaggccucaagaaagugacagaagugaaaggauauacgaaaggugguccaggacaugaagaaccgauuccaauggcuacuuaugguuggaacuuggugaaauuacacagugggaaagauguauuuuucauaccuccagagaagugcgacacacuacuaugcgauauaggagaaagcuccccuaacccaaccauagaagaaggcagaacuuuaagaguuuuaaaaaugguagaaccgugguuaagagguaaucaauucuguauuaagauauuaaacccguacaugccaaguguaguagaaacacuagagcaaaugcaaagaaagcacggaggaaugcugguaaggaauccauuaucacgaaauagcacucacgaaauguauugggugaguugcggaacggggaauaucguuagugcggugaauaugacgaguagaauguuacucaaucgguucacaauggcacaucgcaaaccuacauaugaaagggauguagaucuaggagccggcacucgacauguggcaguugaaccagaaguugcuaacuuagauauuauuggacaaagaauugaaaauauaaaacaugagcauaagucaacauggcauuaugaugaagacaacccauauaagacuugggcauaucauggaaguuaugaaguaaaacccaguggaucagcaucaucaauggucaaugguguagucaaacuauugacaaagccaugggacguaaucccuaugguuacacaaaucgcuaugaccgauacaacaccuuucggucaacagaggguauucaaagaaaaggucgauacgcgaacaccaaaggccaaaagagggacggcacaaauaauggaagucacggcgaaaugguuauggggcuucuuaucacguaacaagaagccacggauauguacacgagaagaauuuaccagaaaggucagaucaaaugcagcgauaggugcaguuuuuguagaugaaaaucaauggaacagugcaaaagaggcaguggaagacgagcguuuuugggaucuuguccacagagagcgugaauuacauaaacaagguaaaugugcaacaugugucuauaauaugaugggcaaaagagagaagaaacuaggggaguuuggaaaagcaaaaggcagucgagcuauaugguacauguggcuaggcgcaagauuucucgaauuugaagcacuaggcuuuaugaaugaagaccauugguuuucuagagaaaauucccuaucaggaguagagggggaaggccuucauaaauuaggcuacauauugcgagacauuucuaagauccccgggggaaauauguaugcugaugacacagcugguugggauaccagaauaacugaggaugaucuucaaaaugaagcuaaaauuaccgacaucauggagccagaacaugcuuuacuagcuaaaaguauauuuaaauuaacauaucaaaacaaaguugucagaguucaacgcccagcgaagaaugguaccgugauggaugugauaaguagacgagaccagcgcggaucaggacaaguaggaacguacggacuaaauaccuucacgaauauggaagcucaauugauacggcaaauggagucggaaggaauauuuagcccuucggaauuagaaacuccaaacuuggccggccgagugcuugacugguuagaaaaacauggugucgagcgauuaaagagaauggcgauaucaggcgaugauugcguaguuaaaccaauagacgauagauuugcuacagcauugacagcacuaaacgauauggguaaaguacguaaggauauaccccaaugggaaccuucaaaaggauggaacgacuggcagcaaguucccuuuugcucucaucacuuucaucaauuaauaaugaaagacggucgagagauugucgugccgugcagaaaucaagacgaauuggucggcagagcuagaguaucccaaggugcaggauggagccuuagagaaacggcaugucuugguaaaucuuacgcucaaauguggcagcugauguauuuucauagaagggauuuaagacuggcagcgaaugcgaucuguucggccgugccaguggacugggugcccacaucgcgcacuacauggucaauacaugcacaucaucaauggaugaccacugaggauauguuaagcgucuggaaucgaguauggauugaagaaaaucccuggauggaggacaaaacucauguuagcaguuggggugacgucccguacuuagguaaaagggaagaucaauggugcggcucauuaauuggcuugacagcaagggcgacaugggcuacaaauauacagguugcuauaaaucaagugagacgacuuuuaggaaaugagaauuaccuagauuacaugacaaguaugaagagauuuaaaaaugaaagcgauccagaaggugcuuuaugguga

SEQ ID NO: 21927 - RNA, 9879 nt, Artificial Sequence
  derived and/or modified CDS sequence (opt6) from DENV-1__EU482481__SS-prME
agcgucaccaugcuauuaaugcuaaugccuacggccuuagcguuccaccuuaccacgagagggggagaaccucacaugauaguaaccaaacaagaacggggcaaaaguuuacuauucaaaacuucagccgggguaaacauguguacacucauagcaauggauuuaggagaauuaugugaagauacuaugacauauaaaugcccgcgaauuacagaagcugaaccagacgauguagacuguuggugcaaugccacugauacauggguaacauacggaaccuguucccaaacuggugaacaccguagagacaaacggucaguggcauuggcgccacauguagguuuagguuuagaaacaagaacagaaaccuggaugagcagugaaggggccuggaagcaaauacaaagaguagaaacaugggcucuuagacaucccggguucaccgugauugcuuuauucuuagcgcaugcgaucggaaccucaaucacgcaaaaagguauuaucuucauucuauugaugcuagugacaccuaguauggcgaugagaugcgucggaaucgguucaagagauuucguagagggccuuagcggugccacuuggguagacguaguacuagaacaugguucaugcguaacuacgauggcgaaagacaaaccuacacucgacaucgaauugcuuaaaacagaaguaaccaacccugcuguuuuaagaaaacuaugcauugaagccaaaaucucaaacacuacaacagacucacgaugcccuacacaaggagaagcaacuuugauggaagaacaagacgcaaacuuuguuugcagacgaaccuuuguagauagaggaugggguaauggguguggccucuucggcaaagguuccuugauaacaugcgcaaaauuuaaguguguaacgaaauuagagggcaaaauaguucaauaugaaaaccuaaaauacucggucauuguuacaguacauacuggugaucaacaucaaguuggcaaugagucuacggaacaugggacgaccgccaccauaacaccacaagcaccuacaucagaaauucaacugacugacuauggggcuuuaacacuggauugcuccccuagaacuggauuagauuucaacgaaaugguccuacuuacuaugaaagaaaaauccuggcuaguccauaaacaaugguuucuugauuuaccacuaccauggacaagcggagcauccacuagccaggaaacauggaaucgacaggaccuauuaguaacauucaaaacugcccaugcgaagaaacaggaaguagucguuuuagguucacaagagggagccaugcauacugcgcuuacaggagcuacagaaauacaaacaucagguacaacuacuauauucgcuggucacuuaaaaugcagguuaaagauggacaaacuaacauuaaaaggaaugagcuaugucauguguaccgguagcuucaagcuagagaaagagguagcagaaacccaacacgggacaguguugguccaaauuaaauacgaagguacagaugcaccauguaagaucccuuucagcacccaagaugaaaaaggcguuacacagaacggaagacuaauuacagcaaauccuauuguuacagauaaggagaaaccaguuaauauugaggcagaaccucccuucggagaaagcuacauagucauaggagcaggagaaaaggcucuuaaauugaguugguuuaaaaagggaaguucuauuggaaagauguucgaagcuacagcgcgaggggccagaaggauggccauuuuaggggacacugcaugggauuucggaagcgugggagguguauuuacaaguguaggaaaacuuguacaccaaaucuucggaacugcauaugguguacuauuuucuggcguuucuuggacuaugaagauaggaauaggaguauuacuaacauggcugggucucaauucucgauccacuucccuuucuaugacuugcauagcuguagggcucguaacacuauauuuagguguaaugguacaagcggauucagguuguguaauaaauuggaaaggacgagaauugaagugcggcucuggaauauuugucacaaacgaaguucauacauggacagaacaauauaaauuucaggcggauagccccaagcggcuaucugcagcaauuggaaaagcaugggaggaaggaguguguggaauuaggucggcaacacgacuagaaaauauuauguggaaacaaaucucaaaugaauuaaaucauauauuauuagaaaaugauaugaaauucacaguuguuguaggugaugugguaggcauacuagcucagggcaagaaaaugauuagaccacaaccaauggaacacaaauauuccuggaagucaugggguaaggcaaagauuauuggcgccgacguccaaaauacaaccuucauaauagacgguccuaauacaccugagugcccagaugaucaacgagcauggaauauaugggaagucgaagauuacggauuuggaauauuuaccaccaacauauggcuuaagcucagagacuccuauacgcaagucugugaucaucgucuaaugucagcagcgauaaaagacucaaaagcaguacaugcugauaugggauauuggauugaaucagagaaaaaugaaacuuggaaacuagcccgugcaucuuuuauagaaguaaaaacuuguauauggccgaagucacacacacucuggagcaacgguguacuagaaucugagaugauuauccccaaaauauaugguggaccuaucagucaacacaaucauagaccuggcuacuuuacacagaccgcaggacccuggcaccuaggcaaacuagaguuggacuucgauuugugcgaaggcacgacaguggucguugaugagcacugcgguaaccgagggccaucguugagaacgaccacaguuacagggaaaauaauccacgaaugguguugcagaagcugcacacucccgccguuaagauucaaaggagaagauggcuguugguaugggauggaaauccgcccugucaaagagaaagaggaaaacuugguaaagucaaugguaucugcuggaucgggugaagucgacagcuuuucuuugggauugcucugcaucucaauuaugaucgaagaaguuaugaggucaagauggagcagaaaaaugcuuaugacaggaacccuagcaguauucuuauuacucaucauggggcaguuaaccuggaaugaucucaucagacuaugcauuauggucggagccaacgcuuccgaccgaauggggauggguacgacauaccuggcauugauggcaacuuuuaaaaugcgaccuauguuugcaguagggcuguuauuucgacgucugacuucgagagaaguucuucuauuaacaaucgggcuaucuuuaguagcgucagucgaacucccuaacagccuagaagaacuaggagaugguuuagcuauggguauaaugauacucaaauuguugaccgauuuucagucccaccagcugugggccacuuuacuuucauugacauucauaaagaccacacuauccuuacacuaugcauggaaaacaauggcuaugguuuugaguaucguaucuuuauuucccuuaugcuuaucaaccacaucacagaaaacaacaugguuaccaguauuacuaggaaguuuggguuguaaaccacuaacaauguuccuaauaacugaaaauaaaauuugggggaggaaaucguggccacuuaaugaagguauaauggcaguagguguggugagcauccuccucucaucacucuugaagaacgacgucccucucgcagggccauuaaucgccggagguauguuaauagccugcuaugucauuucaggaagcagcgcagauuuaucccuugaaaaagccgccgaaguaucuugggaagaggaagcugagcauucuggagcaagccauaacauucuggucgaaguacaagacgacggaacgaugaaaauaaaagaugaggaacgcgacgauaccuuaacuauccuucuaaaagcaacucuucuagcagucagugggguauauccucucaguauacccgcuacgcuauucguaugguauuuuuggcagaaaaagaaacaaagaaguggagugcuuugggacacuccaaguccacccgaaguugaacgagcagugcuggaugacggaauuuaucgcaucaugcagcggggacuucuuggcagaucccaagugggcguuggcguuuuccaggaaaacguuuuucauacaauguggcauguaacacgcggcgccguacugauguaucaagguaaacgauuagaaccuaguugggccucagugaaaaaggacuuaaucucuuacggaggaggauggaggcuucaaggaagcuggaauacaggagaagaaguccaagucauagcgguagaaccagggaagaaucccaaaaauguccagacagcgccggggacauuuaaaacaccggagggggagguaggugcaaucgcacuagacuucaaaccaggaacaaguggaucuccaauagugaaucgagagggaaaaaucgucgguuuauaugggaauggcgugguaacuacaagcggaacauauguuagcgcuaucgcgcaagcgaaagcaagucaagagggcccacucccagaaauagaagaugaaguguuuagaaaacgaaaccuaacaauaauggauuugcauccgggaucuggcaagacacgaagauauuugccggccauaguacgagaagccauaaaacgaaaauuacggaccuugauuuuagcaccuaccagaguuguagcuucugaaauggcagaagccuuaaaagguaugccaauccgauaucaaacaacugcuguaaagucggaacauacuggaaaagaaauaguagaucucaugugucacgccaccuuuaccaugcgacuacuuaguccuguuagaguacccaauuauaauaugaucauuauggaugaagcacauuucacagauccaucauccauugccgcaagaggauacaucucuacaagaguuggcaugggagaagcagcagccauuuucaugacugcuacaccaccaggaucaguggaggccuucccgcaaagcaaugcaguaauucaagaugaagaacgcgauauuccugagagaaguuggaacucuggauaugaauggauaacagauuuucccgguaaaacuguaugguucguuccaagcaucaagagcggaaacgauaucgcaaauuguuugcggaagaacgguaagcggguaauccaauuaucacggaagacauuugauacggaauaucagaaaaccaaaaacaaugacugggacuaugucguuacaacugacauaagugaaaugggugcaaacuuuagagcagaucgaguaauugauccgagaagauguuuaaaaccaguaauuuuaaaagacgguccagaaagagugauauuagcggggccuaugccagugacuguggcuagugccgcucaacgacgcggacggaucgggcguaaccacaauaaggagggagaucaauacauauacaugggucaaccuuuaaacaaugacgaagaucaugcacacuggacagaagccaaaauguuauuagauaauauaaauacacccgaagguauaauuccugcacucuucgagccagaacgcgaaaagagugcagcaauugacggugaauacagacuuagaggagaagcucgaaaaacauuuguagaauugaugagaagaggggaucuaccagugugguugucauacaaaguagcaucugagggauuucaauauuccgacagacgaugguguuucgauggagagaggaacaaucaaguacuugaagagaacauggaugucgaaaucuggacuaaagaaggugagcgcaagaaauuacguccaagauggcuagaugcucgcacauacagugauccauuggcccucagagaauuuaaagaguucgcagcaggcagacgcuccgucagcggugacuuaauaucggaaauuggcaaacugccacaacaucuaacucaaagagcacaaaaugcauuagacaaccuaguaauguugcauaacucggaacaaggcggucgagcuuauagacaugcgauggaagaacuaccagauacgauugaaacuuuaaugcuacuugcacuaauugccguacuuacaggggguguaacauuauucuuucuaucaggucguggucuugggaaaacaucgaucggucuccuuugugugauggcaucaaguguacuccuuuggauggcguccguagaaccacauuggaucgccgcuuccauaauccuggaguucuucuuaaugguacuacuaauaccugagccugaccgacaacgcacuccacaggauaaucaguuagcguauguaguaauaggauuacucuuuaugauauuaaccguagcagcuaacgagauggguuugcuagagacaacaaagaaagacuuaggaaucggacauguggcuguugaaaaucaccaucaugcaacuauguuggacguagacuuacauccggcaucagccuggacacuuuaugcaguagcgacuacgauaaucaccccaaugaugaggcauacuauagagaauaccacagcuaauauaucauugacagcaauugccaaucaagccgcaauuuuaaugggacucgacaaaggauggccaaucucaaaaauggacaucgguguuccguuauuagcgcuaggauguuauucucaaguaaauccacuaacgcuuaccgcugcaguacuuauguuaguagcccauuacgcaauaauaggcccagggcuacaggcaaaggccacaagagaggcacagaagcggacagcagcgggcauuaugaaaaaucccacuguggacgguauaauugcaauugacuuagacccaguaguuuaugaugccaaauucgaaaaacaacuaggucagaucauguuauugauccuauguaccagucaaaucuuguugaugcgaacuacuugggcucucugcgaaucaauaacucuugccacggguccacuaacaacucugugggaaggaucgccgggaaaauucuggaauaccacuaucgcagugagcauggcaaacauauuuagaggaucguacuuggcuggagcgggauuagcauucaguuuaaugaaaucuuuaggaggaggaagaagaggcacaggagcgcagggugaaacacuuggagaaaaguggaaaagacaacucaaccaauuaagcaagagugaguucaacauuuauaaaagaaguggcauuauggaagucgacagaucugaagcuaaagaaggucugaaacguggggaaacuacaaggcaugccgucucgcggggaacggcaaaauugaggugguucguggaaagaaaccucgucaagccugaagguaaagugaucgacuuagguugcggacgggguggcuggucauauuacugugcuggucuaaagaaaguaacagaaguaaaaggauauacaaaaggagggccgggacaugaggaaccgauuccuauggccacauaugguuggaacuuaguaaaguugcacagcggaaaggacguauucuuuacaccaccggagaaaugcgacacguuacucugugauaucggcgaaagcucaccuaaccccacgauugaagaaggacgaacccugcguguacuuaaaaugguagagccaugguugcguggaaaucaauucuguauaaaaauacuaaaccccuauaugccuagcgugguagaaaccuuagaacaaaugcagagaaagcacggagguauguuagugagaaauccgcugucacguaacucuacccaugaaauguauuggguaucuuguggaacuggaaacauuguuagugcaguaaauaugacuuccagaauguugcuaaauagauuuacaauggcucauagaaagccaacauaugaacgcgauguagaccuaggagcaggaaccaggcauguggcuguagaaccggaaguagcaaacuuggauauuauugggcaaaggaucgagaauauaaagcaugaacacaaaucuaccuggcauuaugaugaggacaauccuuauaaaaccugggcauaccaugguucauaugagguuaaaccuucaggaucugcgucaucaaugguuaauggugucguuaagcugcuaacaaagccaugggacgucauccccaugguuacacagauagcaaugacagauacgacaccauucggccaacaaaggguguuuaaagaaaaaguugacacaagaacuccaaaagcaaaaagaggaacagcacaaaucauggaaguuacugcucggugguuauggggauuucucuccagaaauaaaaagccacgaauauguacgagagaagaauuuacucggaaaguccgaucuaaugcagcaaucggagcggucuucguugacgagaaccaauggaacucggcgaaagaagcuguggaggaugaaagauucugggaucuaguccaaaaggaaagggaacuccacaagcaggggaaaugcgcaacaugcguauacaauaugaugggaaaaagggagaagaaacuaggagaguucgggaaagcuaaaggaagccgugcgauaugguacaugugguuaggugcgagauuucucgaauuugaagcacugggcuucaugaacgaggaccacugguuuucucgagaaaauucacuuucagguguagagggagagggccuccauaagcugggauauauauuaagagacauaucaaagauaccuggaggaaauauguaugcagaugauaccgcugguugggauacaaggauaacugaagaugaccuacaaaacgaagcaaaaauuacagacauuauggagccagaacacgcacuucuggcaacaucaaucuucaaguuaacauaucaaaacaaaguaguucgcguucaacgcccagcuaaaaaugguacgguaauggaugucauaaguaggagggaccaaaggggauccggacagguaggcaccuauggauuaaauacauuuacuaacauggaagcacaguuaauccgucaaauggagucagagggaaucuuccuucccagugaauuagagaccccuaaccuagcagaaagaguucuagauugguuagaaaaauacggggucgagcgacuuaaaaggauggcgauaucaggagaugauugcguaguaaaaccaauagacgauagauucgccaccgcacucacugcccuaaaugauauggguaagguuaggaaggauauaccgcaaugggagccuucuaaagguuggaaugauuggcaacagguaccauucugcucacaccacuuccaccaacugauaaugaaagauggccgagaaaucgucguuccaugucguaaucaggacgaauuaguugguagagcaagagucagccagggggcuggauggagucuuagggagacugcgugccuagguaaaaguuaugcgcaaauguggcagcuuauguauuuccauaggagagaucuacgacuggcugcaaaugccauauguuccgccguaccaguagacuggguaccgacaagccguaccacauggaguauacaugcucaccaucaguggaugacuacugaagauaugcucucuguauggaaccgaguuuggaucgaggaaaaccccuggauggaagauaaaacacauguuagcagcuggggagauguaccauaucucggcaaaagggaggaucaaugguguggcucucucauagggcuaacagcacgugccacuugggcauccaauauccaaguagccauaaaccaaguacgucggcuaauuggaaaugaaaauuaucuggacuacaugacuucaaugaagagauuuaagaacgagggagauccagaaggggcgcugugguaa

SEQ ID NO: 21928 - RNA, 9879 nt, Artificial Sequence
  derived and/or modified CDS sequence (opt6) from DENV-1__EU482482__SS-prME
agcguaacuauguuauuaaugcuuaugccgacggcguuagcguuucaucuaacuacacguggcggcgaaccgcacaugauaguaucaaaacaggaaagagggaaaucacuauuauucaaaacgagugccgguguaaauaugugcacacuaauugcuauggaccuuggagaacuaugugaagauacuaugacauauaaauguccacgcaucacggagacugaaccggaugacguugacugcuggugcaaugcuacagacacuuggguuacauacgguaccuguucacaaacaggugaacauagacgggauaaaaggucaguggcacuagcuccacacguuggacuuggucuugaaacgcggacggaaacguggauguccucugagggcgcauggaaacaaauucaacgaguagaaacgugggcacuaaggcauccugguuuuacaguaauugcacuguuuuuagcacaugcuaucgggacuagcaucacucagaaagguauaaucuucauccuacugaugcuagugacuccguccauggcaaugagaugugucggcauaggaaguagagauuucgucgaagguuuauccggcgcuacuuggguugacguuguucuagaacacggcucuugcguuacaacgauggcgaaagacaaacccacacuagauauagaacucuugaaaacggaagucacuaauccagccguucuaagaaaacucugcauugaggcaaaaaucaguaauacaaccacggauucucgauguccaacacagggagaggcuacccuaguugaagaacaagacgcgaauuuugugugcaggagaacauucguugaccgcggaugggggaauggaugcggacuguucggcaaaggaucacugauuacaugugcaaaauuuaaaugcguaaccaaacuagaggguaaaaucguccaauaugagaaucuuaaauauaguguaauugucaccguucauacaggagaucagcaccaaguuggaaaugagagcacagaacacgguacaaccgccaccauuaccccacaagcuccaacuacagaaauacaauuaacugauuauggagcuuuaacacucgauugcagccccaggacgggucuagauuuuaacgagaugguauuauugacuaugaaagaaaaaucauggcucguacacaaacagugguuucuggaucuaccgcuaccauggacauccggagcaucaacuucacaggaaacauggaauagacaagaccuccuaguaacauucaaaacugcucaugcaaagaaacaagaaguugugguacuuggcucacaggaaggugcgaugcauacagcuuuaacaggcgcaacggagauucaaacauccgggacaacaacuauauucgcugggcaucucaagugucgguugaaaauggacaaacucacccuuaagggaaugucauacgucauguguacagguaguuucaaguuagagaaagaacuagcagaaacccagcaugguaccgugcuaguucaaauaaaauaugagggaacggaugcaccguguaaaauuccuuucaguacccaagaugaaaagggaguuacccaaaacggcagacucauaacagcgaaucccauuguuacugauaaggaaaaaccuguaaacauagaagcagaacccccuuuuggugaaucauauauagucauaggggccggugaaaaagcauugaaauuauccugguuuaaaaaggguaguucgauagggaaaauguuugaggcuacagcuagaggugcucgacguauggcaauauuaggagauaccgcaugggauuucggaaguauaggaggaguguucacaagugucgggaaauugguacaucaaauuuucggaacggcauacggcguauuguucucaggagucucauggaccaugaaaauaggaauuggaguacuacuaaccuggcuugguuuaaauucgagaucaacgagucuauccaugacauguauugcaguaggacuuguaacucuuuacuuaggcgugaugguacaagcagauucggguuguguaaucaauuggaagggacgagaacuaaaauguggaucuggcaucuucguuaccaaugagguccauaccuggacugagcaauacaaauuucaagccgauaguccuaagcggcucucagcagcaauuggaaaagccugggaagaagguguaugugguauucgaucagcgacccgcuuagaaaauaucauguggaagcaaaucucaaaugaacuuaaucauauccuuuuggaaaaugauaugaaauucacaguagucgugggcgacguggcaggaauauuggcgcaagggaagaaaaugauucgcccacaacccauggaauacaaauacucauggaagucauggggaaaagccaaaauaaucggcgccgacguucagaauacaaccuucauaauagauggcccaaauacuccugaaugcccagaugaucaacgugcguggaauauuugggaagucgaagacuaugguuuugguauauuuacaacgaacauaugguuaaaauuaagggauucauauacgcaagucugcgaucauagacuaaugagugccgcaauuaaagauagcaaagcgguucaugccgacaugggguacuggauagaaucugagaaaaaugaaacauggaaguuggcacgugcaaguuuuauugaaguaaaaacauguauuuggcccaaaucgcauaccuuauggaguaacggaguucuugaaagcgaaaugauaauaccuaaaauuuauggagggccuauaucacaacacaacuauaggcccggguacuuuacacagacggccgguccauggcacuuggggaaguuagaacuggauuuugaccuaugcgaagggacaacgguugugguggaugaacauugcggaaacaggggacccucccugagaaccacaacaguuacuggaaaaauaauucaugagugguguugucgaucuuguacucucccuccacuaagauuuaggggcgaggacggcuguugguacgguauggagaucagaccugugaaagaaaaagaagaaaaccucgucaagucuauggucucugcaggaaguggcgaaguggacucauucucguuagggcuauuauguauuucuauaaugauagaagaaguaaugagaucucgcuggucaagaaaaauguuaaugaccggaacucuagcgguauucuuuuuguugauaaugggacaacucaccuggaaugaccucauaagauugugcauaauggugggggcuaaugcguccgacagaauggguaugggaacaacuuaccuagcacuuauggcuaccuuuaaaaugagacccauguuugcagucggacuacuauuuaggcgacugacaagcagagaaguucuauuauuaacaauaggacuaucccuuguugcgucgguagaauuacccaacagucuagaagaguugggggauggccuagccauggggauaaugauccuaaagcuauuaacagacuuccaaagucaucaauuaugggcuaccuuguuaucauuaaccuuuauaaagacgacuuuuagucuacauuacgcuuggaaaacuauggcuauggucuugaguaucguuuccuuauucccacuaugccuaucaaccaccucacagaaaacgacgugguuaccugugcuauuaggcucacuuggcuguaaaccuuuaacgauguuuuuaauugcagaaaacaaaauauggggaagacgaucauggccacugaaugaaggaauaauggcaguugggauuguaucgauccuucuguccucauuauuaaagaacgauguuccuuuggcugggccacuaauagccgggggcaugcucauugcuuguuacguaauuucuggaucaucugcugauuugucauuagaaaaagcagcggaaguuaguugggaagaagaagcagagcacagcggugcuucacauaacauauuaguugagguucaagacgaugggacuaugaaaauuaaggacgaagaacgagacgauacccuaaccauacuccuaaaggcaacauuauuagccgucucugggguuuauccccuaucgauaccagcuacucuauuuguaugguacuucuggcagaagaagaaacagaggucuggaguguuaugggauacuccgaguccacccgagguagagagagcuguccuagaugaugguauauauagaauuaugcaaaggggguuacuaggaagaucccaagugggcguaggaguuuuucaggaaaacguauuucauacaauguggcauguaacacguggcgcuguguuaauguaucaagggaagcgauuggaaccuuccugggcaagugugaagaaagaucuaauuuccuauggugguggauggaggcuccaagguuccuggaacacuggcgaagaaguacagguuaucgcuguugaaccggguaaaaaccccaaaaaugugcaaacagcacccggaacauucaaaacuccugagggggagguuggggccaucgcgcuugauuuuaaaccgggaacgucuggaucuccgauuguaaacagagaaggaaaaaucguagggcuauaugggaacggugucguaacuacuucggguacguacgugagcgcuauugcgcaagcaaaagcaucacaagaggguccuuuaccagagauagaggaugagguauuccguaaacgaaacuuaaccauaauggaucuacauccaggcagcgguaaaacgaggagauaucugccagcaaucguacgugaagcaauaaagcgaaaacuuagaacacugauauuggcccccacacgcgugguagcaucagagauggcagaggcccucaaaggaaugccuauuagauaucaaaccaccgcgguuaaaucugagcacaccgggaaagagauaguagauuuaaugugccaugccaccuuuacgaugaggcuguuaucaccugugagaguaccuaacuacaacaugauaauaauggaugaagcacauuucacagauccuucaucaauugcagcacgggguuauauuaguacaaggguagguaugggggaagcugccgcaauauuuaugacagccacucccccagggucaguagaagccuucccacaaucuaacgcagugauacaagaugaagaacgggauauuccagaacgcagcuggaacagcgguuaugaauggauuacagauuuuccuggaaaaacaguaugguuugugccauccauuaaaucugguaaugauauagcgaauuguuuaaggaagaacggcaaaagagucauucaguuaucacgaaaaacguuugauacugaguaucagaagacuaagaauaaugauugggauuacgucguuacgacugauauuucagaaaugggugcaaauuuuagagcggaucguguaauagauccacgaagaugucuaaaaccuguaaucuuaaaagacgggccagaaaggguuauucuggcaggacccaugccaguaacuguagcgagugcagcgcaaagaaggggaagaaucggccguaaucacaauaaagaaggagaucaauacauauacaugggucaaccauuaaauaacgaugaagaucaugcacacuggacagaagcaaagaugcuacucgauaacaucaacacaccugaagguauaaucccagcauuauucgaaccagaaagagagaaaucugccgcaauagauggagaguaccgucugaggggcgaagcacgaaaaacuuucguugaacuaaugcguagaggcgaucuaccugugugguuaucauauaaaguugcgagugagggauuucaguacagcgacaggcguugguguuucgauggagagcgcaacaaucaggugcuagaagaaaacauggauguagaaauauggacaaaagaaggagaacgaaagaaauuacgaccacgcuggcuagacgcacguaccuauucagauccacuagcuuuacgugaauuuaaagaguucgccgcagguagaagaaguguaucaggcgauuuaauuuuagaaauugguaaacuaccucaacacuuaacucagagagcccaaaaugcccuagauaaccuaguaauguuacauaauagugaacaagggggucgagcuuacagacacgcaauggaagaauuaccagauacuauagaaacauuaaugcuacucgcacugauugcuguacuaacagggggcgugacauuauucuuucuauccgguaggggguuaggaaaaacuucaauaggacuacuaugcgucauggcaucaucgguccuacuguggauggccaguguagaaccgcauuggauagcugcuucaaucauauuagaguucuuuuuaaugguucucuuaauaccagaaccugauagacaaagaacaccacaagauaaucaauuagccuauguugucauuggucuauuauuuaugauuuugaccguagcagccaaugaaaugggacugcuugaaacgacuaagaaagacuuagggauuggucacguugccguagaaaaucaucaccacgcugcaauguuggacgucgaccuucacccagcaucagcuuggacgcuuuaugccguugcaaccaccauuauuacaccaaugaugaggcauacuauagagaauacaacugcaaauauuucacucacagcgauagcaaaucaggccgcaauauuaauggguuuggauaaaggguggccaauaagcaaaauggauauagguguaccuuuauuggcuuuagguugcuauucacagguaaacccacucacacucaccgcagccguauuaauguuggucgcgcacuaugcuauaauaggaccaggucugcaagcaaaagccacacgggaagcccaaaagaggaccgcugcgggaauaaugaaaaauccgaccguugacggaauuguagcgauugaccuagacccagugguuuacgaugcaaaauucgaaaaacaacuugggcaaauuaugcucuuaauuuugugcacaagccagauccuauuaaugcgaacaaccugggcacuaugugaaucaauaaccuuagcuacuggaccacuuaccacgcuuugggagggaucaccagguaaauuuuggaacaccacaauagcagugagcauggcaaacauuuuucggggaucauauuuagcaggcgcaggacucgcauuuucauuaaugaaaucauugggcggcggacguagagggacaggugcacagggagaaacccuaggcgaaaaauggaagcgacaguugaaucaacucagcaagagcgaguucaacacuuauaagagaucaggaauaauggaaguugaucgaagugaagcuaaagagggucugaaacgaggagaaaccacaaaacacgcgguaucgagaggaacagcaaaacugaggugguucgucgaaagaaaccuggucaaaccggaagguaaaguaauugaccucgguuguggacgcggcggaugguccuacuacugcgcaggucugaagaaaguaacagaaguuaagggauauacgaaaggaggcccuggacacgaggaaccuauaccaauggcgacauaugguuggaauuuagugaaacuucauucugggaaagauguguucuucauaccaccagagaagugcgacacauugcuaugcgacaucggagaguccucuccaaacccaacgaucgaagagggacguacuuugagaguuuuaaaaaugguagagccaugguuaaggggcaaccaauuuuguauaaagauauugaacccguauaugccuucgguaguggaaacgcuugagcaaaugcaacggaaacauggagguauguuaguucgcaauccauuaagucguaacaguacacacgaaauguauugggucucauguggaacggguaacauuguaagugcuguaaauaugacaagcagaauguuacuuaauagauuuacuauggcacaccgaaaaccuacuuaugagagggacguagaccuaggcgcggggacaaggcauguagcgguagaaccugaaguggcgaaucuugauauuaucggacagcgaauagagaacauuaaacaugaacacaagucgaccuggcauuacgacgaagauaacccauacaaaacgugggcauaucaugguucguacgaaguaaaaccuaguggaagugcaaguaguauggucaauggaguaguuaagcuacuuacaaaaccgugggauguaauaccaaugguuacacaaauagcaaugacugauacgacaccauucggccagcaacgaguauuuaaagagaaaguagacacucgcacaccuaaagcuaaacgcggaacagcacagauuauggaagucaccgcuaaaugguuauggggguuucucaguagaaauaagaaaccuagaauuugcaccagagaggaguucacaagaaaggugagaaguaaugcggccauuggggcaguguuuguggaugaaaaccaauggaacucagcaaaagaggcagucgaagaugaaagauucugggaucuaguacacagagaaagagaauuacauaaacaagguaaaugugccacgugcguuuacaauaugaugggaaaaagagaaaagaaguugggagaguuuggaaaagccaaagguaguagggccauaugguauauguggcucggugcaagguucuuagaguucgaggcacucggauuuaugaaugaggaccacugguuuagccgagagaacucauuaucuggugucgaaggugaaggccuacacaaacuaggauauauacuaagggauauaucgaaaaucccuggcggaaauauguacgcugaugauacagcggggugggacacuagaaucacggaagaugaccuucaaaacgaagcaaggauuacggauauuauggagccagaacaugcucuauuggcaaagaguaucuucaaacuaacauaucaaaacaaggucgugagaguacaaagacccgccaaaaauggcacuguaauggacguaauuagucgacgagaucaaagaggcagcggacaaguaggaaccuacggguuaaauacguuuacgaauauggaagcacaauuaauaagacagauggagucugaagguaucuuuucaccaucugaacuagaaacaccuaaucucgcaaaacgaguacuagauugguuagaaaaguaugguguagagcgacuuaagagaauggccauuuccggugaugauugcguuguuaaaccaaucgacgacagauucgcgaccgcacuaaccgcauuaaacgauauggggaaaguuaggaaggauauaccucagugggagccaucaaaaggauggaaugacuggcaacaaguacccuucuguagucaucacuuucaucaguuaauaaugaaagauggcagagaaaucguaguacccugcagaaaucaggaugaauuaguaggccgagcuagaguaagccagggugcagguuggucacuaagagaaacugcgugucuagguaaaucguaugcacaaauguggcaacuuauguauuuucaccgucgugaccuaagauuagcugcgaaugcaaucuguucugcagucccuguugauuggauaccaacaucuagaaccacauggaguauacaugcgcaccaucaguggaugacuacagaagauauguuaucuguuuggaauaggguauggauagaggaaaauccguggauggaggacaagacccacauauccagcuggggugaugucccguaccuaggaaaaagggaagaccaguggugugguucgcuuauuggacugacagcacgggcuaccugggcuacuaauauccaaguugcuauuaaucaaguacgucgcuuaauagguaaugaaaauuauuuggacuauaugaccagcaugaagagauuuaaaaaugaaucagacccagaaggagcauuaugguaa

SEQ ID NO: 21929 - RNA, 9879 nt, Artificial Sequence
  derived and/or modified CDS sequence (opt6) from DENV-1__EU482485__SS-prME
ucaguuacuauguuacucauguuaaugcccacagcauuagcauuucaucugacgaccaggggaggagaaccgcacaugauuguuaguaaacaagaaagggguaaaagccuucuuuuuaaaaccucagccggaguaaauauguguacacuaauagcuauggauuuaggagaacuaugugaagauaccaugacuuacaaaugcccacgcauaacagaaacugaacccgaugacguggacugcugguguaacgccacugauaccuggguuacauaugguacaugcucacaaacaggcgaacaucgacgagauaaacgaucgguagcacuagccccacacguaggacuaggacuagaaacccgaacugaaaccuggaugucaucggaaggcgcuuggaaacaaauccaacgaguagaaaccugggcacuacgccaucccggcuuuacaguaauugcuuuauuccuagcccaugcaauuggaacaaguauaacucaaaaaggcauuauuuucauccuauuaaugcuaguaacgccaaguauggccaugaggugugucgggauagguagccgagauuuuguugaaggcuuauccggugcaaccuggguggauguaguucuggaacacggcucaugugucaccacgauggcgaaagacaaaccuacccuggacauagaacuacuuaaaacugaagugacaaauccugcaguccuucguaaacuuugcauagaagcaaaaauaucuaauacuacaacugauuccagauguccgacccaaggggaagccacauuaguagaggaacaagacgcgaacuucgucuguagaagaacauucgucgacagaggcugggggaaugguugcggccuauuugguaaaggaagccugauuacgugugcaaaauucaaauguguaacaaaauuagaaggaaaaaucguucaauaugaaaaccuaaaauauucaguaauaguaaccguacacacaggcgaucaacaucaaguugggaacgagaguaccgaacacggaacaaccgcuacgauaacgccucaggcuccaacaacugaaauucaacuaacugauuauggagccuuaacacuagacugcucuccgcgaacuggguuggauuucaacgagaugguccuauuaacaaugaaagagaaaaguugguugguacacaaacaaugguuuuuggauuuaccuuugccguggacgagcggagcuuccacaucgcaagaaacguggaaccgucaagaucuauugguaaccuuuaaaacagcucacgccaagaaacaagaaguaguuguauugggaucacaagaaggagcgaugcauacagcauuaacgggcgcgacagaaauucaaacuucggguacaacgacgauuuuugcaggacauuuaaaaugccgccuaaaaauggacaaacucaccuuaaaaggaauguccuaugugauguguaccggaucauuuaaauuagaaaaagaaguagcugagacccaacauggaacaguccuaguacaaauaaaauacgaagguacggaugcuccgugcaaaauaccuuucaguacacaagaugaaaaaggagucacgcaaaacggucgccuaaucacggcaaacccaaucguuacugauaaagaaaaaccugugaacauagaagcagaaccaccauuuggugagaguuacauaguuauaggagccggcgaaaaagcguugaaauuaagcugguuuaagaaaggaucuucaaucgguaaaauguucgaagcuacagcaaggggagcacgaaggauggcuaucuuaggcgacacugcuugggauuucggaucuaucggagggguuuucaccucgguagggaaauuaguacaucaaauauuugguaccgcuuacggaguucuauucucugguguaucuuggacaaugaaaauagguauagggguucuucuaacuugguuagguuugaacucaagaaguacaucgcugucaaugacgugcauagccguugggcuagugacgcuauauuuaggcguaaugguucaagcggacucaggcugcgugauuaacuggaaaggaagagaauuaaaaugcgguuccggaauuuuuguaaccaaugaaguccauacuuggacggaacaauauaaguuccaggcugacaguccaaaacgacugucagcagcuaucgguaaggcuugggaagaaggagugugcgguaucagaucugcgacaagacuugaaaauauaauguggaagcaaaucuccaaugagcuuaaccauauacuacuugaaaacgacaugaaauuuacagucguuguuggagauguugcaggcauacucgcacaaggcaagaaaaugaucagaccccaacccauggaauauaaauauucguggaaaucaugggguaaagcaaaaaucauaggcgcagacgugcagaacaccacauuuauuauagacgguccaaauacuccggaauguccagacgaccaacgagcuuggaauaucugggaagucgaagacuacgguuuuggaauuuuuacaacgaauauauggcuaaaguuacgggauucuuacacgcagguuugugaccaucgauuaaugagugcagcuaucaaagauucaaaggccgugcacgcagauaugggauacuggauugaaucugagaagaacgaaacauggaaacuugcaagagcgaguuuuauagaagucaagacauguauauggccuaagucgcacacuuuauggaguaauggaguauuagagucggaaaugaucauccccaaaaucuacggaggacccaucucucaacauaauuacagaccgggcuauuuuacgcagacagcagguccguggcaucuaggcaaauuagagcucgacuucgaucuuugugaggguacaacgguggucguugaugaacauuguggaaauaggggaccaucgcugagaacaacgacaguuacuggaaaaauuauucaugaauggugcugccggucauguacucuaccgccauuaagauuucgaggagaagauggaugcugguauggaauggagauaagaccaguuaaagaaaaagaagagaauuuagugaaaagcaugguuucugcagguagcggagagguugacucauuuucacugggccuucuauguauuucuaucaugauugaagaaguuaugagaagcagauggagccgaaaaaugcuaaugaccgguacauuggcgguguucuuuuugcuaauuaugggacagcuaacguggaaugaucucauacgcuugugcauaaugguaggcgcaaaugcaagugaucguaugggaaugggcacgacauaucuugccuuaauggcaaccuucaaaaugcgaccuauguucgcgguaggacuccucuuucgaagacuaacaucaagggagguccuacuccuaacuauuggacuaucccuugucgcuuccguggaauugccgaacagccuagaggaacuaggugaugguuuagcaauggguaucaugauauugaaacuauuaacagacuuucaaagccaucagcugugggcaacuuuacucaguuuaacuuucaucaaaacaacauuuagucuucacuacgccuggaaaacaauggccaugguauuaucuaucgucucacuuuuuccucuaugucugucaacaacuucacagaaaaccacaugguugccgguacuccuaggaucguuagguuguaagccguuaaccauguuuuuaauugcagaaaauaaaaucuggggacgacgcaguuggccucugaacgagggcauaauggccguaggaauugugaguauauuauugucuaguuugcucaagaaugauguuccauuagcaggaccacuaauagcaggaggaauguuaauugcguguuacgucauaucgggaaguucagcagacuugucacucgagaaagcggcagagguaaguugggaagaagaagcagagcacaguggggcaagucauaauauucuaguagagguacaagaugacggaacaaugaaaauuaaggaugaagaaagagaugauacuuuaacuauuuuacuaaaggccacuuugcuagcgguaagcggaguuuacccccuuaguauucccgcuacgcucuuuguaugguauuuuuggcagaagaagaaacaacgaagcggggugcucugggauacaccuuccccaccugaaguaggucgagcaguacucgaugacggcaucuaucgaauaaugcagcgaggccuauuaggucguucucagguuggcgucgggguauuccaggaaaacguauuucauacaauguggcauguuacccgcggagcaguucuaauguaccagggcaaacguuuagaaccuaguugggcaagcguaaagaaagauuugauuucauacggagguggauggcgcuugcaagguucauggaauacaggugaagaaguacaaguuaucgcgguugaaccuggcaaaaaccccaaaaacgugcaaacagcaccaggaacauucaagacacccgaaggagagguaggcgcaauugccuuagacuucaaacccggaacaagugggagucccaucguaaauagggaaggaaagauaguugguuuauacggaaauggcguaguuacuacgucaggaacuuauguuucagcaauagcacaagcaaaggcaagccaagaaggaccucuuccagaaauugaggaugaaguauucagaaaaagaaaucucaccauaauggaucugcaucccggaucagggaaaacgcgcagauacuuaccggccauuguaagggaagccauuaaaaggaaauuacguacucuaauucuagcaccuacaagaguagucgcaucagaaauggcugaggcuuugaaaggcaugccaauacgcuaucagacaaccgcuguuaagucugaacauacugggaaagaaauagucgaccucaugugucacgccaccuucacuaugagguuacuaucuccaguaaggguaccaaacuauaauaugauaaucauggaugaagcucauuuuacggaucccaguuccauugccgcaagaggcuauauaagcacuaggguagguaugggcgaagccgcugcaauuuuuaugacggcuacaccucccgggucugucgaggcuuuuccccagucaaacgcaguaauacaggaugaagaacgagauaucccugaacgaucguggaacucuggcuaugaauggauaacugauuucccgggcaagacaguuugguuugugccaagcauaaaaaguggaaaugauauagcaaauuguuuaaggaaaaauggaaaaagaguuauacaauugucccggaaaacguuugacacugaauaucagaaaaccaaaaauaacgauugggacuacgucguuacaacugacaucuccgaaaugggagcaaacuuucgagcagauagaguaauagacccuagacguugcuuaaaaccggucaucuuaaaagauggaccugaacggguuauucuagcaggaccuaugccaguuacaguagcaucggcugcgcaaagacguggaaggauuggcaggaaucauaauaaagaaggugaucaauauauauauaugggccaaccauuaaacaaugaugaggaucacgcccauuggacagaagcaaaaaugcuauuagacaauaucaauacgccugagggaauaauuccugcucuauuugagccagagcgcgaaaaaucugcggcuaucgauggcgaauacagauuacguggggaagcgcguaaaacuuucguggagcuaaugcgaagaggagauuuaccaguuuggcugucauacaaaguagccuccgaagguuuucaauauagcgacagaaggugguguuuugauggugaaagaaauaaccaaguacuggaggagaauauggauguggaaauauggaccaaagagggagaaagaaagaaauuacguccacgcuggcuagaugcaaggacauauagugauccuuuagcgcucagagaguucaaagaauuugcagcaggccgccguaguguaagcggugauuuaauacucgaaauuggcaaauuaccccaacacuuaacucaacgagcacaaaaugcuuuagauaaccuagugauguuacauaauagugaacagggcggcagagcguaccgacaugcuauggaagaacuucccgacacaauagaaaccuuaaugcuacuugcgcuuauagcugugcuaacuggcggagucacacuauucuuuuuaaguggacguggauugggaaaaaccucaauaggguuguugugcgucauggccucuaguguccuucuauggauggcgucuguagaaccacauuggaucgcagcaaguauaauuuuagaauuuuuccugaugguacuacucauaccggaaccagauagacaacgcacaccacaagauaaucagcuagccuauguaguaauuggacuacuauucaugauuuuaacaguugcggccaaugaaaugggccugcucgaaaccacgaagaaagaccucggcauaggacacgucgcagucgagaaucaucaucaugcagcaaugcuugacguagaccugcacccugcaagugcuuggacacucuaugcaguagccacaacuauaaucacaccaaugaugagacauacaauagagaauacuacugcaaauaucucgcuaacggcgaucgcaaaucaggcagccauauuaaugggauuagauaagggcuggccgauaagcaaaauggacauaggggucccuuuauuagcgcuaggauguuacucgcaagucaauccuuugacauugacagcagccguauuaaugcuaguagcacacuacgcaaucauaggaccaggauugcaagcaaaagcgacucgagaggcgcaaaaacgcacagcugcaggaauuaugaagaauccaacggucgauggaauaguagcaauugacuuggacccaguaguuuacgacgcuaaauucgagaaacaauuaggacaaauaaugcugcuuauucuauguacaucucaaauacucuugaugcgcacaacuugggcucugugugaaagcauaaccuuagcgacaggaccuuugacaacuuuaugggaaggaucacccggaaaauuuuggaauacaacuauugcaguaagcauggcgaauaucuucagggguaguuaccuagcuggagccggacuugcauuuaguuugaugaaaucccuaggcggugggagaagagggacaggugcgcaaggugagacauuaggugaaaaguggaaacgacaacuuaaucaacuaagcaaaucagaguucaauacauacaagcguucagguauuauggaagucgauaggagugaagcaaaagaggggcuuaaacggggagagacuaccaaacacgcugugucuagaggaacagccaaauuacgaugguuuguagagagaaauuugguuaaacccgaagguaaaguuauugaccuaggaugcggaaggggugguuggagcuacuauugcgcuggauuaaagaaaguuacagaagugaaaggauacacuaaaggagggccuggacacgaagaaccaaucccaauggcaacauauggauggaaccuuguaaaacugcacagugggaaagacguauucuucauuccaccggaaaagugugauacccuacuuugugacaucggggaaucaucgcccaacccaacaauugaagaagggcguacgcuuagaguauugaaaaugguugaaccgugguuaagggguaaccaauuuuguauuaagauacuaaauccuuacaugccuagcguuguggaaacccuagaacaaaugcagagaaaacauggugggauguuaguaagaaauccguugagccgaaauucuacacaugagauguacugggugaguuguggaacuggaaauauaguaagugcaguaaacaugacaucaagaaugcuucuuaacagguuuacgauggcucaucgaaagccaacguaugaaagggacguugacuuaggugcugggacacggcaugucgcaguugagccagaaguagcuaaucuugacauuauaggucagcguaucgaaaauauaaaacacgaacacaagaguacauggcauuaugaugaggauaacccuuacaagacuugggcauaccacgggucuuaugaagugaaaccaucaggauccgcaaguucaauggucaauggagugguaaaauuauuaacgaagccaugggacguuauaccaaugguaacacaaauagccaugacugauacgacaccuuucggacaacagcgugucuucaaagagaaaguagauacgagaacuccuaaagcaaaacgaggaacagcccaaauaauggaaguaacggcgaaaugguuaugggguuucuuaagcaggaauaagaaaccuagaauaugcacucgugaagaguucacgcguaagguacgaaguaaugcagccauaggagcaguuuucgucgacgagaaucaauggaauagugccaaagaggcaguagaagacgaaagauuuugggacuuaguacaucgagaaagagaacuccacaagcaagggaaaugugcaacuugcguauacaauaugaugggaaagagggagaagaaguuaggugaguuuggaaaggcgaaaggcucucgagcgauaugguauauguggcuaggugcacgcuuccuugaguucgaggcauugggguucaugaacgaagaucauugguuuucacgugagaacagucuuucaggagucgagggagaagggcuacauaaauugggauacauccuuagagacauaagcaauauaccagggggaaacauguaugcagaugauacagcgggcugggauacgcgaauuacagaagacgaccuucagaaugaagcacgaauaacggacauuauggaacccgaacaugcacuccuagcuaaaagcaucuuuaaacuuacuuaccaaaacaagguaguuaggguacaacgucccacuaaaaauggaaccguaauggaugucauaagcagacgugaucaaagaggcuccggccaaguugggacauacggacucaauacuuuuacgaauauggaggcacaacugaucagacagauggaaucagaaggaauuuucuccccaagugaacuagaaacaccuaaccuugcagaaaggguuuuagacuggcuugagaaauauggaguagagagauugaaacgcauggccauauccggcgacgacuguguggucaagcccguugaugaucguuuugcuacagcucucacagcuuugaaugacauggguaaaguaaggaaagacauaccgcagugggagcccucuaaaggguggaaugauuggcagcaaguaccguuuuguucacaccacuuucaccagcucauuaugaaagacggaagagaaauugucguaccauguagaaaucaagaugaauuagugggccgcgcgaggguaagccaaggugccggguggagucuacgugagacugcguguuuaggaaaaucuuacgcucaaauguggcaacuaauguacuuucaucgccgagauuugaggcuggcugcgaacgcaauauguucggcaguacccguagauuggauccccaccagcagaacuacguggagcauacacgcccaccaucaauggaugacaacagaagauaugcucagcguauggaaucgaguauggauugaagaaaauccauggauggaggauaagacacacauaagcaguuggggagacguaccuuaucuaggcaaaagagaagaucaguggugugggucacucauagguuuaacggcacgcgcaaccugggcaacgaacauccagguugccauaaaccaaguuagaagguuaauaggcaaugaaaacuaucuugacuauaugaccaguaugaaaagauuuaagaacgaaagugauccagaaggugcccuaugguaa

SEQ ID NO: 21930 - RNA, 9879 nt, Artificial Sequence
  derived and/or modified CDS sequence (opt6) from DENV-1__EU482486__SS-prME
ucuguaacuaugcuucuuaugcugaugccaacugcuuuagcuuuccauuuaacuacgagaggaggagaaccccauaugaucguuucaaaacaagaaagaggaaaaucgcuacucuuuaaaacuucagcaggaguuaauaugugcacacucauagcaauggacuuaggagaauuaugugaagauaccaugacauauaaauguccgagaauaacagaaguagaaccagacgacguagacugcugguguaacaccaccgauacuuggguaaccuauggaacuuguucucaaacaggugaacaucgaagagauaaacgaaguguugcacuagcgccacaugugggauuaggucuagagacgcgugcugaaacuuggaugucaucugagggagcauggaaacagauucaaaaaguugagacuugggcacuaaggcacccuggauuuacaguaauagcauuauucuuagcacacgcaaucgguacuagcauuacucaaaaagguauaaucuucauacucuugauguugguuacacccucaauggccaugcgauguguuggcauaggaaguagggauuucguggaaggccuaaguggagcuacaugggucgaugucguauuggaacacgguucuugcguaacgacuauggccaaagauaaaccuacacuggauaucgaacugcuuaaaaccgaaguaacaaauccugcaguucuaagaaaauuguguauagaagcaaaaaucucgaacacaacaaccgauaguaggugcccaacccaaggggaggcaacacugguugaggaacaagaugcgaauuuuguuuguagacggacuuuuguagauagagggugggggaacggcugugguuuauuuggaaaagguucuuuaauuacaugcgcgaaauuuaaaugcguuacaaaacuggaaggcaaaauagugcaauaugagaaucucaaauacucugucauuguuacgguccauaccggggaucaacaucaaguaggaaaugagagcacagaacacgggaccacugcaacaaucacaccgcaggccccaacaucugaaauacaauugacugauuauggcgcacuuacacuggacuguucuccgcgaacagggcuagauuuuaacgaaaugguacuucucacaaugaaagagaaaucuuggcugguacacaaacaaugguuuuuagacuugccucuuccauggacuagcggggcaucuacaucacaggaaacguggaauagacaagaccugcucguaacauuuaagacugcucaugcgaagaaacaagagguuguuguauuagggucacaagagggugccaugcacacugcuuuaacaggugcuacagagauucaaacauccggaacuacaaccauuuucgcaggucaccuuaaauguagauugaaaauggauaaacuaacacucaaggguaugucauauguuaugugcacuggacuuuuuaaauuggagaaagagguggcagagacccagcaugguaccguucuaguacaaaucaaauaugaggguacugaugcccccuguaaaaucccauuuucaacucaagacgaaaagggcguaacccaaaauggaagauuaauaaccgcaaacccaauaguaacagauaaggaaaaaccuguaaauauagaagccgaaccaccuuuuggugaauccuacaucguaauaggggcuggagaaaaagcucuaaaacugaguugguucaagaaggguaguagcauuggaaagauguucgaagcuaccgcuagaggagcgaggagaauggcuauacuaggagauaccgcuugggauuucggcuccauaggaggcguuuucacgucaguggguaaauuaguucaucagauauucgguaccgcauaugguguccuauuuaguggaguaucauggacaaugaagauagguauaggugugcuguuaacauggcucggccuaaauucaagaaguacaucauuaucaaugacauguauagcaguaggcuuagugacucuuuacuugggagucaugguacaagcagauuccggaugugucauaaacuggaaaggacgagaacuaaagugcggguccggaauuuuugugaccaacgagguacacacuuggacagagcaauauaaauuucaagcugacucaccgaagcgauugagcgcugccauugggaaggcuugggaagaaggaguuugcggcauccggucagccacgagauuagaaaauauaauguggagacagauauccaaugagcuuaaccauauacuccuugaaaaugacaugaaauuuaccguugugguuggugauguaguggggauacuggcgcaggggaagaaaaugaucagaccacagccuauggaacauaaguauucauggaaaaguuggggaaaggcaaaaauaauaggugcugauguucaaaauaccacuuuuauaauagaugguccaaacacuccggaauguccagacgaucaaagggcauggaauauaugggagguugaagacuauggauucgguaucuuuacgacaaauauauggcuaaaauugcgggacucuuauacucaaguaugugaccacagacugaugagcgcggcuauaaaagacucgaaagcgguccaugccgacauggguuauuggauagaaagugagaaaaaugaaaccuggaaguuggccagagcuucauucaucgagguuaaaacaugcauuuggccaaaaagucauacacuuuggucaaacggcguacucgaaucagagaugaucauaccuaaaaucuacggaggaccaaucucacaacacaacuauagaccuggauauuucacacagacagcagguccuuggcaccuaggaaaacuugaacuagauuucgaucucugcgagggcacaacuguaguagucgaugagcauugcggaaauagggguccgucuuuacgaaccacgacuguaacugguaagaucauacaugagugguguugcaggaguugcacucuacccccacuaagauuuaaaggugaggauggcugcugguaugguauggaaauuagaccuguuaaagaaaaggaagaaaaucuagugaagaguaugguaucugcaggguccggagagguagacagcuuuucacuaggacuguuauguauuucaaucaugauugaagaaguaaugcgauccagauggagucggaaaaugcucaugaccggcacuuuagcuguauuuuuccuauuaauuauggggcaauuaacauggaacgacuugaucagauccugcauuaugguaggagcaaaugccagugauagaaugggcauggguacuacuuauuuagcuuugauggcaaccuuuaagaugagaccaauguucgcgguaggacuacucuuccguagacuaacaucgcgcgaaguauuguuguugacuauuggacucagccugguggcaucaguagaacucccgaacagucuggaagaacucggugaugggcucgcuaugggaauaaugauucuaaaacuauuaaccgauuuucaauccuaucaacugugggcaaccuuauuaucauuaacuuucauaaaaacaacauucucccuucauuaugccuggaaaacaauggcuaugguccuaagcauaguuaguuuauuaccucugugucucagcaccacuagccagaaaacuacauggcuaccgguccuguuaggaucgcuuggaugcaaaccucuuacaauguuccuaauagcugaaaauaaaauauggggacguaagagcuggccgcugaaugaagguauaauggcuguggggauuguaagcaucuuacucaguucauuacuuaaaaacgauguaccucuagcuggucccuugaucgcuggcggcaugcuaauugcaugcuaugugaucucgggcaguucggcagaccucucguuagagaaagcagcagaagucucuugggaagaggaagcggaacacaguggagcuucucauaacauucuuguugaagugcaggaugacggaaccaugaagaucaaagacgaagaacgcgaugauacuuuaacaauucugcucaaagcaacacuacuagcagugagcggaguuuauccccuaucaauaccugcgaccuuauuuguaugguauuuuuggcagaagaagaaacaacgaucagguguacuuugggacacaccuaguccgccagagguugaacgugcagugcuugaugauggaauauauagaauuaugcaaagaggccuucuuggaagaucucaggugggaguagggguuuuccaagaaaacguauuucauacuauguggcauguaacacgcggggcaguucugauguaucaggggaagcgacuggaacccaguugggcaagcgucaagaaagaccucauuucauauggaggaggcuggcguuuacaagguagcuggaauacaggagaggaaguacagguaauagccguggaaccuggcaaaaauccaaagaacguucaaaccgccccugggacauucaaaacgcccgaaggggaagucggagcuauagcucuagacuuuaaaccaggaacaucgggaucaccgauuguaaauagagaaggaaaaauuguuggucuauauggaaacggagugguaacaacuucagggaccuauguauccgccauagcucaggcaaaggcaucgcaagaggggccacuaccagaaauagaggacgaaguauuccggaagcgaaaucuaaccauaauggaucuacacccggguucggguaaaacacgacgauacuuaccagccauagugagggaagcaaucaagagaaaacuaaggacacucauccuugcaccuacuagaguagucgcaagcgaaauggcugaggcuuuaaaaggaaugccaauacgguaucaaacgacugcagucaaaucagaacauacaggacgggagauuguagaucugaugugccacgcgaccuuuaccaugcgccuucuaucaccgguaaggguaccaaacuacaacaugaucauaauggaugaagcacauuucacggauccgucuaguauugcugcgcguggauacauauccacgcgugucggcaugggugaggcagcagccauuuuuaugacagcgacuccaccuggaucuguagaggcuuuuccccaaaguaaugcaguaauccaagacgaggaaagggacauaccggagcguucauggaauagcgguuaugaauggauaacugauuuuccuggaaaaacagucugguucguaccaaguaucaaaucggguaacgauauugcuaauugucuucguaaaaaugguaaacgcguaauucaacuaagucggaaaacuuuugauacggaguaccagaaaacuaaaaacaaugacugggauuauguuguuacaacugauauuagugaaaugggcgcuaauuuucgagcagacagagugauagaucccagacgaugccuaaaaccaguuauuuuaaaagaugguccagaaagaguuauucuagcuggacccaugccuguaacaguagccucugcggcucaacguagaggacgaauaggaagaaaucacaauaaggaaggugaccaauauauauauaugggccaaccccugaauaacgacgaagaccacgcacauuggacagaagcgaagauguuacuugauaauauuaacacaccugaaggaauuauuccggccuuauucgagccugaaagagaaaagucggcggcaauagacggcgaauaucgacugagaggugaagcuagaaaaacuuuuguagaacuaaugcgacguggggauuuaccgguuugguuaaguuauaaaguagcaagugaaggauuucaguauucagauaggagaugguguuuugauggagaaagaaauaaccaggugcuugaagagaacauggauguggagauuuggacaaaagaaggagaaaggaagaaauugagaccaagaugguuagaugcuagaacauauagcgauccccucgcacugagagaguucaaagaauuugcugcgggccguagaucaguuucaggcgauuugauucucgaaauuggaaaguuaccacagcaucugacacaaagagcucagaacgccuuagauaauuuaguuaugcuacauaauagcgagcaaggggguagggccuauagacacgcaauggaagaacuuccagauaccauagagaccuuaaugcuauuagcccugaucgcugucuugacagguggugucacccuauucuuuuuaagcggucgcgguuuagggaagacaaguauagguuuacuauguguaauggcaaguucugcuuuacuguggauggcaucgguagaaccucacuggauagcagccucuauaauauuggaauuuuuccuaaugguuuuauugauuccggaaccugauagacagcgaacuccccaagauaaucaauuagccuauguaguuauaggauuacuauucaugauauugacaguagccgcuaacgaaaugggauuguuagaaacuacuaaaaaggacuugggaauaggccauguagcugucgagaaucaccaccaugcgacaaugcuagauguagauuugcaucccgcuucagcauggacauuauaugcgguugcaacaacaaucauuacuccgaugaugcgucacacaauagaaaauaccacagcgaauaucagcuugacagcaauugcuaaucaagcugcgauuuuaauggguuuagauaaaggauggccuauuaguaagauggauaucgguguuccgcuauuggcccucggauguuauagucaggugaauccccuaacauuaacugcagcaguacugauguuaguagcacacuaugcuaucauaggaccuggcuugcaagcgaaagccacaagggaggcucaaaaacguacagcugccgguauuaugaagaaucccacaguggaugguaucguagcaauugacuuagauccaguuguauaugacgcaaaguucgaaaagcaacucggucaaauaaugcuccugaucuuguguacaagucaaauuuugcuaaugcguaccacuugggcguuaugugaaucaauuacuuuagccacuggucccuuaaccacauugugggaggguucaccgggcaaauuuuggaacacuacaauugcugucaguauggcaaauauauuuagaggcucauaccuagcaggcgcuggguuggcuuucagucuaaugaaaucuuuaggaggaggcagaagaggaacgggagcacaaggugaaacccucggugagaaauggaagagacaacuuaaucagcuuucaaagagugaguuuaauacauacaaaagaaguggcauaauggaggucgacagaucugaagcaaaagagggauuaagacguggagagacaacgaagcaugcaguaucccgcggcacugccaaacuacguugguuuguagagcguaauuuagucaaacccgaaggaaagguaauagaccuuggauguggacgaggcggcuggucuuacuauugugcaggguuaaagaagguaacggaaguaaaaggauauacaaaaggugggccuggucaugaagaacccaucccgauggcuacuuauggauggaacuugguaaaacuacacucagguaaagacgucuuuuucauaccaccagaaaaaugugauacgcuccugugugacauuggugaauccaguccaaaccccacaauugaagaaggaagaacuuuacgaguacuuaaaaugguugaaccauggcucagagguaaucaguuuuguaucaaaauucuaaaucccuacaugccauccguaguggagacauuagaacaaaugcaaagaaaacauggcggaauguuaguaagaaacccucuuuccagaaauucaacucacgaaauguauuggguaaguugugguacugguaauauaguaucagcugucaacaugaccagccgaaugcuauuaaacagauuuacaauggcccacagaaaaccaacauaugagcgagauguggaucugggcgcggggacaagacauguagcuguagaaccagaaguagcuaacuuggauaucauaggacaacguauugaaaacauaaagcaugagcauaaaagcacauggcauuaugacgaagacaauccguacaaaacgugggcauaccacggaucauacgaaguaaaaccgagcggcagugcgucaucaaugguaaacggaguuguuaaacuguuaacgaaaccaugggacguaaucccgauggugacucaaauugcuaugacagauacaacgccauuuggacaacaaagagucuuuaaggaaaaaguagauacccgaacaccaaaagccaaacguggaacagcacagauaauggaaguaacugcgagguggcuguggggguuucuuucucgaaauaagaaaccgagaauuuguaccagggaagaguucaccagaaaaguuagaucaaacgccgcuauuggcgccguguucguagacgagaaucaguggaacucggcuaaagaggcuguugaagaugaaagauuuugggaccuugugcauagagaacgcgaauugcauaaacaaggcaaaugugcgacuuguguauauaauaugauggguaaacgagagaagaaauuaggggaauuugguaaagcaaaagguaguagagcuauuugguacauguggcucggggcuagauuucuagaguucgaagcacuuggcuuuaugaaugaagaccauugguucucccgagaaaauucacugaguggcguggaaggagaggguuugcauaaacuuggguacauucuucgugauaucucaaaaauaccaggagguaauauguaugccgacgauacagcaggaugggacacaagaaucacagaagaugaucuacaaaacgaggcaaaaauaacugacauaauggagccugagcacgcucugcuugcgacaaguaucuuuaaacuaacauaucaaaauaagguuguaagaguccagagaccagcgcggaauggcacugugauggacguaaucucccggcgugaucagagaggcucgggccaaguugguacauauggccuaaauaccuucacaaauauggaagcgcaauuaauuagacaaauggaaagcgaaggaauauucagcccaucagaacuagagacgccuaaucuugcagaaaggguacuugauuggcuagaaaagcauggaguagaaagacuaaaacgaauggccauaucaggugaugacugcguagucaagccaauagacgauagauucgccacggcacuuucggcacucaaugacaugggaaaagugcgaaaagacauuccgcaaugggagccaaguaaagguuggaaugauuggcaacagguccccuuuuguagucaccacuuccaccaacugauaaugaaagaugguagagaaauugucguccccuguaggaaucaagaugagcuuguuggcagggcuaggguuagucaaggagccgguuggagucuacgagagacugcaugucuugguaaaucguacgcucaaauguggcaacuuauguacuuccaucgacgcgaucuucguuuagcugcgaacgccauuugcagcgcgguaccgguagauugggucccaacaucuaggacuacauggucaauccaugcucaccaccaguggaugacaacagaagacauguuaaguguauggaaccgcguauggauagaagaaaauccguggauggaagacaaaacccauauaucuucauggggugauguuccguauuugggaaaacgagaagaucagugguguggaucauugaucggauuaacugcuagagcuacgugggcaaccaacauccaaguagcuauuaaccaagugcguagacugauaggaaacgaaaauuauuuagauuauaugacaaguaugaagcgauuuaagaaugacuccgaccccgaaggugcauugugguag

SEQ ID NO: 21931 - RNA, 9879 nt, Artificial Sequence
  derived and/or modified CDS sequence (opt6) from DENV-1__EU482487__SS-prME
ucagugacaaugcuacugauguuaaugccgacagcuuuagcguuccaucuuacaacaaggggaggcgaaccccacaugaucguaagcaaacaagaacgcgguaaaucccuccuuuuuaaaacgagcgcgggaguuaauaugugcacacugauugcaauggaucugggggaacuaugugaagacacgaugacauauaaauguccgcgaauaacggaaacugagccagaugauguagauugcugguguaaugcaacagauacuugggugacauauggaacuugcagucaaacuggggaacauagacgggacaaacgcaguguggcauuagccccucauguagguuugggucuugaaacgagaacagaaacuuggaugagcagcgaaggagcauggaaacaaauucaaagagucgaaacuugggcacuucggcacccaggauuuacagugauagcacucuuccuagcacaugcaauagggacuucaauaacucaaaaagguauaauuuucaucuuacucaugcuagucacuccuucaauggccaugcggugcguuggaaucggcucuagagauuuuguugaagguuuauccggcgcgaccuggguagaugugguacuagagcaugguuccuguguaacaaccauggcaaaagacaagccuacacuagacauagaauuacuaaagacugaaguaacaaauccagcaguacuacgaaaacugugcauagaagccaaaauaucaaauacaacaaccgauagccgauguccaacccagggugaagccacacuuguggaagaacaagacgccaacuucguuugccguagaaccuuuguugaucgggguuggggcaacggcuguggguuauuuggcaaaggauccuuaaucaccugugcaaaauuuaaauguguuacaaagcuggaagguaaaauaguucaguaugaaaauuuaaaauauucgguaauagugaccgugcauaccggagaccaacaccaaguagggaacgagucuaccgaacacggcacaacugcaaccauuacaccccaagcuccaacaacagaaauucaguuaaccgauuauggagcccuaacuuuggauuguagcccacggacaggguuagauuucaaugaaaugguuuuacuaacaaugaaagagaaaaguuggcucgugcauaaacaaugguuucuagaucuaccacuaccauggacaaguggagccagcacaagccaagagacguggaaucggcaagauuugcucgugacauuuaaaacagcacaugcgaagaaacaggaagucguagugcuagguucacaggagggagcuaugcacacggcccucaccggcgcuacagagauucaaaccucuggaacaacaacaauauuugcuggacaucuaaaaugcagacugaaaauggacaaacugacacuaaagggcaugucauauguuaugugcacggguagcuucaaacuugaaaaagagguagcugaaacccaacauggaacagugcuuguccaaauaaaauaugaaggaacagaugcuccauguaaaauaccuuucucaacacaagaugaaaaaggaguaacacagaacgggagauugauuaccgcaaaucccauuguaacggacaaagagaaaccgguaaacauagaggcagaaccuccauuuggugaaagcuauauuauaaucggcgccggcgagaaagcacuuaaacuuuccugguucaagaaaggaaguucuauaggcaaaauguucgaggcuacugcucggggugcacgcagaauggcuauacuaggagauacagcuugggacuuuggaaguauuggcgguguauuuaccagcguagguaaguugguucaccaaauauuugguacagcguacgggguuuuguuuaguggugucagcuggacuaugaagauaggaauaggaguauuacuuacaugguuaggacuaaauucacgcaguacgagucuaaguaugacgugcauugcaguaggauuaguuacauuguauuuaggaguaauggugcaagcagacuccggcuguguaauaaacuggaaaggaagggaguuaaaaugcggaucaggaauauucguuacuaacgaaguacauacguggacugagcaauauaaguuucaagcugauuccccaaaacgccucagcgcugcuauaggaaaagcaugggaagaaggaguguguggaauaaggagcgccaccagauuagaaaacauaauguggaagcaaauaucgaaugaauuaaaccacauacuauuagaaaaugauaugaaauuuaccgucguuguaggcgaugucgcagguauauuggcgcaagguaagaaaaugauaagaccccaaccaauggaauacaaguauucauggaaaucauggggaaaggcaaaaauaaucggugcugauguccagaauaccacauuuauuauagaugguccuaacaccccugaaugcccagacgaucaaagagcguggaauaucugggagguagaggauuacgguuucggcaucuuuaccacaaacauuuggcugaaacuaagagauagucauacgcaaguaugugaucauagauuaaugucugccgcuaucaaagauaguaaggccguacacgcugacauggguuauuggauugaaucagccaaaaaugaaacuuggaaguuagcucgagcuucuuucaucgaagugaaaaccuguauauggcccaagucacauacccuauggucgaacgguguacuagagucagagaugauuauuccuaaaauauacgguggaccuauuucucaacacaauuacagacccggauacuucacccaaacugcugggccuuggcaucuaggaaaguuggaauuagauuuugaucuaugcgaaggaacaacuguaguagucgaugaacacugcgguaaccgagguccuucacuacggacaaccaccguaacuggaaaaauaauucaugagugguguugccguaguugcacgcuaccaccuuuaagauucagaggcgaggacggcugcugguauggcauggaaauaagaccugucaaagaaaaagaagagaauuuagugaaaucuauggugagugccggaaguggagaaguagauucauuuucucuaggcuugcugugcauaucaauuaugauagaagaaguuaugcgcucuagauggagccguaagauguugaugacaggaacauuagcgguuuucuuccuguuaauaaugggucaauuaacuuggaaugauuuaauucggcuauguauaaugguaggagccaaugccucagauaggaugggaauggguacaacauauuuggcacuaauggcuacauucaagaugagacccauguuugcaguuggauuacuauuucgaagauuaacuucccgugaaguacuacuguugacaaucgggcuuucucugguggcuucgguagaacuacccaacagucucgaagaauuaggagauggucuggcaauggggauuaugauucuuaaauuauuaacagauuuucagucacaucaauuaugggcaacauuguuaagucucacauucauuaaaacuacauuuucucuucauuaugcauggaaaacaauggcuaugguacuaucuauaguuucauuauucccauugugcuugaguaccacaagucagaaaacgacuuggcucccuguacuccuagggucgcucggaugcaaaccuuuaacaauguuuuugaucgcugaaaacaagaucuggggucguagaagcuggccacuuaacgagggaauaauggcuguagguauagucagcauacuacuuucaaguuuacucaaaaaugauguuccucuagccgguccucugauugcaggaggaaugcugauagcauguuauguaauaaguggauccagugcggacuugucacuagagaaagcagcagaaguauccugggaagaagaagcagaacacucgggagcuucacauaauauauuagucgagguacaagaugacggcacaaugaagauaaaggaugaagaaagagacgauacuuuaacgauacuccuaaaagcgacacugcuagcuguuucgggaguuuacccucugucaauaccugcaacucuuuucgucugguacuuuuggcagaagaagaaacaaagaaguggaguacuaugggauacaccuucuccaccggaaguagaacgcgccguucucgaugaugguauuuaucguauaaugcaacgaggcuuacuaggaagaagccaaguuggaguagguguauuucaagagaacguuuuucacacuauguggcauguuacaagaggugcaguguugauguaccaagguaagagguuggaacccucaugggcuuccguuaagaaagauuugauauccuauggagggggauggagauugcaaggaucauggaacacaggagaggaaguacaggucauugcaguagaaccaggcaaaaacccgaaaaacguacaaacggcgccgggaacauucaagacuccggaaggagaagucggagcaauugcucucgacuucaaaccuggcaccucuggaucaccuauaguaaauagagaagguaagauaguagguuuauauggaaauggaguagugacuacgagugguacauacguaucagcaauagcccaggcgaaagcaagucaggagggaccauuaccugaaauugaagaugaagucuuuagaaaacgcaaucugacaauaauggaucuccacccugguucaggaaaaacccgacgguauuuaccagcgaucgucagagaggcgauuaagagaaaguugcgaacucuuauauuagcaccaacacguguuguugccagugaaauggcugaagcguuaaaaggcaugccuauacguuaucaaacuacugcaguaaaaucagaacacaccggcaaagaaauaguugacuuaaugugucaugcaacauuuacaaugaggcuauuaucgccaguacgcgucccaaauuauaacaugauuauuauggaugaagcacacuucacagauccauccucgauugcggcacgcgguuauauaucuacaagggucggaaugggagaggcugcggccauauuuaugacugcaacuccaccuggguccguagaagcguuuccccaaaguaacgcuguaauacaggaugaagagagagauaucccagaaaggucauggaacuccgguuacgaauggaucacugacuuuccuggaaaaacaguaugguuuguaccaucaauuaaauccggaaaugacauugcuaauugucucaggaaaaaugguaaacgaguaauacaacucagcaggaaaacauuugauacagaauaucagaaaacuaagaacaaugacugggauuauguaguuaccacggacaucucagaaaugggggccaauuuuagagcagauaggguuauugauccccgcagaugucucaagccaguaauccuaaaggauggaccugaaagagugauucuugcugguccaaugccaguuacaguagccagcgcagcucaaagaagaggaagaauuggaagaaaccacaauaaagaaggagaccaguacauauacaugggacaacccuuaaauaacgaugaagaccaugcgcauuggaccgaagcaaaaaugcuguuagauaauaucaauacccccgaagguauuaucccggcuuuauuugaaccagaaagggaaaagucagcagcgauugauggagaauacaggcuucguggagaagcccgaaaaacauuuguugaacugaugcggagaggugaccugccaguauggcugucuuacaaagucgccucagaaggauuccaauauucagaucguaggugguguuuugacggugagagaaauaaccaaguucuagaagaaaauauggauguagaaauauggacgaaagaaggagaaagaaagaaacuucgcccccgauggcucgaugcacgaacauacucugaucccuuagcccuaagggaauuuaaagaauuugcggcaggaagaagaucaguauccggggaccuaauacuugaaauuggcaaauuaccacaacaccuaacccaacgugcacaaaaugcuuuagauaauuugguuaugcuucauaauucagagcagggugguagagcuuaccggcaugcaauggaagaacuaccagacacaauagaaacucuuaugcuucuagcacuaaucgcggucuuaacagguggaguuacguuauucuuuuugucgggcaggggauuaggaaagacgucuauaggauuacugugcgucauggcaaguuccguccuguuguggauggcauccguugaaccgcacuggauugcugccucaauuauacuugaguucuuucuuaugguacuccucauuccagaaccugaccgucaacgaacuccgcaagacaaccaacuagcuuacguaguaaucggauuacuauuuaugauacuaacaguagcagcaaaugaaaugggacuccuagaaacaacuaagaaagaccucggaaucggucacgccgcgguagaaaaccaucaccacgcagcuaugcuugaugucgaucuccacccugcaagugcuuggacauuauaugcaguagccacuacgauaauaacuccgaugaugagacauacaauagaaaacaccacugcuaacauuucacuaaccgcaauugcaaaccaagcagcuauucucaugggauuagacaaagguuggccgauuaguaaaauggacaucggugucccgcugcucgcuuuagggugcuacucccagguaaauccacuaacuuuaacagcagcaguacuuauguuaguagcacacuaugccaucauuggaccaggcuugcaagcuaaagcuacacgagaagcgcagaaaagaacugcagcugggaucaugaaaaauccuacggucgauggcauaguagcaauagaccuugauccggucgucuacgaugccaaguuugaaaaacaauuaggacaaaucauguuauuaaucuuguguacaagucaaauucuacucaugcgaaccacaugggcacugugugaaaguauaacgcuugcaacugguccguugacgacacuaugggaaggaucaccaggaaaguuuuggaacacaacaauugcaguaaguauggcaaacauuuuucgagggucguaccuugcaggggcaggucuugccuucucuuuaaugaagagucuaggaggugguagacgagguacuggagcucagggugaaacccuaggggaaaaguggaagaggcaauugaaucaauugagcaaaagcgaauuuaacacuuacaaacgguccggcauaauggaaguagaucgaagugaagcuaaagagggguuaaagagaggagaaacaacaaaacaugcuguaagcagggguacagccaaguuaagaugguucguugaaagaaacuuaguaaaaccagaagguaagguuaucgaccuaggcugcggcaggggcggguggagcuauuauugcgcaggacuaaagaagguuaccgagguaaaaggauauaccaaaggugggccaggacaugaggagccuauucccauggcaaccuauggguggaaccuaguuaaacuucauucaggcaaagaugucuucuuuauaccaccagagaaaugugauacuuugcuuugcgacaucggugagagcucgcccaauccuacuauagaagaaggacgcacguuaaggguucugaaaaugguagagccguggcucagaggcaaccaauuuugcauaaaaauccuaaauccauacaugcccagugugguagaaacuuuggaacagaugcaacguaagcacggaggcauguuaguaagaaauccauugucuaggaauagcacucacgaaauguauugggucagcugcgguaccggcaauauaguaagcgcaguuaauaugacgagucgaaugcuucuaaaccgcuucacuauggcacaccgaaagccaacuuacgaaagagauguagaucuaggugcagguacucgucaugucgcuguagaaccugaaguagccaauuuagauauaauagggcaacgaaucgagaauaucaagcaugaacauaaaagcaccuggcacuaugacgaagauaauccuuacaaaacgugggcuuaccaugguagcuacgagguaaaaccaucaggcuccgccucgaguaugguaaacgggguuguaaaguuauugacgaagccaugggacgucauaccgauggugacacaaauugccaugacagauacaacaccauucggccaacaacguguuuucaaggaaaaaguugauacuagaacuccuaaagcaaaaaggggcacagcgcaaauuauggaagucacagcuaaauggcuauggggcuuccuaucgagaaauaagaaaccaaggauauguacucgugaggaauuuacccgcaagguucguucuaaugcugcgaucggcgcaguauucguagaugaaaaccaguggaacucugcaaaagaggcagucgaagaugagagauuuugggaucuaguacauagagagagagaacugcauaaacaggguaagugugcaacuugcgucuauaauaugaugggaaaacgcgagaaaaaguuaggcgaauuugguaaagcgaaaggaaguagagccaucugguauaugugguuaggagcuagauuucuagaauuugaagcguuaggauucaugaacgaagaccacugguucucacgagaaaauucucuuucaggugucgaaggagagggacuacacaaauuaggcuauauauuacgagacauaucuaaaauuccuggaggaaauauguaugcugaugauaccgcggggugggauacuagaauaacggaggaugauuuacaaaacgaagcuaggaucacggauaucauggagccagaacaugcguuacucgcuaagaguauuuuuaaauuaacuuaccaaaauaaaguuguaaggguucaaagacccgccaagaaugguacuguaauggaugugauaagccgucgggaucaacguggaucagggcaaguuggaacauauggacucaauaccuuuacuaauauggaagcccaacuuauaagacaaauggagucggaggguauauuuucaccuagugaacuugaaacaccaaaccucgcagaacgcguccuugauugguugaaaaaguauggaguagagcguuuaaagagaauggcuauauccggcgaugauuguguaguaaagccgauugaugauagauuugccacugcgcuuaccgcacugaaugauauggggaaaguuagaaaggacauuccccaaugggagccuucuaagggauggaacgacuggcaacaagugccauuuugcucacaccauuuccaucaacuaauaaugaaagauggaagggagaucguagucccaugcagaaaucaagacgaauuaguugggcgugcuagaguaucacaaggagcaggauggagccuucgcgaaaccgcaugcuuaggaaaaucguaugcccagauguggcaauugauguauuuucaccgacgagaucuccgacuagcugcgaacgcuauauguuccgcugugccagucgacuggauaccaacauccagaacgacauggucuauacaugcacaucaccaauggaugacuaccgaggauaugcucagcguuuggaacagagucuggaucgaggaaaaccccuggauggaagauaaaacccauaucucaucauggggagacguuccauaccucggcaaaagggaagaucaauggugcggaagccugauaggucugacugcuagagcaacaugggcgaccaacauccaaguagcaauuaaucagguccggagauuaauagguaacgaaaacuacuuggauuacaugacaucuaugaagagauuuaaaaacgagggagacccggaaggggcucuaugguga

SEQ ID NO: 21932 - RNA, 9879 nt, Artificial Sequence
  derived and/or modified CDS sequence (opt6) from DENV-1__EU482488__SS-prME
aguguuacuauguuauugaugcuuaugccaacugcgcuagcguuccaucuaacuacacgaggaggggaaccacacaugaucguaucaaaacaagaaagggguaaaucauuauuguucaaaacaucagcuggaguaaauaugugcacuuugauagcaauggauuuaggugaauuaugcgaagacaccaugacauauaaaugcccaaggauaacagaagcggaacccgacgacguggauugcugguguaaugcaacugacacaugggugacauacggaacgugcucacaaacaggagaacacagacgcgauaaacgcucuguagcauuagcaccacacguugguuuggguuuggaaacacgaacagaaaccuggaugucaagcgaaggagccuggaaacaaauucaacguguugaaacaugggcucuacgccauccagguuucacgguaauagcacuauuuuuagcacaugcaauaggaacaucgaucacucaaaaagguauuauauuuauacuuuuaauguuaguaacacccagcauggcuaugagguguguaggaauuggaucgcgcgauuuuguagaaggcuuaucuggugcaacuugggucgacguaguacuagaacacggcaguugugucaccacuauggcgaaagauaaacccacacuagauaucgaauugcugaaaacugagguuacaaaucccgcaguguuacgaaaacuuuguaucgaagcaaaaauaaguaauaccacaacggauucgcguugccccacucaaggggaagcaacuuuaguagaagaacaagacgcuaauuuuguuugcaggcgcacauuugucgacagagguuggggcaacggguguggccuauuuggaaaaggaucccucauuaccugugccaaauucaaauguguuacuaaauuagaaggaaaaauaguacaauaugaaaaucucaaguacuccgucauugucacggugcacacaggagaucaacaucaaguaggcaaugaaucuacagagcauggcacaacagcgacuauaacuccacaagcuccaucaaccgagauucaacucacugacuauggugcacugacgcuagacugcagcccaaggacaggauuagauuuuaaugagaugguacuucuaacuaugaaagagaaaagcuggcuuguccauaaacaaugguuucuagacuuaccuuuaccuuggaccaguggagcaucuaccucccaagaaacuuggaaccgucaagauuuauuagugacauuuaaaaccgcucacgcaaagaaacaggaagucguugugcuagguagucaagaaggcgccaugcauacugcuuugacaggugcaacagagauacagacaaguggaacgacaacgauuuuugcaggacaccugaaguguagguuaaagauggacaaauuaacacuuaaaggaaugucauauguaauguguacugggucuuuuaaacuagaaaaagagguugcagaaacacaacauggaacuguccuggugcaaaucaaauaugaggguaccgaugcaccuugcaagauuccuuucuccacccaagacgaaaaaggagugacacaaaacgggagacuuauaacagcuaauccuauugugaccgacaaagaaaaaccaguaaauauagaagcugagccaccguuuggugagaguuacauugucauaggggcgggagaaaaagcauuaaaacuaucaugguuuaaaaaggggucaucaauugguaaaauguuugaagccacggccagaggugcuaggagaauggcaauauuaggggauacugccugggacuuugguaguauaggaggagucuucacaaguguagguaaguugguucaccaaauuuucgguacggcuuaugguguauuauuuucuggaguauccuggacuaugaaaauaggaaucggaguccucuuaacaugguuaggauuaaacucuaggagcacaagccuaagcaugacauguaucgcuguagggcucguaacccucuacuugggaguuaugguacaggcggauucaggcugugugauaaauuggaaagguagggaacugaaaugcggaagugguauauuuguaacgaacgaaguccacaccuggacagaacaauauaaauuucaagccgauucaccgaaacguuuaucggcggccaucgguaaggcuugggaggaggguguauguggcauucgaucugcuacgagauuagaaaacauaauguggaagcaaaucucaaacgaauugaaucauauuuuacuagaaaaugauaugaaacuaacugucguaguaggcgauguagcaggcauacuagcacaaggcaagaaaaugaucagaccucaaccaauggaguacaaauacuccuggaagucauggggaaaagccaaaauaauuggagcggacguucagaacacaaccuucauuauagaugggccgaauaccccggaauguccagacgaucagagagcuuggaacauaugggagguugaagacuacggcuuuggaauauuuacaacuaauaucuggcuuaaacuccgugauaguuacacccagguaugcgaucaccgcuugaugagugcugcuaucaaagauucuaaagcaguacacgcagauaugggguauuggauagaaucggagaaaaacgagaccuggaagcucgcaagagcauccuucauagaaguaaagaccugcauuuggccaaaaucacauacguuguggagcaacggcguucucgaaagcgagaugauaaucccgaaaauuuacgggggacccauaagucagcauaauuaccggccagguuauuuuacucaaacagcgggacccuggcauuuggguaaacuugaauuagacuuugauuuaugugaaggaacuacaguaguagucgacgaacauugcggaaaccgaggaccaagucuuagaacuacgacaguaaccggaaagauaauccaugaauggugcuguagaucuuguacuuugccuccauugagguuuaaaggcgaggauggcugcugguacgggauggaaauuagaccagucaaagaaaaagaggaaaaccuagugaagucgauggucagcgcgggauccggggagguggauucguuuuccuuaggauuacuauguauuagcauaaugauagaggaagucaugcgaagucgcuggagcaggaaaaugcugaugacagggacuuuagccguauucuuucuuuuaauaaugggucaguuaacauggaaugauuuaauucgcuuauguauaaugguaggagcuaaugccucagaucgcaugggaauggggacaaccuauuuagcccucauggcuaccuuuaaaaugcgaccuauguucgcgguuggauugcuguucagaagacugaccagcagggaaguccugcuacuaacaauaggauuaucuuuaguagcuucuguagaauuaccgaacaguuuagaggaguuaggugauggacuagccaugggaauaaugauccuuaaauuauugaccgacuuucaaucccaucaauuaugggcaacacuacuaucacugacauucaucaggacuacauuuucacuccauuacgcauggaagacgauggcaaugguacuauccaucguaucccucuuuccacuaugccugagcaccacgagccagaaaaccacauggcuacccguacuucuaggcucgcuugguugcaaaccguugaccauguuccuuaucgcugaaaacaagaucugggggcgaaaaagcuggccccuuaaugaaggaauaauggcugucggcaucguaucaauccuauugagcucucuacugaaaaaugaugucccuuuggcaggcccauuaauagcaggcggaaugcuaauagcaugcuauguuauaucaggaucauccgcugaccugucucuagaaaaggccgcagaaguaucaugggaggaagaagccgagcauuccggagcgucucauaauauuuuaguugaaguacaagaugacgguacaaugaagauaaaagaugaggaacgugaugauacacugacaauacuacuuaaagcaacguuacucgcuguguccggcguuuaucccuuaucuaucccagccacacuauucgucugguauuucuggcagaagaagaaacaaagaagcggaguuuuaugggauacuccaaguccaccugaagucgaacgcgcaguauuagaugauggaauuuacagaauuaugcaaaggggacucuuaggccguagucaagucgggguaggcguuuuccaggaaaauguguuccauacaauguggcaugucacaagaggcgcaguucuuauguaccaagguaaaaggcuagaacccaguugggcaucagucaagaaagauuuaaucucauauggaggagguuggagguugcaggguaguuggaauaccggcgaagaggugcaaguaaucgcaguagaacccggcaaaaaucccaaaaauguacaaacggcaccagguacauuuaagaccucagaaggcgaagugggagcgauagcucucgacuucaagccaggaaccucgggaucuccgauaguaaacagagaaggaaaaauagucgguuuguacggaaauggcguaguaacgacuucuggaaccuacgucuccgcaaucgcccaagcuaaggcuucacaagaaggaccacugcccgaaauugaggacgaaguguuucgaaagagaaaccuaacgaucauggauuuacaucccgguagugggaaaacaagacgguauuugccggccauuguacgcgaagcgauaaaacgaagauuaagaacacuuauauuagcaccaacuagaguuguagcauccgagauggcagaagcacuaaaaggaaugccgauaagguaucaaacuacugcuguaaaaagugaacacacaggaaaggagauuguagacuuaaugugccaugcaaccuuuaccaugcgguugcuuucgccagucagagugccgaacuauaauaugauaauuauggacgaagcacauuucaccgacccaucuaguauagccgcacgaggcuacauuucaacgcgaguaggcaugggggaggcugcagcaauauucaugacagcuaccccuccuggaucuguagaggccuuuccucaaagcaacgcuguaauucaagacgaagaacgagacauuccagaacgcucuuggaacucgggauacgaauggauaacugauuucccgggcaaaacagucugguucguuccgucaaucaaaucgggaaacgacauugccaacugccuucgcaaaaacgguaagcguguaauucaauuaucaagaaagacuuucgacacugaauaucaaaagacgaaaaauaaugauugggauuauguggucacaaccgacauaucugagaugggagccaauuuuagggcagacagagugaucgacccaaggagaugucucaaacccguaauucuuaaagacggaccagaacgaguuauucuggcagggccaaugccaguuacaguggcaucggcagcucaaagacgaggcagaauugguaggaaucacaacaaagaaggcgaccaauacauauauaugggacaaccauuaaauaacgaugaggaccaugcgcauuggacggaagcuaagaugcuacuagacaauaucaauacgccagaggguaucauucccgcccuguucgaaccagaaagagaaaagucggcggcaauagacggcgaauaucgucuuagaggagaagcuagaaaaacauucguagaacugaugcguagaggcgaccuuccagucugguuaucuuacaaaguagccagugaaggauuucaauauagcgauagaagauggugcuucgauggcgagaggaauaaucaagucuuagaagaaaacauggauguagaaauuuggacuaaagagggugaaaggaagaaauuacgacccaggugguuagacgcaagaacuuacagcgacccacuugcgcuaagggaauuuaaagaauuugcagcaggacgucguagcgucaguggcgauuuaauauuagaaauaggaaaauuaccacaacauuugacucaacgagcacaaaaugcacucgacaaucuuguuaugcuucauaauucagagcaaggagggagggcauauaggcacgcaauggaggaacuaccagauacuauugagacgcucauguuacuggcacuuauagcaguauuaacaggugguguaacgcuuuucuuuuuaagcggaagaggucuuggaaaaacaucaauagggcuacuguguguuauggccagcagcguuuuguuauggauggcauccgucgagccacauuggauagcagcaucgauaauauuggaauuuuuccuuaugguacugcuaaucccugagccagauagacagcgaacaccucaggacaaucaacuagccuauguaguuauuggacuucuauuuaugauccuaacuguagccgcgaacgaaaugggauuauuggagaccaccaagaaagaucuaggaauuggacauguagcuguagaaaaccaccaucacgcagcuauguuagauguagaucugcauccugcauccgcguggacauuauaugcaguagcgacaacaauaaucacaccaaugaugagacacacaauagaaaauacgacugcgaauauaucacuuacagcgauugcaaaccaggcagcaauuuugaugggacuagacaaaggauggccuauuaguaaaauggauauaggagugccacuucuagccuuaggauguuacucucaaguaaaucccuugacauuaacagcugcaguacuaaugcuggucgcgcauuacgcaauaauuggccccggucuacaagcuaaagcaacgcgcgaagcucagaaaaggacagcugcaggcauaaugaaaaacccuacuguugaugguauaguugcaauugaucuagaucccgucgucuacgaugcuaaguuugagaaacaauuaggucagauuaugcuauugauucuauguaccagucaaauucuccuaaugagaacuacgugggccuuaugcgaguccaucacgcuagcuacaggaccacuaaccacuuuaugggagggcucaccagguaaauuuuggaacacaacuauagcaguauccauggcaaacauauuccgggguagcuaccuagcaggagcuggccuggcuuuuagucuaaugaaaagccuagggggaggaagaagaggaacgggcgcucaaggggaaacacuaggugagaaguggaagagacagcuuaaucaauuaucaaaauccgaguucaacaccuacaaacgaaguggcauaauggaaguugaucggucagaagcaaaggaaggauuaaaacgaggcgagacuacuaaacaugcgguuucaagaggaacugcuaaauuaagaugguuuguugagcgcaacuuaguaaagccggaaggaaaaguuauagaccucggauguggucgaggcgguuggaguuacuauugugcuggcuugaagaaagucacggaaguuaaaggauauacuaaagguggcccaggccacgaagaaccaauuccaauggcaaccuacggauggaaucucguaaaauuacacuccggaaaggauguuuucuuuauaccuccugagaagugugacacacuuuuaugugauauaggcgaaucuucgccaaauccaaccauagaagaaggaaggacccuacggguuuuaaaaaugguugaaccgugguuaagggguaaccaauucuguauaaaaauacucaaccccuacaugcccagcguaguugaaacucuugaacagaugcaacggaaacauggagggaugcucguucguaauccacuuucgagaaauuccacacacgagauguacuggguuucaugcgggacaggaaacauuguuucggcuguaaauaugacgaguagaaugcuuuugaauagauuuacaauggcacaccggaaaccuaccuaugaaagagacgucgaucuuggagcgggaacaagacacguugcaguggaaccagaggucgcgaacuuggauauuauaggacagagaauagaaaauauaaaacaugagcauaaguccacauggcacuaugaugaagacaauccguauaaaacuugggcguaucauggaaguuacgagguaaagccgagcgggagugcaucgucgaugguuaacggcgucguuaagcuacuaacgaagccaugggacgugauaccaaugguuacccaaauugcaaugacggacaccacgccuuuuggccaacaacgaguuuuuaaagaaaaagucgauacaaggacccccaaagcaaaacgagguaccgcgcaaaucauggaaguaaccgcuaaauggcuaugggguuucuuaucaagaaacaagaaaccacgaauuuguacaagggaagaguucacaaggaagguuagaucaaaugcugcaaucggagccguauuuguggaugaaaaccaauggaauagugcgaaagaggcgguagaagaugagagauucugggauuugguucauagagaaagagagcuccauaaacaaggaaaaugugccacaugcgucuauaauaugauggggaaaagagagaagaaauuaggcgaauuuggaaaagcgaaaggcucacgcgcaaucugguauaugugguuaggagcucgguuccuugaguucgaagcauuagguuucaugaaugaggaucauugguuuagccgagaaaauucuuuaagcgguguagagggcgaaggacuacacaaacuuggauauauccuaagggacauuucaaaaauuccaggagguaauauguaugccgaugauacugcugggugggauacaagaaucacugaagaugaucuacaaaaugaggcuaaaauuaccgacauaauggaaccagaacaugcgcuacuugcuaagucaauauucaaguuaacguaucaaaacaaaguaguucgcguacaacgaccugccaaaaacggaacaguaauggacguaauuagucggagagaccaaagaggaucugggcaggucggcacguacgguuuaaacaccuuuacuaauauggaagcacaauuaauacgucagauggaaagugaggguauuuucucuccaucagaacuagaaacuccaaaucuagccggcagaguacucgacuggcuugagaaacaugguguugaacgacuuaaacguauggcaauaucaggagaugauuguguugucaaaccaaucgacgaucgauuugccacagcucuaaccgcauugaacgauaugggcaaagugagaaaagacaucccucagugggaaccaucaaaaggauggaacgacuggcaacaaguuccuuuuugcagucaucauuuccaccagcucauuaugaaagauggaagagaaauugugguccccuguagaaaucaagaugaacugguaggaagggcacgggugagucagggggcuggcuggagcuuaagagagacagcaugccuuggaaaaaguuacgcccaaauguggcaacuaauguacuuccauagaagggaccuuaggcuagcugcaaacgcuauuugcagcgccgucccggucgacuggguucccaccagcagaacaacuuggaguauacaugcccaccaccaguggaugacaacagaagacaugcuuucaguauggaauagaguguggaucgaagaaaacccuuggauggaagauaaaacacauguauccaguugggaagauguuccuuacuuaggaaagcgugaggaccaaugguguggaucguuaaucgguuuaacugcgcgagcgacaugggcuacaaauauucaaguggcaauaaaccaaguccgaagacuacuaggaaaugaaaacuaccuugauuacaugacaucuaugaaaagauuuaaaaaugaaagcgauccugaaggggcauuaugguag

SEQ ID NO: 21933 - RNA, 9879 nt, Artificial Sequence
  derived and/or modified CDS sequence (opt6) from DENV-1__EU482489__SS-prME
ucuguuacuauguuauuaaugcuuaugccuacugcgcuggcuuuucauuugacuacgaggggaggggaaccucauaugauuguuucaaagcaagaaagaggaaaaucacuacucuuuaaaacaagugcaggaguaaauaugugcacuuuaauugcaauggauuugggagaacugugugaagacacuaugacauauaagugcccuagaauaacggaaaccgaaccagaugauguagauugcugguguaacgcuacagacacgugggucaccuacggaacguguucucaaaccggggaacauagacgagacaaaagaaguguagcauuggcaccacacguuggauuaggauuggaaacuagaaccgaaacauggauguccagugagggagccuggaaacaaauucaaagaguagaaacaugggcacuuaggcauccaggguucacuuugauagcgcuuuuucuugcacacgcaaucggaaccaguauuacacaaaaaggaauuaucuucauucuauuaauguuaguuacgccuucaauggcgaugcgaugcguaggaauuggaagccgcgauuuuguggaaggauuaaguggggcgaccuggguggauguaguuuuggaacaugguucuugcguaacuacgauggcuaaggacaagcccacacuagacauugaguuauuaaaaacagaagugacgaacccggcuguacuacgcaaacugugcaucgaagcuaagaucaguaauacaacaacggacagucgcugccccacacaaggagaagcaacucuaguugaagaacaagacgcuaacuuugucugcaggcgaacauuuguagaccggggauggggaaacgguugugggcuauuugguaagggaucuuugauaacaugugccaaguuuaaaugugugacgaaacucgaggguaaaauaguucaauaugaaaauuuaaaauacaguguaauugucacaguucauacgggagaucaacaccaaguuggaaacgagucuaccgaacacgguacaacugcaacuauaacaccacaagcaccuacuacugagauccaauuaacugauuacggagcgcucacacuagauuguucaccucggacuggacucgauuuuaacgagaugguacuucuuacaaugaaagagaaaagcuggcuuguucauaaacaaugguuccuugacuuaccccuaccuuggacaagcggugcuaguacuucacaggaaaccuggaacagacaagauuuguuaguuacauucaaaacagcgcacgcuaagaagcaggagguagucguacucgggucacaggaaggugcgaugcacacagcuuuaacuggagcgacugaaauccaaacgucuggcacgacuacuauauucgcgggccaucuuaaauguagacucaaaauggacaaauuaacuuuaaaaggcaugucauauguaaugugcacggguuccuuuaaauuagaaaaagaauuagcggaaacucaacauggaacggugcuaguacaaauuaaauaugaaggaaccgacgcaccaugcaaaauuccauuuuccacucaagacgaaaagggaguaacucaaaauggcagacugauuacagcgaauccuauugugacugauaaagaaaaaccuguaaacauugaagcagaaccucccuuuggcgaaucguacauagucauaggggcaggggaaaaggcuuuaaaacucaguugguucaaaaagggaucuucuauagggaaaauguuugaagccacagcacgaggggcaagacggauggcaauucuaggcgauacggccugggauuuuggaaguauaggugguguauucacaaguguggguaagcuaguacaccaaaucuucggcaccgcauacgguguacuauuuucaggcgugucuuggacaaugaaaauaggcaucggcguauugcuaacuuggcuaggacuaaauucccguuccacaaguuugucuaugacauguauagcaguaggccuaguaacacuauaccuagguguaaugguacaggccgacagcggauguguuauaaacuggaaaggccgcgagcuuaaauguggaaguggaauuuuuguaaccaacgaaguucauacguggacagaacaauacaaauuucaagcugauucuccuaagaggcucucugcugcuauaggcaaggcuugggaagaagggguaugcggcauaagaagugcuacacguuuggaaaauauaauguggaaacaaauaucuaacgaguuaaaucauauauuauuggaaaaugauaugaaauuuacagugguaguaggagacguugcaggcauucuugcacaaggaaagaaaaugauacguccccagccuauggaauauaaauacucauggaaaucguggggcaaggcaaagauaauuggggcugauguucaaaacacaacuuucauuauagaugggcccaacacaccagagugcccugaugaccaaagagcuuggaacauaugggaaguugaagauuacggauuuggaauauuuacaacaaacauaugguuaaaguugagagauucguacacacaaguuugugaccauagacuaaugagugccgcaauuaaagacagcaaagcgguccaugcagauaugggcuauuggauugagucagaaaagaacgaaacguggaagcucgcaagggcuucauuuauugaggucaagacguguauuuggccaaagucgcauacacuaugguccaauggcgucuuagaaagugaaaugauuauacccaaaauauacggggguccuauaucacaacacaacuauagaccaggauauuucacacagacagccggaccguggcaccuagggaaauuagaguuagauuucgauuuaugugaaggcacaacaguaguagucgacgaacacuguggcaauagggguccaucauuaaggacgacaacaguuaccgguaagauaauacacgaguggugcugucgaaguugcacguugccaccguuaagauuucguggagaagauggaugcugguacgguauggaaaucaggccaguaaaagaaaaggaagaaaaucucguuaagaguauggucuccgcagguagcggcgaaguugauucauucaguuuaggucuauuaugcauaucuauaaugauagaagaaguaaugagaucgcgauggagccgaaaaaugcuaaugacggguacacuagcaguauucuuucuucuaaucaugggucaguuaaccuggaaugauuuaauacgauuauguauaaugguaggcgcgaaugccucugaccguaugggcaugggaacuacauauuuagcuuuaauggcuacguuuaaaaugcgaccaauguuugcagugggucuuuuauuucgucgacuaacauccagagaaguucuucucuugacaauuggucugucauugguggcuucgguagaguuacccaauucacucgaagaauuaggggacggacuugcgaugggaauuaugauacuaaaacuucucacagauuuucaaucucaccaacuuugggcuacuuuacuuucucugaccuucauuaaaacuacuuuuucgcuucauuaugcauggaaaacaauggcaaugguauuaucaauuguaucacucuuuccucuaugccuuucuacaacuucccagaaaacgaccugguugccgguuuuguugggaagccuaggaugcaagccucuaacgauguucuugaucgcagaaaauaaaauaugggggcgucgcucguggccacuuaaugaagguaucauggcaguggggaucguaagcauucuucuaucuagucuacugaaaaacgauguaccucucgcagggccucuaauugcgggugguauguuaauagcauguuacguaauaagcgggagcucagcagaucugagucuugaaaaggccgcagaagucucuugggaggaagaagcugaacauucuggugcaucacauaacauauuagucgaaguucaagaugauggaacgaugaaaauuaaagaugaagaaagggacgauacguuaacuauccuuuuaaaagcaacacuccucgcaguuuccgggguauauccauugagcaucccugcuacccuuuucgugugguauuucuggcaaaagaagaaacaacgaagcgguguacuaugggauacgccaucaccacccgaaguagaaagggcgguccucgaugacgggauuuaccgaauuaugcagcgaggccuucucggacgcucccaaguaggaguuggaguauuucaagagaacguauuucacacuauguggcacguaacucgcggcgcaguguuaauguaucaaggcaagcggcuagaaccauccugggcuucagucaagaaagaucuuauaaguuacggcggcggcuggagacuacaaggaucauggaauacaggagaggagguacagguuauugcaguagaaccuggcaaaaauccgaaaaacgugcaaacagcaccugguacguucaaaacgccugaaggggagguuggagcuauagcacuagacuuuaagccugguacgagugguaguccuaucguuaauagagaaggaaaaauuguugguuuguaugguaacggaguuguaacgacgagugggacuuacguaagugcaauugcucaagcuaaggcuucucaagaaggacccuuaccagaaaucgaagacgaaguguuuaggaaaagaaauuuaacuauaauggaucuacacccaggcagcggcaaaacacgucguuacuuacccgccauaguccgugaagcgauaaagagaaaacugcguacacuuauuuuggccccgacuagaguuguugcgucggaaauggcggaagcccuaaaagggaugcccauaagauaucaaacuacagcgguaaagucagaacauacagguaaggaaauaguagauuugaugugccaugcuacauucacuaugagguuacugucaccuguuagaguacccaauuacaacaugauaauuauggaugaagcgcauuuuacugaucccuccuccauagccgcacguggcuauaucucaacucguguaggaaugggugaagccgcggccauauuuaugacugcaacucccccugggagcgucgaggcuuucccgcaaagcaaugcggugauacaagaugaagaaagagauauaccggaaaggagcuggaacucaggauacgaguggauuacagauuuucccgguaagacugucugguuuguccccaguauaaaaucggguaacgauauagcaaauugcuuaagaaagaauggaaaaagaguaauccaacucaguagaaaaacauucgauaccgaauaucaaaagaccaaaaacaaugacugggacuauguaguaaccacugauauauccgaaaugggugcaaauuuccgggcugaucgugugauagauccacgacguugucucaaaccuguuauacuuaaggacggacccgaaagggugauuuuagcuggaccgaugccaguuacaguugcuagcgcugcccaaaggagagggagaaucggacgaaaccauaauaaggaaggcgaccaauauauauacauggggcagccucucaauaaugaugaagaucacgcacauuggacagaggcaaaaaugcuccucgauaacauaaauacaccagaaggaauaauuccugcguuauuugaacccgaaagagagaaaucggcagcuauugauggcgaauaucgacuaagaggagaggcuagaaaaacuuuuguagagcucaugcgacggggcgaucuaccuguuugguugagcuacaaaguagcaucggaggguuuccaguacagugacagaagauggugcuucgauggggagagaaacaaucaaguccuugaggaaaauauggauguagaaauuuggaccaaagaaggggagaggaagaaauuacgcccaagaugguuagacgcaagaacguauucugacccuuuagcucucagggaauuuaaagaauuugcagccggccgcagauccguaaguggggaccuaauuuuagaaauaggaaagcucccacagcaccuaacgcagagagcacagaaugcauuagauaacuuggugaugcuacacaauuccgaacagggcggcagagcauacagacaugcgauggaagaacuaccggauacaaucgaaacgcugauguuacuggcuuuaauugcuguacugacagggggaguaacacuuuucuucuuaaguggcaggggucuggggaaaaccuccauaggucucuugugugucauggcaaguaguguauuacuuuggauggccuccguagaaccacauuggauagcagcaaguauaauucucgaauuuuuccucaugguccugcuaauaccugaaccagauagacaacgaaccccacaggacaaucaacuagcguacguaguaauaggacuacuguuuaugauacuuacuguugcagcaaaugaaaugggcuuacuagaaacaacuaagaaagauuuaggaauuggucauguggcaguagaaaaccaccaccaugcagccaugcuagacguagaccuucauccugcuucggcguggacacuauacgcaguagcuacaacuauuauuacgccaaugaugaggcacacaaucgaaaacacuacggccaauauuagccuaacggcgauagcaaaucaggccgcuaucuuaaugggucuagauaaagguuggccuauuucuaagauggacauagguguaccuuuauuggcacucggaugcuacagccaaguaaacccucuaacccugacagcagcgguucugauguugguggcacauuaugcgauaauaggaccuggauuacaagcgaaggcuacacgagaagcacaaaaacgaacagcugccgguauuaugaaaaaccccacaguugacggaauaguagcuauagaccuagacccuguagucuaugacgcuaaguuugaaaaacaacuaggccaaauuaugcugcuaauuuuauguacaagucaaauauugcucaugaggacuacaugggcgcuaugugaaaguauuacguuagcaacuggaccgcuuacgacccuuugggaagguagccccgggaaauuuuggaauaccacaaucgccgugucaauggcaaauauauucagaggcucauaucuagcuggagcaggucuggccuucagccuaaugaaaagccuagguggcggacgcagagggacuggggcacaaggggaaacgcuaggggaaaaauggaaaagacaacuuaaucagcuaaguaaaucugaguucaauacauauaaaagauccggaauaauggagguagaccgcuccgaagcaaaagaaggauugaaacgaggagaaaccacgaaacaugcuguuucuagaggaacagcaaaacuuagaugguucgucgaaagaaacuugguaaaacccgaagguaaggugauagaucuagguugcggacgaggaggcuggaguuauuacugugcugggcucaagaaagugacugagguaaaaggauauacaaaaggugguccugggcaugaagaaccaaucccaauggcuacauacggauggaaucuuguuaaacuccacagcggaaaagacguuuucuucauuccaccagaaaaaugugacacccucuuaugugauauaggggaaucaagcccuaacccuacgauugaggagggcagaacacuucgaguauugaaaaugguugagcccugguuacguggaaaccaauuuuguauuaagauccuaaacccauauaugccguccguagucgaaacccuagaacaaaugcaacguaaacauggaggaauguuaguuaggaacccacucaguagaaauucaacacacgaaauguauuggguuucuugcggaacgggaaacauuguuucagcggucaacaugacaaguagaaugcugcuaaaccgguuuacuauggcucacagaaaaccaacauaugagagagauguagacuugggcgcgggcaccaggcaugucgcaguggaaccggaaguugcuaacuuagacauuauaggccaacgaauagaaaacauaaagcacgaacauaaaucaacauggcacuacgacgaagacaacccauacaaaacaugggcauaccacggcuccuaugagguaaaaccuaguggaucugcaagcucuaugguaaacggaguuguaaaguuacucacaaagccuugggauguuauucccaugguuacucaaauagcgaugaccgacacgacucccuucggccaacaacgcguauuuaaagaaaaaguugacacacgaaccccgaaagcgaaacgagggacagcccaaauaauggaaguuacugcuaaauggcuauggggguuuuugaguaggaacaaaaagccaagaauauguaccagagaagaauuuacccguaaagugcgaagcaaugcugcgaucggagcaguauuuguagaugagaaucaguggaacucagcgaaagaagcaguagaggaugaaagguuuugggaucuaguacaccgagaacgugagcuacauaaacaagguaaaugcgccacauguguguacaauaugauggguaaacgagagaagaaacucggggaguucggaaaagcaaaaggaucacgugcaauuugguacauguggcuaggggcgagauucuuggaguucgaagccuuaggauuuaugaaugaagaucauugguucucgagagaaaacucauuaagcgggguugaaggagagggccuucacaaacuugguuauauauuaagagacauuucaaagauacccgguggaaauauguaugcagaugauacagcagguugggacacucgaauuacagaagacgaucuacaaaaugaagcccguauaacugauauaauggagccugaacaugcauuauuagcuaaaagcaucuuuaaacuaacauaucaaaauaaaguuguucggguccaacgaccagccaaaaauggaacaguaauggacgucauuuccagaagagaccaaagggguucagggcaggucgguacauauggccuaaauaccuucacaaacauggaagcccaacuaauuagacaaauggagagugaggguauauucaguccaucugagcuagagacuccgaaccucgcagaacgaguucuagauugguuggaaaaauauggaguggaacgucuaaaacgaauggcaauaaguggggacgauuguguaguuaagccaauugaugauagguucgcaacagcucuuacagcacuuaaugacaugggcaaaguaaggaaggauauuccucaaugggaaccgaguaaagguuggaaugauuggcaacaaguaccauuuugcucucaccacuuccaucaauuaauuaugaaagauggaagagaaauugucguacccugcagaaaucaagaugaguuggugggacgggcaagaguuucucaaggcgcaggguggucacugagagaaaccgcauguuuaggaaaaaguuacgcccaaauguggcaauuaauguauuuucaucgcagagaucuaagacuagcagcgaaugccaucuguucggcagugccaguagauuggauaccuacuucacguacgaccuggucaauucaugcacaucaucaauggaugacgacugaagauaugcucucuguuuggaauaggguauggauagaggagaacccauggauggaggauaagacccauauuuccucauggggagaugucccuuacuuagguaagagggaggaccaauggugcgguucucugauuggauuaaccgcacgugcaacgugggcuacaaauauucaaguggcgauaaaucaaguacgucgauuaauagguaacgagaauuaucuagauuacaugaccaguaugaaacgauuuaaaaaugaaucagaucccgaaggggccuugugguag

SEQ ID NO: 21934 - RNA, 9879 nt, Artificial Sequence
  derived and/or modified CDS sequence (opt6) from DENV-1__EU482490__SS-prME
ucaguuacaaugcuccugaugcugaugcccaccgcacuggcauuccauuuaacuacacgugggggagaaccacauaugaucguuucuaaacaagaacgcgguaaaagccuuuuguucaaaaccagcgcgggaguuaauaugugcaccuuaaucgcuauggacuuaggugaauuaugugaagauaccaugacguauaaauguccaagaauuaccgaaacagagccagaugauguagauuguugguguaaugcgacggauacaugggucacauaugggacuuguucucaaacgggggaacaucgccgagacaaaaggagugucgccuuggcuccacacguuggguuagggcuugaaacacgaacugaaacuuggaugaguuccgaaggagcauggaaacaaauacaaagagucgaaaccugggccuuacgucauccuggauucacggucauugcacuauuuuuagcacacgccauagguacuucaauaacacaaaaaggcauuauauuuauucuauuaaugcuugugacucccucuauggcaaugcguuguguagguauugguucccgagacuucguagaaggacugaguggagcuaccuggguugaugugguccuugaacauggcucuugcgucacaacaauggcuaaagacaaaccuacuuuagacauagaauuacuaaaaacugaaguaacaaauccagccguucuaagaaaguuguguauagaagcaaagauaucaaauaccacaacggacaguagaugcccgacucaaggugaagcaacuuugguagaagaacaagaugcuaauuucgucuguagaaggacauuuguugacagggguugggguaaugguuguggauuguuugguaagggaucucuaauaacaugugcuaaguucaaauguguaaccaaacuugaaggcaaaauaguucaauaugaaaauuugaaauacucugucauaguuacgguacauacuggagaucaacaccaaguaggaaaugaguccacggaacacggaacgacugcaacaaucacaccucaagcaccaacaaccgaaauacaauuaacagauuauggugcuuugacgcucgauugcucgccgcguacaggucuggacuuuaaugaaaugguacuauuaacaaugaaagaaaaguccuggcuuguccauaagcaaugguuccuagauuugccccuucccuggacaaguggcgcaagcacuucacaagaaaccuggaaccggcaagaucucuuaguaaccuuuaaaacggcacacgccaagaaacaagaaguaguuguacugggaucccaagaaggugcaaugcauaccgccuugacaggugcaaccgagauacaaacaaguggcaccacgacuauuuucgccggccacuuaaaauguagacuuaaaauggacaaguuaacucuuaaagguaugucuuauguaauguguacuggcuccuuuaaacuugaaaaggaaguugcagaaacucaacauggaacaguauuaguacaaauuaaauacgaaggaacugaugccccuuguaaaauaccauucaguacucaagacgaaaagggaguuacucaaaacggaagguuaauaacugccaacccaaucguaaccgauaaagagaaaccagugaacaucgaagcugagcccccuuucggggaaagcuacauaacuauuggagcaggagagaaagcauugaaacuaaguugguuuaagaaagguucauccauaggaaagauguuugaagcaacagcuagaggagcuagaaggauggcaauauuaggagacacugcuugggacuuuggaucgauaggagguguauucacauccguaggcaaguuaguacaucaaaucuuugguacggccuauggaguuuuguuuagcgguguaaguuggaccaugaagauagggauaggaguucuucuaaccuggcuagguuuaaauucaagaaguacuucguugaguaugacuugcaucgcuguaggauuaguaacauuauauuuaggaguuaugguacaagcagacagugguugugucauaaauuggaaaggaagagaacucaagugugguagcgguauauuugugacgaacgaagugcauacauggacagaacaauauaaauuccaggccgauaguccaaaaagauuaucugcagcgauaggaaaggccugggaggaaggagucuguggaauuagaucugcaacgagauuagaaaacauuauguggaagcaaauuucgaacgaauuaaaccauauauuauuagaaaacgacaugaaauucacaguagucguaggggauguggcagguauauuagcacaggguaagaaaaugauaagaccccagcccauggaauauaaauauucguggaaaaguuggggaaaagccaaaauaauuggugcugauguacaaaauacaaccuuuauuauagauggucccaauacgccagaauguccagaugaccaaagagcauggaacauaugggaaguugaagauuauggguuuggaaucuuuacaacaaacauuuggcucaaauugagggacucauauacacaagugugugaucauagacuuaugucagcggcgauuaaagacucuaaagcuguccaugcugacaugggauacuggaucgagagugagaaaaaugagacuuggaaacuugcaagagcuucauuuauugaggugaaaacauguaucuggccaaaaagucauacgcucuggucaaauggaguacuugaaagugagaugauaauuccuaaaauauauggugggccgauaagucaacacaacuaccgcccugguuacuuuacacaaacggcuggaccauggcauuuaggaaagcuggaacuugacuuugaucuaugcgaagguacaacaguagugguagaugaacacuguggaaauagagggccgagucuucgaacaacaacaguuacuggaaaaauaauacaugaauggugcugcagaagcugcacccucccaccauugagguuuaggggagaagauggauguugguaugggauggaaaucaggccuguaaaagagaaggaagaaaaucuaguaaaauccaugguuucagcaggaaguggugaaguagauaguuucagccuaggacuacuaugcaucaguaucaugaucgaagaagucaugagaaguagguggucgcguaaaaugcuuaugacggguacgcuugcgguauucuuccuacuaauaaugggacaauuaacauggaaugacuuaauuagguuaugcauaauggugggggcaaaugccucagacagaaugggaauggggacuacguacuuagcguuaauggcuacauuuaaaaugcgacccauguuugcaguagggcuacuauucagacgauuaacgaguagagaaguauugcuuuuaaccauaggacuaaguuuggucgcaucaguugaauugccaaacucguuggaggaacucggagauggacuugcuaugggaaucaugauauugaaacuucugacggauuuucaaagucaccaacuaugggcuaccuuacuuagcuugacauucauaaaaacaaccuucucucugcauuaugcuuggaaaacaauggcaaugguguuaaguauagucucacucuucccauugugcuugucaaccaccucacagaaaacgacauggcugccgguacuucuuggcaguuuaggauguaaaccacuuacuauguuuuuaauugcagagaauaagauauggggacgccgaaguuggccauuaaaugagggaauuauggcuguagguauuguaaguauacuuuuaagcucucuuuugaaaaaugaugucccucuggcagguccccuuauagcugguggaaugcuaauugcaugcuacguaauaaguggaucaagcgcagaucuuucucucgagaaagcagcagaaguaucgugggaagaggaagcagaacacucaggugcaucgcauaauaucuuaguggaaguucaggaugacggcacaaugaaaauuaaggacgaagaaagagaugacacucuuacgaucuuguugaaagcuacguuauuagcaguaagugggguauacccgcuaagcauaccagcgacauuauuugugugguauuuuuggcagaagaagaaacaaagguccggaguuuugugggauacuccuucaccgccggagguggaacgcgcuguuuuagacgauggcauuuaccgaauaaugcaaaggggucugcucgguagaucacaaguaggugucggcguauuucaggaaaauguauuucauacaauguggcauguuaccagaggcgcggucuugauguaucaaggaaaaaggcuagaaccaaguugggcuucagucaagaaagauuuaaucucguauggaggaggguggagguugcaggggucauggaacacaggugaagaagugcaaguuauagccguggagccuggcaaaaaucccaaaaacguacagacugcgcccggcacuuucaagacacccgaaggcgaagucggagcaauugcucuugauuucaagcccgggaccaguggaucaccgaucguaaauagagaaggaaagauagucggccuauacggaaacggaguaguuaccacaucaggaacauacguaucagcuauugcccaagccaaggcaucacaagaaggaccucuaccagagauagaagaugaaguuuuuagaaagcguaaccucacaauaauggauuugcacccuggaucggguaaaaccagaagauauuuacccgccauugugagagaagccaucaaaagaaaauuaagaacauugauauuggcgccgacgagaguuguagcaucugaaauggccgaagcccucaaaggaaugccaaucagauaucagacaacggcagucaagucagaacauacagggaaagaaauuguugaccuaaugugccaugcuaccuucacuaugcgcuuacuuucucccguacgaguaccuaauuauaacaugauaauuauggacgaagcucauuuuacugaccccaguucaauagccgcacgagguuauauaucaacucgaguagggaugggggaagcagcagcaaucuucaugacagcuacuccaccaggaagcgucgaagcauuuccucaaucuaaugccguuauacaagaugaagaaagagacauaccagagaggagcuggaacucuggcuacgaauggauuacagacuucccaggcaaaacugucugguuuguaccgucuauuaaaagugggaaugacauagcuaauugccugcgcaaaaacgggaagaggguaauucagcugucaaggaaaacauuugauacagaauaccagaaaacgaagaauaacgauugggauuauguaguaaccacagacauaagcgaaaugggagcuaauuuuagagcugaucggguuauugauccaagaagaugccuaaaacccgucauacucaaagauggucccgaaagaguaauccuagccgggccaaugcccgugacaguggcaucagcagcccaaaggagaggcagaauagggagaaaccacaacaaggagggggaccaguacauauacaugggccaaccucuaaacaaugacgaagaccacgcccacuggacagaagcaaaaauguuacuugauaacauaaacacaccagaaggcaucaucccugcuuuauucgaaccggaaagggagaaaagcgcugccaucgacggugaauaccgauuaagaggugaagcgcgaaaaacuuuugucgaacucaugagaagaggcgauuugccaguauggcuuuccuauaaagucgcaucagagggcuuccaauauagugaucgcagauggugcuucgacggagagaggaauaaucaaguucuagaggaaaacauggacguugaaauauggacaaaggaaggggaacgaaagaaacuuaggccacgguggcucgaugcgaggacuuacagugauccacuugcucuuagagaauuuaaagaguucgccgccggucgacguaguguaucgggugacuugauucucgaaaucggaaaauuaccacaacaucuuacccaaagagcacaaaacgcacuagacaacuuagucaugcuacauaauucugagcaagggggacgagcauacagacaugcaauggaagaacuaccagauaccauagaaacucucaugcugcuagcccugauagcaguguugacaggaggaguaacacuauucuuucugaguggccguggacuagggaaaacgaguaucggacucuuaugcgugauggccucuaguguuuuauuauggauggcguccguagagccacacuggaucgcugcgagcauaauucuggaauuuuucuuaaugguacuacuaauuccggaaccagacaggcaacguacaccacaagauaaucaguuagcguauguaguaauagggcuucuuuucaugauauugaccguugcagcuaaugaaaugggccucuuggaaacaacgaagaaagaccucggaauuggccacguggcuguugaaaaucaucaccacgccgccaugcuagacguugaucuacauccggcaucagcuuggacacuguacgccgucgcuaccacaauuauuacucccaugaugaggcauacuauagaaaauacuacagcaaacauuagcuuaacagcaaucgcaaaucaagcagcaauauuaaugggauuggauaaaggauggccaauuucaaaaauggacauaggaguaccacucuuagcacugggguguuauucgcaagugaauccgcugacuuuaacggcagcaguacuaaugcucguugcacacuaugcaauuauaggaccaggacuccaggcaaaagcaacgagggaagcucagaaaagaacagcagcaggaaucaugaaaaaucccacagucgaugggauaguagcaauagaccuagauccuguuguauaugaugcaaaauuugaaaaacaacuaggccaaauaauguuauuaauccucuguacuagccagauauuauuaaugcgcacuacaugggcguugugcgaaaguauaacccuggccacaggcccuuuaacuacucucugggaaggaucacccggcaaguuuuggaauacaacgaucgcugucagcauggcuaacauauuuagagguucguaucuagccggagccggacucgcuuuuuccuuaaugaaaagucuuggaggugguaggagagggaccggagcacagggcgaaacgcuuggagaaaaauggaaaagacaacuuaaccaauuaaguaaaagugaauuuaauacauacaagcguucuggaaucauggaagucgaccguagcgaggccaaggagggacuaaaaaggggcgaaacaacuaaacaugcugugaguaggggcacagcaaaacuucgaugguuuguagaacgaaauuuagugaaaccugaagggaaaguaauagaucucggcuguggcagaggaggauggucuuauuauugugcaggccucaagaaagucacagagguuaaaggguauacuaagggcggcccuggacacgaggaaccuaucccaauggcgacauacggauggaaucuuguaaaacuucacucaggaaaagaugucuucuuuauacccccugaaaaaugugauacacuuuuaugcgacauaggagaguccagcccaaauccuacaaucgaggagggccggacgcuacgggucuugaaaaugguugaaccuuggcuacgaggcaaccaauuuuguauaaaaauauugaacccauauaugccaagugugguugaaacgcuagaacaaaugcaacguaaacacggcgguaugcucguacgaaacccauugucgcgcaauucgacucaugagauguauugggucucguguggaacuggaaauauaguuuccgccguaaauaugacgucucggaugcuacuaaaucgauuuacaauggcacaucguaagccaacuuaugaaagagacgucgauuuaggagcagguacaagacauguagcagucgaaccagaaguugcaaauuuagauauuauuggacaaagaauagaaaacauaaagcacgaacauaagucaacauggcacuaugacgaagacaauccauacaaaacaugggcuuaucacggaucguaugaagugaaaccaucagguagugcgagcucaaugguaaacgggguuguuaagcuccuaacaaagccaugggaugucauuccgauggucacccaaauagccaugacagauacgacaccguucggacagcaaagaguuuuuaaagaaaaaguggacacaaggacaccgaaagcaaaaaggggcacggcacaaauaauggagguaaccgcaaaaugguuauggggguuuuuaaguagaaacaagaaacccagaauuugcacgagagaagaguuuacaagaaaaguuagauccaaugcagcuauaggcgcaguuuucguugacgaaaaccaauggaauagugcaaaagaggcaguagaagacgaacgauuuugggaccuaguacacagagaaagagaacuucauaagcaagguaaaugugcaacauguguuuacaauaugaugggaaaacgcgagaagaaauugggagaauuugguaaagcaaagggaucgagggcgauaugguauaugugguuaggcgcccgauuucuagaauuugaggcuuuaggguucaugaacgaagaccauugguuuagucgugagaauagucuaucugggguagaaggugaaggucuccacaaauuagguuauauuuuacgcgacaucaguaaaauaccuggagggaauauguaugcagaugauacagcagggugggacacuaggauaacagaagaugaucuacaaaacgaagcacgcauuacagacauaauggaaccagaacacgcacuacuagccaaaucaauuuucaaauuaacauaccaaaauaagguuguaagaguucaaaggccagcgaaaaacggcacagugauggacgucauuagucgccgugaccaaagaggcaguggucaagugggaacauauggauuaaauaccuucacaaacauggaagcucaauugauaagacaaauggaauccgaaggaaucuuuucuccaagugaauuggaaacaccgaaucuugcagaaaggguccuugacuggcuugaaaaguacgguguagaaagauugaaacguauggcgauuuccggagacgacuguguaguaaaaccaaucgacgaucgcuucgcaacugccuuaacggcgcuaaacgauaugggaaaagugagaaaggauauaccacaaugggaaccaucaaagggcuggaacgacuggcagcaagucccauuuugcagucaccauuuccaucaauugaucaugaaggacggaagagagauuguaguaccuugucgaaaccaagacgaacucguuggacgcgcaagggucagucaaggugcugguuggucucugcgugaaacggccugccuaggcaaaucauacgcgcagauguggcaguuaauguacuuccauaggagggauuuaagguuagcagcuaacgcuauaugcagcgcuguaccagucgauuggauucccacgagcagaacaacauggaguauacacgcucaucaucaauggaugacaacggaagacaugcuaucggucuggaaccgagucuggauugaggaaaauccauggauggaggacaaaacccacauaucaucauggggagaugucccguaucuggguaaaagggaggaucaauggugcggaagucuuaucggacucacugcaagggcaacuugggccacaaauauccaaguagcgauuaaccaggugcgacgccuaauuggcaaugaaaauuaccucgauuacaugaccaguaugaagagauucaaaaaugaaucugauccugagggcgcucuuugguaa

SEQ ID NO: 21935 - RNA, 9879 nt, Artificial Sequence
  derived and/or modified CDS sequence (opt6) from DENV-1__EU482491__SS-prME
uccguuaccauguuguugaugcucaugccaacugcacuagcuuuccaucuuacgacccguggaggagaaccucauaugauugugucaaaacaagaaagaggcaaaucucuauuauucaaaacuucagcggguguuaauauguguacguugauugcaauggauuuaggugaauuuugugaagauacuaugacauauaaaugcccucgaauuaccgaagcagaaccagaugacgucgacugcugguguaaugcgacagacacguggguaacauauggaacauguacacaaauuggugaacauagacgagacaaacgaaguguagcccuagcaccucacgugggacuggguuuagaaacuagaaccgaaacauggaugucuucggaaggagcguggaaacaaauucaacgcgucgaaacaugggcuuuacggcauccaggcuucacaguaauagcauuguuuuuagcacaugccauagguacauccauaacacagaaagguaucauuuucauacucuuaauguuggcuacgccaucgauggccaugagaugcguaggaauuggaucccgagacuucguagaaggguugucaggcgcaaccuggguagacguuguacuugaacauggaucuugcguuacuaccauggccaaagauaagccgacccuggauaucgaauuacuaaaaacagaaguaacaaauccugcaguacuacgaaaauuauguaucgaagcaaaaauaucuaauacaacuacagacucucgauguccuacgcaaggugaagcgacuuuaguggaagaacaagaugcaaauuuuguaugcagaagaacuuuuguugaucgagguuggggaaaugguuguggauuguucggaaaagguaguuuaauaaccugcgcuaaauuuaaaugugucacgaaauuggaaggaaagaucguucaauaugaaaaccugaaguacagcgugauuguuacuguacacacuggagaucaacaucaaguaggaaaugagucuacugagcaugguacaauugcuacuauaacuccgcaagcgcccagcacagagauacaacucacagacuauggagcuuuaacauuagacuguaguccgagaacagggcuagacuucaaugaaaugguccucuuaacaaugaaggagaaaaguugguuaguacacaagcagugguuucuggacuuaccauugccguggacaucuggggccagcacuucgcaagaaaccuggaauaggcaagauuuacugguuaccuuuaaaacugcacacgccaagaaacaagagguaguaguauuagggagccaagaaggugccaugcacaccgcacugacuggagccaccgaaauacaaacgagugguacuaccacaauauuugcaggacacuuaaaauguagauuaaaaauggacaaacuaacucuaaggggaaugucuuaugucaugugcacgggaaguuuuaaacuagaaaaagaagucgcagagacacagcacggaacaguuuuaguucaaauaaaauaugaaggaacagaugcacccuguaaaauucccuuuucuacacaggaugaaaaaggagugacacagaacggccgauugauuacagccaacccuauuguaacagacaaggaaaaaccaguuaauaucgaggcggaaccaccguuuggggaaagcuauauuguuauuggagcuggugagaaagcccuaaaacuaagcugguuuaagaagggcuccagcauaggaaagauguuugaagcuacggcaagaggugccagacgaauggcgauauugggagauaccgcuugggauuucgggagcaucggagguguauucacgucaguuggaaaguuagugcaccaaauauuuggaaccgcauauggcgugcuuuucucuggcguaucauggacuaugaaaauagguauuggaguacuucuuacaugguuaggccuuaauucaagauccacaagccuaucaaugacauguaucgcaguaggauuaguuacacuauaccuuggagucaugguccaagccgacaguggaugcguuauaaacuggaagggucgagagcuaaagugugggucgggcauuuucguuacuaaugaaguucauacauggacugaacaauauaaguuucaagccgacucuccgaaaagacugagcgcagcuauaggcaaagccugggaggaaggaguaugugguauuagaucagcgacaagacuugaaaauauuauguggaaacaaauaucgaaugaacugaaucauauucuauuagaaaaugauaugaaguuaacaguaguuguaggagauguagcaggcauccuagcccaaggcaagaaaaugauucguccccaaccaauggaauauaaauauagcuggaaaauaugggguaaagcgaaaaucauuggugcagauguccagaauacaacauucauuaucgaugguccgaacacgccagaauguccagacgaucaaagagcauggaacauaugggaaguggaagacuacggauuuggcauauuuacgacuaauauaugguugaagcuaagagauaguuauacgcagguaugcgaccaucguuuaaugucagcggcgauaaaagauucaaaggccguucaugcagacauggguuauuggaucgaaagcgagaagaacgagacauggaaauuggcgcgugcgucuuuuauugaggucaaaacuuguauauggccgaaaagucacacauuguggucaaacggaguguuagaaucggagaugaucauuccaaaaaucuaugguggcccaaucagucaacacaauuacagaccgggauauuucacccagacagccggaccauggcaucuagggaaacuugaacuagauuucgaccuuugcgaaggaacgacuguaguuguugacgaacauugugguaaccguggaccuucacuacgcacaaccacagucacuggaaaaauaauucacgagugguguugucgaucauguacacuaccaccucuaagauucaagggagaagacgguuguugguauggaauggaaauacgaccaguaaaagaaaaagaagaaaacuuaguuaaaucuaugguuagugccgggaguggagaagucgauucuuuuagucuuggcuuacuuugcauaucuaucaugauagaggagguaaugagaagucgauggagcagaaaaauguugaugacaggaacuuuggcgguauucuuucuuuuaauuaugggucaguuaacauggaaugauuuaauacgauuaugcauuaugguaggcgcaaaugcaagcgacaggaugggaaugggaaccacguaccuagccuuaauggcgacuuuuaaaaugagaccgauguucgcagucggauugcuauuucgaagacuuacaaguagggaaguuuuacucuuaaccauuggacuaucguuaguggcgucagucgagcuacccaauagccuagaagaacugggagacggacucgcuaugggaauaaugauacucaaacuucuaacugacuuucaaagccaucaauuaugggcuacacucuuaucacucacuuucaucaggaccacauuuaguuuacauuacgcauggaagaccauggcaaugguauugucgauaguuagucuauuuccauugugcuuaaguaccacuucacagaaaaccaccugguuaccaguacuuuugggcagucuaggaugcaaaccauuaacaauguuccuuauagcagaaaauaaaauuuggggaagaaaaucauggcccuuaaaugaggguauaauggcagucggcauaguaucaauauuacugaguucauuauugaaaaacgacguaccccuagcaggaccacugauagccggugguaugcuaauagcuugcuauguuaucucaggaucaucggcugauuuaucauuagaaaaagccgcagaagucucuugggaagaagaagcugagcacucuggcgccucgcauaacauucuggucgaaguucaagaugacggaaccaugaaaauaaaagacgaagaacgggaugacacccuuacuauauuacuuaaagcaacauuauuggcaguaaguggugucuacccauuaucuauuccugcgacucuuuucguaugguauuucuggcagaagaagaaacaaaggagcgguguccugugggacaccccuuccccuccagagguagaaagagcuguucuugaugacgggauauaccgcauuaugcaaagaggacuacuaggacgaucgcaaguugguguuggaguauuccaagaaaacguauuucauacaauguggcacguaacaaggggugccguacugauguaucaagggaaacgauuagaaccaucaugggcuucaguaaagaaagaucuaauaaguuacggcggagguuggagauugcaagguucauggaacacaggugaagaaguucaagucauagcgguagaacccgguaaaaauccuaaaaacguccaaacugcuccaggaacauucaaaacuucagaaggugaggucggugcaauagcauuagauuuuaaaccaggaacaucaggaucgcccauuguaaaccgagaaggaaaaauuguaggucuauacggaaauggagucguuacuacgucaggcacguacguuucggccaucgcacaagcgaaagcaagccaagaagggccauugccagagauugaagaugaaguguuuagaaaaagaaacuugacuaucauggaccuacacccgggcucaggcaaaacuagacguuauuuaccagcuauaguacgagaagcuaucaaacguaggcuaagaacucucauauuagcuccuacuaggguggucgcgagugagauggccgaggcacugaaagggaugccgaucagauaccagacaacagcugugaaaucggagcacacggggaaagagauaguugacuuaaugugucacgcgacauucacgaugagauuauuaucgccaguacgcguuccuaacuacaacaugaucauaauggacgaagcacauuuuacagacccgucaucgauugccgcgagaggauauauaagcacaagaguagguaugggagaggccgccgcuauauucaugacugcuacaccaccuggcucaguugaagcauuuccccagaguaaugcuguuauucaagacgaagaaagagauaucccagaaagaaguuggaacagugguuaugaauggauuacagauuuuccggguaaaacaguaugguuugucccuaguauuaaguccgguaaugacauagccaacugucuuaggaaaaacggaaaaaggguaauccagcuaucacgaaaaacuuuugacacggaauaucaaaagaccaaaaauaaugauugggacuauguagugaccacagauauaagugagaugggggccaauuucagagcagaucguguaauugauccgagaagauguuuaaagccggucauacuuaaagacggucccgaaagagucauacuugcugggccgaugccaguuacgguagcgucagcugcgcaaagaagggggcgaauagguagaaaccauaacaaagagggagaucaauacauauauaugggucaaccuuuaaauaaugaugaagaucacgcucacuggacugaagccaagauguuauuagacaacauaaauacaccagaaggaauaauaccagcacuuuucgaaccugaacgagagaaaagcgcagcuauagauggcgaguauagauugagaggugaggcaagaaaaacuuuugucgaauuaaugaggaggggagacuugccuguguggcugucuuacaaaguggcaagugaaggauuccaauacuccgauagacguuggugcuuugauggugagcgaaacaaucaaguacuggaagaaaauauggacguugagaucuggaccaaagaaggagagaggaagaaauuacgcccacgauggcuagacgcaaggacauacagugacccauuagcacugagagaauuuaaagaguucgcggcgggacgccggucagugucgggagacuugauuuuagaaauaggaaaauuaccacaacaccucacacaacgagcucaaaaugcacuagauaaccugguuaugcuacauaacucugaacaaggcggucgagcuuaccgccaugcaauggaagaguuaccugacaccauagaaacucuuauguuacucgcucuuaucgcgguacuuacaggaggagucacacuauucuucuuaucagggagaggucuggguaaaaccucgauuggacuuuuauguguaauggcgucauccgugcuauuauggauggcaucaguugaaccacacuggaucgcagcuucaauaauccuugaguucuuucuuaugguuuugcuuauuccugagccagacagacagagaacaccacaagacaaucagcuggccuauguaguaauagguuuacuauucaugauuuuaacuguugcagcaaaugaaaugggguuacuggaaacaacuaagaaagaccuaggcaucggccauguugccguagaaaaucaucaucaugcugcaaugcuugacguugauuuacacccagcgucagcguggacacuauaugcaguagcaacgacaaucauaacgccaaugaugaggcauacaauugaaaauacuacggcaaacauaucacuuacggcaauagcuaaccaagcggcuauucuuaugggccuugauaaggguuggcccauaucaaagauggauauaggugugccucugcuggcacucggcuguuauucucaggucaauccucugacgcugaccgcagcagugcuaaugcugguagcacauuacgcaaucauugggccaggucuucaggcuaaagccacccgagaagcccaaaaacgaacugcugcuggaauuaugaagaaccccacaguagacggaauugucgcgauugacuuagauccagugguauaugacgccaaauuugaaaaacaguugggacaaauaauguugcugauacuuuguacuucucaaauauuacuaaugaggacgacuugggcacuaugcgaaucuauaacacuagccacaggaccuuuaacgacguugugggaagguucucccggaaaauucuggaacaccacuauugcuguuucgauggcaaauauauuccgcgggagcuauuuggccggugcgggacuagcguuuagucuaaugaagucuuuagggggaggccgucgcggaacaggagcucagggagaaacguuaggagaaaaauggaaaaggcagcucaaucaauuaaguaagagcgaauuuaacacauauaaaagaagcggaauuauggaaguagaucguagugaagcaaaagaaggacuaaaaagaggugagaccacuaaacaugcaguaaguagaggaacagcuaaauuaagaugguuugucgaaagaaacuugguaaagccugaagguaaaguuauagaucuugggugcgguagggguggauggagcuauuauugcgcgggucuuaaaaagguuacagaaguaaaggguuacacgaagggaggcccgggacacgaggagccgauacccauggccacuuacggauggaacuuggugaaacuacauagcggaaaagauguauucuuuauucccccugaaaaaugugauacacucuuaugcgacauaggagaauccucuccuaauccaaccauagaagaaggacgcacguuacguguacuaaaaaugguugaaccuuggcuccggggcaaccaguucugcaucaaaauauuaaaucccuauaugccaagcgucguugaaacucuagagcaaaugcaaagaaaacacggaggaaugcuugugaggaauccacugagccguaauaguacccaugaaauguauuggguaucuugugguacuggaaauaucguuucagcaguuaacaugacuucucgaauguuacugaauagguuuacaauggcacauagaaagccuacguacgaaagagacguagaccucggagcugguacaagacacguagcgguagaaccagaaguagccaaucucgacauaauagggcagagaauagagaauauaaaacacgaacauaaaucuacauggcauuacgaugaggauaacccguacaaaacaugggcauaccauggcaguuaugaaguuaagccuucggguucagcaucuaguauggugaacggugucguaaagcuacuaacuaaacccugggacgucauuccuaugguaacgcaaauugcgaugaccgauacaacaccauuuggccaacaacgaguauuuaaagagaaagucgauacacguacucccaaggcaaaaagagguacugcacagauaauggaggucaccgcuaaauggcuauggggauuccuuucacgaaauaagaaacccagaauaugcacaagagaagaguucacgcggaaaguacgcagcaacgcggcuauaggugcgguuuuuguagaugaaaaucaauggaacucugcuaaggaagcaguggaagaugaaagauuuugggaucuaguacauagggagcgagaacuucauaagcaagguaaaugcgcuaccugugucuauaauaugauggggaaacgcgagaagaaacucggugaguuugguaaagcuaaaggcucaagagccauuugguacaugugguuaggcgcuagauuucuagaguucgaggcacugggauuuaugaaugaagaccacugguucagucgagaaaauagccuuaguggaguagagggugaaggacuacauaaguuaggcuacaucuuaagagacauuagcaaaauacccggaggcaauauguaugcagacgauaccgcaggcugggauacgagaauuacagaagacgauuugcaaaaugaagcaaaaauaacggauaucauggagccagaacaugcauuacucgcaaagucuauauucaaauugacauaucagaacaaaguagucagaguacagcguccagccaaaaacggaacaguuauggacgugauuaguagacgggaucaaagaggaagcggccagguagguacauauggccuuaauacuuuuacaaauauggaagcucaacuuauaaggcaaauggaauccgagggaauauuuucaccuagcgaacuagaaacuccgaauuuagcuggucgggugcucgacuggcuagaaaaacacgggguugaacgucuuaaaagaauggccauaucaggagaugacuguguggucaaaccaauugaugauagauucgcuacagccuuaacagcguuaaaugauauggguaagguuagaaaagacauaccacaaugggagccuucaaagggauggaaugauuggcaacaagugccuuucuguucccaccacuuucaucaacuuauaaugaaagauggaagggaaauuguagugccauguagaaaccaagaugaacucgucggaagggccagaguuucccaaggagcagguuggucgcugagagaaacagcuugucuugggaaaucauaugcgcaaauguggcagcugauguacuuucaccggagagaucuaaggcucgcggcuaacgccaucuguucagcugucccuguggacuggguuccuacgagccgcacgacuuggucuauacacgcacaucaccaauggaugacuacagaagacaugcucaguguauggaaucgagucuggauagaggagaaucccuggauggaagacaagacacacguuaguucauggggcgacgugccguauuuagguaagcgcgaagaccaauggugcgggucacucauaggauuaacagcucgugcaacaugggcgacaaacauccaaguagcgaucaaccaaguuaggcgauuacuagguaaugagaauuauuuagauuauaugacaaguaugaagcgguuuaaaaacgaaucugaucccgaaggcgcucuaugguga

SEQ ID NO: 21936 - RNA, 9879 nt, Artificial Sequence
  derived and/or modified CDS sequence (opt6) from DENV-1__EU482493__SS-prME
ucugugacaaugcuucuuaugcuuaugccgacagcauuggcuuuccacuugaccacacgggguggggaaccccauaugauuguuaguaaacaggaaagaggaaagagcuuacuauuuaaaacauccgcugguguuaauaugugcacucuuauugcgauggacuuaggugaauuaugcgaagauacgaugacauauaaaugcccacgcauaacagaaacagaaccugaugauguggauugcugguguaaugcaacagauacauggguaacguacgguacaugcucacaaacuggggaacacagaagagauaagcguucaguagcucuagccccucauguaggauuagguuuagaaacuaggacagaaacuuggaugagcagcgaaggggcauggaagcaaauacaaagaguugaaaccugggcacuacgccacccagguuuuacaguaauagcucuauuucuugcgcaugcgauaggaacaaguauaacccagaaaggaauuauauucauucuucuaaugcucgugacaccgucaauggcgaugcgcuguguaggaauaggaagcagagacuuuguugaaggucuuucaggcgccacguggguagaugucguauuagaacauggaaguugcguaaccacgauggccaaagacaagccgacccuagacauagaauuguugaaaaccgaagugacuaauccggccgugcuaaggaaacuuuguauugaagcuaaaauaucaaauacaacuacagauucaagaugucccacacaaggagaagcgacccugguagaagaacaagaugcaaauuuuguauguaggcgaacauucguggaccgugguugggggaacggaugcgggcuauuuggcaaagguucacuuaucacaugugcgaaauucaaguguguaacaaaauuagaaggaaaaauaguccaguaugaaaaccuaaaauacagugugaucguuaccgugcauacaggugaccaacaucaagugggcaaugaaucuacggaacacgguacgacugcuacuaucacaccgcaagcgccaacaacggaaauacaguuaacagauuauggugcucuuacucuagacuguucaccucguacaggguuagacuuuaaugaaauggugcuccucacuaugaaagaaaagucauggcugguacauaaacaaugguuuuuagaucugccacuaccguggacgagcggugcaaguaccucucaagaaacauggaauagacaagacuuauuagucacguucaaaacggcgcaugcaaagaaacaagaaguggucguucuagguagucaagagggugccaugcacacagcacuuaccggagcaacugaaauacaaacaucuggaacaaccacuaucuucgcugggcauuugaagugucgacuuaaaauggauaaauuaacauuaaaggggaugucuuaugugauguguacugguaguuuuaaacuugaaaaagaacuggcagaaacacaacacggcacaguguugguccaaauuaaauacgaaggaacugaugcaccaugcaaaauucccuucagcacacaagaugaaaaaggcguuacacagaauggaagacuaauuacagcuaaccccauaguaacugauaaggaaaaaccaguaaacauugaagcagagccaccguuuggugaaucauauauugucauaggcgcuggggaaaaagcacuaaaacuuucgugguuuaagaaaggaucaucaauuggcaaaauguucgaagcgacugcaagaggagcaaggcgaauggcaauuuuaggugacacggcaugggacuucgguucuauaggagguguauuuaccucgguugguaaacuuguacaucaaauauuuggcacggccuacggaguacuauuuucuggggugucauggacgaugaaaauuggaauaggagugcuauuaacaugguuaggauugaacucuaggucaacuagccucagcaugaccugcauagccgucggucuaguaacccuuuacuuaggagugaugguacaagcugauagcgguugcgucauaaacuggaaggguagggaacuaaagugugggagugguauauuugucacaaacgaaguacacacauggacugaacaguauaaauuucaggcagacucuccuaagcguuugucagcugccauaggaaaagccugggaggaaggggucugcggaauccggagcgcuacgaggcuagaaaacaucauguggaagcaaauuagcaaugagcuuaaucacauauuacuagaaaacgauaugaaauuuacggugguggucggagacguagcaggaauacuggcacagggcaagaaaaugauaaggccucaaccaauggaacacaaguacaguuggaagucgugggguaaagcaaaaauaaucggagccgauguucaaaacacgaccuucauaauagacgguccaaacacaccagaauguccagacgaucaacgugccuggaacauaugggaaguggaagauuacgguuuugggaucuuuacuacaaauaucugguuaaaacuucgugauucauacacacaaguuugugaucacagauuaaugagugcugcuauaaaagacucaaaagcaguccaugcagacaugggauauuggauagagucggagaaaaaugagacuuggaaauuggcacgagcauccuuuauugaagucaaaacgugcauuuggccaaaaucccacacacuauggucuaauggcguccucgaauccgaaaugaucauaccaaaaauauacgguggaccaauaucucaacauaauuauagaccuggauauuucacccaaacagcaggcccuuggcacuuggggaaguuagaauuagacuuugaccuaugugaaggcacaaccguaguaguagacgagcauugcgggaauagggguccaucuuuacguacgacuacagucacuggcaaaaucauccacgaaugguguugcagaucaugcacauuaccaccauuacgauuuaggggagaagauggcuguugguaugggauggaaauuagaccaguuaaggaaaaagaagaaaaccuaguuaaaucuauggugagcgcuggcaguggcgaggucgauaguuuuagcuuaggcuuacuuuguaucucgauaaugauagaagaagugaugaggagccgauggucgagaaaaaugcuuaugaccggaacacuugccgucuuuuucuuguuaauugugggucaacugacguggaacgauuugauacgccugugcauuaugguuggagcaaacgcgagcgacagaauggggaugggaaccaccuacuuagcgcucauggcaacguuuaaaaugcgaccaauguuugcuguaggacuucucuuuagaagauuaacaucgagagaggucuuacuauugacuauagguuuaucacucguagcauccguagaacucccuaauucuuuagaagaacuaggugacggacuggcuaugggaaucaugaucuuaaaauuacucacagacuuccaaagucaucaguuaugggcuacgcuauuaucccucacauucauaaagacuacauuuagcuugcauuaugcauggaaaacgauggcaaugguacucucgguagucucacuuuuuccauugugccuauccacaacaucucagaagacgacuugguuaccaguauuacuaggaagucuaggauguaaaccgcucacgauguucuuaaucgcugagaauaaaauuuggggucgucggucuuggccacugaaugaaggcaucauggcaguagguauaguuucuauccuguugaguucauuguugaaaaacgauguaccacucgcgggacccuuaauagcaggaggaaugcugauagcauguuacguaaucagugguuccucugcugaccuuucucuagaaaaagcagccgaggucaguugggaagaggaagcagaacacucaggcgcgucacauaacauccuuguugagguacaggaugacgguacaaugaaaauuaaagacgaagaaagagaugauacuuuaacgauucuccuuaaggcgacacuacuggcuguaucaggcguauacccuuuaagcauuccagcaacccuuuucgucugguauuuuuggcagaaaaagaaacaacgaucaggaguucuuugggacacaccaagcccgccagaaguugagagagcaguacucgacgaugguauuuacagaaucaugcaacggggauuauuaggacguagucaaguggguguaggaguauuccaggaaaauguauuccacacgauguggcacguaacucgcggagccguauugauguaccaaggaaaacggcuagaaccauccugggcaucggucaagaaagauuuaauaucuuauggaggaggauggagauuacaagggucuuggaauacuggugaagaaguacaagugauugcaguugaaccaggcaaaaauccgaaaaaugugcaaacagcucccggaacguucaaaacaccugaaggugagguaggugcgauagcucucgauuuuaaaccaggaaccucgggaagcccgauagugaacagagaaggaaagauugucggccucuaugggaaugggguaguaaccacaagugguacuuauguaagugcaauagcacaggcaaaggcaagccaagaaggaccucugcccgaaauagaagacgaaguauuucgcaaacguaaucuuaccauaauggaucugcacccugguuccggaaaaacuagaagauaccuaccagccauuguucgagaagcaauuaagagaaaauuacgaacuuugauacucgcacccacaagaguuguagcaucugaaauggcagaagcauugaaagguaugccuauuagguaucaaacaacagcuguaaaaagugaacauacagggaaggagauuguagacuuaaugugucaugcuacuuuuacaaugagacuucuaaguccgguucguguaccuaacuacaacaugauaauaauggacgaggcucacuuuacugacccaaguucuauagcagcacgaggguauauuucuacgagaguuggcaugggagaggcugccgcuaucuuuaugaccgcuacaccaccgggaucuguggaggcuuuuccacaaaguaaugcaguuauacaagaugaggaacgagacauaccugaacggagcuggaacuccggauaugaguggauaacugacuucccaggaaaaacagucugguuugucccgucuaucaaaucugguaaugauauagccaauugcuugcgaaagaaugguaaaagagucauacaguuauccagaaaaacauucgacacagaauaucagaaaacgaaaaacaacgauugggacuauguaguaacaaccgauauuucagagaugggagcaaacuuuagagcugaccgggucaucgauccccgacgcugccuaaaacccguaauccuaaaagacggcccagaaagaguuauacuagcugggccuaugccagucacaguagcaucagcagcacaacggagagggcgcauagguaggaaucacaauaaagagggugaucaguacauuuauaugggacagccacuaaacaaugaugaagaucaugcccacuggacugaagcgaaaaugcuccuagacaacaucaacacaccagaggguauuauaccagcauuauucgaaccggaaagagaaaaaucagcugccaucgauggggaauacagauuaagaggagaagcgcguaaaacauuuguagaauuaaugaggagaggcgacuuaccaguaugguugucguauaagguagcauccgagggauuccaguauucugauagaagaugguguuuugacggugaaagaaacaaccagguacuugaggaaaauauggauguggagauauggacaaaggaaggagagcguaagaaacuuagacccagauggcucgacgcgaggaccuacucugacccauuagcgcuuagagaguucaaagaauuugcagcuggcaggcguucaguuaguggugaccuuauacuagagaucgguaaacuaccgcaacaucuaacccagagagcccaaaaugcucuggacaauuuaguuaugcuucauaacucagaacaaggagguagggcuuauagacacgcaauggaagaauuaccugauacaaucgaaacacuuaugcuacucgcccuuauagcaguauuaaccggagguguaacacucuucuuccucucagggcgaggucuugguaagacgucgauugggcuacucugugugauggcgaguaguguacugcuauggauggcaaguguugaaccacauuggaucgcagcaaguauuauauuggaguucuuccuaaugguccuuuugauucccgaaccagaucgccaaaggacuccucaggacaaccaacuggcguaugucgugauugguuuguuguuuaugaucuugacugucgcggcuaacgaaaugggauugcuugaaacgacuaagaaagauuugggaauuggccaugucgccguagaaaaucaucaucaugcagccaugcucgauguagaucuacauccagcaucagcauggaccuuauaugccguugcaacaacuauaauuacaccaaugaugagacacacuaucgaaaacacgacugccaacaucagcuuaacggccaucgcuaaucaggcagcgauccuaaugggacuagacaaagguuggccaauuucuaaaauggauauaggugucccguuguuagcacuaggaugcuacagucaaguuaauccacuaacauugaccgcagcaguuuuaauguuaguagcucauuaugcgaucauaggaccaggguuacaggcgaaagcuacaagagaagcacaaaaacgcaccgcugcuggaauaaugaaaaaccccacaguggauggcaucguugcgauugacuuagacccgguaguauaugacgcgaaauuugaaaaacaauugggacaaaucaugcuauugauuuugugcacgucgcaaauccuacuuaugaggaccacaugggcuuugugcgaaagcauuacacuugcaacgggaccccucacaacgcuaugggaagggaguccaggcaaauuuuggaacacuacuauagcagucaguauggccaauauauuucgugguucauaccuagcuggugcaggacuugcauucagccuaaugaaaucccuuggagggggucgaagaggaacaggagcucagggagagacucuaggcgaaaaauggaaaagacagcugaaccaacugucaaaauccgaauuuaauacauauaagaggaguggaaucauggaaguagauagaucagaagcuaaggagggccuaaaaagaggugaaacuacaaaacaugcgguaucccgaggaaccgcaaaacucaggugguuuguugagagaaauuugguaaagccugaaggaaagguaauugaccucggauguggaagagguggcuggucauacuauugugccggacuuaaaaagguaacagaaguaaaaggguauacaaaaggcgguccuggacacgaagaacccauucccauggcuacguacggauggaaucuagucaaauugcauuccggaaaggauguauucuucauaccuccggaaaaaugcgauacacucuuaugugauauaggggaaucaaguccaaacccuacuauugaggaaggaaggacacuccggguacuaaaaaugguagaaccauggcuacgagguaaucaguucuguauuaaaauucuaaacccuuacaugccgagcguaguugaaacccucgagcagaugcaacgaaaacauggagguaugcugguucggaacccccugaguagaaacucuacucacgagauguauugggucucaugcgguacaggaaauaucguuucagcuguaaauaugacgagucgcauguuacuaaaucgcuuuacaauggcucaccgcaaacccacauacgaacgcgauguagaucuaggugcaggaacacgucauguggccgucgaacccgaaguagcuaacuuagauaucauaggucaaagaauugaaaauauuaaacacgaacacaaaaguaccuggcauuacgaugaagauaauccauauaaaacaugggcauaucacgguucuuacgaaguuaaaccgagcggaucugcgucaaguaugguaaauggaguuguaaaacuucugacgaaaccuugggauguaauuccuauggucacucagauugcaaugacagauacaaccccuuucggacagcaaagagucuuuaaggagaagguugauacuagaacgccaaaagcgaaaagggguacagcucaaauuauggaaguaacugcaaaauggcucugggguuuccuaucgcgaaacaagaaaccacgaauaugcacucgagaagaguuuaccagaaagguacgcucaaaugcugcaauuggcgccgucuucguugacgagaaucaauggaacucggcaaaagaagcugucgaggaugaacgguuuugggauuuaguucacagagaaagggagcuucauaagcaagggaaaugcgcuacauguguguacaacaugauggggaaaagggaaaagaaauuaggagaguucggaaaagcgaaaggaucgcgagcaauuugguauauguggcuaggugcccgauuccuagaguucgaggcuuuggguuuuaugaacgaggaucacugguuuaguagagaaaauucgcuaaguggaguagaaggagagggcuuacacaaacugggauacaucuuaagagauauaucaaaaauacccggggguaacauguaugcugacgauacugcgggaugggacacucgcauaacggaagaugaccuacaaaacgaagcccguaucacagacauaauggaaccugaacaugcacuucuggcgaagucuauuuuuaaauugaccuaccaaaacaagguuguacgaguucaacgaccagcgaagaauggcacggucauggacgugauaucaaggcgcgaucagcguggaucaggacaaguagguaccuacggucuaaacacauuuacaaacauggaagcccaguuaauacgacaaauggaaagcgaaggaauuuucaguccuucggaauuagaaacuccaaaccuugcagagaggguucuggacuggcuagagaaauauggaguagagcgcuugaaaagaauggcuauaaguggagacgauugcguugucaaaccuauagaugauagauuugcaacggcccuaacagcccuaaaugacaugggaaaggucaggaaggauauuccgcaaugggaaccuuccaaaggguggaaugauuggcaacaagucccuuuuuguucucaucacuuccaucaacugauaaugaaagauggcagagaaauaguagucccaugcagaaaucaagaugaauuaguaggaagggcgagaguaucucaaggagcggguuggaguuuacgagaaacggcauguuuggggaaaaguuacgcucagauguggcaauuaauguauuuccaccgucgcgaccuacggcuagcagcuaaugcuauauguucggcuguucccguagauuggauaccuaccucucguacaacuuggaguauucacgcucaucaucaauggaugacgacagaagauaugcuuagcguauggaauagagucuggauagaggaaaauccauggauggaagauaaaacacauauuucaucauggggagacgugccguaccugggaaaaagagaagaucaguggugcggcucgcuaauaggauuaacugcuagagcgacgugggcaacuaauauacaaguggcuauuaaccaaguccgacgauugauuggaaaugaaaauuauuuagauuacaugaccagcaugaagagguuuaagaaugaauccgaucccgaaggugcccuaugguag

SEQ ID NO: 21937 - RNA, 9879 nt, Artificial Sequence
  derived and/or modified CDS sequence (opt6) from DENV-1__EU482494__SS-prME
ucagucacgaugcuuuuaauguuaaugccuacagcauuagcguuucaccuuacaacaagaggaggagaaccccauaugauugucagcaaacaagaacgaggaaaaucacuucuauuuaaaaccagcgcaggagugaacauguguacccuaauagcgauggacuuaggagaacuaugcgaagauacgauuaccuauaaaugcccaagaauaacugaaacggaaccagaugacguagacuguugguguaacgcuacagauaccugggucacauacggaacuuguucccaaacaggggaacaccgaagagauaaacgaagcguugcacuagccccacacguaggguuaggcuuagaaacgagaacagaaacguggaugucgucugaaggagccuggaaacaaauucaaagaguagaaacuugggcacuaagacacccuggauuuacuguaauagccuuauuuuuggcacaugcaauuggcaccucgaucacucaaaaaggaauaauauucauucuucuaaugcuagcgacucccaguauggcuaugcgaugcguuggaauugguagcagagacuuuguagaagggcucucaggugccacauggguagauguaguccuagaacacggaaguuguguaacuacaauggcaaaagacaaaccaacauuagacauagaacugcugaaaacugaaguaacgaacccugcaguauugaggaaacuauguauagaagccaaaaucagcaacacaacuacagauucaagguguccgacccaaggugaagcaacauuaguugaagaacaggaugcgaauuucguuuguagacggacauucguugacagagguugggggaauggguguggccucuuuggaaaagggagucuaaucacaugcgcuaaauuuaaauguguaacgaaguuggaagggaaaaucguucaguaugaaaacuuaaaauauaguguaaucguaacaguucacacaggugaucaacaccaaguaggaaaugaaucaacagaacacgggaccacagcaacuauaacaccacaagcuccaacuacagaaauccaacuuacugauuacggagcacuaacauuagauuguuccccaaggacaggguuagauuuuaaugagaugguccuucuuaccaugaaggagaaaaguugguuaguacacaaacagugguuucucgauuugccccugccauggacaaguggcgcaaguacuucgcaagaaacauggaaccggcaggaucuauuaguuacauucaaaacagcacacgccaagaaacaagaaguaguaguacucgguucucaagagggcgcgaugcauaccgcacuuacaggagccacagagauccaaacauccggcaccacaacuaucuucgcaggccaccucaaauguagacuuaaaauggauaaacuuacgcuacgggguauguccuauguaauguguacuggcaguuuuaaacuagaaaaagaagucgccgaaacacaacacggaaccguacuuguacagauuaaauacgaaggcacagaugcaccuugcaaaauccccuucucaacgcaagaugaaaaaggaguuacacaaaauggacgauugaucacugccaauccgauaguaacagacaaagaaaaaccagugaauauagaagccgaaccacccuucggagaaaguuacauaguaauuggggccggggagaaagccuuaaaacuuucuugguucaagaaaggaagcuccauugguaagauguuugaggcaacagcucgcggggcgagaagaauggccauccuaggagauacggcuugggacuuuggaucaauuggcggaguguucacguccgugggaaaauuaguucaucaaauuuuuggaaccgcauacgguguauuauucagugguguuucguggacaaugaaaauaggaauaggcguauuguuaacuuggcugggccuuaauucuaggagcacaagccuaucgaugacuuguauugcaguagggcuaguaacucucuauuugggaguuaugguucaagcagauaguggaugcguuauaaacuggaaaggaagagagcuaaaaugcggauccggaauauucgugacgaaugaaguucauacguggacagaacaauauaaauuccaagcggauucgcccaaaagauuaucggcggcuaucggaaaggcuugggaagaaggcguaugcgggauucgaagcgcuacacggcucgagaacaucauguggaagcagauuaguaaugaauuaaaucacaucuuacuagaaaacgacaugaaauucacuguagucgucggagacguggcaggaauacuugcacagggcaagaaaaugauacgaccucaaccaauggaacauaaauacucuuggaaaaguuggggcaaagcuaaaauaauaggugccgauguacaaaauacaacauuuauuaucgacgguccaaacacaccagaaugcccagacgaucagagagcauggaacauaugggaaguugaagauuacggauucgguauauuuacaaccaacaucuggcuuaaguugagagauucguauacucagguuugugaccaucgacucaugagcgcagcaauaaaagauucaaaggcgguucacgcugauaugggauauuggauagagagcgagaaaaaugaaacauggaaacuugcaagagcuucauucaucgaaguaaaaacuuguauauggccuaaaagucauacacucugguccaacggcguguuagagagcgagaugauuauacccaaaauauacggcgggcccauaucucaacauaauuauaggccuggauacuuuacgcaaaccgcagguccauggcaucuaggaaaacuugaguuagauuucgaccuaugugaggggacaacuguaguaguugaugaacauugcgguaacagaggucccagucuaagaacuacaacaguuacagggaaaauaauucacgaauggugcuguaggaguuguacacugccuccauugagguuucggggcgaagauggauguugguauggaauggagauacgucccgugaaagaaaaggaggaaaaucuuguaaaauccaugguaagcgcaggcucaggagaggucgacagcuuuucauugggauuacucuguauuucaaucaugauagaagaaguaaugcgaagucguuggucucgaaaaaugcuuaugacgggaacguuggcaguuuucuuccuuuugauuaugggucaguugacguggaaugacuuaauaagauugugcauaaugguaggcgcaaaugccucugaucguauggguauggguacuacuuaucuugcgcuuauggccacauuuaaaaugagaccaauguucgccguuggacuucuuuuucgaaggcuuacaucgagagaaguauuauuacugacgaucggacucagcuugguagcaucuguggaauuacccaauucacuagaagaguuaggugacggauuagcgauggggauaaugauucucaaauuauuaacggauuuccaaucacaucagcugugggcuacucuuuugagccucacuuuuauaaagaccaccuucagucuacauuacgcuuggaaaacuauggcaaugguccuuucuauugugucacuauucccuuuaugcuugaguacaacaucccagaaaaccacaugguuaccuguauuauuggguagucuugguuguaaaccacugacaauguuccuaauugcagagaauaaaauuuggggacggcgaagcuggccucuuaaugaaggcauaauggcgguuggcauagugucaauucuucugucgucucuacucaaaaacgacguaccucuugcaggaccacuuauagcgggugguaugcuuauugcauguuauguuauaaguggguccagugcagauuuaucucuggaaaaagcagcggaagucaguugggaagaggaagcagaacacucaggugcuucucacaauauccuaguagaaguacaagaugacggcacaaugaaaaucaaagaugaggaaagagaugacacucuaacaauucuuuugaaagccacguuacuagcagugucuggugucuauccauuauccaucccggcuacacuauucguaugguacuuuuggcagaagaagaaacaaaggucagguguacuaugggauacuccuucuccuccagagguagaacgugcaguccuagaugacgguauauaucgaauaaugcagcgaggguuguuaggacgaucccaaguaggagugggaguuuuccaagaaaauguauuucacacaauguggcacgucacgcguggagcaguacucauguaucaggguaaaagauuagaacccaguugggccucgguuaagaaagaucugauaaguuacggagguggcuggcgguuacagggaucauggaacacaggcgaggaaguucaaguaauagcgguugaaccagggaaaaacccuaaaaauguccaaaccgcgccuggcacauuuaaaacuccagaaggcgagguaggggcuauugcucuagauuucaaaccugggacuuccggguccccaauaguaaaccgcgaggguaagauugucggacucuauggaaauggugugguaacuacaucaggaacuuacguuagugcuauagcccaagcuaaggcuucacaggaaggaccgcuaccugaaauagaagaugaaguuuucagaaaacggaauuugaccauaauggaccuccauccaggaagugguaaaacgcgacguuaucuucccgccauugugcgcgaggcaauaaaacgaaaauuaagaacgcucauacucgcuccgacaagggucguagcgagugagauggcugaagcgcugaaagguaugccaauaagguaucaaacaaccgcagucaagucggaacauaccggcaaagagauaguagauuuaaugugccacgccacuuuuacaaugcgacuccuuagcccaguucgcgucccaaauuauaacaugauaaucauggaugaagcgcauuuuacagaucccagcaguauagcggcaagagguuauauaucaacucgagucgggaugggcgaggcugcugccauauuuaugacugccacgcccccagggucaguagaggcguucccccagaguaaugcaguaauccaagaugaggaaagggauaucccagaaagaucauggaacuccggauaugaauggauaacugauuuuccgggaaaaacaguaugguucguaccuuccauaaagagugguaaugacauagcuaauugcuuaaggaaaaaugggaaacgcguaauacagcuaucaagaaagacuuuugauaccgaauaucagaaaacaaagaacaaugauugggacuaugucguuacaacagauauaagugaaaugggagcaaauuuucgggcagaccggguuauagauccacggcggugccuaaagccagugauacucaaggauggcccagaacgagucauucuagcugggccuaugccagucacgguugcuucugcagcgcaacgacgagggaggauaggccggaaccacaacaaagaaggagaucaguauauuuauaugggucagccguugaauaacgacgaagaucaugcacauuggaccgaggcaaaaaugcuacuagacaauauuaauacuccagaaggaauuauuccagcguuauucgaaccugaaagggaaaagucagccgcuaucgauggggaauaucgacuuaggggcgaagcacgaaaaacuuucgucgaacuaaugagacgaggcgaccuaccagucuggcuaucuuacaaagucgcuagugaagguuuucaauauagcgaucggcgaugguguuuugauggagaaaggaauaaucaaguucuagaggaaaauauggacguagagaucuggacuaaagaaggcgaacgaaagaagcuaagaccuagaugguuagaugcacguacauauagugauccccuagcccuucgcgaauuuaaggaguuugcggcaggccgacguucuguuaguggagaccugauuuuagaaauaggcaaauugccgcaacaccucacacaaagggcucaaaacgcuuuagauaauuuagugaugcuucacaauuccgaacagggaggaagggcuuaucggcaugcuauggaggaauuaccagauacuauagaaacacucauguuacucgcacugauagcgguucuaacaggaggcguaacacuguucuuuuuaucaggacgagggcuugguaaaacaucgauaggucuacuguguguuauggcaucuagcguauuauuauggauggcuucuguugaaccccauuggauugcagcaucaaucauccucgaauuuuucuugaugguauuacuuauacccgaaccggacaggcaaagaacuccacaagauaaucaauuagcguaugucgugaucggauuauuguuuaugauccuaacggucgcugcuaacgaaauggguuuacuagaaacuacgaagaaggauuuggguauaggccauguagcagucgaaaaucaucaucaugcagcaauguuagauguagaucuucacccggcuagugcauggacuuuauacgcaguagcgacaacuaucauaaccccgaugaugaggcacacuaucgaaaacacgacggcgaacauaucuuuaacagcuauagcaaaucaggcugcuauccuaauggguuuggauaaaggcuggcccauauccaagauggauaucgguguuccguuauuagcauuaggauguuacagccaaguaaacccuuugacacugacagcagcuguauugaugcuuguagcacauuaugccauaauagggccgggucugcaagcaaaggcuacaagggaggcccagaaaaggacagcagccgggaucaugaaaaauccaacaguggauggaauuguugccauugaucuggauccaguaguuuacgacgcaaaauuugaaaagcaacuaggccagaucauguuacuaauccucugcacuucccaaauacuuuuaaugcguacaaccugggcauuaugugaaucuauuaccuuggcuacaggcccgcuaacgacuuuaugggaaggaucaccaggcaaguucuggaacaccacuauagcggucucaauggcaaauaucuuuagaggaaguuaucuggcaggggcaggacuagcauucagccuaaugaaaagucuuggagggggacgaagagguacaggagcacaaggagaaacacuaggcgaaaaguggaaaagacagcugaaucaauuaucaaaaagcgaguucaauacauauaaacgguccgggauaauggaaguagauaggucggaagccaaagaaggcuugaagcgaggcgaaacaacuaaacacgcaguuagcagaggcacggcgaaauugcggugguucguggagcgaaaccucgugaaaccagaaggaaaggucauagaccugggcuguggccggggcgguugguccuacuacugugcuggccuuaagaaaguaacagaagucaaggguuauaccaaagguggaccaggacaugaagaaccuauaccuauggcuacauacggauggaaucugguaaaguuacauucagguaaagacguguucuuuauaccgccagaaaaaugcgauacacucuuaugcgacauaggagaaucuagcccaaacccuacgauugaagaaggaagaacucuacgaguacuaaaaaugguagaaccauggcucagaggcaaucaauucugcauaaagauuuuaaauccuuacaugccaucgguuguggaaacccuagaacaaaugcaaagaaaacaugggggaaugcuaguccggaauccuuuaucgaggaacuccacgcaugagauguauuggguaucaugugguacugguaacauaguaagcgcaguaaauaugacaaguagaauguuacuaaacagauuuacaauggcucaucguaagccaacguaugagagagauguugaccuaggagcagggacccggcaugucgcaguugaacccgagguagccaaucuagacauaauuggacaacgaauagaaaauauuaagcaugaacauaaaucaaccuggcauuacgaugaggacaaccccuacaagaccugggcauaucacgggucguacgaagugaagccuucaggaagcgcuuccagcauggugaauggaguagugaaguuguuaacaaaacccugggauguaaucccgauggucacccaaaucgccaugacagauacuacacccuucggucaacaaaggguauucaaagagaaaguagacacuagaacacccaaggcuaaacgaggaacggcgcaaauuauggaaguaaccgcuaaauggcuuuggggauuucucagcagaaauaaaaagccaagaaucugcacacgugaagaguucacucggaaggugcgcucaaacgcagcaauaggugcaguauuuguagaugagaaucaauggaacucagcuaaggaagccguagaggaugaacgauuuugggaucuuguccaucgagaaagagaguuacacaagcaaggaaagugugcaacauguguauacaauaugaugggcaaaagagaaaagaaauuaggagaguuugguaaagcaaaggguagcagagcgaucugguauaugugguuaggagcaagauuccuugaauuugaagcucugggauucaugaaugaagaucacugguuuucaagagaaaauagucuaaguggcguagaaggagaaggccuucacaaacucggcuacauucugagggacauuucgaaaauuccgggaggaaacauguacgccgaugacacggcaggaugggauacaagaauaacugaagacgacuugcagaacgaagcaagaauaacggauauaauggaaccagaacacgcgcuacuagcaaaaucaauuuuuaaacuaacauaccagaacaaaguaguacgcguucaacguccagccaaaaauggaacaguaauggauguaauaucgcgacgggaucaaagaggaagcggacaaguugguaccuacgguuuaaauaccuuuaccaauauggaagcacaacuuauuagacaaauggaaagugaaggaauauuuucaccaucugaacuggagacuccaaaucucgccgagcgcgucuuagacugguuagagaaguauggaguagaacgucuaaagaggauggcaauuucaggggaugacugcguaguuaaaccaauagaugaccguuuugcaaccgcccuaacagcguugaacgauauggguaaagugcgaaaagacauuccacaaugggaaccuagcaagggauggaaugacuggcagcaaguuccauuuugcucacaucauuuucaucagcuuaucaugaaagauggcagagaaauuguaguaccuugcagaaaucaagaugagcuuguaggacgagcacgcguaucucaaggggcagguuggaguuuacgagaaaccgcgugucuagguaagucauacgcacaaauguggcaacuuauguauuuucaucguagagaucugcgauuagcugcaaaugcgauuugcagcgcaguaccuguagacuggauacccacaagccgcacuacauggucuauccacgcucaucaucaauggaugacuacagaggauauguuaucaguuuggaaucggguuuggaucgaagaaaauccauggauggaggauaaaacucacauaucuagcuggggagaugucccguacuuagguaaaagagaggaccaauggugcgguagucuaauaggucuaacugcccgagcaacaugggcaaccaauauacagguggcuaucaaucaaguuaggaggcuuauuggaaaugaaaauuaucuagauuauaugacaucuaugaaaagauucaagaaugaaagcgauccagaaggagcacuuugguaa

SEQ ID NO: 21938 - RNA, 9879 nt, Artificial Sequence
  derived and/or modified CDS sequence (opt6) from DENV-1__EU482495__SS-prME
ucggugacaauguuauuaauguuaaugccgacagcacuugcauuccaccuuacaacaagagguggggaaccccauaugauaguauccaaacaagaaagaggaaaaucccuucucuucaaaacgagcgccggggugaauauguguacuuuaaucgcgauggauuuaggagaacuuugcgaagauacgaugacauacaaauguccgcggauuacggaagucgaaccugaugauguugacuguugguguaacacaacagacacguggguuacguacggaacauguagucaaaccggcgaacaccguagggauaaaagaucaguagcacucgcaccacacguaggguugggccuugaaacgagagcugaaacguggauguccagugaaggagcguggaaacaaauacaaaaaguugagacuugggcuuuacggcauccagguuuuacuguaauugcauuauuccuagcucaugcaaucggaacaucaaucacacaaaaaggcauaauauucauauuacuuauguuggucacgccuagcauggcgaugcgaugugucgguauagguucccgagauuuuguggagggacuuucaggggcgacauggguugacguuguacuagaacaugguagcugugucacgacgauggcaaaagacaaaccaacauuagauauagaacuacuaaaaaccgaggucacaaacccugcgguguuacggaaacuguguauugaagcuaaaauaagcaauacuacgacugauaguagaugcccaacacaaggugaagcuacucuaguagaagaacaggaugcaaacuucgugugucgacgaacauuuguagaccggggaugggguaacgguuguggucuauucggaaaaggaucccucauaacaugcgcuaaauucaaaugcgugacaaaacuagaagguaaaauaguucaauaugaaaaccuaaaauauagcguaauagugacaguccauacuggagaccaacaucaagugggaaaugaaagcaccgagcauggcacaacagcaacuauuacaccccaagcaccaacaagugaaauacaauuaacugauuacggagcacugacauuggauugcucucccagaacugggcuagauuucaaugaaaugguccuccuaacaaugaaagagaaauccugguugguacauaaacaaugguuucucgauuuaccucuacccuggacauccggugcgucaacgagccaagaaacuuggaauagacaagaucuuuuaguuaccuuuaaaacugcacaugccaagaaacaagaaguuguagugcuaggaucccaagaaggagcuaugcacacagccuugacgggagcuacagagauacaaaccaguggaacaacaacaauauuugcaggucauuuaaaauguagguuaaaaauggauaaauuaacccuuaaagggaugucauacguuaugugcacuggacuuuucaaacuagaaaaagagguagcugaaacucaacacggaacagugcucguacaaauaaaauacgaagguacugacgccccauguaaaauuccauucuccacccaagaugaaaaaggaguaacccagaacggucgauugauaacagccaauccgauaguaacagauaaagaaaaaccugucaauauagaagcugaacccccauuuggggaaagcuacauaguaauuggagcaggcgaaaaagcacuuaaacuaucaugguuuaagaaagggagcucaaucggcaaaauguucgaagcgacagcucguggagcaagaaggauggcaauauugggugacacagccugggauuuuggaaguauaggcgggguauucacaaguguugguaaacugguucaucaaauauucggaacugcuuacggaguauuguucagugguguaaguuggacaaugaaaauagguauaggaguauuauugacaugguuaggauuaaacagucguucaaccucauuaaguaugacguguauagccgucggguugguuacgcucuauuuagguguuaugguacaagcugacucgggcugcguaaucaauuggaaagggagagaauugaaauguggaagugguauauuuguaacaaaugaagugcauacuuggacugaacaauacaaauuucaagcugacucuccuaaacgccuuucugcagcaauuggcaaagcaugggaagaaggaguaugcggaauacguucagcuacucgauuggagaauaucauguggcggcaaauuagcaaugaacugaaccauauauuguuagagaaugauaugaaauuuacaguaguaguuggagacguuguagguauacuagcacaaggcaagaaaaugauaagaccucaacccauggagcauaaguauuccuggaaauccuggggcaaagccaaaauuauaggugcugauguacaaaacacaaccuuuaucauugacgggcccaacacaccggaauguccggaugaccaacgcgcuuggaauaucugggaaguagaagauuauggguucgguauauucacaacuaauauaugguuaaaacuuagagacagcuacacacaaguaugugaucacagauugaugucagcugcgauuaaagauucaaaggcaguacaugcagauaugggcuacuggaucgagagugagaaaaacgaaaccuggaaacuagcuagagcaucuuuuauugaaguuaaaacuuguauuuggccuaaaucucauacucucuggaguaaugggguguuagaaucagagaugauaauacccaaaauauacggaggucccauaagucaacacaacuauaggccuggcuauuucacucagacagcaggcccuuggcaccucgguaaauuggaauuagacuucgaucucugugaagggacaacaguggugguagacgaacacugcggaaaucgcgguccaagucuaaggacgacaacgguaaccggcaaaauuauacaugaauggugcuguaggucuuguacucuacccccauuacgauuuaaaggagaagacggauguugguacggaauggaaauacggccgguuaaggaaaaagaagaaaaccuagucaaaaguaugguauccgcuggaucuggggaaguugacuccuuuuccuugggauuacucuguauauccauaaugauagaagaaguaaugcgaaguagguggucacgaaagaugcuaaugacugguacacucgcuguuuucuuucuauuaauaauggggcaguugacauggaacgauuugaucagaucauguauuaugguaggugcaaacgcaagcgaucguaugggcaugggcacaacguaucucgcacugauggcuacguucaaaaugcgaccaauguucgccguuggacugcuuuuccggcgacugaccaguagagagguucuauuguugaccaucggacuaucuuuaguugcgucaguagaacucccaaauucucuggaggaacugggagacggauuggcaaugggaauaaugauacuaaaacuauuaaccgauuuccaaucuuaucaauuaugggccacccuuuuaucguugacauuuauuaagacaaccuuuagucuacauuaugcauggaaaacaauggccaugguacuuaguauagucucacuucugccuuuaugccuaagcacgacaagucaaaagacaacauggcuaccgguacuccuggggagcuuaggauguaaaccauugaccauguuuuugauugcugaaaauaaaauauggggaagaaagagcuggccauuaaaugaggguauaauggcaguaggaauaguaucuauauuguugagcucacuacuaaagaacgacguuccauuagccggcccuuuaauagcagggggcaugcucauagcguguuacgucauaucugguagcagugcagaucuaucguuagagaaagcugcggaagucaguugggaagaagaagcggaacauaguggagcgucgcauaacaucuuaguugaaguucaggaugacggaacgaugaagauaaaagaugaagaaagagaugacaccuugacaauucuuuuaaaagcgacuuuacuagcgguaagcgguguguauccucuaucaaucccagcgacgcuauuugucugguauuuuuggcagaagaagaaacaacgaucaggugugcucugggauaccccaaguccaccagaaguagaacgagcaguccuagacgacggaauauauaggaucaugcaacgaggucuccugggacgaagucaaguagggguaggcguguuucaagaaaauguauuucauaccauguggcauguaacaaggggugcuguucuaauguaucaaggaaaacgacuagagccaagcugggccucuguuaaaaaggaucuuauuaguuauggaggaggauggcguuugcaagggucguggaacacgggcgaagaaguccaaguaauugcaguagaaccugguaagaacccgaaaaauguccagaccgccccaggaaccuucaaaacgccagaaggggaagugggagcaauagcgcuggacuucaaacccggcacuagcgguagcccuaucgucaaccgagaggguaaaauuguagguuuauauggaaauggggugguaacuacuucuggaacauauguaucagcuauugcgcaggcaaaagcgucacaagaaggaccacuaccugaaauagaagaugaaguuuuucggaagcgaaauuugacaauuauggaccuccacccugguuccggaaaaacaagacgauauuuaccugcuauaguaagagaggccauuaaacgaaaacuaagaacccugauauuagcgccaacaagggugguagcaagugaaauggcagaggcccucaaagguaugcccauaagguaccaaacgacugcagugaagucugagcauacuggaagagaaaucgucgaucuaaugugucaugcaacauucacgaugcgauuauuaucgccagugcgugugccaaauuauaauaugaucauaauggaugaagcucacuucacugauccgagcucaaucgcugcgcgugguuacauuucaacaaggguuggaaugggggaagcagcugcaauuuuuaugaccgcuacuccuccgggauccguagaagccuuuccucagucaaaugccguaauacaggaugaagaacgggauauuccagagcggagcuggaauaguggguacgaauggauuacugacuuuccaggcaaaacuguaugguuugucccgucaauaaaaucugguaaugacauagcaaacuguuuacgcaaaaacgggaaaagaguaauacaacuaucaagaaaaacauucgacaccgaguaucagaaaacuaaaaacaaugacugggacuacguugucacaacggauauaagugaaaugggggcaaacuuuagagcagauaggguaauagauccaagacgaugcuuaaaacccgucauuuuaaaagaugguccagaaagagugauauuagccggaccuaugcccguaacaguugcaucagcagcgcaaaggcgcggaagaauugguaggaaccauaacaaagaaggagaccaauauauauauaugggccaaccgcugaacaaugacgaagaucaugcccauuggacagaagcaaaaauguuacuugacaauauuaauacgccugaaggcauuauaccagcucuauucgagccugagagggaaaagucugcggcuaucgauggcgaauaucgucugcgaggugaagccaggaaaaccuuuguagagcuuaugcgccgaggagaucuaccaguauggcuuuccuacaaagucgccagugaaggguuucaauauagugauagaagaugguguuucgacggcgaacgcaacaaucaaguauuagaagaaaauauggauguugaaauuuggacaaaagagggggaaagaaagaaauuaagaccuagauggcucgaugcaagaacuuauagugacccuuuagcccugagagaguuuaaggaauuugcagccggacgcagaucagucaguggggacuugaucuuagagauaggaaaacugccacaacacuugacacaaagagcccaaaaugcauuagauaauuuggugaugcuacacaauucagaacaaggagguagagcauauagacaugccauggaagaacuacccgauacuauagaaacuuugauguuacuagcacugauugcgguucuuaccggaggagugaccuuauuuuuccuuucuggucgcggauuagguaagacuucuauagguuuauuaugugugauggcgucuucugcucuacuauggauggcaucuguagagccacacuggauugcugccaguauuauucuagaauuuuuccugaugguauuacuuaucccggaaccggauagacaacguacuccacaagacaaucaacuugccuaugugguaauaggacuauuauucaugauacucacuguagccgcaaaugaaaugggucuuuuagaaacaaccaagaaagacuuagguauaggccauguggcaguagagaaucaucaccaugcuacuauguuagacauagaucugcacccagccuccgccuggacguuguaugcaguagccacgacuauuauaacccccaugaugcgucacaccaucgaaaacacgacagcaaacauaucacugaccgccauagccaaccaagcugccauacuaaugggcuuggauaaagguuggccgauaucuaaaauggauaucgggguaccauuacuggcacuaggauguuacagucaaguuaauccacuaacacuaacagcagcuguacuaauguuaguugcacauuaugcaauuauuggcccagggcuucaagccaaagcuacacgcgaagcacaaaagaggacugccgcaggcauaaugaaaaauccuacaguagauggaauuguugccauagaucucgauccuguagucuacgacgcuaaauucgaaaagcagcuuggucaaaucauguuacugauucuaugcacaagucagauuuuacuuaugcggacuacuugggcauuaugugaaucuaucacuuuagccacagggccacuaacuacauuaugggaggguucaccugggaaauuuuggaacaccacaauugcaguguccauggcuaauauauucagaggguccuaucuagccggagcuggacuagcauuuagccuaaugaaaucccuaggagggggacgccguggaaccggagcacaaggggaaacacucggagaaaaauggaaaagacaacucaaucaguuaaguaagagugaguucaauacauauaagcggucggguaucauggaaguugaccggucagaagcaaaagaaggccuacgucguggagaaacuacaaaacaugcgguuagucgcggcacggcaaagcuccgaugguucguugaacgcaacuuggucaaaccugagggaaaagugauugacuuaggcuguggaagagggggcuggucguauuauugugcaggacuuaagaaagucacagagguuaaaggauauacaaaaggaggaccaggccaugaggaaccuaucccuauggcuacauacggguggaaccuggucaagcuccauucgggaaaagacguauucuuuauaccaccugaaaaaugugacaccuuauuaugugauauaggugaaagcagcccaaauccuacuauugaggaggggagaaccuugagaguucuaaaaaugguagaaccguggcuccgggggaaccaguucuguauaaagauacuaaacccauauaugccaucaguaguagagacguuagaacagaugcaaagaaaacacgggggcaugcuggugagaaacccucuuucucgaaacucaacacacgaaauguacuggguaucuugcggaacggguaacauagugucggcugugaacaugacgucccgaauguuacuaaaucgcuuuaccauggcgcaucgcaagccuaccuaugaacgagauguggaucuaggagcuggaaccaggcauguagcugucgaaccagaaguagcaaaucuagauauaaucggacaacgcaucgaaaacauuaaacacgagcauaagagcacuuggcauuacgacgaggacaacccuuauaaaaccugggccuaccauggaucauaugagguuaaaccaucgggauccgcgucaucuaugguuaacgguguagucaagcuguugacaaagcccugggacgugauccccauggucacccagauagcuaugacagacacaacaccauuuggccaacagcgaguguucaaagaaaaagucgacacaaggacacccaaagcaaagagagguacagcacaaauaauggaaguuacagccagaugguuauggggcuucuuauccagaaauaagaaaccaagaauauguacacgagaagaauuuaccagaaaaguacgaaguaaugcugcaauaggggcaguguuuguggacgaaaaucaguggaacagcgcuaaggaagcuguugaggacgagagauucugggauuuaguucauagagaacgcgaauuacacaaacaggguaaaugcgcgacgugcguauacaauaugaugggaaaaagggagaagaaacugggagaguucgguaaagcaaagggcagcagggcgauuugguauauguggcugggcgcaagguuccuagaguuugaagcacuaggauuuaugaaugaggaucauugguucaguagagaaaacucauuaucugggguggagggagaagggcugcauaagcuaggauacauucugagggauauauccaaaauaccgggcgggaacauguacgccgaugacacugcugguugggacacucgaauaaccgaagaugaccuacaaaacgaagcaaaaauaacugauauuauggaaccugaacacgcucugcuagcgacuucaauauuuaaacuaacauaucagaauaaaguaguucgaguacaaagacccgcacgaaacggaaccgucauggacguaauaucaaggagagaucaaagaggcucgggucaaguuggcacauacggacucaacacguuuaccaauauggaagcacaacugauaagacaaauggaaagcgaaggcaucuuuaguccaagugaacuggagacaccaaauuuagcagagagaguuuuagauuggcuagagaaacauggcgucgaaagacuaaagcgaauggcaaucaguggcgaugauuguguaguuaaacccauugaugacagguuugcaacagcacuuucagcguugaacgacaugggcaaaguacggaaagacauaccccaaugggaaccauccaaaggcuggaacgauuggcaacaaguuccuuucuguucacaucauuuccaccaacuaaucaugaaagauggacgcgaaauuguuguacccugccgaaaucaggaugaguugguaggcagagccaggguaucacagggagcagguugguccuugagagaaacagccugccuaggcaaaucguaugcucagauguggcaacucauguacuuucaccgaagagauuuacgauuagcagcaaacgcaaucugcagcgcagugccagucgacuggguuccuacgaguagaacuaccuggucuauacaugcacaucaucaauggaugacgacugaagauauguuaucugucuggaauagaguguggauagaagaaaauccuuggauggaggacaaaacucauauuaguagcuggggcgauguaccauaucucggcaagcgugaagaccaauggugugggagucuaauuggauuaacagcacgugccaccugggcaacuaauauacaaguugcuauaaaucaggugcggagguugauaggaaaugaaaauuaucuugauuacaugacaucaaugaaacgguucaaaaacgacucagacccagaaggagcucuaugguga

SEQ ID NO: 21939 - RNA, 9879 nt, Artificial Sequence
  derived and/or modified CDS sequence (opt6) from DENV-1__EU482496__SS-prME
aguguaacuauguuacugaugcucaugccaacggcgcuagcuuuucaucuaacaacaagagguggagaaccacauaugaucgugaguaaacaagaacgaggaaaaaguuugcuuuuuaaaacuucagcaggagugaauauguguacccucauagcaauggaucuuggagaacucugcgaagauacaaugacauacaaauguccacggauuaccgaaacugaaccugacgacguagacuguuggugcaacgcaaccgauacaugggugaccuacggaaccuguucacaaacaggagaacaccgucgcgacaaaagaucgguagcucuugcaccccaugucggucucggacuagaaacgagaacagaaacuuggaugagcucggaaggugcauggaaacaaauacaaaggguagaaacaugggcauuaagacauccugguuucacuguaauagcucucuuccucgcacacgcuauuggcacaucuaucacacaaaaaggaauaauauucauacuuuuaaugcucguuacaccaaguauggcuaugagauguguaggcaucgggagucgagauuucguugaaggguugucgggugcgacuuggguagauguaguguuagaacacgguagcuguguaaccacuauggcuaaagacaaaccgacacuugauauagaacuucugaaaaccgaggugacuaauccagcaguauugcgcaaacuuuguaucgaagcuaaaauaucaaacacgacuacugacucuagaugcccaacucaaggugaggcaacccuuguagaagaacaagacgcaaauuucgucugucgccguacuuucgucgacagagguuggggaaacggaugcggauuguuuggaaaagguucuuuaauaacaugcgcaaaauuuaaauguguuaccaaauuagaaggcaaaaucguucaauacgagaaccuaaaguacucuguaauugucacuguacacacuggagaccaacaucagguuggcaaugaauccacagagcauggaaccaccgcaacgauaacuccacaagccccaacaacugaaauucaguuaaccgacuacggggcucuuacauuagauugcagcccuaggaccggacuggacuuuaaugagaugguacuacucacaaugaaagagaaaaguuggcucguacauaaacagugguuuuuagacuuacccuuaccguggacaagcggagcuaguacuagccaggaaacguggaauaggcaagauuugcuggucacuuucaaaacagcucaugccaagaaacaggaaguaguagugcucgguagccaagaaggagccaugcauacagcucuaacaggugcaacggagauucaaacaaguggcacaacgacuauauucgcaggacauuuaaaguguagauugaaaauggauaaguugacuuuaaaaggcaugaguuacguuauguguacggggucauuuaagcuagaaaaagaagucgcggaaacccaacacgggacgguccuagugcaaauaaaauaugaaggaaccgacgcacccugcaagauaccuuucucaacacaggacgaaaaagguguuacacaaaauggacgccuaauuacugcuaaucccauuguuacagauaaagaaaagcccguuaauauagaagcugaaccuccauuuggcgaauccuacaucaucauaggcgcuggagaaaaagcucucaaauuaucaugguuuaagaaagguucuaguauagggaaaauguucgaagcuacggcacggggcgccagaagaauggcaauucucggagacacagcuugggacuuuggaucaauuggaggaguauucacaucaguggguaaacucguucaucaaauuuucgguacagcauaugguguacuauuuucagguguguccuggacgaugaagauaggcauaggcgugcuuuuaacaugguuagguuuaaauucacgaagcacaucauuaucaaugacuugcaucgcagucggacucguaaccuuauacuuaggaguaaugguccaagcagauucaggcuguguaauuaauuggaagggaagggaacucaaaugcgggucaggcauauuuguaacaaaugaaguucacacauggaccgaacaauauaaauuccaggcugauagccccaagcgucuaucggcagcgauugggaaggcaugggaggaaggugucugcgggauccgcucagccacccgacuagaaaauauaauguggaaacaaaucucaaaugagcuaaaccauauuuuguuagaaaacgacaugaaauucacaguagucguuggugauguagcaggaauacuggcucaagguaagaaaaugauaagaccacagccaauggaguauaaauauuccuggaaaaguugggggaaagccaaaauaauaggcgccgaugugcaaaacacaacguuuauuaucgacggccccaacacaccugaguguccagaugaccaaagagcauggaauauaugggaaguugaagauuacgguuuuggcauuuuuacgaccaauauaugguuaaaauuaagggauucuuauacccaaguuugcgaucaccgucuuauguccgcagcuauuaaagauagcaaggcaguucacgcggacauggguuauuggauagaaagcgagaaaaaugaaacauggaaguuggcucgugccagcuucauagaaguaaaaacuuguauauggccaaagagucacacucuguggucaaauggugucuuggaaucagagaugauaauacccaaaauuuacggaggaccuauaucacaacacaacuaucgaccugguuacuuuacccagaccgcgggcccuuggcauuuagggaaacuagaauuagacuuugaucuuugugaagggacuacggucguaguagacgaacauugugguaaccguggaccgucacuaagaacuacuacaguuacagguaagauaauacaugaaugguguuguagaagcuguacccuuccuccgcucagguuuagaggagaagaugguuguugguauggaauggaaauaaggcccgucaaggaaaaagaggaaaaucugguuaagucuaugguaagugcagguucuggagaaguagauucauucucauuggggcuacuguguauaagcauuaugauagaggaaguuaugaggucccgguggucaagaaaaaugcuaaugacggguacguuggcaguguucuuccuucuaauuaugggucaguuaacguggaaugacuuaauuagacuauguauaaugguaggugcaaacgcuucugacagaaugggaaugggaacaacuuaucuggcuuuaauggcaacauucaaaaugagaccuauguuugcgguaggucuauuauuuaggagauugacaucaagagagguauuauuacugaccauaggacuuucucuaguugcuuccguagaacuaccaaauagucuggaggaauuaggagauggauuggccauggguaucaugauucuaaaauuacuuacagacuuccaaucccaccaacuaugggcaaccuuauuauccuuaacauuuauaaaaacuacauuuucccugcauuaugcuuggaaaacgauggcaauggugcuaucaauagugagcuuauuucccuugugccuaucaaccacaagucagaaaacaaccugguugccuguauugcuuggaucacuagguugcaaaccgcucacaauguuucuaauagcugagaauaagauauggggaagacgaagcuggccgcuuaaugaagguauaauggccgugggaauagucucaauauuauuaucgucauuacugaaaaaugacguucccuuagcaggaccacugauugcuggaggaaugcugauagcauguuaugucauaagcgguucaagugcggacuuaagucuagaaaaagccgcggagguaaguugggaggaagaagcagaacacaguggugcaagccauaacauauuaguagaaguucaagaugacgggaccaugaaaauuaaggaugaagaaagagacgacacacugacgaucuuacuuaaagcgacccuucuagcuguuagugguguuuacccacuaagcauucccgccacacuauuuguaugguauuucuggcaaaagaagaaacaacgaagcggaguacuuugggauacaccaucaccgccagaaguagaaagggcgguuuuggaugauggaauuuauaggauaaugcaaaggggcuuacuaggaagaagucaaguaggagucggagucuuucaggagaauguauuccacacaauguggcauguuacuagaggagcaguucuuauguaccagggaaaaagacuagaaccaucgugggcaagugucaagaaagauuuaauaucuuacggaggaggguggcgguuacaagggucauggaauacaggugaggaaguacaagucauagcaguagagcccggcaagaacccgaaaaacguccaaacagccccuggcacuuuuaagacgccggaaggagaggugggagcgaucgcacuugacuucaaaccaggaacgucaggcucaccaaucguuaacagagaaggcaaaaucguuggucucuauggaaauggaguagucacgacuucaggcacauaugugagugcaauugcacaagcaaaggcuagccaagagggccccuugccggaaauagaggacgaaguauuucggaaacgaaaucuaacaauaauggaccuucacccaggaaguggcaaaacacgacguuaucucccggcgauuguucgugaggcgauuaaaagaaaacuuaggacgcucauuuuagcuccaaccagagucgucgccuccgagauggcagaagccuuaaagggcaugccaauccgauaucaaacaacagcagugaaaucugagcauacagguaaagagaucgucgaccuaaugugccaugcgacauuuacaaugcgacucuuaaguccuguaaggguaccaaauuacaacaugauuauuauggaugaggcucauuuuacugacccaaguagcauugcggcacgagguuacauuaguacgcgaguaggaaugggggaggccgcagcuaucuuuaugacagccacacccccaggcuccgucgaggccuuuccacagucaaaugcgguuauccaagaugaagaacgugacauucccgaaagaucguggaacucaggauaugaguggauaacagauuucccuggaaagacgguaugguucgugccaucuauuaaaucuggaaacgauauagcaaacugucuuagaaagaaugguaaacgcguuauacaguugucacgaaaaacauucgauacagaauaccagaaaaccaagaauaacgauugggacuacguagucaccacagacauaagcgagaugggagcaaauuuucgcgcagauagaguaauugauccccgaagauguuugaaaccaguuauucugaaggacgguccagaacguguuauucuagcgggaccgaugccaguaacuguagcgagugcagcucaaaggagagguagaaucggcagaaaccauaauaaagaaggcgaucaauauauauauauggggcaaccacuaaacaacgaugaagaccaugcucacuggaccgaggcaaaaauguuguuagauaacauuaacacuccggaaggcauaaucccagcguuguucgagccugaacgugaaaaaucggcagcuauagauggggaauacagauuacguggagaagcaagaaaaacauucguagaacuuaugcgaagaggagaucuuccaguaugguuaucauacaaaguagcuagugaagguuuucaauacucagaccgacgaugguguuucgacggagagaggaacaaccaaguacuagaggaaaacauggacguggaaauauggacgaaagaaggugaacgcaagaaacuuagaccuaggugguuagacgccagaacauauucagauccauuagcuuuaagggaauuuaaggaguucgcagcaggaagaagaucaguuaguggagauuugauacuugaaaucgguaaacucccccaacauuugacucaaagagcacaaaaugcucuggauaacuuagucaugcuucacaacagcgaacaaggagguagagcauauaggcacgcaauggaagaacugcccgauacaaucgagacuuuaaugcuacucgccuuaauagccguauuaacaggaggagugacacuuuucuuucuaucuggaaggggucuuggcaaaaccaguauuggcuuacuauguguaauggcaucaagcguuuuguuauggauggcaucaguagagccucacuggauagccgcaagcauaauacuagaauuuuuccuaauggucuuacuaauuccggagccagaucgucaacgaacgccccaagauaaucaauuggcuuacguuguaauuggguuauuguuuaugauucuaacgguagcagcuaaugaaaugggacugcuugagacuacuaagaaagaucuugguauaggacaugucgccguggagaaccaucaucacgcagccaugcucgaugucgauuuacauccagccagugcauggacucuauacgcaguagcaaccacuauaauuacaccgaugaugagacauacaauagaaaauacaacggccaacauaucuuuaacggcuauugcuaaccaagcggcgauucuaaugggucuugacaaaggguggccuauaagcaaaauggacaucggaguaccauugcuugcgcuaggguguuauucucagguuaauccguugacauuaacggcggccgugcuaaugcucguggcacacuaugcaaucauaggacccggcuugcaagcaaaagccaccagagaagcccagaaaagaacagcagccggaaucaugaaaaauccuacuguagacggcauaguagccauagacuuagacccaguuguguacgacgcgaaauucgaaaaacaacuugggcaaauaaugcuacuaauuuuauguacgagucagauauuauuaaugcgcacaacuugggcacuaugugagaguauaacguuggcuacugggccacuaaccacauuaugggaggguucaccagggaaauuuuggaauacgacaauagcaguaucaauggcuaauauauuuagaggaucauauuuagcaggagcuggcuuagcuuucucauugaugaagucacugggcggugguaggcgugggacaggagcgcagggugaaacacucggcgaaaaguggaaacgacaauuaaaucaacuuucaaagucugaauuuaauacuuacaaaaggucugggauaauggaagucgacagaagcgaagcuaaggaaggcuuaaagcgaggagaaaccacuaaacacgcugucuccagaggaacagcaaaacuucgaugguuuguagaaagaaaccuaguaaaaccagaagggaaaguaauagaucuggguugugggcgaggggguuggucguauuauugugcaggacuuaagaaagugacugaaguuaaaggcuacacuaagggcggcccuggacaugaagaaccaauaccuauggcaacauacggcuggaaccugguaaaacuccauuccggaaaggacguauucuucauaccgccagaaaaaugugacacccuguuaugcgauauaggcgagaguaguccaaaccccacaauugaagaaggacgaacacuaagaguauugaaaaugguugagccaugguugcgcggaaaucaauucugcaucaagaucuuaaaucccuacaugccaaguguaguggagacucuagaacaaaugcaaaggaagcaugggggaaugcuagucagaaauccacuuucaagaaacucuacacacgaaauguacugggucucguguggcacaggcaauauaguuagugcaguaaacaugacgagucggaugcuguugaacagguuuacaauggcucauagaaagccaacauaugaaagagacguagaucuuggagccggcacucggcauguagcuguggagccugaaguggccaaucucgauauaauuggacaaagaauagagaauaucaaacaugagcacaaaucaacauggcacuaugaugaggauaaucccuacaagacaugggcguaucaugguuccuacgaaguaaaaccgaguggcucagccucguccauggugaacggaguaguaaaauuacucacuaaaccgugggacguaauuccaaugguaacacaaauugcaaugacugauacaacaccuuuuggacaacaacgcguauuuaaggaaaaaguugacacccggacaccuaaagcuaagagggguaccgcacaaauuauggaagucaccgcaaaaugguuaugggguuuucucucucggaauaagaaaccacgcauauguacacgggaggaguuuacaaggaaggugagaucaaacgcugcgauaggagcaguuuucguggacgaaaaucaguggaacucggcuaaggaagccguugaggaugaacgauuuugggaucugguccauagggaaagagagcuucacaaacaagguaaaugugcaaccuguguauauaauaugauggggaagcgagagaagaaacucggagaauuuggcaaagcaaaaggaucacgagcaaucugguauaugugguugggagcccgcuuucuagaguucgaggccuuaggauuuaugaaugaagaucauugguuuucacgggaaaauucucuaagcggaguugaaggugagggauuacauaaacugggcuauauacuucgagauauuucgaagauccccggaggaaacauguacgcagacgauacugccggaugggauacgcguaucacagaagacgaccuacaaaacgaagccagaauaacagauaucauggaaccugaacaugcccuguuagcgaaaagcauuuucaaacuuacauaucaaaauaaaguuguuaggguccaacgccccgccaaaaauggaacuguaauggacguaauaaguagaagagaucaaagagguuccggucaagucgggacauauggacuuaauacauuuaccaacauggaggcgcagcucauaagacaaauggaauccgaaggcauuuucagcccuagugagcuggaaacaccaaaucuagcagaaaggguuuuggacuggcuaaagaaauauggcguagagcgauuaaagcguauggcaauaucuggagaugauugcguuguaaaaccaauagacgauagauuugccaccgcacugacagcacuaaacgauaugggaaaagugagaaaagacauaccacagugggaaccuucaaaaggauggaaugauuggcaacaaguaccuuucuguucucaucauuuccaccaauugauaaugaaagauggaagggaaauagucguuccguguagaaaucaagaugagcuagucgggagagcacgugugucgcagggagcaggauggucauuacgugagacugcauguuuggggaaaucguaugcacaaauguggcaacuuauguauuuccaucgaagagauuuacgguuagcagcuaaugccauuugcuccgcaguaccaguagacuggauuccaacaucccgaaccacgugguccauacaugcacaucaucaauggaugacaacagaagacaugcuaaguguauggaacagaguauggauagaagagaacccauggauggaggacaaaacccauauaucuucuuggggagaugugccauaccuaggaaagagagaagaucaaugguguggaagucuaauugggcuaacugccagggcgaccugggcaacgaacauucaaguugcuauuaaucagguucgaagacucauaggaaacgaaaacuaucuagacuauaugacgucuaugaaaagauucaagaaugaaagcgaucccgaaggggcccucugguag

SEQ ID NO: 21940 - RNA, 9879 nt, Artificial Sequence
  derived and/or modified CDS sequence (opt6) from DENV-1__EU482497__SS-prME
agugugacaauguuacuaauguugaugccuacggcucuagcguuucaucuaacaacucgugggggugaaccccauaugauaguaucgaaacaagaaagaggaaaaucucuauuauuuaaaacaagugcuggcguaaauauguguacacuaauugcuauggaccuaggcgaacuuugugaagacacgaugacguauaaauguccgaggauaacagaaaccgaaccggacgaugucgauugcugguguaaugcuacagacaccuggguaacguaugguacauguagucaaacuggagaacaucgaagggauaaacgaagcguugcguuagcaccgcaugucggucucggccuagaaacaaggaccgaaacauggaugaguucagaaggugcauggaagcaaauucaacggguagaaacgugggcgcuacggcacccugguuucacuguaauugcucuauucuuggcucaugcuauuggaacuucaauaacucaaaaaggcauaauauuuauucuuuuaauguuaguuacuccguccauggcuaugcguugcguugggauuggaucaagagacuuuguagaagggcuaaguggugcuacguggguugaugucguucuagaacaugggaguuguguaacaaccauggcaaaggauaaaccaacacuagacauagagcuauugaagacagaagugacaaacccagcaguuuuacguaaauuaugcaucgaagcaaaaauuucuaacaccacuacagauagccgaugccccacacaaggagaagcgacgcuaguggaagaacaagaugcaaauuuugucugccgucgaacauucguugauagaggaugggggaauggaugcgguuuauucgggaaagggucacugauaaccugcgcgaaguucaaguguguaacuaaauuggaagguaaaauagugcaauaugaaaacuuaaaauauucuguuauagucacuguucauacuggugaccagcaccaaguagguaaugaaucaacagaacacggaaccaccgcuacaauaacuccacaagcgccgaccacagagauucaguugacggauuacggggcauugacauuggauuguaguccacgaacgggacuagauuuuaacgaaaugguccuucuuacaaugaaggagaaaaguugguuaguacacaaacagugguuccuugaucugccauuaccauggaccagcggagcaagcacgagccaagggacguggaaucgccaggaucucuuggugacauuuaaaacggcucaugccaagaaacaggaagucguuguauuaggcagucaggagggagcaaugcacacagcucucaccggagccacggaaauucaaaccagugguacaacuaccauauuugcaggacauuugaaaugcagacuaaaaauggauaaauuaaccuuaaaaggcaugaguuauguuauguguacaggaucauucaaacuugagaaagaagucgccgaaacgcaacaugguacuguuuugguucaaaucaaguaugagggaaccgaugcaccuugcaagaucccauuuucuacgcaagacgaaaagggcguaacccagaacggcagauuaaucaccgcuaauccuauagugacggacaaggaaaagccaguaaacauagaggcagaacccccguuuggagaaaguuauauaguaaucggcgcaggcgagaaggcuuuaaaacugagcugguuuaaaaagggauccaguauaggaaaaauguucgaggcuacagcaagaggcgcucgacgaauggcaauacuaggggacacagccugggauuuuggcaguauaggagggguuuuuacuucgguaggaaagcuagugcaucaaauuuucggaacagccuacgguguccuguucucaggaguaucauggacgaugaaaaucggaauaggaguccuucuaacuuggcuagggcuaaacaguagaucaacaucucuaucaaugacauguaucgcgguggguuugguaacgcuuuaucugggagucauggugcaggcugauucagguugcguaaucaacuggaaaggacgagaguuaaaaugcgguucagguauuuuuguuacaaaugagguacauacauggacggaacaguacaaauuccaagcugacucaccuaaaagauuaucggcugcuaucggaaaggccugggaagaagggguuuguggcauaagaagugccacacgccuggaaaauauuauguggaagcaaaucucuaacgaauugaaucauauccuucuugaaaaugacaugaaauuuacagucgugguaggcgauguagcaggaauuuuggcacaagggaagaaaaugauaagaccucaaccuauggaauauaaguacagcuggaaauccugggguaaagcaaaaauuauaggggcugauguacaaaauaccacguucauaauagacggacccaauacuccugaauguccggacgaucaaagagcauggaauauaugggaaguagaagauuauggguuuggaaucuucacgaccaacauauggcucaaacucagagacucuuauacacaaguuugugaucaucguuuaaugagcgcugcaauaaaagauucuaaagcuguacaugcagauaugggguauuggauagaaucagagaaaaaugagaccuggaaguuagcccgggcgucuuuuauagaagugaaaacguguauauggccaaaaagucacacucuguggagcaaugguguucuugaaagcgaaaugauuaucccgaaaaucuaugguggacccauaucacaacauaauuacaggccgggguauuuuacacagacagcuggaccauggcaccuagggaaauuagaguuagacuuugaucuaugcgaggguacuacaguaguaguggacgaacauugcgguaacagagggccuucuuuaagaaccacuacaguuacugguaaaauuauucaugaguggugcugccggucauguacucuaccaccucugcgauuuaggggcgaagaugguuguugguauggaauggaaauaaggccgguaaaggaaaaagaagagaauuuaguuaaaucuaugguuucugcuggcaguggggagguagauaguuucaguuuaggccuauugugcauuagcauuaugauagaagaaguaaugaggucucgauggucuaggaaaauguugaugacuggaacguuagcuguauucuuucuauuaaucaugggacaauugacuuggaaugaucuaauacgauugugcaucaugguaggcgcuaaugcaucugauagaaugggaauggggacaaccuacuuagcacuaauggcaacguuuaagaugagaccaauguuugccgucggcuuacuauucagacgccuaacaagccgagaaguauuauugcugacuauaggacucagccuaguagcuagcguagaacuaccaaauucuuuagaagaacuaggcgauggacuagcuauggggauaaugauuuugaaguuacucaccgauuuucaaucacaccaacuaugggccacccuucugucuuuaacauuuauuaaaacaacauucucucuccacuaugcauggaagacgauggcuaugguccugagcauaguaaguuuauuuccauuaugucuaucuacuacaagucagaaaaccacguggcuccccgucuuacuaggcagccugggauguaagccuuuaacgauguuucuaauagcagaaaauaagauauggggaagaagaaguuggccuuuaaacgaagggauuauggccguugggauaguaucgauucuacugucuaguuuacucaaaaaugacguaccacuagccggaccccucauagccggcgguauguugauugcuuguuacguaaucaguggaagcagugcugaccuaaguuuagagaaagcagcggaagucaguugggaagaagaagcagaacauucgggagcaucacauaacauacuuguggagguucaggaugacgguacaaugaagauaaaagaugaggaacgcgaugauacucugaccaucuuacucaaagcaacacucuuagccgucucagggguguaucccuugucuauuccagcaacuuuauuugugugguauuuuuggcagaagaagaaacaaagguccggcguguuaugggacacacccagcccacccgaaguugaacgagcuguucuugacgauggaaucuacaggaucaugcaaagagguuugcuagguagaagccaaguagguguagguguuuuccaagaaaacguguuccacacaauguggcauguaacgcgcggagcuguacugauguaucaaggcaaacgucuggaaccuaguugggcguccguaaagaaagaucucauaagcuacgguggggguuggcgauuacagggaagcuggaauacgggggaagaagugcagguaauagcaguggaaccuggcaaaaaucccaaaaauguacaaacggcgccggguacuuucaaaaccccagaaggcgaaguaggcgcaauagcauuagauuuuaaaccuggaacgaguggaagccccaucguuaauagagaaggaaaaauaguaggacuauauggaaauggcguaguuacgaccucagguacauaugucuccgcaauugcacaagccaaggcaagucaagaaggcccguuaccugagauugaggacgaagucuuucguaaaaggaacuuaacaauuauggaccuacauccagggucaggcaaaacaaggagguaucuuccggccauagucagggaagcaauaaagcgaaaguuaaggacucuaauacuagcccccacuagaguggucgcaucagaaauggccgaagcgcugaaaggaaugccaauccguuaccagacuacagcaguaaaaagugaacacaccggcaaagaaaucguugacuuaaugugucaugcaacuuuuacaaugagacuguugagcccaguaaggguaccuaauuacaauaugauuauaauggacgaagcucacuuuacugauccgucuuccaucgcugcgcgugguuacauaucuacaagaguaggaaugggcgaagccgcagcaaucuucaugacggcuacuccacccggcucgguagaagcauuuccacaaucaaacgcgguaauucaagaugaggaacgagauauuccagaaagaagcuggaauagugguuacgaguggaucaccgauuuuccagguaaaacugugugguucgucccgucuauaaaaucuggaaacgauaucgcuaauugucuuaggaagaaugggaagcggguaauacaguuaucgcguaagacuuucgauacagaauaccagaaaaccaaaaacaacgauugggacuauguagugacuaccgauaucucagaaaugggcgccaacuuuagagcagauagagugaucgauccgcggcgcugucuuaaaccagugauauuaaaggauggaccagagagggugauacuagcaggcccaaugccggugacaguagcaucugcggcacaacggagaggccgcaucggaagaaaccauaauaaagaaggugaucaauauauauauaugggacaaccauuaaauaaugaugaggaccaugcccauuggacggaagcuaaaaugcuacuagauaauauaaauaccccagaggguaucauaccggcguuauuugaaccagaaagagaaaaaucagcugcaauagauggugaguaucgauuaagaggcgaagcaaggaaaacguuuguugaacuaaugaggagaggagauuuaccaguuuggcuuaguuauaaaguagcaagugaggguuuucaauauucagauaggcguugguguuuugacggagaaagaaacaaccaagucuuggaagaaaauauggauguagaaauauggacuaaagaaggggagcgcaaaaagcugcgaccuaggugguuagacgcucgaaccuauagcgauccacuggcacugagagaguuuaaggaauuugcugcugggaggagaaguguuuccggagaucuaauauuagaaauagggaaacugccucaacaccuaacacagagagcacaaaacgccuuagacaaccuggucauguuacacaacagcgagcaagggggaagggccuauagacaugcaauggaagaacuaccggauacgauugaaaccuuaaugcuccuagcacugauagcaguucuaacagggggagugacacuuuucuuucuaaguggaaggggguugggcaaaacaucaauagguuugcucuguguaauggcaucauccguacuauuauggauggcuaguguggagccacauuggauagcagcgaguauuauucuugaguucuuuuuaaugguacucuugauaccagaaccagacagacagaggacuccucaagacaaccaguuagccuauguuguuauaggacuauuguuuaugauauuaacaguagccgcaaaugaaaugggacuauuagagacaacuaagaaagauuugggaauagggcauguagcaguugaaaaccaccaucaugccgcaauguuagauguugauuugcauccagcaucugccuggaccuuguacgcaguugcgacuaccauaauaacgccaaugaugcgacauaccauugaaaacacaaccgcuaauauuucguuaacugcgauugcaaaucaagcugcgauuuuaaugggauuggacaagggauggcccauaaguaaaauggauauagggguaccacuauuagcucuuggauguuacucacaggucaacccucugacauuaacagccgcuguauugauguugguagcgcauuacgcaauuauaggaccgggguuacaggcaaaggcaacaagagaagcucagaaaaggaccgcugccggaauaaugaaaaacccuacaguagauggaauaguggccaucgaucuagauccuguaguguaugaugcaaaauucgaaaaacaacuaggucaaauaauguuacuaauauuauguacgucacaaauauuacuaaugcguacgacuugggcuuuaugugaaagcauuaccuuagccacagggccacuaaccacauuaugggaagguucuccuggaaaauucuggaacacgacgauagcggucucuauggcaaauauauucagagguagcuacuuagccggggccggguuggcuuucagccuuaugaaaaguuuaggaggcggacgacgaggaaccggggcgcaaggugaaacucuuggagaaaaauggaaacgacaacuaaaccaauuaaguaagucggaauuuaacacuuauaaacgauccggaauaauggagguggaccgaagugaagcaaaagaggguuuaaagagaggagaaacuaccaaacaugcuguaucccgaggcacagcuaagcuccguugguuugucgaacggaacuugguaaaaccggagggaaaaguuaucgauuuaggaugcggaaggggaggguggucauauuauugcgccgggcuaaagaaaguaaccgaaguaaaagguuauacaaaaggugggccaggacacgaagaaccaauaccgauggcuacguaugguuggaacuuaguaaaacugcacucaggcaaagacguauucuuuauaccucccgaaaaaugugauacucuauugugugauauaggugaaucaaguccgaauccuacuauagaagaggguagaacucuucgugucuuaaagaugguugagccuugguuaagagguaaccaauucuguaucaaaauucuaaauccauauaugccaaguguaguggaaacgcuagaacaaaugcaaagaaaacauggcggcaugcuuguccgcaacccacuaagucgaaacaguacacacgaaauguacugggugucguguggaacugguaauauuguuagcgcagucaacaugacuucucguauguuguugaauagguuuacgauggcccacagaaaaccaaccuaugaaagagauguggacuuaggagcagguacuaggcauguagcagucgaaccagaaguugcaaauuuagacauaauaggacaaaggauagagaacauuaagcaugaacauaaaagcacauggcauuaugacgaagauaauccguauaaaaccugggccuaccaugguucuuaugaggugaaaccuaguggaucggcaaguaguauggugaauggaguuguuaaacuauuaacuaaaccuugggacguaaucccaaugguaacacaaaucgcaaugacagauacaacaccauucggacaacaaagaguguucaaagaaaaaguugauacucguacaccaaaagcaaaaaggggaacagcccagauaauggaaguuacggcaaaguggcuauggggguuccucagcagaaauaagaaaccacggauauguacacgagaagaauuuacgagaaaaguacgaucuaaugcagcaauaggugcaguguuuguggacgaaaaccaauggaacucggcuaaagaggcuguagaggacgaacguuucugggaccucguacaccgagagagggaauuacacaagcaagguaagugugcaacuugcguauacaacaugaugggaaaaagagaaaagaaauuaggagaauuuggaaaggcuaaaggaaguagagcuaucugguauaugugguugggagcucgauuccuugaauuugaagcucuuggauucaugaacgaggaucacugguucaguagagagaauagcuuaagcgguguggagggggaaggguuacauaaauuagguuauauauuaagagacauauccaagauccccggaggaaauauguaugcagacgacacugcuggaugggacacuagaauuaccgaagaugacuuacaaaaugaagcuaggauuacagauaccauggagccagaacacgcauuacuagcgcgaaguauauuuaagcuaaccuaccaaaauaaagucgucagaguucagcguccagccaaaaauggcaccguaauggauguuauaaguaggagagaucagagaggcucuggacaaguaggcacauacggucuuaauacguuuacaaacauggaagcucaauuaaucagacaaauggaauccgaaggaauauuuagucccagugaauuagagacaccaaaucucgcggaaaggguacuagacugguuagaaaaauacgggguagaaagguuaaagagaauggcuauuucuggagaugacugcguaguaaaaccuauagaugauagauuugcaacggcucuaacagcucuaaacgacaugggcaagguaagaaaagauauaccccaaugggagccgagcaaaggcuggaaugauuggcaacaaguuccauucugcucacaccacuuucaucaacuaauaaugaaggaugguagagagauuguuguacccuguagaaaccaggacgaguuaguugggagggcacgagucucccaaggcgcugguuggucauugagagaaacagccuguuuggguaaaucauacgcacagauguggcagcuaauguauuuccaucggcgugacuuaagacuggccgcaaaugcgauauguucggcaguccccgucgacuggauaccgacaucgcguaccacuuggucaauucaugcucaccaccaauggaugacaacagaagauauguugaguguauggaauagaguguggauagaggaaaauccauggauggaagacaaaacucauauaucgagcuggggugacgucccauauuuggguaaaagggaagaucaaugguguggaagucuuaucggccucacagcacgugcuacaugggccacgaauauacagguagcaaucaaccaaguacgccgucugauaggaaaugagaacuauuuggauuacaugaccaguaugaaaagauuuaaaaaugaaucugauccugaaggcgcguugugguag

SEQ ID NO: 21941 - RNA, 9879 nt, Artificial Sequence
  derived and/or modified CDS sequence (opt6) from DENV-1__EU482499__SS-prME
ucagugaccaugcucuugaugcuaaugccaaccgcuuuagcauuucauuugacgaccagggguggugaaccacacaugauuguaucuaaacaagaaaggggaaaaagccuacuguuuaaaacaagcgcuggaguaaauauguguacacucauugcaauggaccuaggugaauuaugugaggacacaaugacguauaaaugcccuagaauuacagaaaccgaaccagacgacguugauuguuggugcaaugcaacggauaccugggugacuuaugguaccuguucucaaacuggugagcaccgaagggauaaaagaucuguagcacuugcaccgcauguaggacuagggcuagagacuagaacagaaacguggaugucaagugagggcgcuuggaaacaaauacaaaggguagaaacuugggcauuacgccacccugguuuuacugugauugcacuuuuucuggcgcacgcaauagguacgucaauuacccaaaaaggaauuaucuuuauauuauuaaugcuagugacaccauccauggcaaugcgguguguggggauuggaagcagagauuuuguugaaggguuaucaggcgccaccuggguagacgugguucuagagcacggcucauguguuacaaccauggcaaaagauaaaccaacacuagacaucgaauuauuaaaaaccgagguaacaaacccagcuguauuaagaaaauuaugcauugaagcaaaaauaucaaauacaacaaccgacucaagauguccaacccaaggugaggcaacuuugguagaggaacaagaugcaaauuucgucugcagaagaaccuuuguugaucggggaugggguaacggaugcgggcuguucgggaaagggagucuuaucacgugcgcuaaauuuaaaugugucacaaaauuggaagguaaaaucguacaauacgaaaaucuuaaauacaguguuaucguuacagugcauacuggagaucaacaucaagucggaaaugaaagcacagaacauggaacuacggcgaccauaaccccucaagcuccgacgacugaaauucaauuaacugacuacggugcucuuacguuagauuguagcccacgaacaggguuagacuucaacgaaauggugcuauugacgaugaaggaaaaaucaugguuaguucacaaacaaugguuucuagaucuuccauugccauggacaaguggugcaucuacaagucaagaaacauggaaucgccaggaccucuuaguaaccuuuaaaacugcacacgccaagaaacaagaaguugucgucuuggggagccaagagggggccaugcauaccgcucuaacuggugcaacagaaauucaaacuucaggaacuacaacuauauuugccgggcaccuuaagugccggcucaagauggauaagcugacacuaaaaggaaugucauauguuauguguacaggaucauuuaaacuugaaaaagaaguagccgaaacgcaacauggaacaguccuuguucaaauuaaauacgaaggaacagaugcuccuuguaaaaucccuuucuccacucaggaugaaaagggcguaacucagaauggcagauugaucacagcaaacccaaucguuacugauaaagagaaaccaguuaauauagaggcugaaccaccauuuggugaaaguuacaucauaauaggugcaggagagaaagcacuuaaauuaucaugguucaagaaaggaaguucuauaggcaagauguucgaggcuacggcuaggggagcaagacgaauggcaauuuuaggagauacagcuugggauuuuggaagcauugguggaguauucaccucuguuggcaaguuagugcaccaaauauucggaacagcauacggcguccuauuuucuggugugaguuggacaaugaaaauaggcauaggaguauuacuaacguggcucggauugaauagccguuccaccucacuuucaaugacuuguauagcuguuggauuaguaacacucuauuuaggcguuaugguacaagcagacaguggaugcgugauaaacuggaagggaagagaauugaaaugcgggucaggaauauucguaaccaacgaaguacauacuuggacugaacaguauaaauuccaagcugauagcccaaagagacuaucugcggcuauuggaaaagcgugggaagaaggaguaugugggauccggucagcaacaagauuagaaaauauaauguggaaacaaauaaguaacgaauuaaaucacauccuucuggaaaacgacaugaaauuuacgguagucguuggagacguagcagguauauuagcccaaggcaagaaaaugauucgcccacaaccaauggaauacaaauacucguggaagaguuggggcaaagcuaagauaaucggagcagacguacaaaacacuaccuucauaauagauggaccaaauacccccgaauguccggaugaucaaagagccuggaacauaugggagguagaggauuauggauucggcauauucacuacuaacauuuggcuaaaauugagagacagccauacgcaaguuugcgaucaucgacuaaugucugcagcaaucaaagacucgaaagcagugcaugccgauaugggauacuggaucgaaucagagaaaaacgaaaccuggaagcuagcaagagcuuccuuuaucgaaguuaagacaugcauuuggccgaaaagucauacuuuauggagcaacgggguccucgaaucagaaaugaucaucccaaagaucuaugguggcccaaucucacaacauaacuaccguccaggauauuuuacacaaaccgcagguccauggcaucuagguaaauuagaguuagauuuugaucugugugagggaaccacuguaguugucgacgaacacugugggaaucgaggaccauccuuacggacgacgacagucacuggcaaaauaauacacgaaugguguuguagguccugcacgcucccgcccuuacguuuccgaggggaagaugguugcugguacgguauggaaauaagaccuguaaaagaaaaggaagaaaaucuuguuaaaagcauggucucagccgggaguggcgaaguugauaguuuuucccuagggcuauuauguaucucuauaaugauugaagaaguuaugaggagccgauggucgaggaagaugcuaaugacagguacacuagcaguauucuuuuuacucauaaugggacagcuaacuuggaaugaucuaauuagacuaugcaucaugguaggagcaaacgccucggaucggauggggaugggcacaaccuauuuagcauuaauggcuaccuucaaaaugagaccaauguuugcaguaggauuguuauuucgaaggcuaacaagccgggagguguugcuccuaacgaucggcuugucgcucguugcuuccguggagcuaccaaacagccuagaagaacuaggugacggcuuggcgaugggaauuaugauucuaaaacuccugacagacuuucaaucgcaccaacuuugggcaacacuucuuuccuugacguuuauaaaaacuaccuuuagucuucacuaugccuggaaaaccauggccaugguuuuaagcaucguaucucuauuuccacuguguuuaagcacuacuagccagaaaacgacaugguuaccaguacuacuggggagccuuggauguaaaccacuuacaauguucuuaauugccgagaauaagaucuggggucgaagaaguuggccucugaacgaaggaauaauggccguugggauuguuucaauuuuacuuaguucacuucucaaaaaugauguaccauuagcaggaccauuaauugcgggcggaauguuaaucgcaugcuauguaaucaguggaucauccgcugaucuaaguuuagaaaaggcugcagaaguaagcugggaagaggaagcugaacauucuggcgcaucacacaauauauugguagagguacaagacgaugguacaaugaaaauaaaggacgaggaaagagacgacacgcugacaauauuauugaaagcuacauugcuugcaguaaguggaguuuauccgcucagcauaccagcaacacuauuuguaugguacuuuuggcagaaaaagaaacaacgauccgguguacuaugggauacgccuaguccaccggaaguagaacgggccguacucgacgacggcaucuauagaauaaugcagaggggccuuuuaggacggagucaaguugguguaggcguguuucaggaaaacguauuucauaccauguggcaugucacaagaggugcaguccuaauguaccaagggaaacgccuagaaccaucuugggcuaguguaaagaaagacuugauuuccuacggaggagguuggagguuacaagguaguuggaauacuggcgaggaaguucaagugauugcaguggaacccggcaaaaaucccaaaaauguacaaacugcuccgggaacauucaaaacaccagaaggcgagguuggagcuauagcucuagauuuuaaaccagguacaucgggaucaccgauuguaaaccgagaggguaagauuguuggacuuuaugggaauggaguaguuacaacaaguggaacuuauguaucugcaauugcacaagcaaaagcaucacaagagggaccacucccagagauugaggaugaggucuuuaggaaaagaaacuuaacaauaauggacuuacauccaggcucuggaaagaccaggagauauuuacccgcaauagucagagaggcaauuaaaaggaaacuuagaacuuuaauucucgcuccuacgagagucguagcaagcgagauggcagaagcacucaaaggcaugccuaucagauaccaaacaacagcuguaaaaucagaacauacaggaaaggaaauuguagauuuaaugugccacgcuacuuuuacuaugcgccuacucucgccuguacgcgucccaaauuauaauaugauaaucauggaugaagcucacuucacagauccaucuuccauagcugcacgaggguacaucucaacucguguaggaaugggcgaagcggcugccauuuuuaugacugcaacuccucccggaucuguagaggccuuuccgcaaucuaaugccgugauccaagaugaagaacgggacauaccugaaagaucauggaacucaggauacgaguggauaacugauuucccaggaaagacuguaugguuuguaccauccauaaaaucuggcaacgauauugcuaauuguuuacgaaagaauggcaaacgaguaauacaacuaucaagaaagacauuugauacggaauaccagaaaacgaagaauaacgauugggauuauguaguaacaacagauauaucugaaaugggagccaauuuuagggcggacagaguaauagauccaagacgaugccuuaaaccugucauauuaaaagauggcccugagcgaguaauacuugcaggaccaaugccagugacagucgccagcgcugcucagcgacggggcagaaucggcaggaaucauaacaaagagggggaccaauauauauacaugggucagccauuaaauaacgacgaagaucacgcacauuggacagaagcaaaaauguuacucgacaauauuaauacaccggaagguauaauaccagcauuauuugaaccugaacgagaaaaaucugcggccauugauggagaguaccguuugcguggagaagcgagaaagacauuuguagagcuuaugcgucgcggggauuuaccaguauggcuaaguuauaaaguugcaucagaagguuuucaauacucugauaggcgaugguguuuugacggagagagaaauaaccaaguccuggaagaaaauauggauguugagauauggaccaaggaaggcgaacgcaagaaacuucguccucgaugguuggaugcacggacauauagugauccacucgcacuacgugaguuuaaggaauuugcagccggaagaaggucugucucaggcgaucuuauacuagaaauaggcaaacuaccacaacaccuuacucaaagagcucaaaaugcgcuggacaaucuagucauguugcacaauagugaacaaggagggcgagcuuaccgacacgcuauggaagaauuaccagauaccauugaaacgcucaugcuguuagcauuaauugcggucuuaaccgggggcguaacgcuguucuuuuuauccggaagaggacuugggaagacaucuauaggccuguugugcguaauggcuagcaguguauuguuguggauggcaucgguagaaccacacuggaucgcugccucaauaauucuagaguucuuuuuaaugguacuucuaauuccugaaccagaucggcaaagaacuccacaggacaaucaauuagccuacguggucauaggucuacuauuuaugauauugacaguugcugcgaacgaaauggggcuacucgagacgaccaagaaagaccuuggaauuggacacguggcaguugaaaaccaucaucacgccgcuaugcuagaugucgaccugcacccugcuuccgcauggacuuuauaugcgguggcuaccaccauaaucacaccuaugaugagacacacuaucgaaaacacuacagcaaauauaucucuuaccgccauugcuaaucaagcagcgauauuaaugggucuggauaaaggauggcccauaagcaaaauggacauaggaguaccuuuacucgcacuaggaugcuacagucaagugaaccccuuaacguuaacagcggcuguacuaaugcugguagcccacuaugcaaucauagguccuggccuccaagcgaaagcuacacgagaggcucaaaaacguaccgccgccggaaucaugaaaaacccuacgguagacggaauuguggcaauugaucucgauccgguaguauaugaugcuaaauuugaaaagcaacuuggccaaauuaugcuacuaauacuuuguaccucccaaauccuacugaugaggacuaccugggcgcuaugcgaaucaauuacucuugcaacagguccucucacuacauuaugggaagggucaccggguaaauuuuggaauaccacaaucgccguaucaauggcuaauauauuuaggggaagcuaucucgcgggugcgggauuagcuuuuucauuaaugaaaucguuagguggaggacgccgaggaacuggcgcacagggagaaacgcuaggagaaaaauggaaacgacaacuaaaccaacuaucgaaaucggaguucaauacuuacaagagaucagguauaauggaagucgauagaucagaggccaaggaaggucuaaagcgcggcgaaacuacaaaacaugccguuagccgcggcacggcaaaauugagaugguuuguugaaagaaacuuaguaaaaccugaaggcaaagucauagaccugggguguggccgcggaggcuggagcuacuacugcgcgggccuuaaaaagguaacugaagucaaaggauacacgaaagggggaccaggucacgaagaacccauaccuauggcgacguauggcuggaauuugguuaaacuucauucagguaaggauguauucuucauaccaccggaaaagugugauacauugcuaugcgacauaggagaaucaucaccaaauccaacaauugaagaaggucgcacgcuacgaguguuaaagaugguugagcccuggcuacgugguaaccaauuuuguauaaaaauauuaaaucccuacaugcccucaguaguugagaccuuagaacaaaugcaacgaaagcaugggggcaugcuuguuagaaacccguugucuagaaauuccacgcaugaaauguauugggucucaugcggcaccgggaauauuguaagugcaguaaauaugaccaguaggauguugcuaaauagguucacuauggcucauagaaagccuacuuaugagagagauguugaucuaggagccgguaccagacacguagcugucgagccagaagucgccaauuuagacauuauuggccagagaauugagaauaucaaacaugaacauaaaagcacauggcacuaugaugaagacaacccguacaaaacuugggcauaccauggaaguuacgaaguaaagccaucaggaucugcuaguaguauggucaaugggguugucaaacuacuuacuaaaccuugggauguaauuccaauggugacgcaaauugccaugacagauacgacaccuuuuggacaacagcgcguauuuaaagagaaaguugauacaagaacgccgaaagcgaaaagagggacugcccagauuauggaaguaaccgcgaaaugguuguggggauuucuuucaagaaauaagaaaccacgaaucugcacccgggaggaguucacgaggaaaguacgaaguaaugccgccauaggggcuguuuuugucgaugagaaccaauggaauagcgcaaaggaagcaguugaagaugaaagauucugggaccuaguucacagagaaagagaacugcauaaacaaggaaaaugcgcaacaugcguguauaauaugaugggaaaacgugaaaagaaauugggggaguuugguaaagccaaaggaagcagagccauaugguacaugugguuaggcgcacgauuuuuggaauuugaagcucuaggauucaugaacgaagaccacugguuuucaagggaaaauucucuuagcgguguggagggggagggccuucacaaguugggauacauacuuagggauaucagcaaaaucccgggugguaacauguaugcugacgacacagcuggaugggacacacgaauuacagaagaugaucuacaaaaugaagcucgaauaacagauaucauggaacccgaacaugcauuacucgcaaaauccauauuuaaacuaacuuaucagaacaaaguuguuaggguucaacguccagcgaagaacgguacaguaauggacgugauaucgagacgagaucagcggggcaguggccaagugggaacauauggccuuaauacguucacaaauauggaagcacaacugauaagacaaauggaaagugaaggcauauuuuccccauccgaacuugaaacaccgaaccuugcugaaagagugcuagauugguugaaaaaguauggcgucgagcgcuuaaaacgaauggcgauaucuggagacgauuguguaguaaagccaauugaugacagauuugcaacugcauuaacugcacuuaacgacaugggaaaaguaagaaaagauauaccucaaugggagccaucaaaaggguggaaugacuggcagcaaguuccuuuuuguagucaucacuuucaccaacugauaaugaaggauggaagagaaaucgugguuccuugccgcaaucaggacgaauuagucggaagggcuagagucagucaaggggcagguugguccuuacgcgaaacggcaugucuggguaagaguuaugcacaaauguggcaauugauguauuuccaccguagagaccugcguuuagcagcaaaugcaauuuguucagcaguaccaguugacuggauacccaccuccaggacaacgugguccauacaugcacaucaucaauggaugacgacggaggauauguugucaguauggaauagaguauggauagaagagaacccauggauggaagauaaaacucacaucucaucaugggaggauguacccuauuuaggcaaacgagaagaucaauggugugggaguuugauagguuuaacugcacgugcuacuugggcaacaaauauucaaguagcuauuaaccagguccguagacuaauagguaaugaaaacuauuuggauuacaugacaagcaugaagcgauuuaaaaacgaaggagaucccgaaggagcucuaugguga

SEQ ID NO: 21942 - RNA, 9879 nt, Artificial Sequence
  derived and/or modified CDS sequence (opt6) from DENV-1__EU482500__SS-prME
ucuguuacgauguuauuaauguuaaugcccacugcauuagcuuuucauuuaacaacgcgaggaggggagccucauaugauugucaguaaacaagagagaggaaaaucccuauuauuuaaaacuucagcgggugucaauauguguacucugauagcaauggacuuaggagaacucugugaagauacgaugacuuauaaauguccacguauuacagaaacagaaccagaugacgucgacuguugguguaaugcaacagauaccuggguaacguauggaacuuguagucaaacuggcgaacaccgaagagacaaaagauccguggcuuuagcaccucaugugggacuagggcuggaaacacggacagagacauggaugucaucugaaggcgcauggaaacaaauccagagaguagaaacaugggcguuacgccauccaggauuuacugucauagcauuauuccuggcucacgcuauuggaacaaguaucacucagaaaggaauuauuuucauacuauuaauguuggugacaccaagcauggcaaugagaugugucgguauagggucuagagauuucguagaaggauuaucaggugcaacguggguagacgucguauuagaacacggaucauguguuacuacuauggcaaaagacaaaccuacucuagauauugaacucuuaaaaacugaagucaccaaccccgcagugcuccggaaauuauguaucgaggcuaaaauaaguaacaccacuacggacaguagaugccccacccagggggaagccacacucgucgaagaacaagaugcaaacuuuguguguagacgaacauuuguagaucgagguugggguaauggcuguggacuauuugggaaagguucacuaauaacgugcgcaaaauucaaauguguaaccaaacuagaagggaaaaucguacaauaugaaaaccuuaaauauucuguaaucgucacaguucacacaggggaccaacaucaaguuggaaacgaaucaacugaacaugguacuacagcaacuaucacuccgcaagcgccaaccacagaaauccaguuaaccgacuacggcgcgcuuacucuagacugcucaccucggaccgguuuagauuuuaaugagauggugcuauuaacaaugaaagaaaaaucaugguuaguacacaaacaaugguuucuugaccugccucuucccuggacaucaggggcaaguacuucacaagaaaccuggaauaggcaagacuugcuaguuacuuuuaaaacagcucaugccaagaaacaagaaguuguaguucuaggaucucaagaaggagcgaugcauacugcacuaacaggggcgacggaaauccaaacgucagguacgacaacaauauuugcuggacaccugaaauguagacuuaaaauggauaaauugacccugaaagguaugucauaugucaugugcacagguaguuuuaaacuagaaaaagaaguagcugagacgcaacauggaacuguacugguucagauuaaauaugaagggacugacgcaccauguaagauuccauuuuccacacaagaugaaaaaggagugacacaaaacgguaggcuuauaacggccaacccaauaguaacggacaaagaaaagccuguuaauauagaagccgaaccgccuuuuggagagucuuauauuauaauaggagcuggcgaaaaggcguugaaacugaguugguuuaaaaagggauccucaaucggaaagauguuugaggcaaccgcacgcggagccaggcgaauggcgauauuaggagauacugcaugggauuuugguucaauugguggaguauucacaaguguaggaaaguuggugcaucaaauauuuggaacagcguacgguguauuauuuucagguguaaguuggacaaugaaaaucgggaucggaguuuuacucacaugguuaggauuaaauagucgaaguaccaguuuaaguaugaccuguauagcgguuggauuagugacacuauaucuagguguaaugguacaggcagacucaggaugcguaauuaauuggaagggcagggaauuaaaauguggaagcggaauuuuugucacaaaugagguacauacauggacagagcaauauaaguuucaagcagauucuccgaaaaggcugucggcugcgauagguaaagcgugggaggagggggucuguggaauacgcucggcuacucgccuagagaauauuauguggaagcaaauaucaaacgaacuaaaucauauccuccuugaaaacgauaugaaauucacuguggucguaggagauguggcgggaauccucgcacagggcaagaaaaugaucagaccgcaaccaauggaauauaaguacagcuggaaauccugggguaaagcaaaaauaauuggugcagauguacaaaauaccacuuucauuaucgacggacccaacacuccagaaugcccugaugaucagagagcauggaauauaugggagguagaagauuauggauuuggaauuuucaccacaaauaucuggcucaagcuacgcgauagucauacacaagugugugaucacagacuuaugucagcagcgauuaaagauucaaaagcaguccacgcggacauggguuacuggaucgaaucagagaaaaacgaaaccuggaaguuagcucgugcaucauuuauugagguaaaaacaugcauauggccuaaaucgcauacccuguggucgaacggaguacuugaauccgagaugauaauuccgaagauauauggaggaccaauuucgcaacauaauuacagaccaggguauuuuacacagacugcaggcccauggcaccuagguaaauuggaauuagacuuugacuuaugugaagggacaacaguagugguugacgaacacugcggcaauagggguccgagccuaagaacaacuaccgugacagguaagauaauacaugaaugguguugucgaaguuguacacuaccaccuuuacgauuuagaggagaggacgguuguugguauggcauggaaauucguccugucaaagagaaggaagaaaacuugguaaaauccaugguaucagccggcucaggggaaguagauucauuuuccuuaggcuuauuaugcauaucuauuaugauagaggagguaaugcgaaguagauggaguagaaaaaugcuaaugacagguacacuugcuguuuucuuccuuuuaauaaugggucaacugaccuggaacgaucuaauacgucuaugcauuaugguaggugcaaaugcaagcgacagaaugggaauggguacaacguaccuagcuuuaauggccacuuuuaagaugcgcccuauguuugcaguagguuuauuauuucgccgcuugacgucaagagaaguuuuacugcuaacuauuggacucucuuugguagccaguguugaguuaccaaauaguuuagaagaguuaggugacggccuggcuauggguauaaugauauugaaauuacuaaccgacuuccaaagccaucaguuaugggcuacacuauuaucucucaccuuuauaaaaacaacguucuccuugcacuaugcuuggaaaacaauggcaaugguacuuucaauuguuaguuuauuuccacuauguuuaucgacaacaagccagaaaacuacaugguugccggugcuacuaggaaguuugggauguaaacccuugacaauguuuuugaucgcugaaaauaaaauauggggucggagauccuggccccuuaaugagggaauaauggccgucgguauaguuucuauucuacuuagcagccuacucaaaaaugacguaccucuagcuggaccgcugauagcaggcgguauguuaauagcauguuauguaauuagugguaguucggcggauuugucuuuagaaaaagcggcagaaguuucgugggaagaggaagcugaacauucgggggcuucucauaauauucuaguggaaguacaagaugaugguacuaugaaaaucaaagacgaagaacgugaugacacacuuacuaucuuacuaaaagcgacccuuuuagcgguaucuggcguauauccauuaagcauccccgcgacgcuauucguaugguauuuuuggcaaaagaagaaacaacgaaguggaguacugugggauacaccaaguccaccagaaguggaaagagcuguacuggacgacggaauauauagaauaaugcaaagaggauuacucggacgaucacaaguaggaguuggcguauuucaagaaaauguauuucacacgauguggcauguuacccgaggugcgguuuuaauguaccaaggaaaaagacuagagccuagcugggcuucggucaagaaagaccugauaucauauggaggcgguuggagacugcaagguaguuggaauaccggagaagaagugcaaguuaucgcaguagaaccaggcaaaaauccaaagaauguacaaacagcaccuggaaccuucaagacaccagagggagaaguaggcgcaauagcacucgacuuuaaaccaggaacgaguggaucuccuaucgucaaucgggaaggaaaaaucguuggacuuuauggaaaugguguaguuacuaccucaggaacauauguuucggcuauagcacaggcgaaggccagccaagaaggcccccuuccagaaauagaagaugaaguguucagaaaaagaaauuuaacgauaauggacuuacauccuggaucggguaaaacaagacgcuacuuaccugcuaucguucgagaagcaauaaagcgaaaauugcggaccuugauacuugcaccgacucgugucguggcuucagagauggcagaggcgcucaaagguaugccgaucagauaucagacuacagcuguaaagagugaacacacugguaaagaaauuguugaccugaugugucacgcuacauuuacuaugcgauuacucaguccaguaaggguuccaaacuauaacaugauaauuauggaugaggcgcacuucaccgaccccaguucaauugccgcccguggcuacauaagcaccagaguaggcaugggcgaagcagcagcaauauuuaugaccgcaacaccaccaggaucuguagaagcauuuccccagaguaacgcaguaauacaagaugaggaacgagauaucccugaaaggagcuggaauagcgguuacgaauggauaacugauuuuccaggaaaaaccguaugguucgugccgaguauaaaaucaggaaacgacauagcaaauugucugaggaaaaacgggaaaagaguaauacaacugucacgaaaaacauucgauacugaauaucagaaaacuaagaauaacgauugggauuacgucguuacaaccgauaucucugaaaugggugcuaacuuuagagcugacagaguaauagauccaagaagaugccuuaaaccaguaauucuuaaggauggcccagaaagaguaauacuggcgggaccuaugccugucaccguagcaucugcagcgcaaagaagaggucguaucggacgcaaucauaauaaagaaggagaccaguacauuuauaugggacaaccacuaaauaaugacgaagaccacgcacacuggacugaggcuaagaugcuuuuagauaauauaaauacaccagaagggauaauuccugcucucuucgaaccugaaagagaaaaaucugccgccauugauggagaauauagacuuagaggagaggcaagaaagacauuuguugaguugaugcggcgaggggaucuaccuguauggcuaaguuauaagguugcaagcgaaggauuucaguacagcgauagaagaugguguuuugacggugaaagaaauaaccaagucuuagaagaaaacauggacguugagauauggacaaaggagggcgagaggaagaaacuuagaccgagguggcuagaugcacgaacguacagugacccuuuagcauuaagagaguucaaagaauuugcagcaggacgaagaaguguauccggcgacuuaauauuggaaauuggaaaacugccacaacaccuaacacaacgagcgcaaaacgcucuagacaaucuagugauguuacauaauagcgaacaaggaggcagggcguauagacacgcaauggaggaacuucccgacacaauagaaacucuaaugcuuuuagcauuaauugcuguacuaacagguggagugacacuguuuuuccuauccggaagaggacuuggcaaaacaagcauuggcuuguuguguguaauggcaucaaguguucuacuauggauggccuccguggagccacauuggauugccgcuuccauaauauuggaguucuuuuuaaugguguugcuuauacccgaaccugacagacaacguacaccacaagacaaccaauuagcauaugucguaaucggccuauuauuuaugauacuuacaguggccgcuaacgagaugggucuauuagaaaccacgaagaaagacuuaggcauaggacaugucgcaguugagaaucaucaccaugcggcgaugcuagauguugauuuacacccggcgagugccuggacucuguacgcugucgcuaccacgauaaucacgccgaugaugcgccacacuauugagaauacgacagcuaacaucuccuugacagcaauagcaaaucaagcggcaauuuuaaugggauuggacaagggguggccgauuuccaaaauggacauugguguaccgcuucuagcacugggaugcuacucacaaguaaauccccuuacccucacggcagcaguuuugaugcuuguggcacauuacgcaauaauuggacccgguuugcaggcuaaagccacgcgugaggcucaaaagagaacugccgcuggaauuaugaaaaauccuacaguugacggcaucguugccauagauuuggacccuguagucuacgacgcaaaauuugagaagcaacucggacagauuaugcuauuaauucuuuguacgagucaaauccuccuaaugcgaacgacuugggcccuaugugaaucaauuacacuugcuacgggaccucuaacuacacuuugggaagguuccccagggaaauuuuggaacacgacgauugcgguuaguauggcaaauauauucagggggucuuaccucgcgggugcaggauuagcauuuucguuaaugaaauccuuaggaggaggacgaagaggcaccggagcacaaggagaaacuuuaggagaaaaguggaagcgacaacuaaaucaauuaucaaaaucggaauuuaacaccuauaaaagaucgggaauaauggaaguugauagaagugaggcaaaagaaggauuaaaacgcggugaaacgacuaagcaugcgguaucccgugggacagcgaaacuucguugguucguugaaagaaaccuagucaaaccugaagguaaggucauagaucuugguugugguagagguggcuggucguacuacugugcuggccuaaagaaggugacugagguaaaagguuauacgaaaggaggacccgggcacgaggaaccaauacccauggcaacuuaugguuggaaccucgucaaacuccacaguggaaaggaugucuuuuucauaccaccagaaaaaugcgacacauuacuaugugauauuggcgaaucgucaccaaauccgacaauugaagaggggagaacacuaaggguauugaaaauggucgagccauggcuaagaggaaaucaguuuuguaucaaaauauuaaauccuuacaugcccucuguaguagaaacacuagaacagaugcaaagaaaacauggagggaugcuagugagaaacccuuuaucacgaaacaguacacacgaaauguacugggugucaugcggaaccgggaacaucgugagcgccgucaauaugacaucaagaauguuguuaaaucgguucacaauggcucaucguaaaccgacauacgagcgugacguugacuugggugcagguacgagacaugucgcgguagagccugaaauagcuaaucuugauauuauaggacaaagaauagaaaauauaaaacaugagcacaagucuacauggcacuaugaugaagauaacccguauaaaacaugggcauaucaugguaguuaugaagucaaaccaucggguucugcgucaucgaugguaaacggaguuguaaaauuguuaaccaaaccgugggacguaauucccauggugacacaaauagcuaugacagacacaacuccuuucggucaacaaagagucuuuaaagaaaagguggacacuaggacacccaaagcuaagaggggaacggcacagauaauggaggugacagccaagugguuauggggguucuugucucguaauaaaaagccucggauauguacuagggaagaauuuacgaggaaaguaagaagcaaugcggcuauuggugcgguauuuguugaugaaaaucaauggaauagcgcuaaagaagcaguggaagacgagcguuuuugggaucuuguccaucgugaaagggagcugcacaagcaagggaaaugcgcaacuuguguuuacaauaugauggguaaacgagaaaagaaauuaggagaguuugggaaagccaaagguucucgugcaauuugguauaugugguuaggagcccgauuccucgaauuugaagcauuaggauuuaugaacgaagaccauugguuuaguagagaaaauagcuugaguggaguugagggggaagguuugcacaaauuaggauauauucuacgagacauaucuaagauaccuggaggaaacauguacgcagaugacaccgccggcugggacacuagaaucacugaagacgaccuacaaaacgaagcacgaauaacugauauuauggaagccgaacacgcauuacuagccaaaucaauauuuaaguuaacuuaccagaacaaaguggugcgaguacagcgccccgcuaaaaaugggacaguaauggacguaauaaguagaagagaucaaagaggcucgggccaaguuggaacuuauggucuaaauaccuuuacuaacauggaggcucaauuaauuagacaaauggagagugaagguauauucaguccaagugagcucgaaacgcccaaucucgcugaaagaguuuuagauugguuagaaaaauacggaguagaacgacucaaaaggauggcgaucucgggggaugauugugucguuaaaccgauagacgaccgcuuugcuaccgcccuaacagcuuugaaugacauggguaaaguacggaaagauauaccacaaugggagccaaguaaagguuggaacgauuggcaacaggucccuuucugcagucaucacuuccaccaauuaauaaugaaagaugggcgagaaauaguaguuccuugucggaaccaagacgaauuagucgggcgagcaagaguaucucagggggcaggauggucgcuuagggagacugcaugcuuagguaaauccuacgcucagauguggcaauuaauguacuuucacagaagggaccuuagauuagcagcaaaugccauuuguucagcugucccgguugacuggauuccaaccagcagaacuacguggucuauacaugcucaucaucaauggaugacgacagaagacaugcuaaguguauggaauagaguguggauagaagaaaauccuuggauggaagacaaaacacauauaaguucuuggggugacguaccauaucugggaaaacgggaagaccaguggugcggaagccucauaggacucacagcuagagcuacgugggcuacuaauauacagguagcaauaaaucagguccggagacuuauaggaaaugaaaauuaucuggauuacaugaccucaaugaagagauucaagaaugagggugaccccgaaggagcacugugguaa

SEQ ID NO: 21943 - RNA, 9879 nt, Artificial Sequence
  derived and/or modified CDS sequence (opt6) from DENV-1__EU482501__SS-prME
ucaguaacaaugcuauuaaugcuuaugcccacagcucuugcguuucaucuaacuacacgugguggagaaccacauaugauaguuucaaaacaggaaagaggaaaaagccuguuauuuaaaacaagugcugguguaaauaugugcacucuaaucgcgauggaucuaggagaacuuugcgaagacacaaugacauacaaaugcccucgcauaacggaaacggaaccggacgauguagauuguuggugcaacgcuacagauacguggguaacguaugguacauguucacaaacgggugaacaucggcgugacaaaaggucggucgcauuagccccucauguugggcuaggauuagaaacacguacagaaacauggaugucuagcgaaggagcuuggaaacaaauccagagagucgaaacaugggcacuucggcauccaggguuuacaguaaucgcacuauuucuagcacaugcaauaggcacaaguauuacucaaaaaggaaucauauucauccuacuaaugcuagugaccccaaguauggccaugagaugugucggaauagggucaagagacuuuguagaggguuugucaggugcuaccuggguagauguaguuuuagaacaugguaguuguguaacaacgauggcaaaagacaaaccuacacucgacauagaauugcuuaaaacagagguuacgaacccagcagucuuaaggaaauuauguauagaggccaaaauaucuaauacaacaacugauucacgauguccaacgcaaggugaagcaaccuuaguagaagaacaagaugcaaauuuugucugccggcgaacauuuguugauagaggauggggaaauggcuguggucuauuugggaaaggcucccugauuacuugugcuaaauucaaauguguuacgaaacuagaagggaaaauaguacaguacgaaaaccuuaaauacucgguuauaguaaccguucacacaggcgaucaacaucaaguuggaaacgagucaacagagcauggaacuaccgcuacaauaacaccccaagcacccacaacagaaauccaauuaacagauuauggggcacuaacacuagauugcucaccucgaacaggacuagauuucaacgaaaugguccuguugacaaugaaagagaaaaguuggcugguucacaaacagugguuccuagaucugccauuaccauggacgaguggugcauccacgucucaagaaacauggaaccgacaggaucuccuaguuacuuuuaaaacagcgcacgcuaagaaacaggaagucguuguauuggggagucaagaaggagcuaugcauacagcacuaacaggagcaacggaaauacaaacauccggaacaacaacuauauuugcagggcauuuaaaaugcagguuaaaaauggauaagcuaacacuaaaggggauguccuacgugauguguacgggaaguuuuaaacucgagaaagaaguggcugaaacacaacacgggacgguauuaguccaaaucaaauacgagggaacugaugcacccugcaaaaucccguuuucuacacaggacgagaaagggguaacucaaaaugggaggcucauaacagcgaauccgauugugacggauaaagaaaaaccaguaaauauagaagcggagccacccuuuggagaaucuuauaucgucauuggagcaggagaaaaagccuuaaaacuuucgugguucaagaagggaaguucuauugggaaaauguucgaagcaaccgcaagaggggcaaggcgaauggcgauauugggagauaccgccugggauuucggaucaauaggaggcguauucaccagcguaggaaaauugguacaccaaauauucggaacggccuaugguguacuauuuucaggugucucguggacgaugaaaaucggaauagguguucuauuaacguggcuaggacuaaauagucgaagcacgucgcuaucuaugaccuguauugcugugggauugguaacauuauauuuaggaguaaugguacaagcugacucaggaugcgugauaaacuggaaagguagggaacuuaaaugcggcucuggcauauucguuacaaacgaaguacauaccuggacagagcaauacaaauuccaggcggauagucccaaacgcuugucugcagcaauagguaaagcaugggaagaaggaguaugugguauuagaucagcaacaaggcuugagaauauaauguggaaacaaauuucaaacgaauuaaaccauauauugcucgaaaacgacaugaaauucacgguuguagucggggauguagcugguauacuagcucaaggcaagaaaaugauucgaccacagccaauggaguauaaauacaguuggaaaaguugggguaaagcgaagauaauaggugccgacgugcaaaacaccacguucaucauagauggaccaaauacuccagaauguccagaugaucagcgagcauggaacauaugggaaguugaagacuacggauuuggaauuuuuacuacgaauauuuggcugaaauugagagauaguuauacccaaguaugugaucauagguuaaugucggcagcaauaaaagauuccaaggcgguacacgcggacaugggcuauuggauagaaucagaaaagaacgaaacguggaagcuagcucgagcgaguuuuauagaaguaaaaacaugcauauggccgaaaucacauacguuguggucgaauggaguccuggagagugagaugaucauuccgaaaauuuacggaggccccaucucacagcacaauuauaggccaggguauuuuacccagacagcaggcccauggcaucuuggaaaacuugaacuagacuuugaucuuugcgagggcacgacgguaguaguugacgaacacugugguaaucgaggaccuucgcuaagaacgacaacaguaacaggaaagauaauacaugaauggugcugcagaaguugcacucuuccgccauugagguuucgaggugaggacggauguugguauggaauggagaucagaccaguuaaagaaaaggaggaaaacuuagugaaaaguaugguuagcgcagggucgggcgaaguagauuccuucucgcugggauuauugugcauauccauaaugauagaggaaguaaugcgaaguagguggucuaggaagauguuaaugaccgggacuuuagcgguguucuuuuuacuuauuaugggccaacuaacauggaaugaucuaauccggcucuguauuaugguuggugcgaaugcuagcgacagaauggggaugggaaccacauaucuugcuuuaauggcaacuuuuaaaaugaggccgauguuugcagucggacuucuuuuucgucgccuaaccucucgugaaguguugcugcuuacgauaggccuaucuuuaguugcaagcgucgaauuacccaauucauuagaagaacuuggggauggccuggcaauggguauaaugauccuaaaacuguugacugauuuucaaucacaucaauuaugggcaacuuugcuuagccuaacuuuuaucaagacaacauucucguuacauuaugccuggaaaacuauggcgaugguuuuaucaauaguaucacuauuuccauuaugcuuaucaacgacuucucagaaaacuacuuggcucccugugcuucugggaagucuugguuguaaaccgcuaacgauguuucuaauugccgaaaacaaaauauggggaagacgaaguuggccauuaaaugaaggaauaauggccguaggaaucguaaguauucuucuguccagccugcuuaagaaugaugugccguuagcaggaccgcugauugcaggcgggaugcugauugcaugcuacgucauauccgguagcucugcagaccuaagucuagaaaaagccgcagaagucucaugggaggaggaagcugaacauucuggagcuucgcauaacaucuuaguagaggugcaagacgaugguacaaugaagauaaaagaugaggagagagacgauacauuaacaauacuacuuaaggcaacauuauuagcaguaucuggagucuauccucugucaauuccugcaacccuauuuguaugguacuuuuggcagaagaagaaacagcgauccgguguauuaugggacacacccagucccccggaaguaggcagagcagucuuagacgaugguauuuaccgcauaaugcaaagaggucuacuuggaagaagucagguaggggucggugucuuucaagagaacguuuuucauacgauguggcaugucacucgaggugcuguccuaauguaccaggguaagagacuugaaccaucuugggcgaguguuaagaaagaucuaauaagcuacggagggggauggagacuacaaggcucauggaacaccggagaagaaguacaaguuauagccguggaaccuggcaaaaacccuaaaaacgugcagacagcaccaggaaccuuuaagacuccagaaggugagguuggagcaauugcacuggacuuuaagcccggaacaucuggaaguccaauuguuaauagagagggcaagauagugggucuauacggaaauggaguaguuacgacaagugggacauacguuucagcaaucgcacaggcgaaggcuucccaagaaggaccccucccagaaauagaagaugaaguauuuagaaaacgaaaucucacaaucauggaccuacauccaggaaguggaaaaacccgcagauauuuaccugcaauaguucgagaagcgauaaaacguaaauugagaacacucauuuuggcacccacgagaguaguagcauccgagauggcagaagcgcuaaaggggaugccaauuagauaucaaacaacagcuguuaaaucggaacacaccggaaaagaaauuguggaucucaugugccacgcgacauuuacgaugcgcuuacugucuccuguaagagucccaaacuauaauaugauuauuauggacgaggcucauuuuacagaccccucuuccauugcggcacggggauauaucucaacaaggguuggcaugggugaagcugcagcaaucuuuaugacugcuacaccacccggaucaguagaggcuuuuccucaaagcaacgcagugauacaagaugaagagagggacauaccagaacguaguuggaacucaggguaugaauggauaacagacuuucccgggaaaacaguuugguuuguaccgaguauaaaaucaggcaaugacauagcaaauugcuuaaggaaaaaugggaaacgugugauccaguuaagucgaaaaacauuugauacagaauaucagaaaacuaaaaauaacgacugggauuauguaguaaccacagauauuagcgaaaugggcgcaaacuuucgggcggaccgagugauagauccgcguagauguuugaaaccaguuauacuaaaagauggacccgaaagggugauucuagcuggucccaugccagugaccguagcaagcgcagcucaacgcagaggucgaauugggaggaaccauaacaaagaaggcgaccaauauauuuauaugggccaaccucuaaauaacgacgaagaccaugcucauuggaccgaagcaaaaaugcuauuagauaacauaaacacaccugagggaauaauuccagcucuuuucgaaccagagcgagagaaauccgccgccauagauggugaauaccguuugcgaggagaggcucgcaagacauucguagaacucaugaggaggggagaucuaccaguauggcuuucguauaaaguggcuagcgaaggauuccaauacucagacagaaggugguguuucgauggagaacguaauaaucaaguacuugaagagaauauggacgucgaaauuuggacgaaggagggagaaagaaagaaacuuagaccccggugguuagaugcacgaacauauucugacccauuagcacuucgagaauuuaaggaauuugcugccggaaggcgcaguguuucuggugaccugaucuuagaaauugguaaauuaccucaacauuugacucagagggcacaaaaugcucucgauaaccuaguuauguuacauaauagugaacagggcggcagggcguaucgacaugcaauggaagaacuuccugacacaaucgaaacauuaaugcucuuagcguugauugcaguucugacuggaggcguaacucuauucuuccuuucuggaagaggcuugggaaaaacaucgauuggucuuuuaugcguuauggcauccucaguccuauuguggauggcuucugucgaaccgcauuggaucgcagcuagcaucauacuagaauuuuuccucaugguacuuuugaucccagagccagaucgucaaagaaccccacaagacaaucagcuugccuacgucguaaucggacuacucuucaugaucuuaacaguagcagcaaaugaaaugggcuuacuugaaacaacaaagaaggacuuaggaaucgggcacguggcaguagagaaccaccaucaugccgcuauguuagacguagaucuacacccugcgucagcuuggacguuauaugccguugcaacuacuauuauaacaccuaugaugcgucacaccaucgagaauacuacagcaaacauaucucucacagcgaucgcuaaucaagccgcuauauuaaugggacuggacaaaggguggcccauuagcaaaauggacauuggcgucccauuguuagcgcugggcuguuauucccaaguaaaccccuuaacuuuaacugcagccguccuuaugcuaguagcucacuacgcaauaauugggcccgguuuacaagcaaaagcaacaagggaggcucagaaacgaacagcggccggaauuaugaagaaucccacaguugauggaauaguggcgauagauuuagaccccguagucuaugaugcuaaauuugagaaacaguuaggucaaauuaugcuacugauacuauguaccucgcaaauucuauuaaugagaacaacgugggcucuaugugaaucaauuacgcucgccacaggaccacucacgacacuuugggaaggaucacccggaaaauucuggaauacuacgauagccguuucuauggccaacauauuucgcgguucauauuuagcgggagcuggauuagccuuuagucuuaugaaaucacucggaggaggcagaagaggaacgggagcccaaggagaaacguuaggugaaaaauggaaacggcaauugaaucaacuuagcaaaucggaguuuaacacuuauaagcguucagguaucauggaaguugauagaucagaagccaaagaaggcuugaagagaggggagacaacuaagcaugcuguauccagggguacggcuaaacuucgaugguucguugaaaggaaucuaguuaagccggagggaaaaguaaucgaucuaggaugcggaaggggaggguggaguuauuacugugccggccuaaagaaaguuaccgaggucaaaggguauacaaaagguggacccgggcacgaggagccaaucccaauggcaacauaugguuggaaccucguuaaauuacacucgggcaaggacguuuucuuuauuccgccggaaaaaugugauacccuauuaugugauauuggcgaaaguucaccuaauccgacaauugaagaaggaagaacacuaagaguacucaaaaugguagagccauggcuuaggggaaaucaguuuugcaucaaaauuuuaaacccuuauaugccuucagugguagagacauuggagcaaaugcaacggaagcauggugguauguuaguccgaaauccuuugucacgaaauucgacacaugaaauguauuggguuucgugugguacuggaaauaucguaagugcgguuaacaugacaagcaggaugcuucuaaauagauuuacaauggcacacagaaaaccgacauacgagcgagaugucgaccuuggcgcgggaacuagacacguggcgguagaaccagagguagccaaucuagacauaauaggccagcggaucgaaaauaucaaacacgaacacaagaguacauggcacuaugaugaagacaacccauacaaaaccugggccuaccaugggucuuaugagguaaaaccuagcggaucugcaaguucaauggugaauggagugguaaaauuguuaacuaaacccugggauguaauaccaaugguaacacaaauugcgaugacagauacaacuccauucgggcaacaacgcguguucaaagaaaaaguagauacacgcacaccaaaagcuaaaaggggaacagcacagauaauggaaguaacagcaaaauggcucuggggauuccuaucacgaaacaagaaaccacgaauauguaccagagaggaauuuacacguaagguaagauccaacgcagcaauaggagccguauuuguugacgaaaaucaauggaauagugcaaaggaagcaguugaagaugaacgguuuugggaucuaguccaucgcgaaagagaacuacacaaacagggcaaaugcgcaacgugugucuacaauaugauggguaaaagggaaaagaaacuaggagaauuugggaaggcuaaaggaaguagagcaauuugguauauguggcugggagccagguuucuugaauuugaggcuuuggguuucaugaacgaagaccauugguucaguagagaaaacucccuaucuggaguugaaggagaaggacuccauaaacuuggguacauacuacgcgauaucucaaagauuccuggcgguaacauguacgcagaugauacugcagguugggacacccgaauaacggaagaugaccuacaaaacgaagcaagaauaacggauauaauggaaccggaacacgcauuacuggcuaagagcaucuuuaaauuaacuuaucagaacaaaguagugcgcguucaacgaccugccaaaaaugguacggugauggauguaauaaguagacgcgaucagagagguucuggucagguaggaacauacggauuaaacacguuuacuaauauggaagcgcaacuuauaagacagauggagucagaaggcauauuuaguccgagcgagcuagagaccccaaauuuagcagagcgaguucuagacuggcuugagaaguacgguguagagcguuuaaagcguauggccauuagcggagaugauugugugguaaaaccgauugaugaucgauuugcaaccgcauuaacagcuuuaaaugauauggggaaaguuaggaaggacaucccucaaugggagccaucaaagggauggaacgacuggcaacaaguaccuuuuuguagccaucacuuccaucaauugauaaugaaagauggucgugaaauuguuguaccauguagaaaucaagaugagcuaguaggcagagcuaggguuagccaaggagcgggauggucucuaagggaaacagcaugcuugggaaaaucauacgcacagauguggcaacugauguauuuucauaggagagaccuccgauuagccgccaacgccauuuguucugcaguaccagucgacuggauuccaacgucucguacaacuuggucaauucacgcccaccaccaauggaugacaaccgaagacaugcuaucagucuggaaccgcguuuggauugaagaaaauccuuggauggaagacaagacacauauaucaucauggggagacguacccuauuuagggaagcgagaagaccaauggugugguucgcuaaucggauugacugcucgagcuacaugggcaacaaacauucaaguagcaauaaaccaaguacgaagauuaauaggcaaugaaaauuaccuggauuacaugacaucaaugaaaagauucaaaaaugagagcgauccagaaggagcccuaugguaa

SEQ ID NO: 21944 - RNA, 9879 nt, Artificial Sequence
  derived and/or modified CDS sequence (opt6) from DENV-1__EU482504__SS-prME
aguguaaccauguuauuaauguugaugcccacagcuuuggcuuuucacuuaacaacccgugggggagaaccacacaugauuguguccaaacaagaacggggcaaaaguuuacuguuuaaaacuucagccgguguuaacaugugcacuuuaauagcaauggacuuaggcgaacuuugcgaagauacuaugacuuauaaaugccccagaaucacugaaacagaaccagacgauguugacugcuggugcaaugcuacggauacuuggguuacauaugguacguguucgcaaacaggcgagcacaggagagauaaaagaucagucgcauuagcaccacacgucggauugggacuugaaacacgcacagaaacauggaugucaucggaaggcgccuggaagcaaauacaaagaguugagacaugggcucuacgacacccaggcuuuacgguaaucgcacuuuuucuugcacaugcuaucgguaccucuauuacccaaaaaggcauaaucuuuauccuucuaauguuagucacaccuagcauggcaaugcguugcguuggaaucgguucuagggauuuuguagaaggacuaucuggagcaacaugggucgauguuguauuagaacauggcucuuguguaacaacaauggcuaaagauaaaccgacguuagacauugaacuucuaaaaacggaaguaacaaacccagcuguauuaagaaaacuuuguauagaggcgaaaauaucgaacacaacaaccgauucacgcugcccgacacaaggagaagcaacguugguggaagaacaagaugcgaacuuuguaugucgacguaccuuuguagaccgaggaugggguaauggauguggcuuauuuggaaaaggcucacuaauuaccugugcaaaguucaaauguguaacaaaacuggaaggcaaaaucguacaauaugaaaaucuaaaauauucugucauaguaacaguacauacuggagaucaacaccaagugggcaaugagagcacugaacaugggacaacagcuacaauuacaccacaagcaccgacaacagaaauccaauuaacagauuauggcgcucuaacccuagauuguucuccccgaacugguuuagacuuuaacgaaaugguacuuuugacaaugaaagagaaauccuggcuaguacauaaacaaugguucuuggaccuuccauugccauggacaagcggcgcuucaacaucacaggaaacuuggaaccggcaggaccuauuaguaacuuuuaaaaccgcacaugccaagaaacaagaaguaguaguucuuggaucacaagaaggggcuaugcacacagcccuaacaggugcaaccgagauacagacauccggcacaaccacaaucuuugccggucaucucaaaugcagacugaaaauggacaagcuaacacuuaaaggaaugucguacguuauguguacaggcaguuuuaaauuggaaaaagaagucgcagaaacacaacaugguacaguauuaguacaaauaaaauacgaaggaacagaugccccauguaaaauaccguuuucuacucaggacgagaaagguguaacacaaaacggacguuuaauuacugcaaacccaauaguaaccgauaaagaaaaaccuguaaacauagaggcugaaccaccauucggcgaaucguauauagugauuggugccggagaaaaggcuuuaaaacuuucgugguucaaaaagggaucuaguauuggaaaaauguucgaggcgacugcccguggagcacggaggauggcgauacuaggugacacugcaugggacuuugguucaauaggaggaguguuuacgucggucggaaagcuagugcaccaaauuuuuggaaccgccuauggaguucuauuuucuggagucucuuggacgaugaaaauaggcauuggaguacuucucacaugguuaggauugaauagcagauccacauccuuaucuaugacauguauagcgguaggucuugucacauuguaucucggugucaugguacaggcggauagcgggugugugauaaauuggaaaggacgagaauuaaagugugggagugggaucuuugugacgaaugaaguacauacauggacagaacaauauaaauuccaagcugauucgccaaaaagguuguccgcugcuauaggaaaagccugggaagagggcguauguggaauaagaucagccacacgucuagaaaauauuauguggaagcaaaucucaaaugaauuaaaucacauuuuacuugaaaaugacaugaaauuuacagucguaguaggggaugucgcuggaauuuuagcccaaggcaagaaaaugauccgaccucaaccgauggaauauaaauacucguggaagucauggggaaaagcaaaaauaauaggagcagauguucaaaacaccacuuuuauaauagauggaccuaacaccccagaaugcccagaugaccaaagggcguggaauauuugggaaguagaagauuauggcuuugggaucuuuaccacaaacauauggcuaaaacuucgugauucuuauacucaaguaugugaucaccgucucaugucagcagcaauuaaagacaguaaggcaguacaugcagacaugggguauuggauugaauccgagaaaaaugaaacguggaaacucgcuagagcuuccuucauugaggugaaaacuuguaucuggccgaaaucacauacucuauggucuaaugggguguuagaaagugagaugauaauaccuaaaauauauggagguccaauaucgcaacauaauuaccgaccgggauacuucacacagacggcagguccguggcacuugggaaaacuagaauuagauuuugauuuaugugaagggacgaccguaguaguugacgagcauugcgguaaucguggaccuagccucagaacaacaacgguaacaggaaaaaucauucaugaauggugcugucggagcugcacauuaccaccauuaagguucagaggggaagacgggugcugguaugggauggaaauuaggcccguuaaagaaaaagaagaaaacuugguaaaaaguaugguaucugccggcaguggagagguggauaguuuuucguuaggccuucucuguaucagcauuaugauagaagaggugaugcguuccagaugguccagaaagaugcuuaugacugguacuuuggcugucuucuuucuuuuaauaaugggacaguuaacuuggaaugaucuuauaaggcuuuguauaaugguaggagcgaaugcaagugauagaaugggcauggggacuacauauuuagcguuaauggcuacauuuaaaaugcgaccuauguucgcaguuggacucuuguuccgucgucuaacaagucgcgaggucuuguugcuaaccaucggccugucgcucguggcuucaguugaauuacccaauagucuggaggagcucggggauggacuggcuaugggcauaaugauuuuaaaauuacuaaccgauuuucagagccaucagcuguggguaaccuugcuaucauugacguucauuaagacaaccuucucacuacacuaugcguggaagacaauggcuaugguauuguccauaguaucguuguucccacuuugccugucaacuacaagccaaaagacgacguggcuuccgguauuacuaggcucacuaggaugcaagccuuuaacaauguuccuuauagcagaaaauaaaauuuggggacgucguuccuggccguuaaaugaagggauuauggcuguuggcauuguuucgaucuugcuaucaagccuccucaaaaaugaugucccacuugcgggucccuuaauugcugguggaaugcuaauugcaugcuauguaauaaguggaucuucagcagaccuuuccuuagaaaaagcggcagaaguaucuugggaagaagaagcagaacacagcggagcaucucauaacaucuugguggaaguucaggaugauggcaccaugaaaauuaaggacgaagaacgagaugacaccuuaacgauacuuuuaaaggcgacauuguuagccguuucagguguuuacccguuauccauaccggccacacucuuugucugguauuuuuggcagaaaaagaaacaacgaucuggaguacuuugggacacuccuagcccaccugagguggaaagggcaguacuagaugauggaauauaucgaauuaugcaaagaggcuuauuagggaggagucaggucggaguagguguguuccaggaaaauguuuuucauacaauguggcacgucacccgaggggcuguacuuauguaccaaggaaaaagacuugaaccauccugggcaagcguuaagaaagaucucauaucguaugguggggguuggcgacuacagggcucauggaacacaggggaagaaguacaagugauugccguagaacccgguaaaaacccuaaaaauguccaaaccgcaccugguacuuuuaaaaccccagaaggugaagugggagcaaucgcuuuggacuuuaagccgggaacaucgggaucgccaaucgucaaucgugaaggaaaaauuguaggcuuauauggaaauggcguugucacgacaucagguacauacguaucggcaauagcgcaagccaaggcuucccaggaaggaccgcuuccagaaauagaagaugaagucuuucgcaagcgcaacuuaacuauaauggaccuccaucccggaagcgguaaaacccgacgguaucucccggccauuguuagagaagcaauaaaaagaaaacuuaggaccuuaauacuagcuccuacgagaguaguagcuucagaaauggccgaggcgcuaaagggcaugcccaucagguaucaaacaacagcgguaaaaucagaacacacggguaaggagauaguagaccuuaugugucacgcaacuuuuacuaugcguuuguuauccccgguccgaguuccuaacuacaacaugauuauaauggaugaagcgcauuucacagaucccucuaguauagcagcacggggcuacaucucaacgaggguagguaugggugaagcugcugcuauuuuuaugacagcgacuccacccgguucuguagaggcuuuuccccagucaaaugcugucauacaggaugaagaacgagauauaccagaaagaucauggaacucuggauaugaguggauaaccgacuuuccugguaaaacgguaugguuugucccaucaauuaagagcgguaacgauauagcaaauugucugcggaaaaauggaaagaggguuauccaauugucaagaaaaacuuuugauacugaauaucagaaaacuaaaaacaacgauugggauuauguaguaacaacagauauaucugaaaugggggcgaacuuuagggccgaucgaguuauagaccccagacguugucuaaaaccgguaaucuuaaaagacggaccugaacgaguaauuuuggcugguccaaugccaguuacuguagcuucagcagcacaacgaagagguagaauaggaagaaaucacaauaaagaaggagaccaauauaucuauaugggacaaccacucaauaaugacgaagaucaugcgcauuggacagaagcaaaaaugcucuuagauaauaucaacacuccagagggaauaauaccagcauuauuugagccagagagagaaaagucugcugcaauagauggggaguacagauugcgaggugaagcacguaagacauucguggaacuaaugaggagaggcgacuuaccagugugguuaucauacaaaguagcaucggaaggguuucaauauagcgacagaagauggugcuuugacggggaaagaaacaaucagguguuagaagaaaacauggacguugagauauggacaaaagaaggcgaaaggaagaaauuacggccgagauggcuagaugcuaggacuuacucugacccacuugcguuaagagaauuuaaggaguucgcggccggaagaagaaguguuagcggggaccugauuuccgagauagguaaacucccucaacacuuaacgcaaagagcccaaaacgcacuagauaaccuaguaaugcuacauaacucagaacaagguggacgagcauaucgccacgcaauggaagaacuuccggauacuauugaaacacucaugcuuuuagcacugauagcaguacugaccggaggagucacauuauucuuucuaucaggucguggacugggaaaaacaaguaucggguuacucugcgucauggcaaguaguguuuuacuauggauggcgagcguugaaccacacuggauagcugcuaguauaauauuagaguucuuucucaugguuuuacucauucccgaaccugaucgucaacggacaccgcaagauaaccaacuggcuuacguaguaaucggcuuauuguucaugaucuuaacagucgcagcgaacgaaaugggacuauuagagacaacgaagaaagacuuaggcauuggacauguggcaguagaaaaucaccaucacgcugcaauguuagacguagauuuacauccagcgucggcauggaccuuauaugcuguugccacaacuauaauaacaccuaugaugagacauacuaucgaaaacaccacagcaaauauaucgcugacugcuauugcaaaucaggcugcuauauuaaugggccuagacaaagguuggcccaucagcaaaauggauauuggaguuccucuauuagcacuaggguguuauucacaagugaacccucuaacacuaacggcggcagugcuuauguuaguagcccauuacgcaauaauaggcccuggacuacaagcuaaagcaacucgugaagcccagaaaagaacagccgcaggaaucaugaaaaauccaacuguugacggcauaguugccaucgaucuagauccugucguauaugaugcuaaauucgaaaagcaacuaggccaaauaaugcuauuaauauuguguacgucccaaauacuuuuaaugaggacgacuugggcgcugugugaaagcauuacccuggcgacaggaccucuaacgacuuuaugggagggcucaccgggaaaauucuggaauacaacgauugcagucaguauggccaacaucuuucguggcagcuaccucgcaggagcugggcuagcauucuccuugaugaagucauuaggugggggaagaagagguacaggcgcucaaggagaaacauuaggagagaaauggaagcggcaauugaaccagcuuaguaaaagcgaguuuaacacauacaagcgcucaggaauuauggaaguagaccguagugaagcaaaggagggauuaaagagaggugaaaccacgaaacaugcaguaagccgagguacggcaaaacuaagaugguuugucgaaaggaacuuagucaagccagaaggaaagguaauagauuuagguugugguagaggaggauggucauacuacugugcggggcuaaagaaagucacagaaguaaaaggauacacaaaaggagguccaggacaugaagaaccgauuccaauggcuacuuauggcuggaacuuaguaaaacuccauucagguaaagacguuuucuuuauaccaccggaaaaaugugauacuuuauugugugauauuggugaaucaucacccaauccuacuauugaagaaggucggacacuuagggugcucaaaaugguagagccguggcuuaggggaaaccaauucugcauuaagauacuuaaucccuauaugccaagcguaguagaaacucuagaacaaaugcagagaaagcauggcggcauguuagugagaaauccccucucacgaaauaguacgcaugagauguauuggguuaguugcgggacgggaaacauuguaucugccguaaauaugacaucaagaaugcugcucaaccgcuucacaauggcacaucguaaaccaaccuaugaaagagauguagaccugggugccggaacccgacacguagccgucgaaccagaaguugcgaacuuagauauaauaggacagaggaucgaaaacauuaaacacgagcacaaauccacguggcauuaugaugaagauaauccauacaagacgugggcauaucacggaagcuaugaagucaaaccuagugguagcgcaucuaguauggucaauggcguugucaaacuucuuacgaagccuugggauguaauccccauggugacucaaauagccaugaccgauacaaccccuuuuggacaacagcggguuuuuaaagagaagguagauacaagaacgccaaaggcuaaaaggggaacagcccagaucauggaaguaacggcaaaaugguuaugggguuucuugucucguaacaagaaaccgagaauauguacgagagaggaauuuacacgcaagguuagaucaaaugcugcgaucggagcaguauucguugaugaaaaucaguggaacagcgcaaaagaagcuguugaagacgaaagguuuugggauuugguucaccgagagagagagcuacacaaacaggggaaaugcgcgacuugcguauauaacaugaugggaaaacgcgagaagaaacuaggugaauuuggaaaagcuaaagguucaagggcuaucugguauaugugguugggagccagauuuuuggaauuugaggcuuuagguuuuaugaaugaagaucauugguuuagucgugaaaauaguuugucggguguggaaggugaaggacuacacaaguuaggauauauucuaagggauauuucuaagauucccggcggaaacauguaugcugaugacacggcaggaugggauacacgcaucacugaggacgauuuacagaaugaagcaagaauaacagacauaauggaaccugaacaugccuuacuugcaaaaucgauuuucaaacugacguaucagaauaaaguggugcgaguacaacguccugcaaagaaugggacagugauggaugucaucucuagaagagaccaacgagguucgggucaaguaggaacauauggucuaaauacauuuacuaauauggaagcucaacugauaagacaaauggaaagcgaaggaauauuuucaccaucugaauuagaaacaccuaaccuugcagagagaguucuagacuggcuggagaaauaugguauagaaagacugaaacgcauggcaauaaguggugacgauugcguagugaagccaauagaugacagguuugccacggcucugacggcucuuaaugauauggguaaaguacguaaagauauaccgcaaugggaacccucgaaaggguggaaugacuggcaacagguuccauuuuguucucaccauuuucaccaauugaucaugaaagaugguagagaaauuguuguaccaugucguaaucaagaugaacuugugggccgugcaagaguuucacagggugcgggauggaguuuacgggaaacagcgugucuggggaaaaguuaugcacaaauguggcaacuaauguauuuucauagaagagaccuucgacuugcagcaaaugcaauauguagugcagugccaguagacuggauaccuacaagcagaacaacauggucaauacaugcacaccaucaauggaugacaaccgaagacauguuguccguauggaacagaguuuggauugaggaaaacccauggauggaagacaaaacacacauaucuaguuggggcgacguaccauauuuaggcaaacgugaagaucaauggugugggagucugauaggucuuacagccagagcaacuugggcgacaaacauucaaguagcaauaaaucaaguccgucgucuaauaggaaacgaaaauuacuuagacuauaugacaaguaugaaacgauucaagaacgagucagaucccgaaggagcacuuugguaa

SEQ ID NO: 21945 - RNA, 9879 nt, Artificial Sequence
  derived and/or modified CDS sequence (opt6) from DENV-1__EU482505__SS-prME
uccgugacuauguuacuaaugcuaaugccaacagcauuagcauuccaucuuacaacccgagguggagaaccucauaugauaguguccaaacaagaacgagggaaaagucugcuauucaaaacguccgcaggaguuaacaugugcacacucauugcuauggauuuaggggaauuuugcgaagacacuaugacauacaaauguccaagaauaacagaagcagaacccgacgaugucgacugcugguguaaugcaaccgauacuuggguaacguauggcaccuguagccaaacaggcgaacauaggcgagacaaacgaucaguugcucuggcgccgcaugucggacuuggauuagaaacuagaacugaaaccuggaugucaagugaaggagcauggaaacaaauacaaaggguagaaacaugggccuuaagacacccaggguucacagugauagcauuauuucuugcacacgcaauagggacaucgauuacucagaaagggauuaucuucauacuucuaaugcuaguuaccccaucuauggcaaugcgaugugucgggauaggaucccgagacuuuguagaagggcugucaggagcaacaugggucgacguuguuuuagaacacggaucguguguaacaaccauggcaaaagauaaaccuacucuagauauugaauuacuuaaaacagaagugacaaacccggcuguccuacguaaacuuugcauugaagcuaaaauauccaacaccacaacggacucacgauguccgacccaaggugaggccacacuuguugaggaacaagaugcuaacuucguaugucgcaggacguuuguagacagagguuggggaaacgguuguggauuauucgguaaaggauccuugauuacaugugcaaaauucaaauguguuacaaaauuagaagggaaaacaguacaauaugaaaauuuaaaguacuccguaauugugacaguacauacaggugaccagcaccaaguuggaaacgaaucaacugaacaugggacaacagcaacgauaacaccucaggcacccucgacagaaauacaacuaacagacuauggcgcacuaacccuagauugcuccccuaggacgggguuagacuuuaacgaaaugguuuuauuaacuaugaaagaaaaagcauggcucguacauaagcaaugguuuuuagacuuaccgcuuccuuggacaagcggcgcuuccacaucacaggagacuuggaauagaaaagaccuuuuagugacguuuaaaacggcacaugcgaagaaacaagaaguuguagucuuggguagucaagaaggagccaugcauacugcguuaacuggagcgacggaaauucaaacaucaggaacaacgacaauuuuugcgggucaccuuaagugcagauugaaaauggauaagcuaacucucaaaggaauguccuacguaauguguacggggagcuuuaaacucgaaaaggaagucgcagaaacucaacauggaacaguauuggugcaaauaaaauacgaagggacggacgcgccaugcaaaauaccuuucucgacacaagaugaaaaaggagugacccaaaacggaagauuaauaacagccaauccuauagucaccgauaaagaaaaaccagucaauaucgaagcagaaccaccauuuggggagucauauauugugauaggugcuggagagaaggcuuugaaacucucaugguuuaaaaaggggucaaguauugguaagauguucgaagcuacagccaggggugcaagaagaauggcuaucuuaggagauacugcaugggauuuuggaucaauuggaggaguguuuacaucgguaggcaagcuaguacaucaaauuuucgguacugcuuaugguguacuauuuucuggaguaagcuggacaaugaaaauagguauaggcguucuacuaacgugguuaggacuaaacaguagaucuacaucgcugagcaugacauguauagcagucgggcuuguaacacuguauuugggcguuaugguccaggcagauuccgguuguguuauaaauuggaaagggagagagcucaaaugcggaucggguauuuucgugacaaaugaagugcacacauggacugaacaauauaaauuccaagcugauagcccaaaaagauuaucggcagcaaucgguaaagcaugggaagaaggaguuuguggaauuagaucggcaacuagacuagaaaacauaauguggaaacaaauaucuaacgaguuaaaccauauacuguuagaaaaugauaugaaguucacgguugucguuggugauguagcggguauauuggcgcaagggaagaaaaugauaaggccucagccaauggaacauaaauauucauggaaaucauggggaaaagccaagauuauuggagccgauguacagaacgcuacuuuuauaauagauggaccuaacacuccggaaugcccagaugaucaaagagcguggaauaucugggagguagaggacuaugguuuuggaauuuucaccacgaauauauggcuaaagcuaagggacuccuacacacagguaugugaccauagauugauguccgcagccauaaaagauucgaaagcuguucacgccgacauggguuacuggaucgaaucagagaaaaacgagacauggaaauuagcgagagccucauuuauugaggugaaaaccugcauauggcccaaaucacauaccuuauggucuaacggaguccucgagucagagaugauaauaccaaagaucuacggcgguccaaucagccaacauaauuauagaccaggauauuuuacucaaaccgcugggccguggcaccuuggaaaguuagaacuugacuucgaucugugugagggcacaacaguagucguagacgagcacugugggaaucgaggaccgucccuaagaacgaccacaguaacaggaaagauuauacacgaaugguguuguagaucuuguacgcuaccuccuuuaagguuuaaaggagaggauggaugcugguacgguauggagaucagacccguaaaggaaaaagaggaaaaucuagucaaaagcaugguuucagcaggaucgggagaaguagacaguuucucacuuggauuauuaugcauaaguauaaugauugaagaaguaaugaggucuagauggaguagaaaaauguugaugacggggacacuagcaguguuuuucuuauugauaaugggacagcugacguggaaugauuugauuagauuauguauaauggucggugccaaugccagugaccguaugggcauggguacuacauaccucgcacuaauggccacuuuuaagaugcguccuauguuugcgguuggauuacuuuuuaggaggcuaacaagccgugaaguccuauugcuaacaaucggauuaaguuuaguugcgaguguggaauugccaaacucucuagaggaauuaggugauggccuugccaugggaauuaugauacuuaaguuacuuacugauuuccaaucacaucaauuaugggcuacacuacuuucguugacuuucauaaaaaccacauuuucuuuacauuaugcauggaaaaccauggcgaugguauuguccaucguuucacuuuucccauuaugucucagcacgacaagucagaaaacuacaugguuaccugugcuuuuaggaucauugggaugcaaaccacuuaccauguucuuaaucgccgaaaacaaaauaugggggaggaaaagcuggccacugaacgagggaauaauggccguuggcauuguaucuauauuauugaguucacuucucaaaaaugauguaccuuuagcuggaccgcucauugccgguggaaugcuuauugcauguuaugucauaucuggauccagugccgaccuuagccuugaaaaagcagcagagguaagcugggaagaagaagcagaacauaguggugcuagucacaacaucuugguugaaguccaagaugauggcacgaugaaaauaaaggacgaagaacgagaugauacauuaacaauacugcucaaagcaacauuacuagccguaucuggcguauauccacucucaauaccugcuacuuuauuuguaugguacuucuggcagaaaaagaagcaaaggagugguguuuugugggauacuccgaguccaccagaaguugagcgagcaguguuagaugacggaauuuacagaauuaugcaacgaggauuacugggcagaucacaagucggaguagggguuuuccaagaaaauguuuuucacacaauguggcauguuacucgaggggcuguguugauguaccaaggaaagagguuagaaccauccugggcgucugugaagaaagaucucauuaguuauggcgguggcuggagacugcaaggcuccuggaauacaggagaagaaguacagguaaucgcagucgaaccaggaaagaauccgaagaauguccagaccgcaccaggaacguucaagaccucagaaggugagguuggagcgauugccuuggauuuuaagccuggaacuucagggucgcccauuguaaaucgcgaagguaaaaucguaggauuguaugggaacgggguagugacaaccagcgguacuuacguuucagcuauugcacaagcaaaagcaucgcaagaaggaccauugcccgaaauagaggaugaaguauuucgaaaaaggaaucuuacuauuauggaccuccauccaggaucagguaagacgagaagauauuuaccagcuauaguuagagaagcaauaaagaggaaacugagaacauuaauauuagcgccaacaagaguagucgccagugaaauggcugaagccuuaaaaggaaugccgaucagguaccaaacaaccgcuguaaaaucagagcacacugguaaagaaauaguagacuugaugugccaugcuacauuuacgaugcgacuauuauccccgguaagaguaccaaacuauaauaugauuauuauggaugaagcucauuuuacagaccccagcagcaucgcagcuagaggauauauuucaacuagagugggcaugggcgaagcagcugccauuuuuaugaccgcaacgccgccagguucuguagaagcauucccucagaguaacgcuguaauacaagaugaagaacgagacaucccggagcguucguggaauaguggguacgaauggauaacugauuuucccggcaaaacaguuugguuugugcccagcauuaaaucagguaacgacaucgcuaauuguuuaaggaaaaacggaaagcgugucauacaacugagccguaaaacauuugauacagaguaucagaaaacgaaaaacaacgauugggauuaugugguuacaacugacauaucugagaugggagcaaacuuuagagcagaucgaguuauagauccaagacgguguuuaaaaccagugauccuuaaagauggaccagaaaggguuauccuagcaggccccaugccagucacgguagcuuccgcugcacagagacgaggucgcauaggcagaaaucacaacaaagagggagaucaauauauauacaugggacaaccauuaaauaacgacgaagaucacgcacauuggaccgaagcaaaaauguuacuggauaauauaaauacaccugaaggaauaauaccugccuuauuugaaccugaacgagagaaaagcgcugcgauagauggagaauauagacuaaggggcgaagcucguaaaaccuuugucgaacuaaugagaagaggagacuuaccaguuugguuaagcuacaagguggcuuccgaagguuuucaguauucagaucgucggugguguuuugacggagagagaaacaaucaaguauuagaagagaauauggacguugaaauauggacaaaggaaggagaaagaaagaaacuacgaccuagauggcuggaugcgagaacguauagugacccccuggcuuugagagaauuuaaagaguuugcugcgggaaggagguccgucucaggagacuuaauauuagaaauagguaaacuuccucaacaccuuacgcaaagggcacaaaaugcguuagauaaccuaguuaugcuucacaauucggaacaaggcgguagggccuaucggcaugcgauggaggaacuaccggauacaaucgagacacuaaugcuacuugcacuuauagcaguauuaacaggcgguguuacguuauucuuuuuauccgguaggggauuagguaaaacaagcauuggacuacucuguguaauggcaucuagcguauugcucuggauggcaaguguagagccacauuggaucgcugcaucaauuauucuagaauuuuuccucaugguguugcuaauaccagaaccagacagacaacgcacgccacaagauaaucaauuggcauaugucgucaucgggcuguuguuuaugauauugacgguagcggcuaaugaaauggguuuguuagaaacuacuaagaaagaccuaggaauagggcacguugcgguugagaaucaccaccaugcagcaauguuagacguggacuuacauccugcgucagcguggacauuauaugcuguagcuacuacaaucauuaccccuaugaugagacauacuaucgagaacacaaccgcaaacauaucguuaacggcgauagcaaaucaagcagcuauauugaugggguuagacaaaggauggccuaucucuaaaauggauauaggcguuccccuacuugcuuuaggaugcuacagccaaguuaauccgcuuacucucacagcagcaguucuaauguugguagcucacuacgccauaauuggaccgggccuccaagcgaaagcuacacgagaagcgcaaaaacgaacugcagcuggaauuaugaaaaacccuacuguugauggaauaguugcgauagacuuggauccagugguguaugauacaaaauuugaaaaacaacugggucagauaaugcuauuaauuuugugcacaagucaaauauuauuaaugaggacaacuugggccuuaugugaaagcauuacgcuugccacgggacccuuaacuacgcuaugggaagggagccccggcaaauuuuggaauaccacaauagcagucuccauggcuaauauauuucggggaaguuauuuggcuggagcaggacuagcauucucacucaugaaaucauugggcggaggcagacgagguacgggugcgcagggugaaacgcuaggugaaaaguggaagcgucaacugaaucaacuuucaaagagcgaguucaauaccuauaaacgaucggguauaauggaaguugacaggucagaagcuaaagaaggcuuaaagagaggugaaacuaccaagcacgcagugucucgaggcacagcaaaauuaaggugguucguugaacgaaauuugguaaaaccggaaggcaaagucauagaucuggguuguggccgaggaggguggagcuauuauugugccggguuaaagaaaguuaccgaaguaaaaggauauacaaaaggagguccaggacacgaagaaccgauccccauggcgacuuauggauggaaccugguuaaacuucacucugguaaagacguauucuuuauaccacccgaaaaaugcgauacucuguuaugugacauuggagaaaguaguccaaauccaaccaucgaggaaggacggacacuccgagucuuaaaaaugguagaaccauggcuacguggaaaucaauucugcauuaagauauuaaacccauauaugccgaguguuguggaaacccuagaacaaaugcagaggaaacaugguggaauguuaguacgcaauccuuugaguaggaauaguacucacgaaauguauugggugagcugugggacugguaauauaguaagugcgguuaacaugacaucccgaaugcuucuaaacagauuuacaauggcgcauaggaaaccuacguacgaacgagauguagauuuaggcgccgggacaagacacguugcaguugagccggaaguagcaaaucuagacauuaucggccaaagaauugagaacauuaagcacgagcacaaaaguacguggcacuacgaugaagacaaccccuacaaaacaugggcauaccacggcagcuaugagguuaaaccauccggaagcgccuccucuauggugaacggaguuguaaaacuuuuaacaaaaccuugggaugucauuccuauggugacgcaaauagcuaugacugauacaacuccauucggacaacagagaguuuuuaaagaaaaaguagacacgcgcacgccgaaggcgaaacgagggacagcucagauaauggaaguuaccgcaaaauggcugugggguuuccuaaguagaaauaaaaagccgcgaauuuguacgagagaggaauuuacaagaaaaguccguucuaacgcggcaauuggagcagucuucguugaugaaaaccaauggaacagugcaaaagaagcuguagaagacgaacgauuuugggaccugguacaccgagaacgcgaacuccauaaacagggcaagugcgcuacgugcguauauaacaugaugggaaaacgcgagaagaaacuaggcgaguucgguaaagcaaaagguagcagagcaauuugguauauguggcugggugccagauuucuagaauuugaggcauuggguuucaugaaugaagaccacugguucaacagagaaaauucucuaagcgguguagagggugaaggacuacauaaauuaggcuacauauuaagagauauaagcaaaauuccuggcgguaauauguacgcagacgauacggcggguugggauacccgcauaacugaagacgaucuccaaaacgaagcgaaaauuacagacauuauggaacccgagcacgcguuauuagccaaaucaaucuucaaauuaacguaucaaaacaaagucguaagaguucaacgaccugcgaaaaacgguacaguaauggacgucauaagucgucgagaccaaagaggaucagggcaaguugguacuuauggucugaauacuuucacuaauauggaggcccaacucauuagacagauggagagugaagggauauuuucucccagugaacuugaaacuccuaaucuugcuggcaggguuuuagacuggcuggaaaaacauggcguagaacgccucaaacguauggcaauaucaggggacgacugcguaguaaagccgauagacgauagauuugcuacagcguugacagcucugaacgauaugggcaaaguucguaaagacaucccucaaugggaaccaucgaagggauggaaugauuggcaacaaguuccuuuuugcucacaucauuuucaucaguuaauaaugaaggacggacgugaaauaguggucccaugccguaaucaggaugaauuaguuggcagagcaaggguuucacaaggugcggguuggucuuugagggaaacugcgugcuuaggcaaaucauaugcacaaauguggcaauuaauguauuuccauagaagagaucugagauuagcagcaaaugcgauauguagugccgugcccguggauugggugcccacuucccgaacaacuugguccauacacgcacaucaccaauggaugacgacggaagacaugcugucaguauggaaccgcguguggauugaagagaacccuuggauggaagauaaaacacauauuucaucauggggagauguaccauacuugggaaaaagagaagaucaaugguguggaagucuaauaggacugaccgccagagcgacuugggcaacuaacauccagguggcgauuaaucaaguaagaagacugauagguaaugaaaacuaccuggauuauaugacaucaaugaaaagguuuaaaaaugagauugauccggaaggagcgcugugguga

SEQ ID NO: 21946 - RNA, 9879 nt, Artificial Sequence
  derived and/or modified CDS sequence (opt6) from DENV-1__EU482506__SS-prME
aguguaacaauguuauugaugcucaugccuacagcguuagcauuccacuuaacuacucgaggaggugaaccucacaugauugugagcaaacaagaaaggggaaaaucguuacuauucaaaacaucagcggggguuaauauguguacacuuauagcaauggaccuaggugagcucugcgaagacacaaugacauauaaauguccacguauaaccgaaacagaaccagaugacguagacugcugguguaaugcgaccgauacauggguaacauacggaacuuguagccaaacgggagaacauaggcgugauaaacgcuccguagccuuagcgccucauguaggauuaggauuagagacucguacagaaacauggaugagcagugagggagcguggaaacaaauacaaaggguagaaacaugggcacugaggcacccgggauuuacgguuauagccuuauuccuugcacaugccaucggaacuucaauaacucagaaagggauuauuuucauucuacuaauguuagugacuccaaguauggcaaugagauguguuggaaucgggucacgcgauuucguugaaggucuuuccggagcuacuuggguggacguuguauuagaacauggaaguugcguaacuacgauggcuaaagauaaaccaacuuuagauauagaacugcucaaaacugaagugacaaauccagcaguauuaaggaaacuauguauugaggcuaaaauaaguaauacuacgaccgauucaagaugcccaacacaaggggaagcuacccuuguagaagaacaagaugcuaauuuuguaugcagacgaacauuuguggauagaggaugggguaauggaugcggauuguucggaaaagguucacucauuacgugcgccaaauucaaauguguaaccaaauuagagggaaaaauaguucaauaugaaaauuuaaaauacagcguaauaguaacuguucauacgggcgaucaacaucaagucggaaaugagucaacugaacauggcacaacagcgacgaucacuccacaagcuccuacaacugaaauacaacuaaccgauuauggggcgcuaacauuggacugcucgccaaggacaggacuagauuuuaaugaaaugguuuugcuuaccaugaaagagaaaaguugguugguccacaaacagugguuccuggaccugccucucccuuggacaucgggagcuucaacuucucaagaaacuuggaaccgacaggaucuucucguaaccuucaagacagcgcaugcaaagaaacaagaaguugucguacuggguagccaggaaggagcuaugcauacagcguuaacaggagcaacagagauacagacgucaggaacgacaacuaucuucgcaggucacuuaaagugccgacucaaaauggacaaguugacucuaaaaggaaugaguuacgucauguguacaggaaguuucaaacuggaaaaagaaguagcggaaacucagcauggaacugucuuaguccagauuaaguacgaaggaacagacgccccuuguaaaauuccauuucuuacucaagaugaaaaaggcguaacacaaaacgguagauuaauaacagcaaaccccauaguaacugauaaagaaaaaccuguuaauaucgaggcagaaccaccauuuggugagucauauauaauaauuggugcaggggaaaaagcauugaaacucagcugguucaaaaaggguaguucaauaggcaaaauguucgaagcaacugcaagaggugcaaggagaauggcuauacuaggagacacugcuugggauuucgguucaauaggagguguauucacaucgguuggaaaacuuguacaccagauauucggaacagccuacggagucuuauuuucaggagucaguuggacaaugaaaauugguauagguaucuuacuaaccuggcuaggucuuaacagucguucgaccucgcuaucgaugacauguauagcugucggacuggucacacuuuacuugggcgugaugguucaagcugauagcgggugcguaauuaacuggaagggcagagaauuaaaaugcggaucaggaauuuuuguuacaaacgaaguacacacauggacagagcaauacaaauuccaggcagacaguccaaagcgauugagcgcagcaauagguaaggcgugggaagaaggaguaugugggauaaggucggcgacuaggcucgagaauauaauguggaaacaaaucucgaaugaguuaaaucacauauuauuagaaaacgauaugaaguucacaguugugguuggugacguagcaggcaucuuagcacagggcaagaaaaugauacggccucaacccauggaauacaaauacucguggaaaucauggggaaaagccaagauuauaggugcggaugugcagaacacaacauuuaucauagaugggcccaauacaccagaaugcccagaugaccaacgggcauggaauaucugggaagucgaagacuauggauuuggcauauuuaccacaaacauauggcuaaaauuaagagauagcuacacccagguuugugaccacaggcugauguccgcagccauaaaagacucaaaagcaguucaugcagauauggguuauuggauagaaucagagaaaaaugaaacauggaaauuagcacgagccuccuuuauagagguaaaaacaugcauauggccgaaaagccacacgcuuuggaguaacggagugcuagaaagcgaaaugauaauaccuaagaucuauggaggucccaucagccaacauaacuaccgaccugguuacuucacccaaacggccgguccguggcaucuaggaaaacuagaacuagacuuugaucuaugugaagguaccacgguugucguugaugaacauuguggcaaccgugggccuucucuaaggacgacgacaguaacagggaaaauaauucaugagugguguugccgcaguuguacucucccgcccuuaagguuuaggggcgaagauggaugcugguauggaauggaaauaaggcccguuaaggaaaaagaagaaaaccugguaaagaguauggucuccgcgggcaguggcgaaguagauaguuucagucugggguugcuaugcauaucaaucauaauagaggaaguaaugcgcagucgauggaguagaaaaauguuaaugaccggaacuuuagcaguguuuuuccuguuaauaaugggacaauugacauggaaugacuuaauaagguuauguaucauggucggagccaacgcuuccgaucggaugggaaugggcaccacauaucucgcguuaauggccacauucaagaugagaccaauguucgcaguaggucucuuauuuaggagauuaacaaguagagaaguacuauuacuaacaaucggauuaucucugguagcaucagucgaacuacccaacagucuagaagaacuaggggauggguuagcuaugggaauaaugauccuuaagcuauugacggacuuccagagccaucagcuuugggcgacacuuuuaucucuuacauuuauuaaaacaacuuuuagccuucacuaugcguggaaaacuauggcuaugguucugaguaucgucagucucuucccgcuaugcuuaucgacaacuucacaaaagacaacauggcuccccgugcuccuuggaagccuuggauguaaaccucuaacuauguuuuugauagcagaaaauaaaauauggggcagaaggucuuggccacucaacgagggaaucauggcugucgguauagugagcauauuguuauccagccuauuaaagaacgacguuccauuagcgggaccccuaauugcugguggcauguugauugcuuguuauguuauaaguggaucaagcgcugauuuaucacuagaaaaagcagcagaaguuucaugggaagaagaagccgaacauucaggagccucucacaauaucuugguggaaguccaagacgacggcacuaugaaaauuaaggaugaggaaagagacgauacauuaacgauuuugcugaaagcuacacuccuugcggugagcgguguuuacccgcuaucuauacccgcuacauuauucgucugguauuucuggcagaagaagaaacaaagauccgguguucucugggauacuccuucaccuccugaaguugagcgagcaguucuagacgaugggauuuacagaauaaugcagcgaggauuauugggaagaucccaaguugggguaggaguguuucaagaaaacguauuucauaccauguggcacgucacaagaggggcgguauuaauguaucagggaaaaagguuagaaccaaguugggcgucagucaagaaagaucuaauaucauaugggggcggguggagauugcaagguaguuggaacaccggagaagagguacaaguuaucgcgguggagccaggcaaaaauccgaagaauguacaaacagcaccaggcacauucaaaacaccugaaggagaaguuggagcaaucgcauuggauuucaaaccggggacgucagggagcccaauuguaaauagagaagggaaaauuguuggauuguauggaaauggcgucgucacaacaucaggcacauacgucagugccauagcacaggccaaagcgucucaagaaggaccacuaccagaaauugaggacgaaguuuuccgaaaaaggaaccuuacaauuauggaccuacauccaggaagcgguaaaacacgucguuaucucccagccauuguucgagaagcgauaaaaagaaaacugcgaaccuugauauuagcaccuacgcggguugucgcuagugaaauggcggaagcguuaaaagguaugccgauucgauaccaaacuacagcaguaaaaagugagcacacugggaaagaaauuguggaccugaugugccaugcaacguucacaaugagacugcuauccccaguaagaguuccgaauuacaauaugaucauuauggacgaggcacauuucacggacccgucuaguauagcagccagagguuacauauccacaagaguaggaaugggugaggcagcagcaaucuuuaugacagccaccccacccggcaguguagaagccuuuccacaguccaaugccgucauacaggaugaagaacgggauaucccugagaggucuuggaacucuggauaugaguggaucacugacuuuccuggaaaaacaguaugguuuguaccaucuauaaaaagcggaaaugauauagcuaacugccuccgcaaaaauggaaaaagagugauccaacugaguagaaagacuuuugauacagaauaucagaaaaccaaaaauaaugauugggauuauguaguaacaacggacauaagugaaaugggugcgaauuucagggcugacagaguaauugacccuagaaggugcuuaaaacccguaauucugaaggauggaccugaacgugucauuuuggcaggcccaaugccaguuacaguagccucagcugcacaacgcaggggcagaauaggacgcaaccacaacaaggaaggagaccaauauauauauaugggucaacccuuaaacaaugacgaggaucacgcucauuggacagaagcaaaaauguugcuagacaacauuaacaccccagaggggaucauccccgcauuauucgaaccagagagagaaaaaucggcggcaauagacggugaauacagacuacgaggggaggcgcgaaaaacauuuguagaguuaaugcgacguggggacuugccgguuugguugaguuacaaaguugcgagcgaagguuuucaauauucugaucgucgcuggugcuucgauggugaaaggaacaaucaaguauuagaagaaaauauggauguugaaaucuggaccaaagaaggagagaggaagaaauuacgcccgagguggcuagaugcaagaacauacucagauccucuagcuuuacgggaauuuaaagaauuugcggcaggccggagauccguaagcggugaccuuauuuuagaaauaggcaaacuuccgcaacaccuaacccaaagagcccaaaaugcgcuagauaauuuaguaaugcugcauaauucugaacaaggugguagggcauaccggcacgcuauggaagaguuaccagauacuauagaaacccuaauguuguuagcacuaauagcagugcucacgggugguguaacacuauuuuuccuuaguggaagggguuuagggaaaaccucuauagguuuauuaugcguaauggcgagcagcguccuacucuggauggcuucaguagaaccacauuggaucgcagcaaguauuauauuagaguucuuuuuaaugguacucuugaucccggaaccugauagacaacguacaccccaagauaaccagcuagcguauguaguuauaggacuacuguuuaugauacugacggucgcagccaaugaaaugggauuacuugaaacuaccaagaaagacuugggcauagggcaugucgcagucgaaaaccaucaucacgccgcaaugcuagacguugaucuacauccagcaagugcguggacguuauaugccguugcgacgacaauaauuacaccaaugaugagacauacuauagaaaauacgacugcgaauauuucucuaacagcuauagccaaucaagcagcaauucuaaugggauuagacaaaggauggccuauaucuaagauggacauuggcguaccacuuuuggcauuaggauguuacucacaggucaacccacuaaccuuaacugcugcaguucuaaugcuaguugcacacuaugccauuauaggaccaggccuccaagccaaagcuacaagagaagcacaaaagagaaccgcagcuggcauaaugaaaaauccgaccguugacgguauaguggcuaucgauuuagacccuguuguuuaugacgcuaaauuugagaagcaacuuggacaaauuaugcuucuuaucuuauguacaucgcaaauuuugcucaugaggacuaccugggcuuuaugugaaagcauaacacuugcaacagggccuuugacuacacugugggaaggaaguccagggaaauucuggaauacuacaauagcuguuaguauggcaaauauuuuuaggggcucuuaucuugcuggggcuggucuagccuuuagcuugaugaaaagccuuggugguggccggcgaggcacaggggcacaaggggagacauuaggagaaaaauggaaaaggcaguugaaucaauuaaguaaaagcgaguucaacacuuauaaacguuccgguaucauggaaguagacagaagugaagcgaaagaagguuugaaaagaggagagacaacuaaacaugcggucuccaggggaacagccaagcugcgaugguucguagaacguaaccuuguuaaaccggaaggcaaagucauagaucuuggaugcggacgaggaggauggagcuauuauugcgcgggucugaagaaaguuacagaaguuaaagguuauacgaaaggaggcccaggccaugaggaacccauuccaauggcuacguauggauggaacuuaguaaaacuccauagcggaaaagauguauuuuucauaccgccagaaaagugugacacacuguugugugacauaggcgagucaucgccaaacccuaccauagaagaagguagaacauuacguguauuaaagaugguagagccgugguuacgaggaaaccaauuuuguauaaaaauuuuaaauccauacaugccaucuguaguugagacucuggaacaaaugcagcggaagcacggaggaaugcuuguacgcaauccacuuucucgaaauaguacucaugagauguauuggguaucgugcgggacugguaauauaguuucagcgguuaauaugaccucaagaaugcuuuuaaacagguucacgauggcacaccgaaaaccuaccuaugagagggauguagaccucggggcaggcacuagacacgucgcuguugaacccgaaguagccaaucuagacauuauugggcaaaggauagaaaacauuaaacaugaacacaagucaacauggcauuacgaugaagacaacccauacaaaacgugggcguaucacggcaguuacgaagucaaaccaucagguucagccuccuccaugguuaacggaguuguuaagcuacucacaaagccgugggacguaauuccuaugguaacgcaaauagcgaugacagauacaacuccauucggccagcaacgaguauuuaaagagaaaguagauaccaggacaccuaaggcuaagaggggcacggcgcagauaauggaaguuacugcgaaauggcuuuggggauuucuaucucguaauaagaaaccucggauuuguacaagggaagaauuuacgaggaaagugcgauccaaugccgcaauaggggcaguguuuguggacgagaaccaguggaacucugccaaagaagccguugaagaugaacgcuuuugggaucuaguacauagggaaagggaacuacauaaacaagguaaaugcgcgacauguguauauaacaugaugggaaagagagagaagaaacuuggagaauuuggcaaagccaaggggagucgagcaauaugguacaugugguuaggagcaagauuccuagaauuugaagcacuugguuuuaugaaugaagaccacugguuuucuagagaaaacuccuugagugguguugaaggugaaggauuacacaaacugggcuacauauuaagggauauuucaaagauaccggguggcaauauguaugcagaugauaccgccggaugggauacacgaauaacagaagaugaccuacaaaaugaggcucgaauaacugacauaauggaaccagaacaugcucuuuuagcuaaaucuauauucaaacucacuuaccaaaauaaaguaguaagggugcaaagaccugcaaagaauggaacagugauggaugucauaucgaggagagaccagagagguagcggucaagucggaacauacggacuuaauacuuucacaaacauggaagcacaauuaauaagacaaauggagagugaggggauauuuucacccucggagcuugagacaccuaaucuugcggaaaggguacuagacuggcuagaaaaguauggaguugaaagauuaaaaaggauggcuauaagcggagaugacuguguugucaaaccaauugacgaccguuuugcgacagcacuaacagccuugaacgauauggguaaaguccggaaagauauaccacaaugggaaccaagcaaaggcuggaacgauuggcagcaagugccauuuuguucacaucacuuucaccaacucauaaugaaagauggucgggagauaguaguuccuuguagaaaccaagacgaacuugucggcagagcuaggguaagucaaggugcuggauggagccuaagagaaacagcguguuuaggcaaaucauaugcacaaauguggcagcuaauguauuuucaccgaagagaucugagauuggcggcaaacgccauauguagugcuguacccguggauuggaucccgaccucaagaacuacuuggucaauucacgcacaucaucaguggaugacaacagaagauaugcuaaguguguggaauaggguauggauagaggaaaauccauggauggaagacaaaacgcacauaucaaguuggggagauguacccuacuuagguaagcgagaagaccaauggugcggaucuuugauagguuugacugcacgagcaacgugggcuacaaauauacagguagccaucaaucaagucagacgacugauugggaaugaaaauuaccuagauuacaugacgagcaugaagcgguuuaaaaaugaaggcgauccagaaggagcacugugguag

SEQ ID NO: 21947 - RNA, 9879 nt, Artificial Sequence
  derived and/or modified CDS sequence (opt6) from DENV-1__EU482509__SS-prME
ucuguuacuaugcuccugaugcuuaugccgacagcauuagcuuuucauuuaacgacacgcggaggagaaccacacaugauugucaguaaacaagaacgaggcaaaucauuauuauucaaaaccagugcuggagugaacauguguacacuuauagcaauggauuugggcgaacugugcgaagauacaaugacauauaaauguccgagaauuaccgaaacagaaccagaugacgucgauuguuggugcaacgcaacggauacgugggugacuuaugguacauguagccaaacaggcgaacaccguagagacaaaagguccguggcgcuggcuccacauguggggcuaggacuugaaacgcgcacggaaacauggaugucaucagaaggcgcuuggaaacaaauacaaagaguggaaacuugggcgcuaagacauccaggauucacugugauagcguuauuuuuggcgcaugcuauaggcacaucuauaacucaaaaaggaaucauuuuuauacuguugaugcuaguaaccccauccauggcaaugaggugcguuggaaucggaucacgagauuucguagaaggccuauccggggcuacguggguagaugucguacucgagcacgggucaugcguuaccacgauggcaaaagauaaaccgacacuagacauugagcuacucaaaacagaaguuacgaauccagcaguuuuacguaaacuauguaucgaagcuaaaauuuccaauacaaccacagauucucgaugucccacacaaggagaagcaacauuaguugaagaacaagacgcgaacuucgucuguagaagaacauuuguugacagggguugggguaaugggugcggcuuauuuggcaaagggagucucauaacgugugcaaaauucaaaugcguuacgaaauuggaagggaaaauaguccaauaugaaaaucuuaaauauucuguuauaguuacgguacauacaggggaucaacaccagguggguaacgaaaguacggaacauggaacuacugcaacaauaacaccccaagcuccuaccacagaaauccaguuaacugacuacggcgcuuugacguuagauuguucgccacgaacuggauuagacuucaaugaaaugguacuacugacgaugaaagagaaaagcugguuaguacacaaacaaugguucuuagauuuaccgcuuccauggaccucuggggcaagcacaucccaagaaaccuggaaucgacaagauuuacugguuacguuuaaaacagcacacgccaagaaacaagaaguggugguacuuggcucgcaagaaggagcgaugcacacagccuuaaccggagcaacugaaauccagacaucuggaacaacaacaauuuuugcaggacaccuaaaaugucgacuuaaaauggauaaacucacuuugaaggggauguccuacguaauguguacggguaguuucaaacucgagaaagaaguagcagagacccaacacgggaccguccuaguacaaauaaaguaugaaggaacagaugccccaugcaagauaccuuuccuuacacaggacgaaaaaggaguuacacagaauggaagguuaauuaccgcaaauccaaucguuacggacaaggaaaaaccgguuaacauagaagccgagccaccguucggagaaucauacaucaucaucggagcuggcgaaaaagcgcuaaagcuguccugguuuaagaaaggcaguucgauaggaaaaauguucgaggcgacagcucguggagcuagacguauggcgauacugggagauacugcaugggauuuuggcaguauuggcggaguauuuacauccgcgggcaaauuagugcaucaaauuuucggcacggccuacggaguacuuuuuagcggaguuucauggacuaugaaaauaggaauagguguauuacuaaccugguuaggauuaaauucgcguucaacuucuuuaucuaugaccuguaucgcaguuggccuaguaacuuuguacuuaggggugaugguucaagcagauucugguugcguaaucaacuggaaaggccgagaauuaaaaugugguucagguauauuuguuacaaaugaagugcauacguggacggagcaauauaaauuucaagcugauucaccgaaaagacugagugcagcaauuggcaaagcgugggaagaagguguauguggaaucagguccgcaaccagacuugaaaauauuauguggaaacagauuucuaacgaguuaaaucauauucuuuuagaaaaugacaugaaguuuaccgugguagugggcgauguagcgggaauuuuagcgcagggcaagaaaaugauaagaccucaaccaauggaauauaaauacuccuggaaauccuggggaaaggcaaagauaaucggugcggacguccaaaauacuaccuuuauaauagauggcccaaacaccccagaaugcccagacgaccaaagggccuggaacauaugggagguagaggacuauggguucgguauuuucacuacaaacauaugguuaaaauuaagggauagcuauacacaaguaugcgaucaucgucuaaugagcgcggcaauaaaagauucuaaggcaguacaugcagauauggguuacuggauagaaucugagaaaaaugaaacuuggaaauuagcaagggcuaguuucauagaggucaaaacaugcauauggcccaaaucacacacacuauggagcaacggugugcuagaaucagaaaugauuguaccaaaaaucuauggaggaccuauuagccaacauaacuaucggcccggcuacuuuacccaaacagcagguccguggcaucuaggcaaacuagaauuagauuuugaccuaugcgaagguacaacggugguaguagaugaacauugcggaaacagggguccuucucugagaacgacaacaguuacggguaaaauaauucacgagugguguugucgcaguuguacguuaccaccgcuccgcuucaggggagaagauggauguugguacggcauggaaaucaggccugucaaggaaaaagaagaaaaccugguaaaaucgauggucagcgcugguaguggcgaaguagacuccuuuucuuuagguuuacuguguauaucaauaauaauagaagaaguaaugagaucccgauggagcagaaagaugcuuaugacgggaacuuuagcaguauuuuucuuauugauaauggggcaacuuacuuggaacgacuuaauacguuuguguaucaugguaggagccaaugcuagugaucggauggguauggguacaacauaucuggcauuaauggccacauuuaaaaugaggccaauguuugccguaggacuacucuuucggagguuaacauccagagaaguacuacuauuaacuauuggccucaguuuaguugcgagugucgaauuaccuaauagccuagaagaauugggggacggucuugcaaugggcauaaugaucuuaaaacuacuuaccgauuuucaaucucaucaacucugggcgacacuacugucgcuuacauuuaucaaaacuacauuuagcuugcauuaugcauggaaaacaauggccauggugcuaucuauaguaagccuuuucccacuuugucuaagcacaacaagccagaaaaccacguggcucccuguuuuguuagguucacuuggcuguaaacccuuaacaauguuccucauagccgaaaacaaaauuuggggaaggcgauccuggcccuuaaaugaggggauuauggcaguggggauuguuagcaucuuguuaaguaguuugcuaaagaaugacguaccuuuagcaggaccacugaucgcuggagguaugcugaucgcuuguuaugucauuaguggauccucagcagaucuaucccucgaaaaggcagccgaaguuagcugggaagaagaagcugagcauucaggcgcaagucauaacaucuuaguggaaguccaggacgauggcacaaugaaaauaaaagacgaagaaagagaugacacacuaacaaucuuguuaaaggccacgcuacuugcuguaaguggaguguacccuuuaaguaucccagcgacauuguucgucugguacuucuggcaaaagaagaaacaaagaucagguguuuuaugggauacccccaguccaccagaaguagaacgcgcaguguuggacgaugguauauaccgaauuaugcagcggggauuacuagggcgaucacaaguugguguuggaguuuuucaggaaaauguguuccauacaauguggcaugucacucguggagcaguacuaauguaccaaggaaagagacuagaaccgucaugggcaagugucaaaaaggacuuaauuucuuacgguggaggauggagauuacaaggauccuggaacacaggugaggaagugcaaguuauugcaguugaaccagguaaaaacccuaagaauguucaaacggcuccgggaacauucaagacgccagaaggcgaaguuggugccauugcucuagauuuuaaaccagguaccaguggaaguccuauaguaaauagagaagguaaaauaguaggacuauauggaaauggaguuguuacgacaucaggcacauacguuucagcaauagcccaagccaaggcgucccaggaggguccauuaccggagauagaggaugaagucuuccgaaaaagaaaccuaacaaucauggauuugcaccccgguucuggaaaaacgagaagguacuugccugccauuguccgcgaagcuauuaaaaggaaguuaagaacacugauacucgcaccaacucgagucguagcuucagagauggcugaggcauugaaaggaaugccaaucagauaccaaaccacggccguaaaguccgaacauacaggcaaagaaauuguagacuugaugugccaugcaacauucacaaugcgguuacuuucacccguuagaguuccuaauuauaauaugauaauuauggaugaagcacacuucaccgacccuaguucuauagcagcucgaggauauaucucaacgcgaguaggaaugggugaagcagcagccauauuuaugacggcuacuccacccggaaguguagaggcuuuuccacagucgaacgcggugauccaagacgaagaacgugauauucccgaacgaucuuggaacucaggauaugaauggaucacugacuucccagguaagacuguaugguucguuccauccauuaaaucuggcaaugauauagcaaacugccuacguaaaaacgggaagcgaguuauacaacuaucccguaaaacuuucgauacugaauaccagaaaacaaagaauaaugauugggauuauguaguuacgacagauaucagugaaaugggagcuaauuucagggcggacagaguaauagacccaagacgaugucuuaaaccugucauauugaaggaugguccagaaagaguaauucucgcugggccuaugccggucacaguagcaucugccgcacaaagaagggguaggaucggccgaaaccacaacaaagaaggagaucaauacauauacaugggccaaccgcuuaauaacgaugaagaccacgcucacuggacugaggcuaaaaugcuacucgacaauauaaauacaccagaaggcaucauaccugcucuauucgagcccgaacgcgaaaaaucagcugcgaucgauggggaauacagauuaagaggggaagcacgaaagaccuuuguugaauuaaugagaagaggcgaccuaccaguguggcuaagcuauaagguggccucugaaggcuuucaauauucagauagaagauggugcuuugacggagaaagaaauaaccaggucuuagaagaaaauauggauguggaaauauggacuaaagaaggugaaaggaagaaauuacgcccaagauggcuugaugcgaggaccuauucggacccgcuagccuuacgugaguuuaaagaauuugccgcaggaagacggucuguaaguggugaucugauccucgaaaucggcaaauuaccucaacaccuaacgcaaagagcucaaaaugcacuggauaauuuagugauguuacauaauucagaacaaggaggucgugcuuaccgacaugcuauggaagaauuaccugauacaauagagacauuaaugcuccuagccuugauagccguucuuaccggaggcguaacauuauucuuucucucagggagaggccuugggaaaacgucaauaggguuauuaugcgugauggcaucauccguacuacuauggauggccucagucgaaccacacuggauagcggcaucaauaaucuuagaguucuuucuaauggugcuucucauaccggaaccagauagacagagaaccccgcaagauaaucaauuagccuacgucguaauuggacuacuauuuaugauucuaacgguagcagcaaacgagaugggcuuguuagagacaaccaagaaagacuuaggcauaggccauguagcuguagagaaucaccaucacgcagccaugcuagauguugauuuacacccagcuagcgcguggacuuuauacgcgguugccacaacaauuauaacgcccaugaugcggcauacaauagaaaacacuaccgcuaacauaucuuugaccgcuauagcaaaucaagcugcuauucuaaugggauuagauaaagguuggccaauuucaaaaauggauauaggaguaccacuuuuggcuuugggauguuauucacaaguuaauccucuuacccugacagcagccguacucaugcuagucgcacauuaugcuauaauaggccccgguuuacaagcaaaagcaacacgugaagcgcagaaaaggacugccgcagguauuaugaaaaauccaacaguagacggcauaguugcgauagaccucgauccuguuguauaugacgcgaaauuugaaaaacaacucggacaaaucaugcuguugauucuuugcacuucucagaucuuacuaaugcguacaaccugggccuuaugugaaucgaucaccuuagcaaccgguccacuuacgacauugugggaaggcucaccagguaaguuuuggaauacuacuauugccguuucuauggcaaauauuuuucgaggcucuuaucucgccggugcuggacucgcuuuuucauuaaugaaaagccuaggaggcggaagaagaggaacaggcgcacaaggcgaaacauuaggcgaaaaguggaaacgacaauuaaaccagcuaucaaaaucggaauuuaacacauacaaaaggagcggcauuauggaaguugauagaagugaggcgaaagaaggacuaaaaaggggagaaacuacaaaacacgcaguauccagagggacugcaaaacuacgaugguuuguugagcgaaaccuagucaaaccggaggggaaaguaauugauuuagguugcggcagaggaggcuggucauauuauugcgcuggucugaagaaaguaacagagguuaaaggauauacuaaagguggaccaggacaugaagaacccauaccaauggcaaccuauggauggaaucuuguuaaguuacauuccgguaaagauguuuucuuuauuccucccgaaaaaugcgauacccuauuaugcgacauaggagaaucaaguccgaauccgacgauagaagaagguagaacccugaggguccuuaagaugguggaaccuuggcuccgaggcaaccaauuuuguauaaaaauacuaaauccuuacaugccuagcguaguggaaacuuuagaacaaaugcaaaggaaacauggagguauguuggucaggaauccacuuucccgaaacagcacccaugaaauguauuggguaucgugcggaacggggaauauugucucagcaguuaauaugaccaguaggauguuacuaaacagauuuacuauggcucaccggaaaccuacauaugaacgggacguggaucuaggugcugggaccagacauguagcaguggaacccgaaguagccaaccuggauauaauuggacagcgaauagaaaacauaaaacaugaacacaaaucuaccuggcauuacgaugaagauaaucccuauaaaacaugggcauaucacggaagcuacgagguaaagccaucugggagugcaagcagcaugguaaauggcguuguaaagcucuuaacaaaaccgugggauguaauaccgauggucacucagauagcaaugacagauacaacacccuuuggccaacagcggguauuuaaagaaaaaguagauacacgcaccccaaaagcaaagagggggaccgcucaaauaauggaagucacagccaaaugguuauggggauucuuaucaaggaauaagaaaccacggauauguacgagagaagaguucacucguaaagugaggaguaacgcugcaauaggagcuguuuuuguagaugagaaccaauggaacagcgcuaaggaagcgguugaagaugagagguucugggacuugguacauagggaaagagaguuacauaagcaaggaaaaugugccacauguguuuauaacaugauggggaaaagagaaaagaaauuaggcgaauuuggaaaagcaaaaggcaguagagccaucugguacauguggcuaggagccagguucuuagaguucgaagcgcugggguuuaugaacgaggaucacugguuuucgagggaaaauagcuugaguggcgucgaaggagaaggacuccacaaguuagguuauauacucagagacauaucgaagauaccgggagguaacauguacgcggacgauacagcuggcugggacacccgcauaacugaagaugacuugcaaaaugaagcgagaaucaccgacauaauggagccagaacaugcucucuuggcaaaaagcaucuuuaaauuaacuuaccaaaacaaaguagugagggugcaaagaccagccaaaaacgguacuguaauggacguuaucaguagaagagaucaacgaggcagugggcagguaggaacauacggacuaaauacuuuuacgaauauggaagcacagcuaauuaggcagauggaaucugaggguauuuuuaguccauccgaacuagaaaccccaaaccucgcagaaagaguacuugauuggcuagaaaaguacggaguugaaaggcuaaagcguauggccauaaguggugacgacugugucguuaagccaauagaugauagauuugcaacagcucuaacagcauuaaaugauaugggcaagguaagaaaagauaucccgcagugggaacccagcaaagguuggaaugacuggcaacaaguucccuuuuguucucaccacuuccaccagcugauaaugaaagacggacgggaaauaguagucccuugucggaaucaagaugaguugguggggagagcacgaguaagccaaggggccggauggagccuccgagaaacagcuugucuaggaaaaagcuaugcacagauguggcaguugauguauuuucauaggagagauuuaagacucgcggcaaaugccauaugcucagcuguucccguagauuggauucccacuucccgcacuacauggaguauacaugcacaccaucaauggaugacgacugaggauaugcuuucaguauggaacagagucuggauagaagagaauccuuggauggaagauaaaacccacaucagcuccuggggugacguaccuuacuugggaaagagagaagaucaauggugcggaucauuaauuggauuaacugcacgcgcaacuugggcaacuaauauacagguagcuauaaaccaaguuagacgauuaauuggcaacgaaaauuaccuagauuauaugacuucgaugaaaagauucaaaaacgaaggggaaccagaaggugcgcuaugguga

SEQ ID NO: 21948 - RNA, 9879 nt, Artificial Sequence
  derived and/or modified CDS sequence (opt6) from DENV-1__EU482510__SS-prME
ucaguaacaaugcuacuuaugcuuaugccaacugcacuagcauuucaccuaacuacucgagggggugaaccccauaugauagugaguaaacaggaacgugggaaaucgcuacuauuuaaaacauccgccgguguaaauaugugcacauugauagcuauggaucuaggugaacuaugugaagauacgaugacuuauaaauguccacguauaacagaaguagaaccugacgauguagacuguugguguaauacaacagauaccugggucacuuaugguacaugcucacaaacaggugaacauagaagggacaaacgcucuguggcccuagcaccucauguagguuuaggacuagaaacacgugcagaaacauggaugucgucagaaggagccuggaaacaaauucaaaaaguagaaacaugggcguuaagacacccaggguuuacugugauugcccuauuucuugcgcaugcuauugguacaaguaucacacagaaaggaauaauauuuauucuuuuaauguuaguaaccccaucgauggcaaugagaugcguaggaauaggaucacgugauuuuguagaagguuugucuggggccaccugggucgacguaguacuagagcauggaaguugcguuacaaccauggcgaaagauaaaccuacucuugacauagaacuauuacguacggaaguaacaaauccagcagucuuacguaaauuauguauugaggccaaaauaucaaacaccacuaccgacuccagauguccaacucaaggagaagcaacucuuguagaagaacaagaugccaacuucgucuguagacgcacguucguugauagaggauggggaaacggauguggacucuuuggcaaaggaucgcuaauaacaugugcaaaauucaaaugugucaccaaacuugaaggcaaaauaguacaguaugaaaacuugaaauauucaguuaucgucacuguccacacaggagaucaacaucagguagguaacgagagcacagagcacggcacuacggcaacuauaacuccucaagcaccgacgagcgaaauacagcucacagauuacggugcuuuaacuuuggauuguucgccuagaacaggccuggacuuuaacgaaaugguauuauuaacaaugaaagagaaaaguugguuaguucacaaacaaugguuucuggauuuaccuuuaccauggacgucaggagccaguacaucgcaggaaacauggaaucggcaagacuuacuggucacauucaaaacggcacaugcaaagaaacaggaaguggucguucuaggaucgcaagagggagcaaugcauacagcacuaacgggagcgacggaaauucaaacuucugguacgaccaccaucuucgcaggacaccugaaauguagauuaaaaauggacaaauuaaccuuaaaagguaugucuuaugucauguguaccggcagcuuuaaacuagaaaaagaaguugccgaaacccaacauggaaccguacuugugcagauaaaauaugaaggaacagaugcaccuugcaaaauacccuucucuacacaagauggaaaagggguaacacaaaauggacgguuaaucacugccaacccaaucguaacagauaaagaaaaaccgguuaacaucgaagcugaaccaccauuuggugaaucauacauaguaauaggggcaggagaaaaagccuugaaauugucaugguuuaagaaaggauccuccauuggcaaaauguucgaagcuacggcuagaggagcacgacgaauggcaauauuaggugacacggcgugggauuuuggaaguauaggagguguauuuaccucaguaggaaagcuaguacaucaaauauuugggacagcuuacggaguucuauucagugguguaucauggacaaugaaaauagguauaggaguccuauuaacuuggcuuggcuuaaauucuagaagcacgucuuuaucgaugaccugcauugcgguugguuuaguuacccuuuacuugggcgucaugguacaagcagacucgggguguguaauaaacuggaaaggacgugaacuaaaaugugguucgggaauauuugugacgaaugaagugcauacauggaccgaacaauacaaauuucaagcagauucuccaaaaagacucucagcagcaauaggaaaggcuugggaagaggggguauguggcaucagaucagccacaagauuagagaacauuauguggcgacagauaucuaaugaauuaaaucacauccuauuagaaaaugauaugaaauucaccguagugguaggagaugucguaggcaucuuagcgcaaggcaagaaaaugauaagaccgcaaccaauggaacauaaauauucuuggaaaucauggggcaaggcuaaaauuauaggagcagacgugcagaacacaaccuuuauaauagauggaccaaauacgccugaguguccagaugaucagcgggccuggaauauaugggaaguagaggacuacggauuugguaucuuuacaacgaacauauggcuaaagcuacgcgauucauacacccaaguuugugaccaucgauuaaugagcgccgcaauuaaagauaguaaagcuguacaugccgauauggguuauuggauugagagugagaaaaaugaaacauggaaacucgcgcgugcaaguuuuauugaaguaaaaacuuguauuuggccuaaaucucauacgcucugguccaacgggguucucgaaagugaaaugauaauaccuaaaauauauggaggaccaauuagccagcauaauuauaggccaggauauuucacccaaacagcuggucccuggcacuuaggcaaauuagaauuagauuuugaccucugugaaggaaccacagugguuguagaugagcauuguggcaaucggggaccuagccuucguacuacuacgguaaccgguaagaucauacacgaaugguguuguagaaguuguacuuuaccuccauuacgguucaaaggcgaagauggaugcugguacgguauggagauacgcccaguuaaggaaaaagaagaaaacuugguaaaaaguauggugagugcuggaucaggcgagguagauucauuuucccucggcuugcuuuguauuagcaucaugauagaggaagucaugagaagcagauggucacgcaagaugcugaugacaggcacccuggcuguauuuuucuuauuaauuaugggacaacucacguggaaugaucugauccguucauguauuaugguuggagcaaaugcaucagaucgaauggguauggguacuacuuaccuagcguuaauggcgacuuuuaaaaugaggccuauguuugcaguaggauuacuuuuuaggagauuaacuucucgcgaaguuuugcuucugacaaucgguuuaucucugguugcaucaguagaacuaccaaauucucuugaagaguugggagauggauuagcaauggguauaaugauauugaaacuacucacagauuuucaaagcuaucaauuaugggcgacuuugcuaagccugacauuuaucaaaacuacauuuucucuacauuacgcauggaaaacuauggcaaugguucuaagcaucgugucucuucuaccucuuugcuuaucaaccacaucacagaaaacuacuugguuaccagucuuauuggguagcuuaggaugcaagccguuaacaauguuucugauagcagaaaacaaaauuugggguagaaaaucuuggccucuuaaugaagguauuauggcagucgguauaguuucaauacuacucuccagucuucuuaagaaugacguaccacucgcagggccucuuauagcgggagggaugcuuauugcguguuacgucauauccggaucaagcgcggauuuaucauuagaaaaagcagcggagguaucgugggaagaagaggcugagcauucaggagccucgcauaauauuuuaguugagguccaagacgacgggacaaugaaaauuaaggaugaggaaagagaugauacccuuacuauccuauugaaagcuaccuuacuugcugucuccggaguauauccuuuaucuauaccugcaacauuauuuguaugguauuuuuggcagaagaagaaacaaagaucuggcguuuuaugggauacacccucgcccccugagguggaaagagcaguucuagaugauggaaucuacagaauaaugcaaaggggauuacugggaaggucacaaguaggugucggaguguuucaagagaacguuuuucacacaauguggcacguaacucgaggagcgguucuaauguaccaaggcaaaaggcuugaaccuagcugggcaucagucaagaaagacuugauaaguuaugggggcgguuggagauuacaaggaucuuggaauacgggagaagaaguacagguuauagcuguagaaccagguaaaaaucccaaaaauguacagacggcuccuggcacauucaaaacaccggaaggggaaguaggggccauagcccuagacuucaaacccggcacaucaggauccccaauuguaaauagagaaggcaaaauagucggauuauauggaaauggcgucguaacgacauccgguacauacgucucugccauugcacaggcuaaagccagccaagagggcccgcuuccagaaaucgaggacgaggucuuccgcaaacggaaucuaacgaucauggauuugcauccuggaagcggcaaaacacgaagguaucuacccgcgaucguucgagaagcuauaaagaggaaacuaagaacacuaauucucgcucccacuagggucguagcuagugagauggccgaggcuuuaaaaggcaugccaauaagguaucaaacaacagcgguaaaaagugaacauaccggacgagaaauuguagaucuaaugugucacgcuacguuuacaaugcgcuuauuaucacccgugagagugccaaacuacaacaugaucauaauggacgaagcgcauuuuaccgacccaucuaguauugcugcucggggauauauaucaacuagaguagggaugggagaggcggcggcuauauuuaugacagcuacgccaccaggaucugucgaagcauuuccacaguccaaugcaguaauucaggacgaggagcgagauauucccgaaaggucuuggaacucaggguacgaauggauaacagacuucccagggaaaacuguuugguuugucccaaguaucaagucuggaaaugauauagcaaauuguuuacggaagaacgguaaacguguaauacagcuaagccgaaagacguuugauacggaauaccaaaagacaaagaacaacgacugggauuauguuguaacaacagacaucucagaaaugggggcuaauuuccgcgccgauagggugauugacccacgaagaugccucaagccggugauacugaaagauggacccgagagagucauacuagcgggaccuaugccagucacaguagcaagugcagcacagcgcagagggcguaucggacguaaccacaauaaggagggagaccaauauauauauaugggacaaccguuaaauaacgaugaagaccaugcacacuggacggaagccaagauguuacuggacaauauaaauacaccagaaggaauaaucccagcguuguucgaaccugagagagagaagagugcggcaaucgauggagaauaucgacuuagaggugaagcucgaaaaacuuuuguggaauuaaugaggcgaggcgacuuaccagucugguuaucguacaagguugcuagugaaggauuucaauauagugaucgaagauggugcuuugauggagaacgaaacaaucaggugcuugaagaaaauauggacguagagaucuggacaaaagaaggcgaacgaaagaaacuaagaccgcgauggcuagaugcaagaacauauucagauccauuagcacugagggaauuuaaagaauuugcagcgggacgaagaagcguaagcggugaucuaauuuuagaaauaggaaaacugccccaacacuuaacucaaagagcucaaaaugccuuagauaauuuaguuauguugcacaauucagaacaaggcggccgugcguaccgucacgcgauggaggaacugcccgacacuauagaaacacuaauguugcuugcccuaauagcgguuuugacugguggagucacguuauucuuucucuccggacgaggauuagggaaaacaucuauaggucuacuuugcgucauggcuaguucggcguuauuauggauagcaucggucgaaccucauuggauagccgcuucaauuauauuagaguucuuuuuaauggugcuuuuaauaccugaaccagauaggcaacgcacuccucaagacaaucaauuagcuuacguugucauagguuuauuguuuaugauucuuaccguugccgcuaaugagaugggacugcuugagaccacuaagaaagaucuuggaauuggccauguugccguggagaaccaucaucacgccaccauguuagauguagaucuccauccagcaagugcguggaccuuauaugcuguugcuacgacaauaauaacccccaugaugcgacauacaauagagaauacuacagcgaauauaagucuaacagcaauagcaaaccaagccgcuauacuaaugggacuagacaaaggcuggccaauaagcaaaauggauauuggaguacccuuacucgcucucgguugcuauucacagguuaaucccuuaacacuaacugccgcaguacugauguuaguagcacauuaugcaaucauaggcccugguuugcaagcaaaagcaacacgagaggcccagaagaggacugcggccgggauuaugaaaaaucccacaguagauggaauaguugcaauagaccucgacccuguagucuaugaugcgaaauucgaaaaacaacuuggacaaaucauguuacucauccuuuguacuucacaaaucuuacugaugcgaaccacaugggcacucugugaauccauaacauuagccacaggaccucucacuacgcuuugggaagguaguccagggaaauucuggaauaccacgaucgcaguuucgauggcaaauauauuucgagggucauaucuggcaggagcuggucucgccuuuucacucaugaagaguuuaggaggcggaagacgaggaacaggagcacaaggagagacacuuggcgaaaaauggaaacgacaauuaaaccaguuaagcaaaucagaauuuaacacuuauaaaagaucaggaauaauggaggucgauaggagcgaagcgaaggaaggcuugcgcaggggugagacgacaaagcaugcgguaucucgagguacugcaaaguuacgcugguuuguugagcguaaucuaguuaaacccgaagggaaaguaauugaccucgguugcgguagaggcggauggucauauuauugugccggccucaagaaaguaacagaagucaaaggguauacuaaaggagguccaggucacgaagaaccaauaccuauggcaacguacggauggaaccuuguaaagcuacacagcggaaaagacguguucuuuauuccaccagaaaaaugugacacccuacuuugcgacaucggugaaaguuccccgaauccgacaaucgaggaagguagaacauuaagggucuuaaaaaugguugaaccauggcucagaggaaaccaguucuguauuaaaauacuuaacccauauaugccuaguguagucgagacacuagagcaaaugcaacggaaauauggaggaaugcugguacgcaauccacuaaguagaaacaguacacaugagauguacuggguuuccugcgggacaggaaauauaguuagugcagucaauaugacgucaagaaugcuacuaaaccguuucacaauggcccaucggaaaccgacauaugaaagagauguagauuugggcgccgggacuaggcauguugccguugagccugaaguagcaaauuuagauauaauugggcaaagaauagaaaacauaaaacaugaacacaaguccacauggcauuacgaugaggauaacccauauaaaacaugggcauaucacgguucauacgaaguuaaacccucaggaucagcaucaaguauggugaacggaguugucaaauuauugacaaaaccaugggauguaaucccaauggucacucaaauagcuaugacugacacuacgcccuucggacagcaaagggucuuuaaagaaaaaguugauacccgaaccccaaaggcaaaaagaggaacggcccaaaucauggaagucacagcgagauggcuuuggggauuccugucucgaaacaaaaagccaagaaucuguacgcgugaagaguuuacgagaaaaguacgaucgaacgcagcaauaggugcugucuucguugaugaaaaccaauggaacucagcaaaagaggccguagaagaugagcguuucugggaccuaguccaccgagagagagagcuccauaaacaaggaaaaugcgccaccugugucuacaauaugaugggaaagcgcgagaagaaauuaggggaguuuggaaaagcaaaagguagccgagcaaucugguacaugugguuaggagcacgauuucucgaauuugaggcacuagguuuuaugaaugaggaccauugguuuucacgcgaaaacaguuuaucaggaguugaaggagagggacuacacaaacuuggguauauuuuaagggauauuaguaagauaccuggagguaauauguacgccgaugauacagcaggaugggauacacgaauaacagaagaugauuuacagaaugaagccaaaauaacugacauaauggaaccagaacacgcgcuauuagccacaaguauauuuaaguugacuuaucagaauaaaguaguccgaguucaaaggccugccaaaaacggaacggugauggacguaaucucgagacgagaucagcguggaucaggacaaguaggaacguacgggcugaacacauuuacgaacauggaagcgcaacuuauuagacaaauggaaucagagggaauauucagcccuagcgagcuagaaacuccaaaccuagcagaaagaguucuggauugguuggaaaaguaugguguugaaaggcucaaaaggauggcaaucagcggugaugauugugugguuaagccaauagacgauagguucgcaacggcuuuaacggcucuaaaugacaugggaaaagugaggaaagauauuccccagugggagccaaguaaaggauggaacgacuggcaacaagucccuuucugcagucaccacuuucaucaauugauuaugaaagacgggagagaaauagucguucccugucgaaaccaagacgaacuugucgguagggcacgaguuucacagggagcuggcuggucguuacgagaaacugcguguuuggggaaaucuuaugcacaaauguggcaauuaauguauuuucaccggagggauuuaagacucgcggcaaacgcaauauguucggcgguaccuguagacuggguacccacuucgcguacaacauggagcauucaugcgcaccaucaauggaugacaacagaagacaugcugaguguguggaacagaguauggauugaagaaaaucccuggauggaagacaaaacacauauuaguucauggggagauguaccuuauuuagguaaacgagaggaccaauggugcgguuccuuaauugggcuuacggcacgugcaacuugggcuacaaauauacagguagcuauaaaccaaguaagaagauugauaggaaacgaaaacuauuuagauuacaugacgucaaugaaacguuucaagaaugaaucugacccggaaggcgcauuaugguaa

SEQ ID NO: 21949 - RNA, 9879 nt, Artificial Sequence
  derived and/or modified CDS sequence (opt6) from DENV-1__EU482511__SS-prME
uccgucacuaugcuucuaaugcucaugccuacagcguuagcauuccauuugacgacaagaggaggugaaccccauaugauaguaucaaaacaagaacgcggaaaauccuuguuauucaaaacaagcgcugguguuaauauguguacacuaaucgcgauggaucuaggggaacugugugaagauaccaugacauauaaaugcccgagaauuacugaaacagaaccagacgauguagacugcugguguaaugcuacagacaccuggguuacguacggaacauguucacaaacuggagaacaucgaagagauaaacgauccguugcucuagcaccccacguugguuugggucucgaaacaaggaccgaaaccuggaugagcagugagggagcauggaaacaaauucaaagaguugaaacaugggccuugcgucacccuggauuuacaguaauagcuuuauuuuuagcacaugccauugguacaucaaucacucaaaaaggcaucauauuuaucuugcuaaugcuggugacaccaaguauggcaaugcgauguguaggcauaggaucacgugacuuuguagaaggauuaucaggagcaacguggguagacguuguacuagaacacgguagcugcguaaccaccauggcgaaagacaaaccaacacuugauaucgaauuauuaaaaacugaaguuacuaauccagcaguucugcgaaaacuauguauugaagcuaaaauuucaaacacgaccacagauucacgcugcccaacacaaggagaagcaacauuggucgaagaacaagaugcuaacuuuguuuguaggagaacguuuguugauagaggcugggguaauggcugcgguuuauucgguaagggaucuuugauaacaugugcgaaauucaaaugugucacuaaauuggaaggaaaaauaguacaguaugaaaacuuaaaguacucaguuaucguaacagugcacacaggagaccaacaccaaguagguaaugaguccacagaacaugguaccaccgcuacuauuacaccacaggcgccgacaaccgaaauucaauuaacagauuauggcgcccuaacacuugauuguaguccgcgaacaggauuagacuucaaugagauggucuugcuuacgaugaaagaaaaaucauggcuagugcauaagcaaugguuccuugacuugccccuaccauggacaucaggagcaaguaccagccaggaaacguggaacaggcaagauuuacugguaaccuucaaaacagcacaugcgaagaaacaagaaguuguaguuuuaggaucccaagagggagccaugcauacagcgcucacaggggcaacagagauacagacaaguggaacuacgacaauauuugcuggacaccuaaaaugucggcuuaaaauggacaaacuaacauuaaagggaaugagcuacguuauguguacaggaucauucaaacuugaaaaggaauuggcugaaacacaacauggcacggucuuaguccaaauuaaauacgaagggacagacgcgccuugcaaaauuccguucagcacccaggacgagaagggagucacccagaauggucgacuaauaacagcaaacccgauuguuaccgauaaagaaaaaccaguaaauauagaagcagaaccuccauuuggugaaagcuauauagucauaggcgcaggagagaaggcucuuaaauuaaguugguuuaagaaaggaucuucaauaggaaagauguuugaagcuacagcucgcggugcaagaagaauggcaauccucggagauacggcuugggacuuuggcucaaucgguggaguuuuuacaucaguggggaaacuuguacaccagauuuuugguacagcuuacggcguguuguucagcggcguaucuuggacaaugaaaauaggaauuggcguacugcuaaccugguuaggguuaaauucgagaagcacgagccuuucuaugacaugcauugccguagggcuagugacacuuuaucucgggguuauggugcaagcagacagugguuguguaauaaauuggaaagggcgggaacuaaaaugugguucaggaaucuuuguaacaaaugaaguccacaccuggacagaacaauacaaauuucaagcagacucucccaagcgucuaucugcagccauugguaaagcgugggaagaaggcguauguggaauacgcagugcuacuagguuagaaaauauaauguggaagcaaaucucgaaugaacuaaaucauauacucuuagaaaaugacaugaaauucaccguagucguuggcgaugucgcagggauucuggcucaggggaaaaagaugauucgaccccaaccaauggaauauaaauacucguggaaaucuuggggaaaggcuaaaauaaucggagcggacguucaaaauacaacauucaucauagauggaccaaacacuccugagugcccugacgaccaaagagcuuggaauauuugggaaguagaagacuacggcuucgguauauuuacaaccaacauuugguugaaauuaagagacagcuauacgcaggucugcgaucacagacuuaugagcgcagcaauuaaagauaguaaagcagugcaugcugauaugggcuauuggaucgagagcgagaaaaacgaaacguggaaacucgcucgugcauccuuuauagaagucaaaacaugcaucuggccaaaaucucauacacuauggaguaauggaguacucgaaagcgagaugaucauaccgaaaauauacgguggcccgaugagucaacauaauuauaggccagguuauuucacccaaaccgcgggaccauggcaucuagguaaauuagaacuagacuuugaucuaugcgaggggacaacugugguaguagacgaacacugcggaaacagggggccgucucuccgaacuacuacgguaacggggaaaauaauccacgagugguguuguagaaguuguacccuaccaccccuacguuuccggggagaagaugguuguugguaugguauggaaauuaggcccguaaaagagaaagaggaaaaucuaguaaaaucuaugguaagcgcagguucaggagaaguugauagcuuuuccuuagguuugcucuguauaucuauuaugaucgaagaaguuaugagaagcagauggucacgaaagauguuaaugacugggacguuagcuguauuuuuccuuuugauaaugggucaauuaacuuggaacgaucuaauacgauuauguauaaugguaggggcaaaugcgagugacaggaugggaauggguaccacauaucuagcucugauggcgacuuucaagaugaggccgauguuugcugugggauugcuguuucgacgauuaacuucgagagaagucuuacuauuaaccauuggacuaaguuuaguagcaucuguagaauuaccuaacucguuagaagaacuaggagauggacuagcaaugggaauaaugauacuaaaguuacucacugacuuccaaagccaucaacucugggcgacccuauugagccuuaccuuuauuaaaacaacguuuucucuacauuacgccuggaagacaauggccaugguauuaucaauaguaucacuauuuccacucuguuuaagcacaacgucgcagaaaacuacguggcucccaguucuuuuagguagcuuaggcuguaagcccuuaacaauguuucucauagcagaaaauaaaauaugggguaggcguucauggccgcuuaaugaaggcauaauggcaguaggaaucguaucgauacugcuuucaucucuacuaaagaaugacguuccauuagccgguccacucauagccgguggaaugcuaauagcaugcuaugugauaucaggaucgucagccgauuugucacuugaaaaagccgcagaaguaaguugggaagaagaggcagaacauaguggggcaagucacaacauccuaguagagguacaagaugauggcaccaugaaaauuaaggacgaagaaagagaugacacacuaacaauacuacugaaagccaccuuacucgcaguuuccggcguauauccguugucaauaccagccacacuauuugugugguauuuuuggcagaagaagaaacaaagauccggaguauuaugggacacgcccagcccaccagaaguggaaagggcuguucuggaugacggaauuuaccgaauaaugcaacggggguugcuagggagaucacaaguaggaguaggcguguuucaggaaaacguuuuccauacaauguggcacguaacacgaggugcaguucugauguaccaaggaaagagauuagagccaucaugggcaaguguaaagaaggaucuaauaucuuacggaggcggauggcguuugcaaggaagcuggaauacuggcgaggaaguucaaguaaucgccguggaaccaggcaaaaauccuaagaaugugcagacagcaccggggaccuucaaaacgccagaaggugaaguuggggccauagcucuggauuucaaaccaggaacgucgggauccccgauaguaaaucgggaagguaagaucgucggccuguaugguaauggggucguuacgacaucugggacguauguaucugccauugcacaggcgaaggcuucacaagaaggacccuuaccugaaauagaagaugaaguuuuccgaaaaagaaaucucacaauuauggaucuucauccaggguccggcaaaacuaggcguuauuugccagcaauugugcgugaagcaauaaaacgaaaacuucguacuuuaauuuuagcgccaacucgggugguagcuuccgaaauggcagaagcucuaaaagggaugccaauaagauaucaaacaacagcagucaaaagcgaacauacaggaaaagaaauaguugaccucaugugucaugcaacauucacuaugcgccuguuaucgccaguacguguaccaaacuacaacaugaucauuauggaugaagcucauuucacagaucccucuucuauagccgcacggggauauauaucaacccgaguugggaugggcgaagcagcagcaauauuuaugacagccacaccgccaggaucaguugaggcuuuuccccagagcaacgccgucauucaggacgaagaaagagauauaccugagagaucauggaauagugguuacgaauggauaacagacuuuccuggaaaaacugugugguucguaccgagcauuaagaguggcaacgauauagcaaacuguuuaaggaaaaaugggaagcgaguaauccaacuaucgagaaaaacuuucgacacagaauaucagaaaacgaaaaacaaugacugggauuacguagugacuacugauaucagcgagaugggugcuaauuuuagggcagaucgugugauagauccacgaagauguuuaaaacccguaauuuuaaaagaugggccagaacgcguuauacuggcagggccaaugccgguaacuguagcaucugcugcacaaaggagagggaggauugguagaaaccacaacaaagagggagaucaauacaucuacaugggccaaccucuaaacaaugacgaagaucacgcccacuggacagaagcgaagauguuacuugauaacauaaacacaccugaagguauaaucccagccuuauuugaaccggagcgcgaaaagucagccgcuauagauggcgaauacagguuaagaggagaggcucggaaaacauuuguugaauugaugagaagaggagauuugccuguuuggcuuagcuacaagguagcuagcgaaggcuuucaauacucugaccgccgcuggugcuuugauggggaacggaauaaccaaguacuggaagaaaauauggacguagagauauggacaaaagaaggggaaaggaagaaacuaaggccaagguggcuagaugcacgcacauauucugaccccuuagcacuucgagaguucaaagaauuugcagcuggaagacgcucaguuagcggugaccuaauacuagaaauaggaaaacuuccucaacauuuaacucaaagggcacagaaugcgcuagauaauuuagucauguuacacaacagugaacaagguggcagagcauaccgacaugcuauggaagaguugccugauacuauugaaaccuuaauguuguuggcauuaauagcugugcuaacugguggugucacccucuucuuuuuaucaggcagaggcuugggaaagacgucuauaggacuacucugugucauggcaaguuccguacucuuauggauggcaaguguugaaccacacuggauugcggcuuccaucauauuagaauuuuuccugaugguauuauuaauacccgaaccagauaggcaaaggacuccgcaagauaaccaacuggcguacguaguaauaggacucuuauucaugauucuaacaguggccgccaaugaaaugggauuguuagaaacuaccaagaaagaccuggggauaggucauguggccgucgaaaaucaucaucaugcagccauguuagauguagaccuccacccagccucagccuggacacuauaugcaguugcaacaaccauaauaacaccgaugaugaggcacacuaucgaaaacacaacagcuaacauaaguuugacugcaaucgccaaucaagcagcaauucucauggguuuagauaaaggauggccuauaucgaaaauggauauuggaguaccguuacuagcccucgguugcuacucacaagugaauccacuaacacugacagccgcugugcucaugcugguggcacacuaugcuauaauugggccaggauugcaggcaaaggcaacaagggaggcacaaaagagaacugcggcaggaaucaugaaaaauccgacuguagacggcauuguugcaauagacuuggauccuguaguuuaugaugcgaaauuugaaaaacaacuaggacaaauaaugcuauuaaucuuaugcacuucucaaauucuuuuaaugagaacaacaugggcauuaugugagaguauaacacuugcuaccggaccucuuacaacgcuaugggaagguuccccaggaaaauucuggaacacuacaauagcggugucaauggcuaauauauuucggggcucauaucucgcuggagcaggacuagcauuuaguuuaaugaaaucucuuggaggaggcagaagaggcacaggggcacaaggugaaacuuugggugaaaaguggaaacgacaguuaaaucaacucucaaaaagugaauuuaacacuuacaaacguucgggaauuauggagguagacagaagcgaagcaaaagagggucuaaaacguggcgaaaccacaaaacaugcgguaaguagaggcacagcaaaauuaagaugguucguagagagaaacuugguaaaaccagagggaaaaguaauagaucuuggauguggaaggggaggauggucauacuauugcgccggacugaaaaagguaaccgaagugaaaggauauacuaaagguggaccaggccaugaagaaccuauaccaauggcgacuuauggauggaacuugguaaaauugcauaguggaaaggauguguucuucauaccaccggagaaaugcgauacacuuuugugcgacauuggcgaaaguucaccuaacccgacgauugaggaagguagaacauuacgcgucuugaaaauggucgaaccaugguuacgagggaaccaauucugcauaaaaaucuuaaauccguacaugccgagcguagucgaaacucucgaacaaaugcaacggaaacaugguggaaugcuaguaagaaaucccuuaaguagaaacagcacacaugagauguacuggguuucauguggaacggggaacaucgugagugcagucaauaugaccagucgcaugcucuuaaauagauucacuauggcucaucggaagccgaccuaugagagagaugucgauuuaggugccgguacucgacacguagcagucgaaccugagguagcaaaccuugauauaauaggacaaagaauagagaauauuaagcaugaacacaaaucaacuuggcauuaugaugaggacaauccuuauaaaacaugggcauaucacggaaguuaugagguaaagccguccggaagugcaagcuccauggugaacggaguagucaaacuucuaacuaaaccgugggacguaauaccuauggugacucagauugcaaugacagacacuacaccuuucggacaacagagagucuucaaagaaaagguugauacaaggacgccaaaagccaagaggggcacugcgcaaauuauggaagucacagccaaauggcuuuggggauuucucagcagaaacaagaaaccgcgcauaugcaccagggaagaauuuacucgaaaaguacgaucuaaugcagcuauaggugccguauucguugaugaaaaucaauggaauagugcaaaagaggcaguagaagaugaacgguucugggauuuaguacauagggaaagagaauugcacaaacaggguaaaugugcuacaugcguguauaacaugauggggaaaagagagaagaaacugggugaauuuggaaaagcgaaaggaucacgagcgauuugguacauguggcuaggggcgagguucuuggaauuugaagcccuuggguuuaugaacgaagaucauugguucagucgagaaaacucacugucagggguggagggcgaagggcuucacaaauuaggauacauauuacgcgauaucaguaaaauaccuggaggaaauauguaugcggacgauacagcaggaugggauacacgaauuacugaagacgaccugcaaaaugaggcacgaauaacggauauaauggaaccagaacaugcuuuauuagcaaagucaaucuuuaaguugaccuaccagaauaaagugguccgaguacaacgcccagcaaagaacgguacggucauggacguuauaucacgcagagaccaaagagguaguggccaaguuggaacuuacggacuaaauacguucacaaauauggaagcucaauugauaagacaaauggaaucugaggggauauucucgccaagugaguuggaaacaccaaauuuggcaaaacgaguacuagacuggcuagaaaaauauggcguugaaagauuaaaacggauggcaauuucaggcgacgacuguguagucaagcccaucgacgauagauuugcuacagcacuaacugcccucaaugauaugggcaaagucagaaaggacauaccacaaugggagccaaguaaagguuggaacgauuggcaacagguaccguuuugcagucaucacuuucaucagcucaucaugaaggaugggagagaaauaguuguacccuguaggaaucaggaugaacuugugggcagagcaagaguuucacaaggagcugguuggaguuuacgagaaacagcuugucuggguaagaguuaugcucagauguggcaacucauguauuuccacaggagagaucuacgauuggcagcaaacgcuauauguuccgcaguaccuguggauuggauaccaacuagccgaacgacuuggaguauacaugcucaucaccaauggaugaccacugaagauauguuguccgucuggaaucggguauggauugaggaaaauccuuggauggaagauaaaacccauaucaguaguuggggagacguucccuaccuggguaaacgugaagaccaauggugugggucauuaaucggucuaacagcaagagcuacaugggcaacaaauauacaaguugcaauaaaccaaguccgaagacuuauaggcaacgaaaauuauuuagauuacaugacaucuaugaaacgauuuaaaaaugaguccgauccugagggagccuuaugguga

SEQ ID NO: 21950 - RNA, 9879 nt, Artificial Sequence
  derived and/or modified CDS sequence (opt6) from DENV-1__EU482513__SS-prME
ucaguuacaaugcuacuaauguuaaugccaacagcgcuagccuuucaucuaacuacacgugguggagaaccccauaugauuguuucgaaacaagaaagagguaaaucauugcuauuuaaaacaucggccggagugaacaugugcacauuaauugcaauggaccuaggugaauuaugcgaagauaccaugacguacaaauguccuaggauuacggaaacggaaccugaugauguugauugcugguguaaugcgacugauacguggguaacauaugguacauguucgcaaacuggagaacaucggagagacaaaaggucaguugccuuagcgccccauguuggauuaggccuugaaacuagaacugaaacauggaugagcucugaaggggcauggaaacaaauacagcgcguugaaacaugggcauugagacacccgggcuucacaguaauugcucuuuuucucgcgcaugcgauugguacaagcauuacucaaaaaggaauuauuuuuauauuacuaaugcuaguaacgccgucaauggcuaugcgauguguaggcauugguucaagggauuucgucgaaggccuaaguggagcuacauggguggaugugguccuagaacauggaucauguguaacgacaauggcaaaagacaaaccaacacuagauauagaacuucuuaaaacggagguaacgaauccagcuguacugcgaaaacugugcauagaagcaaaaauuucaaacacgacuaccgauucucgauguccaacucaaggagaagcaacucuaguagaagaacaagaugcgaauuucguauguagaagaacguucguagauagagguugggggaauggguguggucuauucggaaaaggaucuuugauuacgugugcaaaauuuaaaugcgugacaaaacuagaaggaaaaauuguacaauaugaaaaccuaaaauacucaguuauaguaacagugcacacaggagaucaacaucaaguugguaaugaauccacagaacacggcacaacagcaacaauuacaccacaagcucccaccacggaaauucaauuaaccgauuauggggcauuaacucuugauugcucaccacgaaccggacucgauuuuaaugaaaugguacuguuaacaaugaaagagaaaaguuggcuaguccauaaacaaugguucuuagaucuaccguuaccuuggacuucgggggcgucaacaagucaagaaacauggaaccggcaagaucuccuuguaacuuucaaaacagcccaugcgaagaaacaagaagugguuguuuuaggaucgcaggaaggugcaaugcacacugcuuuaacaggugccacugaaauacaaacgucaggcacuacaacaauauuugcaggucacuuaaagugcagauuaaaaauggacaaacuuacuuuaaaaggaaugucauaugugauguguacuggaaguuuuaaacuugaaaaagaauuggcugaaacucaacaugggacaguacuugugcaaauaaaguaugaaggcacagaugcaccgugcaagauuccauucucaacacaggaugaaaaggguguuacgcaaaaugguagguugauuaccgcaaacccuauugugacagacaaagaaaaacccgucaacauugaagcugaaccuccguucggagagucuuauauuguaaucggcgcgggcgaaaaagcacucaaacuuucgugguucaagaagggaucaaguaucgggaaaauguucgaagcaacagccagaggagcccguaggauggccauuuuaggagacaccgcaugggauuuuggaagcauugguggaguauucacaaguguaggaaagcuaguacaccaaauuuuuggaacggcguauggaguuuuauucucuggagucuccuggacgaugaaaauaggaaucgguguguuacuuacgugguugggcuuaaauucacgauccacaaguuuauccaugacaugcauugccgucggccuagugacacuguacuugggaguuaugguacaagcggauucaggauguguaaucaacuggaaagguagggaauuaaaguguggaaguggaauauuuguaaccaacgaaguucacacauggacagaacaauauaaguuccaagcagauucaccaaaaagacuaucugccgcaaucggcaaagcgugggaagagggaguaugcgggauucggucagcuacuaggcuggagaacauaauguggaaacaaauaaguaaugaauuaaaccacauuuuacuggagaacgauaugaaauuuacagugguggugggcgauguggcagguauacuagcgcagggaaagaaaaugauucgcccacaaccaauggaauauaaguacucauggaaaucaugggguaaagcaaaaauaauuggagcugauguacagaauacuacauucauuauagaugguccaaacacuccagaauguccagacgaucagcgcgcuuggaauauaugggaaguagaggauuacgguuucgguauuuucacaaccaacauuuggcugaaacuacgagauucauacacacagguaugcgaccaucgucuaaugucugccgcaauaaaggauucaaaagcaguccaugcggacaugggauauuggauagaaucugagaaaaaugaaacuuggaaauuagcuagagcaaguuuuauugaaguuaaaacguguauuuggccuaaaagucauacauuaugguccaauggaguuuuagagagugagaugauaaucccaaagauauauggggguccgauaucccaacauaacuaucgaccuggauacuucacucaaacagcgggcccguggcauuuagguaaauuagaacucgauuuugaucuaugugaagguacgacaguaguagucgacgaacauugcgguaaucgagguccaucguuaagaacgaccaccguaacgggcaagauaauacaugaaugguguugucguucguguacacugccaccccugagguucagaggugaagaugguugcugguauggaauggagauuaggccugucaaagaaaaagaagaaaaccuagugaaaucuaugguuagugcagguagcggagagguagauucguucucucuaggcuuauuguguauuagcauuaugaucgaagaagugaugagaucgagauggucucgaaaaauguuaaugacggggaccuuagcaguauucuuuuuacucauaaugggccaacuaacauggaaugauuuaauacgccuauguaucaugguaggagcaaaugccagugacagaauggggauggguacuacauaccucgcccuaauggcaacuuucaaaaugagaccuauguuugcuguaggguuacuauucaggagacuuacaucaagagaaguccuucucuuaacaauuggacuaucauuaguagcaagcguggagcuaccaaauucauuagaggaacuuggagauggauuagcgaugggcauaaugauucucaaauuacuuacugacuuccaaucacaucaacuaugggccacacuacuuucacuuacauuuauaaagacuacuuuuucacugcauuacgcauggaagacgauggcaaugguucuuaguauuguaucguuauucccauuaugucucagcacuacgucacagaaaacgaccugguugccuguacuacuaggauccuuggggugcaaaccacugacuauguuucucauagcagaaaauaaaauuugggguagacgaucguggcccuuaaacgagggaaucauggcaguuggaauaguaucaauucucuugucaucucuacucaaaaaugacguaccauuagcaggcccucuuauugcagggggcauguuaaucgccugcuauguaaucucaggaucuagugccgauuuaucauuggaaaaagcagcagagguaagcugggaggaagaagcugaacacucaggugcaucacauaacauucucguagaagugcaagaugacggaacaaugaaaaucaaagaugaagaacgugaugacacacucaccauucuacuuaaagcaacgcuguuagcuguaucuggaguauaucccuuaaguauacccgcaacgcuauuuguaugguacuuuuggcagaagaagaaacaaagaucgggaguuuuaugggacaccccuagcccaccugaggucgagagagccguccucgacgauggcauauauaggauaaugcaacgcggguuguugggccguagccaagucgggguaggaguauuccaagaaaauguuuuucauaccauguggcauguuacaagaggagcaguacuaauguaucaaggcaagcguuuagaaccaucgugggccagcguuaagaaagaccugauuucuuacggugguggauggagauuacaagguucauggaauacaggugaagaaguucagguuauagcaguagaaccgggcaaaaauccaaagaacguacaaaccgccccgggcaccuuuaagacaccagaaggagaaguaggugcaauugcauuagacuucaaacccgguacaaguggaagcccaauaguaaaucgcgaaggaaaaauaguggggcuauaugguaauggaguaguaacgacaagcggaaccuauguuagugcuauugcacaagcuaaagcaagucaagaaggaccacucccagaaauugaagaugaaguauuuagaaagaggaaccuaacuauuauggauuugcaccccgggucgggaaagacaagaagauaucucccagcgauaguccgugaagccauuaaacgcaaauugagaaccuugauacuggcuccaacuagaguaguagcuuccgagauggcagaggcucugaaagguaugcccauaagguaccaaacuacugcugugaaaucagagcauacaggcaaggaaauagucgacuugaugugucaugcuacauucacaaugagacuauuaucaccgguuagaguuccuaauuauaauaugauuauuauggacgaagcccacuuuacugauccaaguaguauugccgcacggggauacaucucgacaagaguaggcaugggggaagcugccgcaauuuucaugacagcaacaccuccaggcucuguagaagcauuuccacagucuaacgcgguaauacaagaugaagaacgggauauuccugaacgaagcuggaauaguggcuaugaguggauaaccgauuuccccggaaaaacaguuugguucgucccaagcauaaaaagcgggaaugauauugcuaacugccugagaaagaauggaaaacgaguaauucaauuaucaagaaaaacguuugauacagaauaucagaaaacgaaaaauaaugacugggauuacguagugacaacagacauuucagagaugggugcaaacuuucgagcagauagaguuauagacccaagaagaugucuaaaaccaguuauucuaaaggacggacccgaaagggugauccuagccggaccuaugccaguaacgguugcaagcgcugcacagcgucgcggacgaauugguagaaaucauaauaaagaaggggaucaauauauauauaugggacaaccuuuaaacaacgaugaggaccacgcacauuggaccgaagcgaaaaugcuacucgauaacauaaacacccccgaaggaauuauuccugcgcuguucgaaccugagagggagaaaagugcagcaauagauggggaauaccgacugaggggugaagcaagaaaaacguuuguugaacuaaugagaagaggagauuuaccaguauggcuuucauauaagguggcgucagaggguuuccaauacagcgauagacgauggugcuuugauggagaaagaaacaaccaaguacuagaagaaaacauggauguagaaaucuggaccaaagaaggagagagaaagaaauuaaggccgagauggcuugaugcacguacauauagcgauccgcuugcuuuaagggaguucaaggaauuugcugccgggagacggucagugaguggugaccugauauuagagauuggaaaguugccucagcaucuaacacagagagcacaaaaugcacuagacaaccuaguuaugcuccacaacuccgaacagggcgggagggcguauagacacgcuauggaagaauuaccagauacaauugaaacauuaauguuauuagcucuuauugcagucuuaacgggaggcguuacgcuauucuuucuaucgggccguggacuggguaaaacgucgaucggauuacugugugugauggcuucuucagugcuacuguggauggcgaguguugagccacauuggauagcggcuagcauaauauuagaauuuuuccuaaugguauuacuaauuccugagccagaccgccaaagaacuccccaggauaaucaacucgcauauguugugauagguuuauuauuuaugaucuuaacuguggccgcaaaugaaauggguuuacuagaaaccacuaagaaagaccuagggauagggcacguagcaguagaaaaccaccaucaugcagccauguuagacguagauuuacauccugccagugcauggaccuuguacgcuguagccacaacaauuauaacacccaugaugaggcauacaauugaaaacacaacggcuaacauaucacuaacagcaauagcuaaucaagccgcuauccugaugggacuagacaaaggauggccgaucuccaagauggauauaggaguaccuuuacuagcuuuaggcugcuacucacaagugaauccgcugacauugacagcagcaguucucauguuaguugcucacuacgcaauuauuggaccuggccuacaagcaaaggcaacaagagaagcucaaaaacgaacagcggcggguauuaugaagaacccuacagucgauggcaucguagcuauugacuuagaccccgugguuuacgaugccaaauuugaaaaacaacuaggacaaaucaugcuucucauacuauguacuucacaaauacuacuaaugcgaacgacaugggcgcugugcgaaucaauuacauuagcaacggguccauuaacaacauuaugggaagguucaccggguaaauuuuggaauaccacaaucgcaguguccauggcuaacauauucaggggaagcuaucuagccggugcaggacuggcuuucagucucaugaaaucuuugggaggaggucgccgugguacaggcgcucaaggggaaacacugggcgagaaauggaagcgacagcuaaaccaauugucaaaauccgaguuuaauacauauaaaagaagcgguauuauggaaguugaucgaagugaagccaaagagggucuuaagcgaggagaaacaacgaaacacgcgguaucacgcgguacggcaaaauuaagaugguuuguugaaaggaaucuaguuaaaccggaagggaaggucauugauuuggguugcgguagaggcggauggaguuauuauugugcugggcuuaaaaaggucacagagguaaaaggguauacaaaagguggacccggacacgaggagccgaucccgauggccacauauggauggaaucuuguaaaauuacauucaggaaaagauguauucuuuauaccucccgaaaaaugcgacacuuuacucugugauauaggugagucuucaccaaacccuacuauugaggaaggacguacgcuuaggguacuaaagauggucgaaccaugguuacgugguaaucaguuuuguauuaaaauuuuaaauccauacaugccaucggucguagagacgcuugaacaaaugcaacguaaacacggagggaugcuaguucggaacccacuuucgagaaacucuacucaugaaauguacuggguaucgugcggcaccggaaacauaguaagugcagugaacaugacgucacgaaugcugcucaauagauuuacgauggcacacaggaagccaacguacgaacgggauguagacuuaggcgcagguacaaggcauguagcuguugaacccgagguagcaaauuuagacauuauuggucagagaauagaaaauauaaagcacgaacauaaaucaaccuggcacuacgacgaggauaacccuuacaagacuugggcauaucaugggucguaugaaguaaaaccaagcgguagcgcgucuagcaugguaaacggaguaguuaaacuacuaacuaaaccuugggauguuauaccgauggugacucaaauugcgaugacagacacaacaccauucggucaacagcgaguauucaaggaaaaaguagauacaagaacuccaaaagcuaaaaggggcaccgcacagauaauggagguuacugcgaaaugguuauggggauuucuaucgagaaacaaaaagccccgaaucuguacgagagaagaauuuacaaggaaaguuaggucaaacgccgcaauaggugcuguauucguagaugagaaccaauggaacucugcgaaagaagcuguugaagacgaacgauucugggauuuagugcauagagaaagagaacugcauaaacaaggaaagugugcuacauguguauacaacaugaugggcaaaagagagaagaaauugggugaauuuggaaaagcaaaagguaguagggcuaucugguauauguggcuaggggccagguuuuuagaauuugaagcgcuaggguucaugaacgaggaccauugguuuucucgugaaaacucuuuauccggaguagaaggggaaggguuacauaaauuaggauauauccucagagauauaucaaaaauccccggugguaacauguaugcagacgauacggcgggaugggacacccguauuacggaggaugaccuacaaaaugaagcaagaauaaccgacauaauggagccugagcaugcauuauuagcgaagucaaucuucaaguugacuuaccaaaacaaaguaguaagaguacaacgcccagcuaaaaaugggaccguaauggacgugaucucacggagagaccagagggguucgggacaggugggaacuuauggucuuaauacauuuacaaauauggaagcacaguuaauaagacaaauggaaagugagggaaucuucucaccgucugaacuagaaaccccgaauuuagcggagagaguacucgauuggcuagaaaaauauggugucgaacgguugaagagaauggcgauuucaggugacgacugugucguuaaaccaauagaugauagauucgcaacggcgcuaaccgccuugaacgauaugggaaaaguucgaaaggauauuccacaaugggagccgucuaagggguggaaugacuggcaacagguuccauucuguucgcaccauuuccaccaauuaauuaugaaggaugggcgcgagaucguuguuccgugcagaaaccaagaugaauuagucggcagagcacguguaucacaaggagcgggcuggagucucagagaaacagcauguuuagguaaaagcuacgcgcaaauguggcaauuaauguauuuucaucgaagggaucuucgacuggcggcaaacgccaucuguuccgcugugccuguggacuggauuccaacaaguagaacaacguggaguauccaugcgcaucaccaauggaugaccacugaagacauguugaguguuuggaacagaguauggauagaggaaaauccguggauggaggauaaaacacacauaucgucguggggugauguucccuauuugggcaaacgagaagaucaauggugcgggagccucaucggacugacagcccgggcaacgugggcuaccaauauacaaguagcaauaaaccaaguaagacgccuaauuggaaaugaaaacuaucucgauuauaugacaucaaugaaaagguuuaaaaaugagucugauccagagggcgcccuuugguaa

SEQ ID NO: 21951 - RNA, 9879 nt, Artificial Sequence
  derived and/or modified CDS sequence (opt6) from DENV-1__EU482515__SS-prME
ucugucacaacucuguugaugcuuaugccaacagcauuggcauuccaccucacaacgcggggaggggaaccacacaugauaguuuccaaacaagaacgcgggaaaucgcuucuauucaagacuucagccgguguaaauaugugcacuuugaucgcaauggaucuaggggaacugugcgaagacacgaugacuuauaaauguccgagaauaaccgaaacggagccagacgauguggacugcugguguaaugcuaccgacacauggguaacuuacgggacguguucacaaacgggugaacauagaagagauaaaagaucuguugcgcuagcaccucacgucggauuaggucuagagaccagaacggaaacauggaugaguucagagggagcauggaaacaaauucaaagagucgagacgugggcauuaagacauccuggguucacgguuauagcauuguuccuugcucaugcuauagggacaagcauaacacaaaaagguauaauuuucauacuauugaugcuaguaacaccaucaauggcaaugagauguguaggaauaggauccagagauuucgucgaaggacuuaguggcgccacuuggguugauguuguacuagaacauggaucuuguguaacaacgauggcgaaggacaaacccacauuagauauagagcuauuaaaaaccgaagugacuaauccugcuguauuaagaaaauuaugcauugaagcuaagauuucuaacaccacgacagauucuaggugcccaacucaaggcgaagcgacacugguugaagaacaagaugccaauuuugugugcagacggacauucguugaccgagguugggguaaugggugcggacuuuuuggcaaaggaucacuaauaacuugugcaaaguucaaauguguaacgaaacucgaaggcaaaauaguucaauaugaaaauuuaaaauacuccgucaucguaacaguacauacaggugaccagcaucaaguugguaaugaaucuaccgaacauggaaccacagcaaccauuaccccacaggccccuacuacggaaauacaacugacagauuauggugcacuaacccuagacuguucuccgcgaacgggacuugauuuuaaugagaugguauuauuaacaaugaaagagaaaaguuggcuaguacauaaacagugguuuuuagacuuaccgcugccauggacuucaggggccucaacaucucaagaaacguggaaucgucaagaccuccuaguuacuuucaaaaccgcccacgccaagaaacaggaaguuguaguacucggaucccaagaaggugccaugcauacggcucuaacaggcgccacagagauucaaacaucugguacuacaacgauuuuugcaggacaucucaaguguagacucaaaauggacaaacucacgcuaaaggggaugucuuauguaauguguacagguuccuuuaaacuugaaaaggaguuagcagaaacccaacaugguacaguccugguucaaauuaaauaugaaggaacggaugcaccauguaaaaucccauucucaacucaagacgagaaaggaguaacacaaaaugggagauugauaacagccaacccuauuguaaccgauaaagagaagccgguaaacauugaagcugaaccuccauuuggagaguccuauauagugauaggggcaggagaaaaggcacucaagcucucuugguucaaaaagggauccucgauuggaaagauguucgaagcuacagcuagaggagccagacguauggcuauccuaggcgacacagcuugggacuuugguaguauuggaggaguauuuaccuccgucggaaaguugguacaucagaucuuugggacagccuaugggguauuauucucagguguaucauggacaaugaaaauaggaauagguguacugcuaacuuggcuugguuuaaauaguagauccacuucacuuucaaugacuugcauagcagucggccugguaacccuauaccucgggguaaugguucaagcagauuccgguuguguuauaaauuggaaaggacgagaacuaaaaugugggucagggaucuucguuacaaaugagguacacacguggacggaacaauauaaguuucaagcggacucccccaaaagacuaucggcggcaauugggaaggcuugggaggaaggaguaugcgggaucagaucugcaacaagguuggaaaacaucauguggaaacaaauuucuaacgaauuaaaucauauuuuacuugaaaaugauaugaaguuuacugugguugugggagacguugcagggauucuagcucaggggaagaaaaugauacguccacaaccuauggaguacaaauauaguuggaaguccuggggaaaagcaaagaucaucggagcugacguccagaauacaacauucauaauagacggaccaaacacuccagagugucccgaugaccaaagggcauggaacauaugggaggucgaggacuacgguuucggaaucuuuacuacaaauauauggcuaaaacuuagagauaguuauacacaggucugugaucauaggcuuaugagugcagcaauaaaagacuccaaagcuguccacgcagacaugggauacuggauugagucagaaaagaacgaaacguggaaauuggcccgggccucauucauugaagucaaaaccuguaucuggccuaaaucccacacuuuauggaguaauggaguucuugagagcgaaaugaucauaccgaaaauauauggagguccgaugagucaacauaauuacagaccagguuauuuuacacagacugcagguccauggcaucucggaaaguuagaauuagauuuugaucuaugcgaaggaaccacgguaguaguggaugaacacuguggaaacagggggccaagccuacggacaacuacuguuacggggaaaauaauacaugaaugguguuguagaucuuguacgcucccaccauugcguuuucggggagaggauggaugcugguauggaauggaaauccgcccaguuaaggagaaagaggagaaccuuguuaaauccauggucagcgcugguaguggggaaguugacucauuuagccugggacugcucuguauuucaauaaugaucgaggaggucaugcgcagucgcuggucgaaaaagaugcucaugacugggacucuagcuguguucuucuuacugauuaugggccaacuuacauggaaugauuuaauacgauuauguauuaugguaggggcaaaugcaucugauagaaugggaaugggaacuacauauuuggcguuaauggcaacauuuaaaaugcgaccaauguuugcaguaggauuguuguucagacgacugacaucacgcgaaguucuguugcuaacaauuggccucucucugguugcaucaguggagcuuccgaacucccuugaagaguugggugacggacucgcuauggguauaaugauucuuaaauuauuaacagauuuucaaagccaucaauuaugggcuacuuuacuuagccugacauucauuaagacaacuuuuagucuucacuacgcauggaaaacuauggcgauggugcuaucaauaguuagcuuauucccauuaugccucucaacaacgagucagaaaaccacauggcucccuguuuuauugggaagccuuggauguaaaccuuuaacaauguuccugauagcagagaauaaaauuuggggacguaggucauggcccuuaaaugagggaauaauggcggugggcauaguguccauauuacuauccuccuuacugaaaaaugacguaccuuuagccggcccauugaucgcgggagggaugcucauugcuuguuauguuauuucgggaaguagugcagacuugagucuugaaaaagccgcagagguauccugggaagaagaagcugaacauaguggggccucucauaauauauuaguugaaguucaagaugacggcaccaugaaaauaaaagacgaggaaagagaugauacguuaacgauacuacuaaaggcgacguuauuggcagucucagguguuuacccauuaucuauuccugccacauuauucguaugguauuuuuggcaaaagaaaaagcaacgaucaggaguauuaugggauacaccauccccaccugaaguggaaagagcgguacuagacgauggcauauauagaaucaugcaacgcggcuuacucgggagaagccagguaggaguaggaguguuucaagaaaacguguuucacacuauguggcauguaacaagaggugcuguacuuauguaucaaggaaaaagacuagaaccuagcugggcaagcgucaaaaaggacuuaauuucuuacggaggggguuggagacuacagggaucauggaauaccggggaggaaguucagguuaucgcuguggaacccgguaagaaucccaaaaauguucaaacagcuccaggcacguucaaaaccccggagggugagguaggagcaauugcuuuagacuuuaagccgggcacuucuggaucuccaaucgugaaucgggaaggaaaaauuguaggacuauaugggaauggaguagucacuaccagcgggacauauguaucagccauagcucaagcgaaagcaagccaagaaggccccuugccagaaauagaagaugagguuuuuagaaaaagaaaucucacaaucauggaucuacauccaggaucagguaaaacuagacgauauuuaccagcaauagugcgugaagcgauuaagagaaaacuaagaacauuaauucuugcaccgacaaggguaguggcuagcgagauggcagaagcacugaaaggcaugccuauccguuaucaaacgacugcuguuaaaagcgagcacacugggaaagaaaucguagaucuuaugugccacgccaccuucacaaugagauuguuaucaccagugcgugucccaaacuauaacaugauuauaauggacgaagcccauuucacagaccccuccuccaucgcggcaagaggauauauuucgaccagaguagguaugggugaagcugccgcuaucuuuaugacagcgacacccccugguucaguagaagcguucccacagucuaaugcggugauacaagaugaagaaagagauauucccgagaggagcuggaauagcgguuacgaguggaucacagauuuccccgggaaaacagucugguuuguaccuucaauuaaaucggguaaugacauagcgaauugcuuaaggaaaaaugggaagcgcgugauacaguuaucucgcaaaaccuucgauacagaauaccagaaaacuaaaaauaaugacugggacuauguuguaacaaccgacauuagugaaaugggagcuaauuuucgggccgacagggucaucgacccccgaaggugccuaaagcccguaauacucaaggacggcccagaaagggucauauuagcgggaccaaugcccgugacaguagcaucugcugcucaaagacgagguaggauaggaaggaaucauaauaaagaaggagaucaauauauuuauaugggacaacccuugaauaaugaugaggaccaugcucacuggaccgaggcaaaaaugcucuuagauaacauaaauacaccugaaggaauaauccccgcccuauucgagcccgaaagagaaaaaucagcagcuauugacggugaguaucgauugagaggagaagcuagaaagaccuuuguagaacuaaugagaaggggagaucugccaguauggcugaguuacaagguugcaagcgagggcuuccaauauuccgaucggcguugguguuuugacggggaacgaaacaaccaaguuuuagaagaaaauauggacguugaaauuuggacaaaagagggagaaaggaagaaacuucgaccacgcuggcuagaugcaaggaccuauuccgauccacuugcgcuaagagaauuuaaggaauuugcugcaggacgaaggucgguaagcggcgaccuaauucuagaaauuggaaaguuaccacaacacuugacccaaagagcucaaaacgcucuggacaaccuuguuaugcuucacaacucagaacaagguggacgugcguaucgacaugccauggaagaacuaccggauacuauagaaacacuaauguuauuagcucuuauagccguacuaacaggaggaguaacgcuauucuuuuuaaguggaaggggacucgguaaaaccagcaucggauugcuaugcguaauggcgagcaguguacuauuauggauggcuuccgucgaaccacacuggauagcagcaagcauuauacuggaauuuuuccucaugguauuauuaauacccgagccagaccgucaacgaaccccucaagauaaucaacuagccuaugugguuauuggcuugcuauuuaugauucuaacaguugcugcuaaugaaaugggacuccuggaaacuacaaagaaagaucuaggcauuggccacguagcaguggaaaaccaucaccaugcugcaauguuagaugucgacuuacacccugccucagcauggacauuauacgcaguagcuacaacaauuauaacaccuaugaugaggcacaccauagagaacacgacugccaauauaagucucacagcaauagcgaaccaagcagcgauacuuaugggacuggacaagggguggccaauauccaagauggauaucggagucccauuacuggcuuuggggugcuauagucaaguaaauccgcuaacguuaacagcugcaguucuuauguuaguugcccauuaugcaauuauuggaccaggacuacaagccaaagcaacuagagaggcucaaaagaggaccgcggccggaauuaugaaaaacccuaccgucgacgguauuguugccauagaucuagacccuguagucuacgacgccaaauuugaaaaacaacuaggccaaauuauguuacugaucuuauguacaucacaaauccuacugaugcgaacgacuugggcucuuugugaaagcauaacgcuggcgacaggaccgcuaacaacucuuugggaagguucgcccgggaaauuuuggaacacaacgauugcgguguccauggccaauauuuuucguggaucuuaccuagcuggagcaggucuagcuuucuccuuaaugaagagucuagguggugggaggcgagguacaggagcucaaggggagacacugggugaaaaauggaaacgucaacuuaaccaacuuucaaagagcgaauuuaauacauauaaaagaucaggaauaauggagguugaccguuccgaagcgaaagaaggccugaaaaggggagaaacgacgaaacaugcaguaaguagaggaacugcuaaguuaagaugguucguagagagaaacuuagucaaaccugaaggcaaaguuauugaucugggcugcggaagaggugguuggucuuacuacugcgcggguuuaaagaaaguaacggaagugaaaggauacacaaaaggaggcccaggccacgaagaaccaauuccaauggcaacguauggauggaauuuagucaaacuacacucgggcaaggauguuuucuuuauuccuccggaaaaaugugauacauuacuuugcgauauuggugaaucgucgccaaacccaacaauagaagaaggcagaacccuaagaguacucaaaaugguugaaccuugguugagagguaaucaguucuguauaaagauacuaaauccguacaugcccagcguugucgaaacauuagagcaaaugcaaaggaaacauggagguaugcuuguuagaaacccauugucccggaauaguacgcacgaaauguauuggguaaguugcgggaccggaaauaucguaagugcgguuaacaugaccucaaggauguugcuaaauagauuuacaauggcacacagaaagccaacuuacgaacgagauguagacuuaggggcaggaaccagacaugucgcaguugaaccggaaguggcaaaucuugauaucauuggacaacgcauagaaaauauuaagcacgaacauaagaguacuuggcauuaugaugaagacaauccuuauaaaacgugggcauaucauggaaguuacgaggucaaaccauccggaagcgcgaguucaaugguaaacgguguagugaaacuucuaaccaaacccugggaugugaucccuauggugacacagauagccaugacagauacuacuccauuuggacaacagaggguauucaaggagaaaguugacacccgaacaccaaaagcuaagcgaggaaccgcucaaauaauggaaguaacugcaaaaugguuauggggcuucuuaagccgaaauaagaagcccaggauauguacacgugaagaguucacuagaaaaguacgaaguaaugcagcaauaggugcaguauucguagacgaaaaucaguggaacucagcuaaagaagcgguggaagacgaacgauucugggacuuaguucauagagaaagagaacuacacaaacaaggaaagugcgcaacuugugucuacaauaugaugggaaaacgagagaagaaacugggggaguucgguaaggcaaaaggaucuagagcaauaugguauauguggcuuggagcacgauuuuuagaguuugaggcacucgguuuuaugaaugaagaccauugguuuagccgugagaacucguuaucuggaguugagggugaaggacuacacaaauuaggauauauacuacgcgauauaagcaaaaucccuggaggaaacauguaugcggaugauacagccgggugggauacaaggauuacugaagacgaucuccaaaaugaggcaaggauaacagauaucauggaaccagaacacgcucuacuugcaaaaaguauuuuuaaauuaacuuaucagaauaaaguaguuagaguacagcgcccggccaaaaacggaacuguaauggauguaaucucgcgccgggaucagagagggucgggacaaguuggaacguacggauuaaauacauucacaaauauggaagcccaacucauuagacaaauggaaagcgaggguauauuuucgcccagugaguuagagacacccaaccuagcuaaacguguauuagacuggcuggagaaauauggcguagagagauugaaacgcauggccauuuccggggaugauugugugguuaaacccauagaugaucgauuugcaacagcauugaccgcguuaaacgacaugggaaaaguucgcaaagauauaccgcagugggaaccuagcaaaggauggaaugauuggcaacagguaccauucugcucucaucauuuucaccaacuaauuaugaaagacggacgagaaauuguggugccuugucgaaaccaagaugaauuaguaggacgcgcuagaguaagccaaggggcaggauggagccuucgcgaaacagcuugucugggcaaaucauaugcgcaaauguggcagcuaauguauuuucauagaagagauuuacgacuggcggcaaacgcuaucugcucugccguacccguugauuggauaccaacgagcagaacaacuuggagcauucaugcacaccaccaguggaugacaacagaagacauguuauccguuuggaacagaguauggauagaagaaaaccccuggauggaagacaaaacgcauauaucuagcuggggagacgucccguaucuaggaaaacgagaagaucaaugguguggcucauuaauagggcuuacagcucgcgccacaugggcaacaaacauucaaguagccauuaaucaagugaggagacuuaucggcaaugagaacuaucuagauuauaugacuagcaugaaacgauucaaaaaugaaucugaccccgaaggugcauugugguaa

SEQ ID NO: 21952 - RNA, 9879 nt, Artificial Sequence
  derived and/or modified CDS sequence (opt6) from DENV-1__EU482516__SS-prME
ucgguaaccauguuacuaauguuaaugccaacagcacuagcauuucaccuaaccacuagaggaggagaaccgcauaugauugugaguaaacaagaaagaggcaaaagccuauuauuuaaaacaagcgccgguguaaauaugugcaccuuaauagcuauggaucucggggaauuaugugaagacacuaugacuuauaaauguccucgaauaacagaaacugaacccgaugacguagacugcuggugcaaugcaacagacacguggguuacuuauggcaccuguucucaaacaggugaacaccgaagagacaaacgaagcguugccuuagcuccgcacgucggacugggcuuagaaacacguacggagacauggaugucgagcgaaggugcauggaaacaaauucaaagaguagagacgugggcucuccgacauccuggcuuuacugugaucgcacuguuuuuagcacaugcaauagguacaucaauuacucaaaaaggcauaauauuuauucuauuaaugcuaguaacgccgaguauggccaugagaugcguuggaauagggagucgggauuucguagagggauuaucuggagcaacguggguagauguaguacuagaacacgggucaugcgucacaaccauggcaaaagacaagccuacguuggauauugaguuguuaaaaacagaaguaacgaaucccgccguauuacgaaaauugugcauagaagcuaaaauaagcaauacaacuacagacucgagaugcccuacccaaggagaggcuacguuaguagaagaacaagacgcuaauuucgugugcagaagaacguuugucgacagagggugggguaaugguugcggauuguuugggaaaggcucacuaauaacaugugccaaauucaaguguguaacgaaacuagaagguaaaauaguacaauaugagaacuuaaaguauaguguaauagugacuguucauaccggagaccaacaucaaguggguaaugaaucaacggagcaugggacuacagccaccauaacgccucaggcaccuacaacugaaauacaauuaaccgacuacggagcucucacguuagauuguuccccacgcacuggcuuggacuuuaacgaaaugguccuuuugacaaugaaagaaaaaucuugguuaguucacaaacaaugguucuuagacuuaccccuaccuuggacaaguggugcaagcacgucacaagaaacuuggaacagacaagaccuccuggugacguuuaaaacugcccaugcuaaaaagcaagaagucgucguauuggguucacaggagggcgcgaugcauacagcuuuaacgggugcuaccgaaauacaaacaucuggcacgaccacaauauuugcaggucacuuaaaauguagauuaaaaauggauaaauugacuuuaaaagguaugucuuauguuaugugcacaggcuccuucaaacuagagaaagagguagccgagacucagcaugguacuguauuaguacaaaucaaauacgaaggaacagaugcaccuuguaagauaccauuuaguacucaagacgagaaagguguaacucagaacgggcgccucauaaccgcaaacccgauugugacagauaaagaaaaaccaguuaauauugaggcagaaccaccuuucggagaaucguauauuguaaucggagccggugaaaaagcacuaaaauugaguugguuuaaaaaggguuccuccauaggaaaaauguuugaagcgacggcuagaggagcacgcagaauggccauacuaggagauaccgcuugggauuucggaucuaucggcgggguauuuacgucaguaggaaaauugguacaccaaauauuuggcacagcauauggaguucuauucucaggaguaagcuggacuaugaagaucgggauagguguccuucucacgugguuaggauuaaauagucggucuacuagcuuaucaaugacaugcauugccguugggcuuguaacgcuuuaccucggaguaaugguacaagcugauaguggauguguuauaaauuggaaagggcgagaauuaaaauguggcucugggaucuucguaacgaacgagguucauacuuggacagaacaguacaaguuucaggccgauucgccuaaaagauuaagugcugcaauaggaaaagcaugggaagaagggguauguggaauaagaucagcaacaagacuugagaacauaauguggaagcagauuaguaaugaacucaaucauauacuacuagaaaaugauaugaaauucaccguugucguuggugacguagcugguauauuagcucaaggcaaaaagaugauaagaccgcaaccaauggaauacaaauauaguuggaaaagcuggggaaaagcuaaaaucauaggcgcugauguucaaaauaccacauuuauaaucgacgggccuaauacaccugaaugucccgaugaccagagagcauggaacauuugggaagucgaggacuacgguuucgguauauuuacuacgaauauuuggcuaaaacuaagggauucguacacccagguuugugaccauagacuaauguccgcagccaucaaggauaguaaggccguacacgcugauaugggcuacuggauugaaagcgagaagaacgagacauggaaacucgcacgugccucguucauagaaguuaaaacaugcauauggcccaagucgcauacucuguggucuaaugguguucuugaaucagaaaugaucauaccgaagaucuaugggggccccauaagucagcacaauuaccgcccaggauauuuuacacaaacugcuggacccuggcauuugggcaaacuagaacuagauuucgaucugugugaggguacuacgguaguuguagacgaacacugcggaaacagaggccccucacucagaacaacaacaguaacaggaaaaauaauccacgaguggugcugccgaaguuguacacuuccgcccuugagauuucgaggggaagauggauguugguacggcauggagauccgaccagucaaagagaaggaagaaaacuuaguaaaaucuaugguauccgcugguaguggugaggucgacucuuucagccuaggauuguuguguaucucuauuaugauagaggagguaaugagaucccguuggucaagaaaaaugcucaugaccggaacucuagccgucuucuuucuauuaaucaugggacaguuaacuuggaaugaccuaauucgacuaugcauaaugguaggcgcaaacgccucugaccgcaugggaaugggaaccacauaccuugcacucauggccacuuucaaaaugaggccgauguuugcagucggucuacucuuccgacgauuaacaaguagagagguauuguuauugacgauaggauuaagucuugucgccucagucgaauuaccuaauucccuagaagaauuaggugacggacuagcgaugggcauaaugauacuaaaacuccugacggacuuucaaucucaucaacuaugggccacauugcuaagucugaccuucauuaagacuacuuuauccuugcacuaugcguggaaaacuauggccaugguuuuaucuaucguaucauuauuuccgcuaugcuuaucaacuacaucucagaaaacuacgugguugccgguuuuguuagguagcuuaggauguaaaccgcuaacaauguuuuuaauagcggagaauaaaauuuggggacgaagaaguuggccguugaaugagggaauuauggccguagguauaguaagcauauuguuaucuaguuuacuuaagaacgaugucccacuagcaggaccuuugauugcuggaggaauguuaauagcaugcuaugucauuaguggaucuagugcagaucuuucacuggaaaaggcagcagaaguuucuugggaagaagaagcugaacauucaggugcgagccacaauauuuuagucgaaguucaagaugaugguaccaugaaaauaaaagaugaggagagagaugauacauuaacaauauuacugaaagcgacauugcuugcaguuagcgguguuuacccacugaguauaccugcaacauuauucgucugguauuucuggcagaagaagaaacaaagauccggcguucuaugggacacuccaucaccgccggaaguuggcagagcgguacuggaugacggaauauacaggauuaugcaacguggacuacugggcagaucacagguaggagucgguguauuccaagaaaauguauuucacaccauguggcauguuacaagaggagcuguucuuauguaucaagggaaacgacuugaacccucuugggcaagugucaagaaagacuuaauaagcuacggcggaggauggagauuacaaggaucuuggaacacgggugaagaaguccaagugauugcgguagaaccggguaaaaaucccaaaaauguacagacugcaccaggaacauuuaaaacaccugaaggugagguuggcgcaauagccuuagacuucaaaccaggaacguccgguucuccaauaguaaaucgagaaggaaaaauugugggauuauaugguaauggcguuguaacaacaaguggaacuuacguauccgcaauagcgcaagcaaaggcuucacaagaagggccacuucccgaaauagaagacgaagucuuccgaaagagaaauuuaacaaucauggauuugcacccagggagugguaaaacucgacgauauuuaccagcaauuguacgcgaagcaauaaagcgaaaacugcguaccuugauacuggcacccacaaggguaguagcgucugaaauggcagaggcuuuaaaggguaugccuauuagguaucaaacaacagcagucaaaagugaacauacuggcaaagaaauaguugacuuaaugugccacgcuacuuuuaccaugcgauuacuuucaccaguccgagugccaaacuacaacaugauaauaauggaugaagcucauuucacugacccgucaucgaucgcggcuagaggguacauaucuacuagagucgggaugggagaggcugcagcaauauucaugacagccacaccgccugguuccguagaagcguucccacaaucaaaugcugucauucaggaugaggaaagggacauacccgaaagauccuggaacagcggauaugaguggauuaccgacuuccccggaaaaacugucugguucguaccuagcauuaagagugguaacgacaucgcaaauuguuuaaggaaaaauggaaaaaggguuauacaacuaucaagaaaaacuuucgacacagaauaucagaaaacuaaaaauaacgauugggauuauguuguuacaacagauauaagugaaaugggcgcgaacuuuagagcagauagggugauagauccgcgaagaugccuuaaacccgucaucuuaaaagauggcccugaacgggugauuuuagcagguccaaugccaguaacaguagccagcgcugcacaaaggagaggucguauagguagaaaccacaauaaagaaggggaucaauauauuuacaugggccaaccccuaaauaacgaugaagaucaugcucacuggaccgaagcaaaaaugcuccuggauaacauaaauaccccagaagguauaaucccggcguuauucgagccugagagagaaaaauccgcagcaauagauggagaauacagauuaagaggggaggcuagaaaaaccuuugucgaacuaaugagaagaggugaccuaccaguauggcuauccuacaaaguugccuccgaaggcuuucaguacagcgauaggagaugguguuucgauggugaacgcaacaaccagguacuagaggagaauauggauguugagauauggaccaaagaaggugaaagaaagaaacuaaggccacgcugguuagaugcaagaacguauucagauccucucgcucuccgagaauuuaaagaauuugcugcaggaagaagaucaguuaguggagaccuaauucuugaaauugggaagcugccccaacauuuaacucaacgggcucaaaacgcacuagacaaucuuguaauguugcauaacagugaacagggaggacgcgcuuauagacaugcaauggaagaacuaccagacacgauugaaaccuuaaugcuguuagcucuaauugcaguauuaacaggaggggugacccuauucuuucuuagcggacgaggccuaggcaaaacauccauuggauuacuuugugucauggcaaguagugucuugcuuuggauggccuccguggagccacauuggauugcggccuccauaauacuagaauuuuucuugaugguauuacucauuccggaaccagaccgacaacgcacuccacaagauaaccagcuagcuuauguagugaucggacucuuauuuaugaucuuaacugucgcagcgaaugagaugggcuuacuagaaacaacuaagaaagaccuuggaaucggacauguagcagucgagaaucaucaccaugcugcaauguuagacguagacuugcaccccgcaagugcauggacucuguacgcagucgcgacuaccauuaucacaccaaugaugagacauacaauugaaaacacuaccgccaauauaucucuaacugccauagcuaaucaggcagccauccugaugggcuuagauaaaggauggccgauuucgaagauggauauuggggugccgcuauuagcauuagggugcuacagccaggugaauccacuaacccuaaccgccgccguucuaaugcuaguugcccauuacgcgauaauuggacccggucuucaagcuaaggcaacaagagaagcacagaaacgcacugcugccgguaucaugaaaaauccgacgguugacggaauuguggcaaucgaucuggacccagucguauacgacgccaaguucgaaaaacaacuugggcaaauuaugcuauuaauccugugcacaucacagauauugcucaugcguaccacaugggcauugugcgaauccauaacauuggccacuggaccauuaacaacauuaugggaaggcucaccaggaaaauucuggaacaccaccauugcuguaucgauggcgaauaucuuucguggcaguuauuuagcuggggccggcuuggccuuuucgcuuaugaagagucuaggaggagggcgacgcgggacaggagcacagggcgaaacauuaggagagaaauggaaacggcaguuaaaccaacucucuaagagcgaguuuaacacuuauaaacgaagugguauaauggaagucgacagauccgaagcaaaagaaggccuaaagaggggagaaaccacaaaacaugcugucagcagagguacagcuaaauuacgaugguucgucgaaagaaaccuaguaaaaccggaaggaaaaguaauugacuuaggcuguggacguggaggcuggucauacuauugcgcuggacugaagaaaguaacagaaguuaagggauauacgaaaggagggccagggcaugaagaaccaauucccauggcuacuuauggguggaacuuaguaaaguuacauaguggcaaggauguguucuuuaucccacccgagaaaugugauacucuacucugugacauuggagaauccucaccuaauccuacaauagaagaagggaggacuuuaagaguccuaaaaaugguagagccgugguugaggggaaaccaauuuuguauaaaaauacuaaacccuuauaugccaucaguaguagaaacccuagaacaaaugcaaaggaaacacggugguaugcuaguacguaauccucucagccgaaacagcacgcaugagauguauuggguaagcuguggcacuggaaauaucgucuccgcaguuaacaugacaucucguauguuacuaaaccgauuuacuauggcccaccgaaagccgacauaugaacgcgaugucgaucuuggagccggaacucggcacgucgcaguugaaccggagguugcuaaccuggauauaaucggucaaagaaucgagaauauuaagcaugaacauaaauccaccuggcacuaugaugaagacaacccauauaaaacaugggcauaucacggaucguacgaagucaaaccaagugggucugcuagcagcaugguaaacgggguagucaaguuauuaacuaaaccaugggacgucauaccaauggugacacagauagcaaugaccgacacgacaccauucgggcagcaaagaguuuucaaagaaaaggucgauacccgaacaccuaaagcgaaaagaggaacugcucaaauuauggagguaacagcgaaaugguuguggggguuccugagucgaaacaaaaagccacgaauuuguaccagggaagaguucacaaggaaaguacggagcaaugcagcuauuggcgcaguuuuuguagaugagaaccaauggaacucggcaaaagaagccguugaggacgagagauuuugggauuuaguacauagagaaagggaacuacacaaacaaggaaaaugugcaacauguguuuauaacaugaugggaaaacgagagaagaaacucggagaguucgguaaggcaaagggcucacgagcaauaugguacaugugguugggugcaagauuuuuagaauuugaagcgcuaggguuuaugaaugaggaccauugguuuucucgcgaaaacagccugaguggcguugaaggcgaaggauuacauaagcugggcuauauacuucgagauauuucuaauaucccaggaggaaauauguaugcagacgacaccgcuggaugggauacacgaauaacugaagacgaucuccaaaaugaggcucguauaacugauauaauggagccagaacaugcguuauuggccaagucgauauuuaaauuaacguaucaaaauaaagugguacgaguucaaagaccagcgaagaacggaacaguuauggauguuauaucaagacgcgaccaaagaggaaguggacagguagguacuuacggucugaacacauuuacaaauauggaagcucaacugauaaggcaaauggaaucagaaggaauauuuagcccuagcgaacuagaaacuccaaaccucgcagaaaggguacuggauuggcuagaaaaguacgguguagagcgauuaaagaggauggcuauaucgggagaugacuguguaguaaaaccgauagacgaucgauuugcaacggcauugacggcauuaaacgauauggggaagguaagaaaggauauaccacagugggaaccuucuaaaggauggaaugacuggcagcagguaccauuuuguagucaccacuuucaucagcuuaucaugaaagacgggagagaaauaguagucccuuguagaaaccaagaugagcuagucggaagggcucggguuucccaaggugcaggauggagcuugcgagagacugcuugucuaggaaagaguuacgcacaaauguggcaacuuauguauuuccauagacgagaccuuaggcuggcugcaaaugccauaugcucagcaguacccguugauuggauuccuacaagccguacgacaugguccauccacgcucaccaucaauggaugacuacagaagauauguuaagcgucuggaauaggguauggaucgaggaaaacccguggauggaggacaaaacacauaucucaagcuggggugacgucccuuaucugggaaagcgagaggaccaauggugugguagucuuauagguuuaaccgcaagagcgacuugggcgaccaauauucagguagcuauaaaucaggugagaagacuaaucggaaaugaaaauuaucuagauuacaugacuuccaugaaacgguuuaaaaaugaauccgauccugaaggagcucuaugguaa

SEQ ID NO: 21953 - RNA, 9879 nt, Artificial Sequence
  derived and/or modified CDS sequence (opt6) from DENV-1__EU482517__SS-prME
ucuguaacuaugcuauuaaugcugaugccgaccgcacuagcguuucaucuuacuacaagggguggugagccucacaugauuguaaguaaacaagaaagaggaaagagcuugcuuuuuaaaacuuccgcagggguaaauauguguacacucauugcuauggacuugggagagcuuugugaagauacgaugacuuacaaaugccccagaaucaccgagacugagcccgaugauguugacuguugguguaacgccaccgacacuuggguuaccuauggaacaugcagucaaacgggggaacauaggagagauaaaagauccguugcgcuugcuccccauguuggguugggacuagaaacuaggacagagaccuggaugaguucggaaggcgcguggaaacaaauacaaagaguggaaacgugggcacuaagacauccagguuuuacuguaaucgcucuguucuuagcucaugcuauugguacguccauaacacaaaaagguauaauauuuauacucuuaaugcuaguaacacccaguauggcaaugcgauguguagggaucggaagcagagauuuuguagagggcuuaucaggagcgacuuggguagauguaguccuggaacacggaagcugcguuaccacaauggcuaaagauaaaccgacucuggauauugagcuauuaaaaacagaaguuacuaauccugcugugcugcgaaaacuguguauagaggccaaaauaucuaauacaacgacugauaguagguguccaacccaaggagaagccacauuagucgaagaacaagaugccaacuuugugugcagaaggacuuuuguagauagagguuggggaaacgggugcggauuauuuggaaaagguagucugauaacaugugcaaaauucaaauguguaacaaaacuugaaggaaaaauuguacaauacgaaaaucuuaaauauucuguuauaguaacaguucauacuggagaucaacaccaagucggaaacgaaucaaccgagcacggaacaaccgccacuauaacuccacaagcuccaacaacagaaauacaacuuacugauuauggugcacuaacacuagacugcagcccucguacagggcuagauuucaaugaaaugguacuacucacuaugaaagagaaauccuggcuuguacauaaacaaugguuuuuagacuuaccauugcccuggacgucaggggcgucaacuucacaagaaacauggaauagacaagauuuacuugugacuuuuaacaccgcucacgcuaagaaacaagagguaguggugcuagguucccaagaaggggcaaugcauacugcucuuacaggugcuacugagauacagacaagcggaacaacgacuauauucgcugggcaccuaaaaugccggcuaaaaauggacaaauuaacacuaaaagguaugucguacguuaugugcacuggaaguuuuaaauuagaaaaagaguuggcugaaacucaacacgguacagucuuaguacaaauaaaauacgaaggcaccgaugcacccugcaaaaucccuuuuucaacccaagaugaaaaaggcguaacccaaaaugggagacuuauaaccgcgaacccuauaguaacugacaaagaaaaacccguaaauauagaggcagagcccccguuuggagagaguuacauaguaaucggcgcaggagaaaaagcacuuaaacugaguugguuuaagaaaggaaguagcauaggcaaaauguucgaagccacggcgagaggagcuagacgaauggcuauacugggugacacagcgugggauuucgggucaauaggcgguguguuuacgagugucggaaaauuagugcaucaaaucuuuggaacagccuacggcguucucuuuucugguguaagcuggacgaugaaaaucggaauagggguacuacugacaugguuaggacuaaauucuagaagcacgagucucagcaugacuuguauugcuguaggucuaguuacgcuauaucuuggugugauggugcaagcagauucgggcuguguuaucaauuggaaagguagagaauugaaaugcgggucggggauauuuguaaccaaugaaguacauacauggaccgaacaauauaaauuucaagcagacucuccuaaacgauuaagugcggcaauagggaaagcaugggaagaaggcguauguggcauaagaagugcgacuagauuggaaaauauaauguggaaacaaauaucaaaugaacucaaucacauucuauuagagaaugauaugaaauucacaguuguggucggugauguagcaggaauccuagcgcagggcaagaaaaugauuagaccacaaccaauggaacauaaauauucauggaaaucauggggcaaagcaaaaauuauuggagcggaugugcaaaauacuacuuucauaauugauggacccaacacgccggaaugcccugacgaccagcgugccuggaacauaugggaaguugaagauuauggauucggaauuuuuacuacgaauauauggcucaaauuaagagauucauauacacaaguaugcgaccauagauugaugagugccgcuauuaaggauagcaaagccguacaugcagacaugggauacuggauagagucagaaaagaacgaaaccuggaaacucgcuagggccucauuuauugagguaaaaacauguauauggccgaagucgcacacccuguggucaaauggcguccuagagagugagaugauuaucccuaaaauauaugggggacccaucucucaacacaauuaccgaccuggauacuuuacacagacugcaggaccauggcauuuagguaaauuggaguuagacuuugauuuaugcgaagggacgacuguagucgucgaugaacauuguggaaaccguggcccaaguuuaaggaccacuacugucacagggaaaauuauccaugaaugguguugcaggagcuguacacuaccaccccucagguuucgcggugaggacggcuguugguaugguauggaaauucgcccagugaaagaaaaggaggaaaacuuaguuaaaucgaugguaucugcuggcagcggcgaaguagauuccuuuagucucggacuuuuaugcauuagcaucaugauugaagagguaaugaggagucgaugguccagaaagauguuaaugacgggaacauuggcaguauuuuucuuauuaauaaugggucaauuaacauggaaugaccucaucaggcuaugcauaaugguuggggcgaaugcuucagaucguaugggaauggguacuacauauuuagcccuaauggcuacauuuaaaaugagaccuauguucgcaguaggccuucuguuucgacguuuaacaucuagagaaguacuacuccuaacaauaggauugagcuuaguugcaucaguagaguugccaaacucacuagaagaauugggagacggcuuagcuauggguaucaugauuuugaaauuacugacugauuuucaaucucaucaauuaugggcaacacugcugucauuaacguuuauaaaaacaaccuucucgcuccauuaugccuggaagacuauggcaaugguuuuaaguauagugucacuguuucccuuaugcuugucaacgacuucgcagaaaacgacaugguuaccugugcuauuaggaucauuggguuguaaaccccuaacuauguuuuugauagcagaaaauaagaucuggggucgucggagcuggccacucaacgaaggaauuauggcggucggaauaguuaguauccuuuuauccagcuuauugaaaaacgaugucccacuagcuggaccguuaauagcaggaggaauguuaauagcaugcuauguuauaucggggaguucugccgaccuauccuuagaaaaagcugcagaaguuucaugggaagaagaagcugaacacuccggagcaucucauaacauccugguugaaguacaagaugacggaacuaugaagauaaaggaugaggaacgugacgauacacuaaccauucucuuaaaagcaacguuauuagcaguaaguggugucuacccguuaagcauuccagcaacauuauucguaugguacuucuggcagaagaagaaacaaaggucaggaguauuaugggacacaccuuccccaccagaaguugaacgcgcaguacuagacgauggcauauaucgaauuaugcaacgaggauuacuugggagaucacaaguuggggucgggguauuccaggagaauguguuucacaccauguggcacgugacucgaggggcgguguuaauguaccaaggcaaacgucuugaaccuuccugggccagcguaaagaaagacuugauaucauaugggggcggguggagguugcaaggcuccuggaauacaggugaagaggugcaaguuauagcaguugagccaggcaagaacccaaagaauguacaaaccgcaccaggaacauuuaaaacccccgagggagaggucggcgcuauagcguuagauuucaagccgggaacauccgguuccccaaucguuaauagagaagguaaaauuguuggauuauaugguaauggcgucguaacaacaagcggaacuuacgucagcgcaauagcacaagcaaaagcaagucaggaaggucccuuaccugagauagaagaugaaguuuuucguaaaagaaaccuaacaauuauggaucuucauccaggaucugggaaaacgagacgauauuugccugcgauaguucgagaagcuauuaagcgaaaacuaagaacucuaauucucgccccaacacgugugguugcaagugaaauggcagaggcacugaaggguaugcccauuagauaucagacaacggccgugaaaucugaacauacggguaaagaaauuguggauuuaaugugccaugcaacauuuacuaugagguuacuuucgccuguuagagucccgaauuacaacaugauaaucauggacgaggcacacuuuacugacccaaguaguauagcggcuagaggguauauaucaacuagagugggaaugggggaagcagcagcaauauucaugacggcaaccccaccagggucagcagaagcauucccccaaucuaaugcugucauccaagaugaagagagagauauuccugaaagauccuggaacucaggauacgaguggauaacggauuuuccuggaaaaacaguuugguuugugccuucaauaaaaucagguaacgauauagccaacugucuaagaaagaauggaaagcgcguaauacagcuuucgcgcaaaacauuugacacggaguaucagaagaccaaaaacaaugacugggauuauguugucacuacugauaucucggagaugggagcaaauuuccgcgcagacaggguaauagacccaaggcggugccuaaaaccaguaauauuaaaagacgggccggaaagagucauauuagcaggaccaaugcccguaacaguugcaucugcugcacaaagaagaggccgaauaggaagaaaucauaacaaagagggugaucaauacauauauaugggccaaccauuaaauaacgaugaagaucacgcgcauuggaccgaagcuaaaaugcuguuagacaauauaaauacaccggaagggauuauaccggcacuuuucgaacccgaaagagaaaagagcgcugcaauagauggugaauaucggcuaaggggugaggcccgaaagaccuucguggaauugaugagaagaggggauuuacccguuugguugagcuauaaaguagcuucugaagguuuucaauauagugacagaagaugguguuucgacggcgaacggaauaaucaaguuuuagaagagaauauggacgucgaaauuuggacuaaagaaggggagagaaagaaacuacgaccgagauggcuagaugcacgcaccuauagcgaucccuuagcacuuagggaauuuaaagaauuugcagcaggccgacguucaguuaguggugaucucauauuagaaauugguaaacuaccccaacauuugacacaacgggcucaaaacgcacuagacaauuuaguaauguuacacaauucagagcaggguggcagagcuuaucggcaugcaauggaggaauuaccagauacaaucgaaacacugaugcugcuagcgcuaauagcagucuuaacaggagguguuaccuuauucuuuuuaaguggaagagguuuaggaaaaacaucuauaggccuacucuguguaauggcuuccucuguacuacuguggauggcgaguguugagccgcacuggauagcggcaucaauuauacuugaguucuuccuuauggugcugcugauaccggaaccagaucgucaaaggaccccucaagacaaucaauuagcauacguuguaauuggucuuuuauuuaugauuuuaacaguggcagccaaugaaaugggccuacuugagaccaccaagaaagacuugggaauuggucauguagcuguggaaaaccaucaucaugcagcaaugcuugacgucgaccugcauccagcaucggccuggacucuguaugcgguagccacaaccaucauaacaccgaugaugcgucacaccaucgaaaauacaacagcuaauauaagucuuacagccaucgcaaaucaagcggcaauucuaauggguuuagauaaaggauggccuauuucgaagauggauauaggagugccauuguuggcuuuagggugcuacucccagguaaauccccuaacucuuaccgccgcaguuuuaaugcuaguugcgcauuaugcaauuauaggcccuggauuacaagcuaaagcaacacgugaagcacaaaaacgaaccgcagcugggaucaugaaaaacccuacuguggacgggauaguagcuauagaccuggacccagucguguacgaugcaaaguuugaaaaacaacuuggucaaaucauguuauuaauauuauguacgucacaaauucuacuaaugagaaccacaugggcuuuaugugaaucaauuacauuagcuacuggaccacugacuacgcuaugggaagguuccccagguaaguuuuggaauacgacuauagcaguuucuauggcaaauaucuuucgaggauccuaccucgcuggcgcgggguuggcguuuaguuuaaugaagucauuaggaggugguagaagagguacuggugcacagggagaaacuuuaggggaaaaguggaaacgucaguugaaccaauugagcaaaucugaguucaauaccuauaaaaggaguggaauaauggaaguagaucgaagcgaggcuaaagaggguuugaaaagaggagaaacuacuaaacaugcuguuuccaggggaacagcuaaauuacgaugguuuguugaacggaaccucguaaaacccgaagggaaaguuauugauuugggauguggacgaggggguuggaguuacuauugugccggucuaaagaaagucacugaaguaaaaggguacaccaaaggcgggccaggacacgaagaaccaauaccuauggccacuuauggguggaaucuggucaagcuacauagugguaaggauguguuuuucauaccacccgagaaaugcgauacguuacuaugugacauaggagaaaguagcccaaacccaacgauugaagagggaagaacgcuacgaguucucaaaaugguugaaccaugguugcgaggcaaucaauucuguauaaagauacuaaacccauauaugcccagcguuguugagacauuagagcaaaugcaaagaaagcacggggguaugcuaguaaggaacccuuuaagcaggaauagcacucacgaaauguacugggucucauguggaaccggaaauauaguuucggcaguaaacaugacuucucgaauguugcuaaaucgguucaccauggcucauagaaaaccaacuuaugaaagagauguggacuugggagccggaaccaggcacguagcaguugaaccggaaguagcaaaucuagacaucauaggucaaagaauugaaaacauaaaacacgaacacaaaagcacuuggcacuacgaugaagauaaccccuauaaaaccugggcguaucauggcucauaugaagucaaacccucgggaagcgcuuccucuaugguuaauggcguugucaaauuacugacuaagccuugggauguaauuccaaugguaacacaaaucgcaaugacugauaccacgccauuugggcaacaacggguauuuaaagagaaagucgauacuaggacgccgaaagcaaaacggggcaccgcacagaucauggagguaaccgcaaaauggcuauggggcuuccucagccgcaauaagaaaccucguauauguacucgugaagaguucacuagaaaaguacgcucuaaugccgccauuggcgcagucuuuguugacgagaaucaauggaacucugcaaaggaagcagucgaagacgaacgauucugggaccuaguacauagggaacgcgaacugcauaagcaaggaaagugugcaacauguguauauaauaugaugggaaagcgcgagaagaaacucggcgaauuuggcaaggccaaagggucgagagcaauaugguauaugugguugggagcaagauuuuuagaguucgaagcacuaggauucaugaaugaagaucauugguucucccgcgaaaauucccuaaguggaguagaaggggagggguuacauaaauugggauacauacuccgcgauauuucuaaaauaccagguggaaacauguaugcugaugauacugcgggaugggacacuaggauaacagaagaugaucuucaaaaugaagcucguauaacagauauaauggaaccugaacaugcuuuauuagcuaaaaguaucuuuaaguugacauaucaaaauaaagugguuagggugcaacgucccgcuaagaacggaacugugauggauguaauaucacgaagagaucaaagaggauccggccaaguaggaacguacggguugaauacauucacgaauauggaagcacaacuaauuaggcagauggacagugaaggcaucuucucaccuucugaauuggagacgccaaaccuugcugaaaggguauuagauuggcuggagaaauauggaguugagagguugaaaagaauggcuauuucaggugacgacuguguaguaaaaccgauagacgacagauuugcaacugcauuaacagcgcuaaaugauauggggaagguucggaaagauauuccgcaaugggagccaucaaaaggguggaaugacuggcagcaaguuccauucuguucccaucauuuccaccaacucauaaugaaagauggaagagaaauaguaguuccuugucgaaaucaagaugaauuagucggaagggcucgaguaucacaaggugccggcuggagccuacgagaaacagcuuguuuagguaaaaguuaugcccaaauguggcaacuuauguauuuucaucgacgugaucuaagacucgcagcaaaugcuauuuguucggcaguucccguagauuggauaccaacaagccgaaccacauggucaauccaugcacaucaucaauggaugacgacugaagauauguugagugucuggaaucgaguguggaucgaagagaacccuuggauggaagauaaaacucacaucaguucuuggggugacgucccuuauuuaggcaaacgggaggaccaauggugugggucauuaauuggacuaacugcaagagcaacaugggcgacuaacauccaagucgcaaucaaucagguccgaaggcuaauaggcaacgagaauuaccuagauuauaugaccaguaugaagcgguuuaaaaaugaaagugauccugaaggugcacuaugguaa

SEQ ID NO: 21954 - RNA, 9879 nt, Artificial Sequence
  derived and/or modified CDS sequence (opt6) from DENV-1__EU482519__SS-prME
ucugugacaauguuauuaauguuaaugccaacagcuuuagcauuucacuuaacaacucgagggggagaaccacacaugauaguaacgaaacaagaaaggggaaaaagccuacuauuuaaaacaagcgcaggagugaauauguguacauuaaucgcaauggauuuaggagaauugugugaagacacuaugacuuauaaaugcccuaggauuacagaagcugaacccgacgacguagauuguuggugcaaugccacggauacuugggucacguauggaacuugcucacaaacaggagaacaucggcgggacaagagaucaguugcuuuggcgccacauguagguuuaggauuagaaacacguacggaaacauggauguccagcgagggagcauggaagcaaauacagcguguagaaaccugggcuuugcggcaccccgguuucacagugauggccuuauuuuuggcccacgccauaggaacuuccauuacucaaaaagggaucaucuuuaucuugcucauguugguuacaccuucuauggcgaugagaugugucggaauaggaagucgcgauuucgucgaggggcuauccggcgccaccuggguagauguaguuuuggaacacggcagcugcgucacaacaauggccaaagacaagccgacgcuagauauagaacuacuaaaaaccgaaguuacaaauccugccguccuaaggaaacuuuguauugaagccaagauaaguaauacaacaacagauagucgaugccccacgcaaggggaggcaacguugauggaagaacaagaugcgaacuucguaugccgcagaacuuuugucgaucgcggauggggaaacgguugcggacucuucgggaaaggaucuuuaaucacaugugcaaaauuuaagugcguaacuaaauuagagggaaagguaguucaauaugagaauuugaaguacucagugauuguaacaguucauacaggagaucaacaucaaguugguaacgaaucuacagagcacgggacaacugcaacgauaacgccgcaagcuccaaccucggaaauacaacuaacagacuacggagcauuaacguuagacuguucaccucguacgggauuggacuucaacgaaaugguauuacuuacuaugaaagaaaagagcuggcugguucacaagcagugguuuuuagauuugccccuaccauggacgucuggagcgucgacgucacaggaaacuuggaaucgacaggaccucuuaguuacguuuaaaacagcacacgcuaagaaacaagaaguugugguguuagguucccaggagggugcaaugcauacugcucuuacaggagcaaccgaaauacaaacgagcgguacuacaacgauuuuugcaggacaucuaaaaugccgcuuaaagauggauaaguuaacguuaaaagguaugagcuauguaauguguacuggaucuuucaaauuggaaaaagagguggcugaaacucaacaugggacaguucucguucaaauaaaauacgaagggacagaugcgcccuguaaaauaccauucagcacacaggacgaaaaggguguaauucaaaauggaagacuaauaacagccaauccaaucgucaccgacaaagaaaaaccaguuaacauagaggcagaaccaccuuuuggugaaaguuauauugucaucgguguaggagaaaaagccuuaaaguuaaguugguuuaagaaagggucaagcauuggaaaaauguuugaagcuacggcacgaggagcucgucguauggcaauacuaggcgacacggcuugggacuucggaucaauuggaggaguuuuuacgagugucggcaaacucguacaucagauauuuggaaccgcauaugguguauuauuuucagggguaucuuggacuaugaagauaggcauugguguucugcugacaugguuaggauuaaacagcagaucaaccagcuugaguaugacuugcauugcgguagguuuaguuacucuuuaucuggguguuaugguacaggcagauagugggugcguuaucaauuggaaggguagagaacuaaaaugcgggaguggaaucuucgugacgaaugaagugcauacuuggacggaacaguacaaauuucaagcagauagcccgaaacgauugucugcugcuauaggcaaggcaugggaagaaggcguguguggaauccgguccgcuacucgguuagagaauauaauguggaagcaaaucagcaaugaacucaaucauauauuacuagaaaacgauaugaaauuuacgguugucguaggugauguaguggguauucuagcacagggcaagaaaaugauaagaccccaaccaauggaacauaaauauucguggaaaucgugggggaaagcgaaaauuauuggcgcagauguacaaaauacgacguuuauaauugauggaccuaacacaccugagugcccugaugaucaaagggcuuggaacauuugggaaguagaggauuaugguuucggaauuuuuacaacaaacauaugguuaaaguuacgugacucuuauacacaagcaugugaucauagauugauguccgcagcgauaaaagacucgaaagcaguacacgcggacaugggguacuggauagagagugagaaaaacgaaaccuggaaauuggcacgagcaaguuucaucgaagucaagacguguauuuggccaaagucacacacauuguggucaaacggaguauuagaaucagaaaugguaauucccaaaauuuauggaggaccgaucagccaacauaacuaucgccccggcuauuucacccaaacggcuggaccguggcauuuaggcaaacuagaauuagauuucgaucucugcgaagggacgacggucguuguagacgagcacugugggaauagaggaccaagucuacggacuaccacuguaacaggcaagauuauacaugaauggugcuguagaucauguacccuuccaccuuuaagauucaaaggugaagacggauguugguacggcauggaaaucagacccgugaaagaaaaagaagaaaaucuaguaaaaagcauggugucugcuggaucgggggaaguugauucuuucuccuuaggauugcuguguaucucaauaaugauugaagaaguaaugcgaaguagauggucgagaaagaugcuuaugaccggaacuuuagcaguuuuccuacuccuuauaaugggacaacucacguggaacgauuugacccgguuauguauuaugguaggggcuaaugcaucagaucguaugggcauggggacuaccuauuuagcuuugauggcgacuuucaagaugagaccaauguuugcgguaggauuauuauuucgaagacuaacuucucgcgaaguauuauuacuaaccaucggacuaagccuuguagcuuccguagagcuaccaaauaguuuagaagaacugggcgauggauuggcaaugggaauuaugauacuaaagcucuuaacggauuuucaaagccaucaacucugggcaacacuccucagucugaccuuuauuaaaacuacacuuucucuccauuaugcauggaagacaauggcaaugguacucagcauagucucccucuucccacuaugucuaucaacuacuucucagaaaacaaccugguuaccugugcugcuaggaucucuuggcuguaagccuuugacuauguuccuaauagcugaaaauaaaauauggggaaggaaaucguggcccuuaaacgaaggaauuauggccguaggcguaguaucaauauugcugucuucgcuacuuaagaacgacguuccacuagcaggaccguugauagcaggaggaauguuaauagcgugcuauguaauuucaggaucuucggccgaccucagcuuagaaaaagcagcugaaguuagcugggaggaggaagcugaacacaguggugcaagucauaauauauugguagaaguucaagaugacggcacaaugaaaauaaaagacgaagaaagagacgacacuuuaacuauacuacucaaagcaacgcugcuagcagugagugguguauacccucuuaguauaccugcaacacucuucguuugguauuuuuggcaaaagaagaaacagagaucggggguauuaugggauacaccaucuccaccggaaguugaaagagcuguauuagacgacgggauuuaccgcauaaugcaaagaggacuucuugguagaagccaggucgguguuggaguuuuucaagagaauguauuucauacuauguggcacgugacaaggggugcaguucuuauguaccaagggaaacgauuagaaccaucaugggcuaguguaaagaaagaccuaaucucuuauggugguggauggagauugcaagguaguuggaauacaggggaagaaguacagguuaucgcaguagagccagguaaaaauccgaaaaacgugcaaacagcacccggcacauucaaaaccccagaaggagagguaggcgcuauagcauuggacuucaaacccgguacaucagguucaccaaucguuaauagagaaggaaagauaguaggccuuuacggaaaugguguagugacuaccucugggacauacguaagcgccaucgcucaggcgaaagcaucucaagaggguccacuuccugaaauagaggaugaaguuuuuaggaagagaaaccuuacaauaauggacuuacauccugguucugguaaaacucgccgguauuugccagcgauuguuagagaagcgauuaaaagaaaacuacgcacacuaaucuuggcuccaacuagaguaguagcaucugaaauggcagaagcucuuaagggcaugccgauacgauaccaaacgacagcaguuaagucugaacauacagguaaagaaaucguugaucucaugugucacgcaacguucaccaugcgauuguuaucucccguucguguaccaaauuacaauaugauaauuauggaugaagcucacuuuaccgaccccaguucaauugcagcucggggauauauuucuacgcguguugggaugggugaagcagccgcaaucuuuaugacagcuacaccacccggaucuguagaagcauuuccccagucaaacgccguaauccaagaugaggaacgagacauacccgaacgaaguuggaacuccggguaugaauggaucacagacuuuccuggcaaaacagugugguuuguuccuagcaucaagagcgggaaugauauagcaaauugucuaagaaagaauggaaaacguguaauacaguuaagccggaagaccuucgacacagaauaccaaaagaccaaaaacaaugacugggauuauguaguuacuacugacaucagcgaaaugggagcgaauuuuagagcagacaggguaauagacccuaggagauguuuaaagcccguaauauuaaaagacggaccugagcggguaauauuagcaggcccuaugccaguuaccgucgcaagugcugcacaacguagagguagaaucgguagaaaucacaauaaggaaggagaucaauauauuuauaugggucagccccucaauaaugaugaagaucaugcacauuggacagaggcaaagauguuauuagauaacauaaacacuccggaaggaauaauuccugcucuauucgaaccugaaagagaaaagucagcagcgauagauggagaguauagauuaaggggagaagcacguaaaaccuuugucgaauuaaugaggagaggggacuugccaguauggcugaguuacaaaguugcaucagagggauuucaguacucugauagacgcuggugcuuugauggugaaagaaauaaucaggugcuugaagaaaauauggauguagaaaucuggacuaaggaaggagaaagaaagaaauuaagaccacgauggcuagacgcgagaacuuauucggauccgcuugcauuaagagaauuuaaagaguuugccgcggguagacguagcguauccggagaccuuauauuggagauaggaaaauuaccacagcaccuaacucaaagagcccaaaaugcucuggacaaucucguaaugcuucacaauagugagcaagguggucgagcauaccgacacgcgauggaagaauugccggauacaauugaaacccuuauguugcuagcacuuauagcgguacuaacagguggagucacacuauuuuuccuaaguggacggggacugggaaagacgucaauagggcuccuaugugugauggcuaguuccguuuuauuguggauggcaucgguagaaccgcacuggauagcagcaucaauaauauuggaguucuuccucaugguauuacugauuccugaaccagauaggcaacggacgccacaggauaaucaacuugccuauguaguuauugggcuucuauucaugauauuaacuguggcugcaaacgagaugggguuacuugagacaacgaagaaagaccuaggcauugggcaugucgcaguugagaaccaucaucacgccacaauguuagacguagaccuacauccugcaucugcauggacauuauaugccgucgcaacgacgaucauaacgcccaugaugagacauacaauugaaaauacaacggcaaacauaucucuaaccgcuauugccaaucaagcggcaauacugaugggacuugacaaaggcuggccaauuaguaaaauggauauuggagugccauuacucgcccuagguuguuacagucagguaaacccacucacacuaaccgcggcugugcugaugcuuguugcgcacuacgcaauuauagggccaggccuucaagcuaaagcuacucgagaagcacaaaaacguacugcugccggcaucaugaaaaauccgacgguugauggaauuguugcgauagauuuagauccgguuguauaugacgcuaaauuugaaaaacaacucggucaaauaaugcuauugauuuuaugcacaagccaaauacuguugaugagaacaacaugggcgcugugugaguccauuacacuagcgacaggaccacuaaccacauuaugggaaggaaguccggguaaauuuuggaacacaacuauagcgguuucgauggccaacaucuuucgcgguaguuaucuagcuggagcaggacuugcauucucauugaugaaaucauugggaggcggucgcagggguacuggggcucaaggcgaaacauugggagaaaaauggaaaagacaacuaaaucaacugucgaaaucagaguucaauauauacaaaagaucaggaauaauggaaguugaucggagugaggcaaaagaaggacuuaaaagaggugaaaccaccagacaugcuguuucacgugggacugcgaaacuccgaugguuuguagagcgcaacuuaguuaaaccagaagggaaggucauagaccuaggguguggacguggcggauggucauauuauugcgccggacuaaagaaagucacugaaguaaaaggauacacuaaaggaggaccuggucaugaagaaccgauacccauggcuacguauggauggaaucucguuaaacuucauagcgguaaagacguuuucuucacaccaccagaaaaaugcgacacguuauuaugugauauuggagaaucuagcccaaauccuaccauagaagaaggcagaacauuaaggguacuaaaaaugguagagccaugguuaagagguaaucaauucuguauaaaaauacuaaacccauauaugccaagcguaguagaaacauuagagcaaaugcaacguaagcacggaggaauguuagucagaaacccacuaaguagaaacuccacccacgaaauguacugggugucuuguggcacaggcaauauuguuucggcaguaaauaugacuucaaggauguuauuaaauagauuuacuauggcucacaggaaacccaccuacgaacgcgacgucgauuugggagccggcaccaggcauguagcgguagaaccggaaguggccaaucuagacauaauuggacagagaauagagaauauaaagcaugagcauaaaucuacuuggcacuacgacgaagauaauccguauaaaacuugggcguaucacggaaguuaugaaguaaaaccuagugguucugccucuucuaugguaaacggcguagucaaacuuuugacuaaaccuugggaugugaucccaaugguuacucaaauugcuaugacggauacgacaccguuuggacagcaaagaguuuuuaaagaaaagguugauacucgaacaccaaaggcaaaaaggggcacagcgcaaauuauggagguuacugcaagguggcuauggggcuucuuauccagaaauaagaaaccacguaucuguacuagagaggaauuuacacgaaaaguaaggucuaaugcagcaauaggcgcuguauuuguagaugaaaaccaauggaacucagcaaaagaagcaguagaagacgagagauuuugggauuuaguccaaaaagaacgggaauugcauaaacaagguaaaugugcuacuugcguguacaauaugaugggaaaacgagagaagaagcuaggagaauuuggaaaggcaaaaggaaguagggccauaugguacauguggcuaggggcccgcuuccuagaauuugaggcuuuagguuuuaugaaugaagaccacugguuuucuagagaaaacucacuuucuggaguagagggugaaggucuacauaaauuaggcuauauccuacgcgacauuucgaagauaccaggaggaaauauguaugcagaugauacagcaggaugggauacacgaauuacagaagaugacuuacagaacgaggcuaaaauaaccgacauuauggaaccagaacaugcccuauuggccacuucaauauuuaaauuaaccuaucagaauaaaguaguucggguacaacguccggccaaaaacggaacaguuauggaugugauaucacgucgcgaucaaagggguucuggacaaguagggacauauggucugaauacuuuuacgaauauggaagcacaauuaauucgacaaauggagucagaggguauauuuuuaccuagugaauuagaaacccccaauuuagcagagagagugcucgacuggcuagaaaaacaugguguagaaagguuaaaaaggauggccauaaguggugacgauugcguagucaagccuaucgacgaccgguuugcuacggcauuaacugccuuaaaugauaugggcaaggugcggaaagacauuccccagugggaaccuucuaaagguuggaacgauuggcaacaagucccuuucuguucgcaucacuuucaucaacuaauuaugaaagacgguagggaaauaguagugccaugucgaaaucaagaugagcuaguagggagagcccgcguaagucaaggagcagguuggaguuugcgcgaaacugcaugucucggcaaaaguuaugcacagauguggcaauuaauguauuuccaccgucgagauuuaagguuagcagcaaaugcuaucugcagcgccgugccuguagauuggguaccuacuucccgaacaacuuggaguauccacgcccaccaucaauggaugacaacagaagauaugcuuagugucuggaauagaguauggaucgaggaaaaucccuggauggaagauaaaacgcauguaucauccuggggugaugucccguaccuuggaaagcgagaagaucaauggugcggcagcuugaucggacugacugcuagagcgaccugggcaucaaauauacagguagcaauuaaucagguacgacgacuaauaggaaacgaaaauuauuuagacuacaugaccuccaugaaacgcuucaaaaaugaaggugacccugaaggggcacuaugguaa

SEQ ID NO: 21955 - RNA, 9879 nt, Artificial Sequence
  derived and/or modified CDS sequence (opt6) from DENV-1__EU482520__SS-prME
ucuguuacgauguuguuaaugcuaaugccaacugcauuagcauuccaucuuacuacucgagguggagagccacacaugauuguaucaaaacaagaaagaggaaaaagccuauuauucaaaacuucggcgggagugaauauguguacauugauugcuauggaucuaggugaacucugcgaagacacaaugacuuauaaauguccgagaaucacagaaacggagccagaugauguggauugcugguguaaugcaacggacaccuggguuacauaugggacaugcucccaaacaggagaacauagaagagauaaaagaucagucgcauuagcaccccacguaggauuaggauuagaaaccaggacggaaaccuggaugaguucggaaggagcuuggaaacaaauccagcgaguugaaacaugggcgcuuagacauccgggcuuuaccguuauagcguuguuccuagcgcaugcuauaggaaccucgauaacacaaaaaggaauuauuuucauacuacuaauguuaguaaccccuucuauggcuaugcgauguguugguauagguagucgcgauuucgucgaaggauuaucaggcgcaacaugggucgacgugguauuggaacacggaucaugcguaaccacgauggcuaaggacaaaccaacauuagacaucgaacugcuaaaaaccgaagucacuaacccugcaguacuuagaaaauugugcauagaagcuaaaauuaguaacaccacaacagauaguagguguccaacucaaggggaagcuacucuaguagaagaacaagacgccaacuucgugugccguaggacauuuguugauagaggaugggguaauggauguggacuguucgguaaggguucacuaauaacuugugcuaaauuuaaaugcguaacgaaguuagaaggcaagauaguacaauaugagaacuuaaaauacucgguaaucgugacaguccacacuggagaucagcaccaagucgguaaugaaucgacugaacaugguacgacagccacgauaacaccucaagcgccaacuaccgaaauacaauuaacagacuacggugcgcuuacguuagauuguuccccaaggacagggcuagacuuuaaugaaaugguacuacuuacaaugagagaaaaaucauggcugguacauaaacagugguuuuuagacuugccgcuaccuuggacaaguggagccaguacaagucaggaaacauggaauagacaagaccuccuaguaacauucaaaacagcacacgcaaagaaacaagaaguuguaguucuuggaucacaagagggcgccaugcacaccgcguuaacaggagcuaccgaaauucaaacuagcggaacgaccaccauauucgcaggacaucuuaaaugcaggcucaaaauggauaaacuaaccuuaaaagggaugagcuacguaauguguacuggcucauuuaaguuggaaaaggaagucgcagaaacacaacaugggaccguucuaguacagauaaaauacgaaggaacugaugcuccuuguaaaaucccuuucucgacgcaagaugaaaagggcgugacccaaaauggaagauugauaacugccaacccaauaguuacagacaaggagaaaccugucaauaucgaagcugaaccuccuuucggggaaucguacaucgucauaggagcuggugaaaaggcuuuaaaauuaucuugguuuaaaaaggggagcagcaucggaaaaauguuugaggcgacggcacguggugcuagacgaauggcgauauugggagacacggcuugggacuuugguucaauaggagggguauuuacuucgguagggaagcuaguccaccaaauauuugguacagccuacgggguucuauuuuccgguguauccuggaccaugaagauaggaauaggcguuuuacuaacguggcuagguuuaaauagcagaucaacaaguuugucaaugacguguaucgccgugggccuaguaacacuguaucuuggagucaugguacaagcagauaguggguguguaauaaauuggaaagguagagaauuaaaaugcggaucggggauauuugugacaaacgaaguccacacguggacagaacaauauaaauuucaagccgauagccccaaacguuuaucagcagcaauaggaaaagcaugggaagagggaguguguggcauuaggucagcaacacgauuagagaauaucauguggaaacaaauauccaaugaacucaaccacauauugcuugaaaacgacaugaaauucacaguggugguaggugauguugccggcauacuagcgcaagggaagaaaaugauucgaccacaaccgauggaauacaaauauaguuggaagucauggggaaaagcuaagauaaucggagcagauguccaaaauacuaccuuuaucauagacggacccaauacgccugaaugcccagacgaucaaagagcuuggaauauuugggaaguugaagauuacggauuuggaauauucacaacgaacauuugguuaaaacucagggauagcuauacgcaagucugugaucacagacucaugucggccgcaauaaaggauaguaaagcagugcacgcagacaugggauauuggaucgagagugagaaaaaugaaacguggaaacuugcaagagccagcuucauugagguaaaaacuugcaucuggccaaaaucacauacgcuauggucaaauggcguauuggaaucagaaaugauaauaccaaaaaucuacggagggccgauuucucaacauaauuacagaccaggcuauuucacucagacugccggaccuuggcauuuaggaaaauuggaacucgauuucgaucuaugugaggguacaaccguuguuguagauggacauugcggaaaucgcgggccuucccugcgaacaacaacuguaacuggaaaaauuauccaugaauggugcugccgcucuuguacacuucccccauugcgguuuaggggcgaagauggcugcugguaugguauggagauacgaccuguuaaggagaaagaagagaauuuagugaaauccaugguauccgcaggaagcggagagguggacucauuuagucuaggacucuuaugcauuagcauuaugauagaagagguaaugaggucgagguggagucgcaagauguuaaugaccggaauauuagcgguguuuuuccuacuaaucaugggacagcucacuuggaacgaucuaauacgauuauguauuaugguuggcgcaaacgccucugaucgaaugggaauggguacaacauauuuagcacuaauggcaacuuucaaaaugcggccaauguuugcugucggauuauuauuucgcagguuaacaaguagagagguucuauuacuuacuauaggauuauccuuaguagcaucaguggaauuaccaaacucuuuggaagaacuaggagacggucuugcaauggggauuaugauccuaaagcuccugacagauuuucaaagccaccaauuaugggcgacccuauuaucacucacauucauuaaaaccacauucuccuuacacuaugcauggaaaaccauggcaaugguuuuaucgaucgugaguuuauucccccuuuguuugagcacuacaagccaaaagaccaccuggcuaccaguccuuuuaggcagccuaggauguaaaccauuaacaauguuuuuaauugcagaaaacaaaauaugggggcgaagaaguuggccuuuaaaugaaggaauaauggcaguaggaauugucucuauucuacucaguucauugcucaaaaaugaugugccuuuagcuggaccauuaauagcaggagggauguuaauugccuguuaugucauaagcgggagcagcgcggauuuaucacucgagaaggcggcagaggugucaugggaagaggaagcugaacauucuggugcaucucauaauauauuaguagaaguccaagacgauggaaccaugaaaauuaaggaugaagaaagagacgacacucuaacaauauuauugaaagcaaccuugcuagcagucucagguguuuauccccuaucaaucccugccacgcucuuuguuugguacuuuuggcagaaaaagaaacaaagaaguggcguauuaugggauacucccucaccuccugaagugggacgugcggucuuagaugaugguauauacagaauaaugcagagaggacugcucggaagaucgcaagugggaguuggugucuuccaggaaaacguauuucauacaauguggcacgugaccagaggcgcaguuuuaauguaucaggggaagcgacuagaaccuucaugggccagugucaagaaagaucugauaucuuacggcgggggauggagacuacaagggucauggaauacaggagaagagguacagguaauagcgguagaaccuggcaaaaauccuaagaauguccagaccgcuccugggacguuuaagacaccugaaggagaaguaggcgccauugcacuagauuucaaaccuggaacuucuggaucuccuaucguuaauagagagggaaaaauaguaggucuauacgguaaugggguagucacaacaagugguacauauguaucagcuaucgcacaagcuaaagcuagucaagaaggcccucucccagaaauagaggaugaaguauuccggaagagaaacuuaacaauaauggaucuucaucccggcuccgggaagacaagacgauaucuaccagcaauaguaagagaagcgaucaaaagaaagcuacggaccuugauacuagcacccacacgcguaguagccuccgagauggccgaggcauuaaaaggaaugcccauacguuaucaaacuacggcaguaaaaucugaacacacaggcaaggaaauaguggaucuaaugugccacgccaccuuuacuaugaggcuauuaucacccguacgugugccuaacuacaacaugaucauuauggacgaggcgcauuuuacagacccaaguucuauagcagcgagaggauauauuagcacgcgggucgguaugggggaggcagcagcaauauuuaugacagcuacacccccagguaguguugaggcauucccccaaucaaacgcaguuauacaagacgaagaaagagauauacccgaaagaagcuggaacaguggguaugaauggauaacggauuucccuggaaaaaccguaugguuugugccuaguauaaaaagcggaaaugacauagccaacugcuuacgcaaaaacggaaaaagggucauacaacucucgcguaagacuuuugacacagaauaccagaaaacuaagaacaaugacugggauuaugugguaacuaccgauauaucugaaaugggugcaaauuuuagagcugauagaguaauagacccgagacgguguuuaaaacccguaauuuugaaagaugguccugaacggguaauccuggcagguccaaugccuguuacuguugccagugcggcacaaagacgcgguagaauagguaggaaccacaauaaagaaggagaucaauauauuuacaugggucagccacucaauaaugacgaagaccaugcccacuggaccgaagcaaagauguuguuagacaacauaaacacaccagaaggaauaauacccgcccuauuugagccagaaagggagaaaagcgcggcgaucgauggugaauauagacuucggggcgaagcucgaaaaacauuuguugaguuaaugaggaggggugaccugccaguuugguuaucauacaaaguugccagcgaaggcuuucaguauucugaccgacggugguguuuugauggugaacgaaacaaucaaguauuggaagaaaacauggaugucgagauauggaccaaggaaggugagcgcaagaaacuaaggccacgauggcucgaugcaaggacuuacucagacccauuagcucuuagagaguuuaaggaauuugcagcaggacggcguuccguaagcggcgaucugauccuagagauugggaaguugccccaacaccugacacaaagggcacaaaaugcauuggauaauuuaguaauguuacauaauagcgaacaaggaggacgagcauaccgacacgcuauggaagaacuaccagacacgauagaaacauugauguuacuugcacuaaucgcaguguuaacaggcggagugacacuauucuuuuuaucugguagaggucuaggaaagacgagcaucggacuucugugcguaauggcuagcaguguacuucuguggauggcuaguguugaaccgcauuggauagcggcaucuauuauuuuggaauuuuucuuaaugguccuacugauaccagaaccggaucgucaaaggacaccacaggauaaucaauuagcguacguuguaauaggacuuuuauuuaugauacuaacgguugccgcgaaugaaaugggauuacuagaaacgacgaagaaagaucuaggcauaggucacguugccguagaaaaccaucaccacgcagccaugcuggauguggaucuacauccugcaucagcuuggacacuuuacgcgguggcaacuaccauuauaacaccuaugaugagacauacaaucgaaaacacaacggcuaauauaagccuuaccgcgauagccaaucaagccgcgaucuuaaugggauuagauaaaggauggccaauuaguaaaauggauauuggaguaccgcuguuagcuuuagguugcuauucgcaggucaacccacuuacucuaacagcagcuguacuaauguuaguagcacauuaugcaauaaucggcccuggucuacaagcuaaggcaacgagagaggcacagaaacgcacugcagcgggaauaaugaaaaacccuacagucgacgguauaguagcaauagacuuagauccagucguauacgacgcaaaauuugaaaagcagcugggacagauaaugcuacuuauuuuaugcacgagccaaauccuacuaaugagaacaacgugggcgcucugcgaaucuauuacgcuugcaacuggaccacucacaacauugugggaaggaucuccggguaaauuuuggaacacaacgauugcuguuucaauggcaaauauuuuucgcggaaguuaccuagcaggggcaggacuugccuucucauugaugaaauccuuaggcggaggacgacgcggaacaggagcacaaggagagacucuuggagagaaauggaaacgacaauugaaccaauuauccaagucagaguuuaauacauacaaaagaucugggauaauggaaguagauagaagugaggcuaaggagggacuaaaacguggggaaaccacaaaacacgcgguaucacgugguacggccaaacucaggugguuugucgaacgcaaucuagucaaaccugaagguaagguaauugauuugggaugcgggagaggaggcuggaguuauuacugcgccgguuuaaagaaaguaacagagguaaaaggguauacgaaagggggcccaggacacgaagaacccauuccaauggcaacauacggauggaacuugguaaaacuccauagcgguaaagaugucuucuuuaucccuccugagaaaugugauacacuacucugugacauaggugagaguagcccuaauccaacgauugaagaaggccggacuuuacgcguacuuaaaaugguagagccauggcugcgaggaaaccaauuuugcaucaaaauauuaaaucccuauaugcccagcgucguagaaacauuggaacagaugcaaagaaaacacgggggaauguugguaagaaauccccuaucgagaaauucaacucaugagauguauuggguuucguguggaacaggaaacauagucuccgcgguuaauaugacaucucgcaugcugcucaacagguuuacaauggcacauagaaaacccacauacgagcgcgacguagauuuaggcgcgggaacacgucauguugcaguagagcccgaaguagccaacuuagauauuauuggacaaagaauugaaaacauaaaacacgagcauaaaucuacuuggcacuaugaugaagauaauccuuauaaaacgugggcuuaucaugguagcuaugaaguuaagccaucgggcagcgccucgucaaugguuaaugguguaguaaaacuauuaacaaagcccugggacgugauaccgaugguaacacaaauagccaugacggauacaacaccauuuggucagcagcguguauucaaggaaaagguugacacuagaacaccuaaagcaaaaaggggaacagcucagauaauggaaguaacagcaaaauggcuuuggggcuuccuaucgagaaacaagaaacccagaaucuguacaagagaagaauuuaccaggaaggugcggucaaaugcagcaauaggugcugucuuuguagacgagaaucaguggaacucagcgaaggaagcgguugaagacgaacguuuuugggaucuugugcaccgagaaagggaacuucauaaacaaggaaaaugcgcaacauguguauauaacaugauggguaaacgagagaagaaauugggcgaauuuggaaaagcuaagggguccagggccauuugguauaugugguuaggugcuagauucuuggaguuugaagcacugggguuuaugaacgaggaucauugguuuaguagagaaaacucgcucagcggaguagaaggcgaagggcuccauaaauuaggguauauccuccgugauauuucaaauauacccggcggaaauauguacgcggaugauacagcaggcugggacacaaggauuacugaggaugaucuucaaaaugaggcuagaauuacagauauuauggaaccagaacacgcacuucuagcuaaaucgauauuuaaauuaacauaucaaaauaaggugguaagggugcaacggccugcuaaaaauggcacuguaauggacguaauaaguagaagagaccaacgaggaucagggcaaguugggacguacggccugaacacguuuacuaacauggaagcacaacuaauaaggcaaauggaaagugaaggaaucuuuuccccgucagaauuagaaaccccaaaucuagcagaaagaguauuggacuggcuugaaaaauauggaguagaacggcugaaaaggauggcuaucucaggagaugacuguguaguaaaaccaauugaugaccgguucgccaccgcguuaaccgccuuaaaugacauggguaaaguaagaaaagauaucccucaaugggagccaucaaaagguuggaaugauuggcaacaagucccauuuugcucacaccauuuccaucaauuaauaaugaaagacggacgggagaucguaguuccuugccguaaccaggaugagcucguagggagagcaagggucagucagggagcgggauggagucugagggagacagcgugucuuggcaaaagcuaugcacaaauguggcagcuaauguauuuucacagacgugaccuacgccuugcagcaaacgcuauauguagugcagugcccguugauuggaucccgacaucuagaacaacauggaguauccaugcucaccaccaauggaugacaacagaagauauguuauccguauggaacagaguauggauagaagagaacccauggauggaagauaaaacucacauauccagcuggggcgauguuccauacuuagguaaaagggaagaucaauggugcgguaguuuaaucggauugacugcuagagcaacgugggcaacuaacauucaaguugcuaucaaucaggugaggagauuaauagguaaugaaaauuauuuggacuauaugacgagcaugaaaagauucaaaaacgaaucugacccagaaggagcgcuaugguaa

SEQ ID NO: 21956 - RNA, 9879 nt, Artificial Sequence
  derived and/or modified CDS sequence (opt6) from DENV-1__EU482521__SS-prME
agcguuaccauguuacuuaugcuaaugccuacggcauuagcguuucauuugacgaccagggguggggaaccgcauaugauaguaaguaaacaagaacggggcaaaucucuauuauuuaaaacaagugcagggguaaacauguguacguugauagcaauggaccucggugaauuaugcgaagauacaaugacuuacaaaugcccgagaaucacggaagcugaaccggacgauguagauuguugguguaacgcuacagauaccugggucacauaugguacauguucucaaacaggagaacacagacgagauaaacgcagcguugcacuagcaccucacgucggacuuggauuagaaacaagaaccgaaaccuggaugucaagugaaggggcuuggaaacaaauccaacgaguugagacaugggcacuacgacauccuggguucaccguuauagcccuuuuucucgcgcaugccauaggaacgaguauaacccaaaaaggaauaauauucauucugcuuaugcucguaacgccaaguauggcaaugcggugcguagguauugguagccgagacuuuguagaagguuuaaguggagccacguggguagauguagucuuagagcauggaucaugcguaacuacuauggcgaaagacaaacccacccuggauauugagcuuuuaaaaacagaagucacgaacccagcuaucuugcgaaaacuauguauugaagcgaaaauauccaacacaacuacugacaguaggugcccaacgcaaggcgaagcgaccuuaguggaagaacaagaugcaaauuuugucuguagacguaccuuuguagaucguggauggggcaacggcugcggccuuuuuggcaaaggauccuugauuaccugugcaaaauucaaaugcguaacgaaacuagaaggaaaaauaguacaauaugaaaaucucaaauauuccgucauuguuacgguccacacaggagaccaacaccaaguggguaacgaaucaacugaacaugguaccaccgccacaauuacaccgcaagcuccaacuacagaaauacaacuaacugauuauggcgcauuaacacuagauuguucaccccguaccgguuuagauuucaaugaaaugguuuuauugacaaugaaagagaaaucauggcuaguacacaaacaaugguuuuuagauuuaccauugccauggacaucaggggccucaacgucucaagaaacauggaaccgacaggaucuauuaguaacuuuuaaaacagcacaugcgaagaaacaggaaguaguuguucugggaucccaagaaggagcaaugcacacugcguuaacaggagcgacggaaauacaaacgucuggaacaacgacgauauucgcaggacaucucaaauguagauuaaaaauggauaaguuaacacucaaaggaauguccuauguaaugugcacaggcuccuucaaauuggagaaagagguugcugaaacacaacauggcacaguucuaguacaaauuaaauaugaagguacagaugcuccuugcaagauuccguuuaguacacaggaugaaaagggcguaacgcaaaacggacgucuaauuacggcaaauccuauuguaacggauaaggaaaaaccagugaauauagaagcagaaccucccuuuggugaaaguuauauaguaauuggggcuggugaaaaggcuuuaaaacuaaguugguuuaagaagggaucgaguaucggucgaauguucgaggccacugccagaggagcacgacggauggcaauacuuggagauacggcuugggacuucgggaguauaggcggggucuuuacaagcguaggcaaauugguucaucaaaucuucgguacggcauauggcguguuauucaguggagucucauggacaaugaaaauagguauuggcguacuauuaacuuggcuaggucugaacagcaggagcaccuccuuuaguaugacauguauugcagugggacuuguuacccuauaucuggguguaaugguccaggcagauucaggaugugugaucaacuggaagggacgcgaacugaaaugcgguucaggcauuuuugucacaaaugaaguacauacguggacugaacaauauaaauuccaagccgauaguccaaagcguuugucggcagcaauuggaaaggcuugggaagagggaguuugugguauucgaucagcgacacgucuugaaaauauuauguggaaacaaauuaguaaugaacuuaaucauauacucuuggaaaacgauaugaaguuuacagugguagugggagacguagcugguauucuugcgcagggcaagaaaaugauuagaccccagccaauggaauauaaauauucauggcgaucaugggguaaagcuaagauaauaggcgcagaugugcagaauacuacguuuauuaucgauggcccuaauacaccagagugcccagacgaucagagggcuuggaacauuugggagguugaagauuauggauuuggaauauucacuaccaauauuuggcucaaauuacgugauucuuauacccaaguuugugaccauagacuuaugucagcugcgauuaaagacucgaaggcaguacaugcggauaugggcuauuggauagaaucagagaaaaaugagacauggaaauuagcacgagcuucguuuaucgaagucaaaacgugcauuuggccaaaaagccauacguuauggagcaacggaguguuggaaagugaaaugauuauaccaaaaauuuauggagggccuaucagccaacacaacuaucgaccagguuacuucacucaaacagcgggaccuuggcaccuugggaaauuggaauuggauuuugaucuuugugaaggaaccacuguuguuguugaugaacacuguggaaacaggggcccgaguuuaagaacaacuacgguaacagggaagauaauucaugaauggugcugucgaucguguaccuugccuccucugcgauuucggggcgaggaugguuguugguauggaauggaaauacguccggucaaagaaaaagaagaaaacuuagucaagucaauggucucugcagguagcggagagguagauagcuuuucucuugggcuuuugugcauaucgaucaugauagaagaagugaugagaucuagauggagccgaaaaauguuaaugacagggacgcucgcaguauucuuacuacuuauaaugggccaacuaacauggaacgaucuaauacgccuuuguaucauggucggcgccaaugccagugacagaaugggcauggggacuacuuaucuagcguuaauggcaacauucaaaaugagaccaauguucgcagucggguugcuguucagaagacuuacaagcagggaagugcuacuauugacaauaggauugagucucguagcaaguguagaauuaccaaauucguuggaagaacucggcgauggauuagcaauggguauaaugauauuaaaacuucuuacugauuuccaaucccaucaacuuugggcgacauuacucagccugacguuuauaaaaacuaccuucagucuucauuaugccuggaagacaauggcgaugguguuaucaauaguuucacuuuucccuuuaugucugaguacgacaucucagaagacuaccuggcuaccuguucuuuuagguucacucgggugcaagccccuaaccauguuuuuaauugccgaaaacaaaauaugggggcgccgcuccuggccccuuaacgaagguauaauggcuguugguauaguuaguauacuuuuaucaucguuacuaaagaaugauguuccuuuagcgggaccguuaauugcagggggaaugcuuauugcgugcuauguuauuucagguucuucagcggaucuuagccuagaaaaagcugcagaagugaguugggaagaagaagcggaacacaguggggcgucacauaauauauuaguggaaguacaagaugacggcacuaugaaaauuaaagaugaagaacgugaugacacucuaacgauuuuauuaaaagcgacuuuauuagcagugagugggguauacccgcuaagcauucccgcaacacuauuuguaugguacauauggcagaagaagaaacagcgaucaggaguauuaugggauacuccgucaccuccggaaguugaacgugcuguucuugacgacggaauauaucguaucaugcaaagaggacucuuaggaagaucucaagucggaguuggagucuuucaagaaaacguuuuccacacaauguggcauguaacucguggugcaguacuaauguaccaagggaagagauuggaaccaucgugggccucugucaagaaagaccuaauuucauacggaggaggcuggcggcuucaaggaagcuggaacacaggagaggagguacaaguaauagcaguugaaccugguaaaaaucccaaaaacguccaaacugccccgggaacuuucaagacuccggagggggaagucggagccauagcccuagauuucaaaccuggaacaucgggcuccccuaucgugaauagagagggcaagauuguggguuuauacggaaauggagucguuacaacaucgggcacuuauguuagugcaaucgcacaagcaaaagcgucacaagaagguccauuaccggagauugaagacgaaguuuuuagaaaacggaauuuaacuauaauggaucuccauccagguucuggaaaaacaagaagauaccuaccagcaauaguucgcgaagccauaaagcguaaauugagaacccucauacuagcuccuacaagaguuguagcuucagaaauggcagaggcauuaaagggcaugccuauaagauaucaaacgacagcugucaaaucggaacauacagguaaagaaauugucgaucucaugugccaugccacuuucacuaugagauuauugucuccaguuagaguaccuaacuacaacaugauuauuauggaugaagcucauuuuacggacccuaguaguauagcagcaagggguuauaucucaacacguguugguaugggagaagcagcagcuaucuuuaugacagcaaccccucccggaagugucgaggcuuucccccaaucuaacgcgguaauccaagacgaagaaagggauauucccgagagaaguuggaauaguggauaugaauggauaacagacuucccuggaaaaacuguaugguucgucccauccauaaagagugguaacgauauagcaaauugucuaaggaaaaauggaaaaagggugauccaacuaucccgaaagaccuucgauacggaauaccagaaaacuaagaauaacgauugggacuauguggucacaacagauaucucagaaaugggagccaacuucagagcagauagagucaucgauccacgucgaugcuuaaaaccagucauacucaaagauggaccagagcguguaauucuagcaggucccaugccaguaacaguagcaagugcagcacaacguagagggcggauagguagaaaucauaacaaggaaggagaccaauacaucuauauggggcaaccccucaacaaugaugaggaucacgcgcacuggacagaagcuaaaauguuacuagauaauauuaacacuccagaagguauuauacccgcccuauuugaaccugaacgcgagaaaagcgcagcaauagacggcgaauacagacugaggggugaggcaagaaaaacuuuuguagaauuaaugagaaggggcgaucuaccgguuugguuaucauacaagguagccagcgaagguuuucaauacucagaucgaaggugguguuucgacggggaacguaauaaccaaguuuuagaagaaaacauggauguagaaauauggacaaaggagggugaaaggaagaaauuacgaccuaggugguuagacgcacguacuuauagcgauccguuagcgcuaagagaguucaaagaauuugcggcaggccgccgaucaguaucaggcgauuuaauacucgagaucggaaaauuaccacaacauuuaacccaaagggcacagaaugcuuuagacaaccuagucaugcuucauaauucggagcaaggaggaagggcauacagacaugcuauggaagaacucccagacaccauugaaaccuugaugcucuuagcgcuuaucgcaguauuaacaggggguguaacacuauucuuucuuuccggucgaggauuaggaaagacgucaauaggucuuuuguguguuauggcuucaaguguauugcuauggauggccucaguugaaccacauuggauagcagcaaguaucauauuggaguucuuccuaauggugcuccugaucccggaaccagacagacaacgaaccccacaggauaaucagcuugccuauguggucauaggccugcuauucaugauuuugaccguagcugccaacgaaaugggauuauuagagacaacuaaaaaggaucuaggaauugggcauguagccguuggcaaucaucaucaugccgccaugcuagaugucgauuuacauccagcgucggcguggacauuauaugcuguggcgacgaccaucauaaccccuaugaugagacacacaaucgaaaauacgacagccaauaucucccugacugcaauagcuaaccaagcggccauucuuauggguuuggauaaagguuggccaauaaguaaaauggacauagguguaccucuauuagcauuagguugcuauagccaagucaauccauuaacccuuacagcagccguacuaauguuaguugcucacuaugccauuaucggcccaggacuccaggcuaaagcaacaagagaagcucagaaacggaccgcagcgggaauaaugaaaaacccgacaguagacggcauaguagcuauagaccuugacccugucgucuaugaugcaaaauucgaaaagcaacuaggucagauuaugcuauugauacuuugcacaucucaaauuuuauuaaugcgcacaacaugggcuuugugcgagagcauaaccuuagcaacgggaccguuaacgacgcugugggaagguagcccggggaaauuuuggaacaccacaauagcagucucuauggcaaacauauuuagagggagcuaucuggcuggugcaggauuagcguuuucccugaugaagucuuuggguggcggcagacgagguacuggugcacaaggcgaaacacuuggcgaaaaguggaaacgucaacucaaucaauuaagcaaaucugaauuuaauacauauaagagguccggcauaauggaaguagaccgaucugaagccaaggaaggacuuaagcgaggggaaauuacaaaacacgcuguaucgagggguacagcuaaacuucguugguuuguggaaagaaacuuagucaaaccagaagggaaaguaauagaucuagguugugguagaggagguuggucguacuacugcgcuggacuuaagaaaguaacugaaguuaagggguacaccaaaggaggcccggggcacgaagaaccuauacccauggccaccuauggguggaaccuagucaagcuacauucuggcaaagacguauucuuugugccgccagaaaaaugugauacauuauugugugacauaggagaaucuaguccuaauccaacuaucgaagaaggucgcacgcuacggguucucaagaugguagaaccguggcuucgcgggaaccaauucuguauaaaaauacuuaauccguacaugcccucuguaguagagacccuggaacaaaugcagaggaagcauggaggcaugcuggucagaaauccguuaucuagaaauucuacucaugaaauguauugggugucaugugguacuggaaauaucguuucagcuguaaacaugacuucaagaaugcuacucaaccguuuuacgauggcgcauagaaagccuacuuacgaacgagauguagaucuaggagcaggaacuagacauguagccguugaaccagaaguagcuaaucuagacauuauuggacaacgcaucgaaaauauaaaacacgaacacaagucaacauggcacuacgaugaggauaauccauauaaaacaugggcguaucauggauccuacgaaguaaaaccgagcgguagcgcuucaucgauggugaaugguguuguaaaacuuuugacuaaaccuugggaugucauaccuauggugacccaaauugcaaugaccgacaccacgccauucggucagcaaagaguauuuaaagaaaaaguagauacaagaaccccuaaagcaaagagaggcacugcacagaucauggagguuaccgccaaauggcugugggguuucuuaagcagaaauaagaaaccgcgcauuuguacucgagaggaauuuacacggaaagucagaaguaaugccgccauaggggcuguuuuuguagacgagaaucaauggaacucugcaaaagaagcaguagaagacgagcguuucugggauuuggugcaucgcgaaagagaauugcauaaacaagguaaaugcgccacauguguguauaauaugaugggcaagagggagaagaaauuaggugaauuugggaaggcaaaaggaagccgagcaauaugguacauguggcucggugcacgauuuuuggaguucgaggcacuagguuuuaugaacgaggaucauugguuuaguagggaaaacucacuuucggguguugaaggagaaggguuacauaaguugggauacauacuacgagauaucagcaaaauaccgggugggaauauguaugcugaugacacagccggcugggauacacgaaucacagaagacgaucuacaaaaugaggcccgaaucacggauaucauggagccagaacaugcacucuuagcaaagaguauauucaaacugacguaucaaaacaaaguuguaagaguacaaaggccggcaaagaauggaaccguuauggaugucauaucacgaagggaccaaaggggaucgggacaaguggguaccuauggccuuaauacuuucacgaacauggaagcacaacuaauccgacagauggaauccgaagggaucuucuccccguccgaacucgaaacgccaaaucuagccgaacggguacuagauuggcucgaaaaauaugguguagaaagauugaaaagaauggcaaucucaggugaugacugcguaguuaaacccauagaugacagauucgcgacagcauugacugccuuaaaugacaugggaaagguucgaaaagacauaccucaaugggaaccuuccaaaggguggaaugacuggcaacaagucccuuuuuguucucaucacuuucaucaauuaauaaugaaagaugguagagaaauaguggugcccuguagaaaucaggaugaacuugucgguagagcucguguuucccaaggugcaggauggagcuuaagggaaacggcauguuuaggaaaaaguuacgcccaaauguggcaauuaauguacuuucaccgccgagacuuacggcuugccgccaacgcaauauguuccgccgucccagucgauuggauuccaacaucaagaacuacauggucuauacaugcgcaucaucaauggaugacgacugaagacaugcuaucaguauggaaucgaguauggauugaagagaacccauggauggaagauaaaacccauauuaguucauggggagauguuccauauuuggguaaaagggaggaucaauggugugguucauugauaggccuuacggcaagagcgacgugggcgacaaauauucaaguugccauaaaucaaguaagaagauugauuggaaacgaaaauuauuuagauuauaugacgucaaugaaaagauuuaaaaacgaaucggaucccgaaggcgcacuaugguaa

SEQ ID NO: 21957 - RNA, 9879 nt, Artificial Sequence
  derived and/or modified CDS sequence (opt6) from DENV-1__EU482523__SS-prME
aguguaacuauguuacucaugcuuaugccuacggcucucgcuuuccaccuuaccacgcggggcggugaaccucauaugaucguaaguaaacaagaacguggcaaaucacuacuauucaaaaccucugcgggagugaacaugugcacguugauagcaauggaccuuggagaacugugugaagauaccaugacguacaaauguccacgaauuacggaaacugaaccugaugacgucgauuguugguguaacgcuacugacacuugggucacuuauggcacauguucacaaacaggcgaacaucgacgagacaaacguucgguugccuuagcuccgcacgucggucucggcuuagagacaagaaccgaaacauggaugaguucagaaggggcauggaaacagauacaaagaguagaaacaugggcacuucgacaccccggcuucacagugaucgcgcucuuucuagcacaugcgauuggcacaucuauaacgcaaaaagguauaauuuuuaucuuacuuauguuaguaacgccuucaauggcgaugagaugcguagggauagguucacgagauuuuguugaaggacucucaggugcgaccuggguagauguagugcucgaacauggaucaugcguuacuacuauggcaaaagacaaaccuacauuagacauagagcuacucaaaacagaaguaacaaauccagcuguauuacgaaaacucuguauugaggcaaaaauuagcaacacaacuacagauucgcgcuguccaacacagggcgaagcaacguuaguugaagaacaagaugcuaacuucguauguagaagaacauucguugaucgaggcuggggaaauggauguggacuauuugggaaagguagccuuauaaccugcgcuaaauucaaauguguuacuaaacuagaggguaaaauaguacaguacgaaaauuuaaaauauagugugauugucacagugcacacuggugaccagcaucaagucggcaacgagucuacagagcacggaacgacagcuacaauaacuccucaagcuccaacgaccgaaauacaauuaacagauuacggcgcuuuaacccucgauuguaguccuagaacaggauuagauuucaaugaaaugguauuacuaacaaugaaagagaaaaguuggcucgugcacaaacaaugguuuuuggauuuaccucuaccuuggacaaguggggcuaguaccucacaagaaacauggaaucggcaagacuugcuaguaacuuucaaaaccgcucacgccaaaaagcaagaaguugugguuuuagguucccaagaaggugcaaugcauacggcacuaaccggagcuacggagauacaaacauccggaacaacaacaauauuugcgggacauuugaaaugucgauugaaaauggauaaauuaacgcuuaaagggaugucuuacgucauguguaccgguaguuuuaaacuugagaaagagguagcagaaacacaacauggaacggucuuagugcagaucaaauaugaaggaacagacgcgccaugcaaaauuccauuuucaacacaggaugagaaaggcgugacacagaauggacgauuaauuacugcaaauccaauaguaaccgauaaagagaaaccaguuaauauagaagcagaaccuccauucggagaaucuuauauuguuauuggagcaggcgagaaggcccugaaacuaucuugguucaagaaagggagcucuauugguaaaauguucgaagcaacagcacgcggugcgagaagaauggccaucuuaggugacacagcaugggacuucggaucgauaggaggagucuucacuucgguaggcaagcuaguacaccaaauuuucgguacugcauacgguguauuguuuucuggaguaucuuggacaaugaaaauaggcauuggaguacuucuaacaugguuagguuuaaauaguagaaguacaaguuuauccaugacauguauagcaguaggacuuguaacccuuuaucuuggaguuaugguacaagcugauucuggauguguuaucaacuggaaagguagagaauuaaaauguggaagugguauuuuuguuacgaacgagguucauaccuggacggagcaauauaaauuucaggcagauuccccaaaaagauuaucagccgcaaucggaaaagccugggaagagggagucugcggaaucagaucagcgacacgucuugaaaacauuauguggaaacaaauaaguaacgaacuaaaccauaucuuacuggaaaaugacaugaaauuuacaguggugguuggagacgucgccggaauacuugcucaggguaagaaaaugauaagaccacaacccauggaauauaaguacucauggaaaucauggggcaaagcaaaaauaauuggagcagauguucaaaacacuacauucauaauagauggaccaaauaccccugaauguccagaugaccaaagagcuuggaauauaugggaaguggaagauuauggauuugguaucuuuacaacaaauauauggcugaaguugagagauagcuauacacaagucugugaucaccgacuaaugagugcugcuauaaaagacucaaaagcaguucacgcugauauggguuauuggauugagagugagaaaaaugaaacuuggaaauuagcgagagcguccuuuauugaagugaaaacauguauauggccgaaaagccauacacuauggaguaauggcguguuagaaagcgaaaugauaaucccuaaaauuuacggaggaccuauuagucaacacaacuauagaccgggauauuucacccaagcggcuggucccuggcaucuuggaaaguuggaacuagauuuugaccuaugcgaaggaacuacaguaguugucgaugaacauugcgggaaccgcgggccuucguuacgaacaacaacaguaacuggaaaaauaauacaugaaugguguugucgaucguguacauugccgccauugcgguuucgaggcgaggauggcuguugguacgguauggagauuagaccaguaaaagagaaggaagaaaaucuagugaaaagcaugguaucggcgggaaguggagaaguggacaguuuuagcuuaggauuacucugcauuagcauuaugauagaggaaguaaugcgaaguagauggucaaggagaauguugaugacagggacuuuagcaguauucuuccuauuaauaaugggucaguuaacuuggaaugaccuaaucagacuaugcauaauggucggagcaaacgcgagcgaucgaaugggcauggguacaacuuacuuagcacuaauggcuacuuuuaaaaugagaccaauguuugcugucggucugcucuuucgaagacugacaagucgcgaagucuuacuacuaacuaucggcuuguccuuagucgccucuguagaauuaccgaauagucuggaagaacuuggugauggguuggccauggggauuaugauucugaaacuacuuacagauuuucaaagucaucaacugugggcgacacuguuauccuuaacauuuaucaaaacgaccuuuucucuacauuacgccuggaaaacaauggcgaugguacuaucgaucgugucucuguucccauugugucuuucaacgacaucacagaagacuacuugguuaccaguacuauuagguucuuuaggauguaaaccgcucacgauguuucuaaucgcagaaaacaaaauuugggguagaaggagcuggccacucaaugaaggaauaauggcuguagggauuguuucuauuuuguugucaucccuccucaaaaacgacguaccauuagccggaccccucauagcgggaggaaugcuuaucgccuguuauguaauaagcggauccucagcagauuuaagccucgaaaaagcugccgaagucuccugggaagaagaggcagaacauagcggugcaagucauaauauauuaguggaaguacaagaugaugggacgaugaaaauaaaagaugaagaacgugaugauacgcuaacgauucuacugaaagcaacacucuuagcaguaucaggaguuuacccccuaucuauaccugcuacacuauucguuugguacuucuggcagaagaagaaacaaagaagcggcguccuaugggauacgccgagcccuccugaaguagaacgagcggucuuggaugacggaauuuaucguauaaugcaaagaggauuacugggcaggucacaaguaggcgugggaguauuucaggaaaauguuuuccauacaauguggcauguuacuagaggggcgguucugauguaucaaggaaaacgucucgaaccuaguugggcaucaguuaagaaagaccuaaucucuuacggaggugguuggagauuacaagggucauggaauacaggugaagaaguucaaguaauagcaguagaacccggcaaaaauccuaaaaauguacaaacggcuccuggaacauuuaaaacgccugaaggcgagguuggagccauagcauuggacuucaagccaggcacuagcggaagcccuaucguaaauagagaaggaaagauagugggucuauauggaaacgguguuguuacgacaucuggaacuuaugucucagccauagcccaggcaaaagcaucccaggaaggaccccucccggaaauagaagaugaaguguuucguaagaggaauuugacaauuauggaucuacauccagguucugguaagacuagacgcuacuuaccagcaauaguaagagaagcuauaaagaggaaauuacguacacuuauuuuggcuccaaccagagugguugcaucugaaauggcagaggcgcuaaaaggaaugccaauacgauaucagacaaccgcgguuaagucagaacauaccggaaaagaaauuguugauuuaaugugccaugcgacauucacgaugagacuacuaagcccgguucgcgugcccaauuacaauaugauuauaauggaugaagcacacuucacagaucccagcucuauagccgcuagaggcuauauaucaacucgaguuggaaugggagaagcagcugccauauucaugacagccaccccaccgggaucagucgaagcguucccccagucgaaugcaguaauacaggacgaagaacgugacaucccagaaagauccuggaauagcggguaugaguggauaacagacuuucccggcaagacuguaugguucguaccaaguauuaaaagcggaaacgauauugcaaacugccuaaggaaaaacggaaagagaguaauacaacuaagucgcaaaacguuugacaccgaauaccagaaaacuaaaaauaaugacugggacuaugucgucaccacagauauaagugaaaugggagccaacuuuagagcagacagaguuauugacccgcggagauguuuaaaaccagucauauuaaaagacggaccugaacgagugauacuagccggccccaugccugucacuguugcaucagccgcacaacggagaggacgaauagggcggaaucacaacaaagagggagaccaauauauuuacaugggccagccacucaacaaugaugaagaucacgcacauuggacagaagcaaaaaugcuccucgacaauaucaacacaccagaaggaauaauaccagcauuguucgaaccagaacgcgaaaaauccgcugcuauagacggagaauauagauuacggggagaggcacgaaagacauucguagaauugaugaggcgaggagauuuaccaguaugguuaagcuacaagguugcaagugaagguuuucaauauagcgauaggaggugguguuuugauggugaaagaaauaaucaaguauuagaagaaaauauggauguagaaaucuggacgaaagaaggcgaaaggaagaaacuacgaccacgauggcuugacgcccgaacuuauuccgacccccuagcauuacgcgaguuuaaagaauuugcagcuggacgcagaucaguaucaggugaucuuauacuagaaaucggcaaguuaccccaacauuugacacaaagggcccagaaugcauuagacaaccuaguaaugcuccauaauucggaacaggguggccgagcguacagacacgcuauggaagaauuaccagauacaauugaaacccuaaugcuucuugcuuuaauugcuguauugaccggagguguuacauuauucuuucugucaggaagaggguuaggaaaaacgucaauaggccuauuguguguaauggcgucaucaguguuauuauggauggccucaguagaaccacacuggauagcggcaucuauaauauuagaauuuuucuugaugguuuuacugauuccggaaccggauagacaacguacuccgcaagacaaccagcucgccuacguagucauaggcuuguuguucaugauauugacuguagcugcaaaugagauggguuuacuugaaacaacuaagaaagauuugggcauagggcacguugcgguugaaaaccaucaccacgcagcgauguuagauguugaucuacacccggcaagcgccuggacguuguaugcaguggcaacuacuauaaucacucccaugaugcggcacacuauagagaauacaaccgcuaacauuagucuuacggccaucgcuaaccaagcugcuauacuaaugggacuugauaaagguuggccuaucucaaagauggacauugguguuccacuguuagcucuaggauguuauucucagguuaauccccugacucuaacugcagcuguauuaaugcuuguugcccacuaugcgauuauugguccggguuuacaagcaaaagcuacacgugaagcacagaaaagaacggcggcuggcauaaugaagaauccuacagucgacgguauaguagcaauagacuuagacccaguagucuaugaugcuaaauucgaaaaacaauuaggacagauuaugcucuuaauauuauguacgucacaaauauuacuaaugcgaaccacaugggcucugugcgaaucuauuacguuagcuacugggccucuuacaacccugugggaggggucaccgggaaaguucuggaauacaacuaucgccguaaguauggcaaauauauuucgcggaaguuaccuagcaggagcaggcuuggcauuuucauuaaugaagaguuuggguggcggaagaagaggaacaggcgcccaaggagaaacucugggagaaaaauggaaacgucagcugaaccaacuuagcaagucagaauuuaacaccuacaaaagaucugguauuauggaagucgaccguucagaagcaaaggagggccuaaagagaggcgaaacaacgaaacacgcggucucgcgcgguacugcuaaauuaagaugguucguagaacgaaaccuaguaaaaccugagggcaaaguaauugaucuuggauguggacgaggagguuggucauauuacugugcaggacuaaagaaagugacagaaguaaaaggauauacaaaagguggaccaggacaugaggaaccuauccccauggccacauaugguuggaauuuagugaaauuacauucaggaaaggacguguucuucauuccacccgaaaagugugauacucuuuuaugugacauuggagaaaguucuccaaauccaacaauagaagagggacgcacccuuagaguguuaaaaaugguagaaccgugguugagaggaaaucaauucugcauuaaaauacuuaacccauauaugccaucaguaguugaaacacuugaacaaaugcaacgaaaacauggcggaaugcuuguccgaaauccucuaagcagaaacucgacacaugaaauguauuggguuucaugcgguacaggaaacauuguuagugccgugaauaugacaagucgaauguuauuaaaccguuucacgauggcucaucguaaaccuacauacgagagagauguagaccuuggagcgggcaccagacauguagcgguugaacccgaaguagcgaaucuugacauuauaggacaacggauugaaaauaucaaacaugagcacaaaaguacguggcacuacgaugaagacaauccauacaaaacgugggcauaucacggaucuuacgaagucaaaccgucuggguccgcuaguucaauggugaauggagugguaaaauuacuuacaaaacccugggaugucauuccuaugguuacccagauagcuaugacagauacgacgccauucggucaacaaaggguauuuaaagaaaaaguggacacuagaacgccaaaagcaaaaagggguacugcucagaucauggaaguaacggcaaaauggcucuggggguuucuaucgaggaacaagaaaccaaggauaugcacucgcgaggaauuuacuagaaaggugaggucaaacgcugcuauuggagcaguauucguugaugaaaaccaguggaauagcgccaaagaagcuguagaagaugaacgguuuugggaucuaguacauagggaacgugaacuccacaagcagggaaaaugcgcgacaugcguguauaacaugaugggaaaacgagaaaagaaauuaggcgaguucgggaaagcaaaaggcucacgagcaauaugguacauguggcuaggggcgcgguuccuugaauuugaagcauuaggcuuuaugaacgaggaucauugguuuagccgugaaaauucguuauccggaguugagggagaaggucuacacaaacuuggcuauauucucagggauaucucgaagaucccgggagguaacauguaugcagaugacacugcuggaugggacacuaggauaacggaagaugauuuacagaaugaagcacgcaucacugacauuauggaaccagaacacgcacuucuggcaaagagcaucuuuaaauuaacauaucaaaacaaaguaguaagaguucaacguccagcuaagaauggcacaguaauggacgugauaagccgacgagaccaaagggguagugggcaaguagggacauauggucuaaacaccuucacaaauauggaagcccagcugauccgucaaauggaaagugaagggauauuuagcccuucagaacuagagacacccaaucuagcagagagagugcucgauuggcuggagaaauacggaguggaacguuuaaagagaauggcaaucuccggagaugauugcguugucaagcccauagaugaccgauucgcaacugcguuaacagcuuugaacgacaugggaaaagugcgaaaggacauaccucagugggaaccaagcaaagguuggaaugacuggcagcaaguaccauuuugcucacaccauuuucaucaauugauaaugaaggacgguagggaaauaguaguaccaugucgcaaucaagacgagcuaguagguagagcaagagucagucaaggugcaggauggaguuugcgagaaacagcuugcuuagguaagucauacgcacagauguggcaacuaauguacuuccaccgucgugauuuaagacuagcagcaaaugcaauuugcucugcaguacccguugacuggaucccgacaucucgcacaacuuggucgauacaugcccaucaucaguggaugacaacagaggauaugcuaaguguauggaauaggguauggauagaagagaacccuuggauggaagauaaaacacacauaucaucauggggcgaugucccuuaucucgggaaaagagaagaccaaugguguggaagucucauuggucuaacggcacgugcuacuugggcaacaaauauacagguugcaauuaaucaaguucgacguuuaauaggcaaugaaaauuacuuggauuacaugacgucaaugaaacgguuuaaaaacgaaucugauccggagggagcauuaugguaa

SEQ ID NO: 21958 - RNA, 9879 nt, Artificial Sequence
  derived and/or modified CDS sequence (opt6) from DENV-1__EU482525__SS-prME
agcgugacaauguugcuuauguuaaugccuacagcauuagcuuuucacuugacaacucguggcggagaaccacauaugauuguaagcaaacaagaaagagguaaaagccuauuauuuaaaacuucagcuggaguuaauaugugcacauuaauugcuauggacuuaggagaauuaugcgaagauacuaugacauacaaaugcccucgaauuacagaagccgaaccugacgauguagauuguuggugcaaugcaacagacacaugggugacauauggcacuuguucgcaaacuggagaacaucggagagauaaaaggagcguugccuuagcaccgcaugucggauuagguuuagaaacacgaacagagacauggauguccagugaaggugcauggaaacaaauucaacgcguagaaacaugggcauugagacacccaggauuuacaguaauagcucuguuucuagcacacgcgauuggaacaaguauuacacaaaagggcauaauuuuuauacuguuaauguugguaacucccucaauggccaugcgaugcguugggauugggucucgugauuucguggaaggauuaucaggugcaacuuggguugacguuguucucgaacacggaagcuguguaacaaccauggcuaaagauaaaccuacucuugauaucgaacuccuaaagacagaagucacaaauccagcuguccugaggaaacuaugcauagaggcaaaaauaaguaacacaacgacagauucacguuguccgacacagggugaagcuaccuugguggaagaacaagaugcaaacuuuguauguaggagaacguuugucgauagagguugggguaauggcugcgggcuauucgguaaagguucccucauaacuugcgccaaauuuaaauguguaaccaaauuggaaggaaaaauuguucaauaugaaaauuugaaguacucggucaucgucacaguucauaccggagaucaacaucagguugggaacgaaucaacugagcauggcacuacugcaaccauaacgccacaggccccaacaacagaaauacaauugaccgauuacggggcucugacccuagauuguucgccccgcacugguuuagauuuuaaugaaaugguauugcuuacuaugaaagaaaaaucauggcuaguacauaaacaaugguuucuggacuuaccuuuaccguggacuucaggagcuagcacaucgcaagaaaccuggaacagacaggacuugcuuguuacguuuaaaacugcucacgcuaaaaagcaagaagucgugguuuuagggucacaggaaggagccaugcauacggcacuaacuggugccacggaaauacaaacaagugggacaacaacaauuuucgcaggacauuugaaaugcagauuaaaaauggauaaacuaacccuaaaagguaugagcuaugucaugugcaccggguccuuuaaauuagaaaaagaaguggcugaaacucaacauggcaccguccuaguacaaauuaaauacgaggggaccgaugcaccuuguaaaauuccuuuuucaacucaggaugaaaagggcguuacacaaaaugggcgucuuaucaccgcaaaccccauagugaccgauaaagaaaaacccguaaauauagaagcagaaccuccauuuggugagaguuacauaguaauaggagcgggagaaaaggcccucaaacuaucuugguuuaagaaaggaucaagcauuggaaaaauguucgaagcgacggccaggggagcucgaagaauggcaauucuaggagacacugcuugggacuucggaucuauaggaggugucuucaccagugucggcaaauuaguacaucaaauauuugguacggcguacggaguauuauucagcggaguaagcuggacaaugaagauugguauaggaguacuccuaacaugguuaggccuaaauucacggagcacgaguuucaguaugacuugcaucgcaguuggcuugguaacguuauaccuuggaguuaugguucaagcagauaguggaugcguuauaaauuggaaaggcagagaacuaaagugugggucgggaauauuuguuacuaaugaagugcauacuuggacugaacaauauaaguuucaggcugacucgccaaaaagacuaagcgcugcaauugguaaggcuugggaagaagguguuuguggcauucguagugcaaccagacuugagaacauaauguggaaacaaauuucuaaugaguuaaaucacauccuauuagaaaacgauaugaagcuaacaguaguaguaggagacguggcagguauucuaggucaaggaaagaaaaugauucggccacagccaauggaguauaaauacucauggaagucauggggaaaggcuaagauaauaggugccgacgcucaaaacacaaccuuuauaaucgaugggccaaauacuccggagugcccagaugaccaaagagcauggaacaucugggaaguagaagauuaugguuucggaauuuucacuacuaauauaugguugaaauugcgagauucauauacacaaguaugcgaccauagauugaugucagcagcaauaaaagauuccaaggcaguacaugcagauauggguuacuggauagaaucugaaaagaaugaaacguggaaacucgcgagagcuucauuuauugaaguaaagacauguauauggccaaaaucacauaccuuguggagcaaugggguucuugaaucggaaaugaucauuccaaagauuuauggagggccuaucagucaacauaauuaucgcccgggguauuucacacaaacggcagguccauggcaucugggaaagcuggaauuagacuuugaucuaugugaggguacgaccgucguuguagacgaacacugcgggaaucgcggaccgucguuaagaacaacaaccgugacaggaaaaauaauccaugaaugguguuguagaaguuguacccuuccuccauuacgcuuucggggcgaagauggauguugguauggaauggagauuagaccaguaaaagaaaaagaagaaaaccugguaaaaucuaugguaucagcaggaucuggggaagucgacaguuucagccuagggcuauuauguaucucaauaaugauagaggaaguuaugagaaguagauggucgagaaaaaugcuaaugacugggacauuagccguauuuuucuugcuaauuaugggacagcuuacauggaaugaucucauuagguuguguauuauggugggcgcgaaugcuagugauagaauggggauggggacuacguaucuagcccuaauggcaaccuucaagaugcgccccauguuugcuguaggauugcuauuccggagacuuaccucucgagagguucuauuacuaacaauaggacuaucauugguggcaaguguugaacuaccaaauucauuagaagaauugggugacggucuagcgaugggaauuaugauuuuaaaacuucuaaccgauuuucaaucucaccaguuaugggcuacauugcuuagucugacauuuauuaaaacaaccuucucauuacauuaugcauggaaaacuauggcaaugguucuuagcaucgugucccuguucccucuuugucucucaacgacuagccagaaaacaacauggcuaccugucuugcuaggaucacuugguuguaaaccgcuaacaauguuucugaucgcugaaaauaaaaucuggggaaggaagucuuggccucuuaaugaaggaauaauggcugugggaauagucucaauccuacucaguagccugcucaaaaacgaugugccucuagcugguccccuaauagccgguggaauguuaauagcuugcuacguaauaucagguuccucggcagaucucucacuagaaaaagcagcggaaguuaguugggaggaagaagccgaacacucgggggccucucauaauauauuaguagaagugcaggaugacggaaccaugaaaauaaaggaugaagaaagagaugacacauuaacaauuuuacucaaagcaacacuauuggcagucucaggaguauauccauuaucaauaccagccacgcuuuucgugugguauuuuuggcagaagaagaaacagagaucugggguuuuaugggacacaccuucaccaccagaaguagaaagagcaguacucgacgaugggauuuaccgaaucaugcagagaggccugcuagguagaucacagguaggcguugguguuuuccaagagaauguuuuccauacaauguggcaugucacaagaggagcugugcuaauguaucaaggcaaaagauuggagccauccugggcguccgucaagaaagauuugauaucauauggagguggguggcguuuacgcggaucauggaauacaggagaagaaguccagguuauagcagucgagcccgggaaaaacccuaaaaauguucagaccgccccaggaacguucaaaacuccagaaggagaaguaggugcuauugcucuugacuuuaagccagguaccucuggcaguccaauaguaaaucgagaagguaaaaucguaggacuguaugggaauggcgugguuacuacaaguggaacauacgugucggcgauagcacaagcaaaagcaagucaagaagguccccugccagaaaucgaagaugaaguauuccgaaagagaaaccuaacaaucauggaucuacauccuggaagugguaaaacgagaagguaucuuccagccaucguaagagaagcuauuaaacggaagcucagaaccuugauacuugcaccuacgaggguuguugcuucggaaauggcugaggcuuuaaaaggcaugcccaucagguaucaaacaacagcugucaaaucagaacacacaggaaaagagauuguagaucuaaugugucaugccacguuuacgaugagauuacuaucgccgguaagaguaccgaauuauaauaugauaauaauggaugaggcccauuuuacggaucccucaaguauagccgcuagaggauauauaucuacaagggucggaaugggagaggcagcagcaaucuucaugacagcuacacccccuggaagcgucgaagcguuuccacaaucgaaugcaguuauccaagaugaagaaagagauauaccggaaagaucguggaacuccggauaugaauggaucacggauuuuccugggaagacggucugguucguaccgucaaucaaaucaggcaaugacaucgcgaauugucugagaaagaauggaaaacgaguuauccaacuaaguagaaaaacguucgauaccgaguaccagaaaacuaagaacaaugacugggauuacguggucacgacagauauuagugagaugggagcuaacuuccgagcagauagagugaucgauccaagaaggugucucaaacccgucaucuuaaaggacggacccgaacgaguaauuuuggcaggaccuaugccagucacugucgcuucagcggcccaacgacgaggaaggauagguagaaaucacaauaaggaaggagaucaauacauauacauggggcaaccccuaaacaacgacgaggaucaugcgcacuggacugaggcgaagaugcugcuagauaauaucaauaccccagaagguauaaucccggcacuauuugaaccugaacgagagaaaagcgcagcaguugacggggaauacagauuaagaggagaagcgagaaaaaccuucgucgaacucaugaggagaggagaucuaccaguauggcuaagcuauaagguagcaucagaaggcuuccaauacagugacaggagauggugcuuugauggggaacguaauaaucaaguauuagaagaaaauauggacguagaaauauggaccaaggagggugagaggaaaaaguugagaccuagguggcuugaugcgagaacauauucggacccauuagcccuaagggaauuuaaagaguuugccgcagggaggcgaaguguuuccggagauuugauauuggaaauugguaaacuuccucaacauuugacccagagagcccagaaugcacuagauaauuugguuaugcugcauaauucagagcaggguggccgugcuuacagacacgcaauggaagaguuaccagauacuaucgagacucuuaugcucuuagcccuaaucgcuguguuaacaggaggaguaacacuuuucuuuuuaucaggacguggacuaggaaaaaccaguauaggacuacuauguguuauggcuagcucaguauuauuauggauggcgaguguggagccccauuggaucgcagcaucaaucauuuuagaauuuuucuuaauggugcuuuuaauuccggaaccagauagacagagaacaccucaggauaaucaauuagcuuacguaguuauaggccuacuauuuaugauccucacugucgcagcuaacgaaaugggauuacuagagaccacuaaaaaggaucucggaaucgggcauguggcgguagaaaaccaccaucacgcugccaugcuagacguugaccuucaucccgccucagccuggacacuauaugcuguggccaccacaaucauuacuccaaugaugagacauacaaucgagaauacaaccgcuaacaucucauuaaccgcuauagcgaaccaggcagcaaucuugauggggcuugacaagggguggcccauuaguaaaauggauauaggaguaccauuacucgcacuagguuguuauagccaaguaaacccauugacucuaaccgcugcuguauugaugcuaguugcucauuaugcgauuauaggucccgggcuccaggcaaaagcuacaagagaggcgcagaaaaggacggccgcggguauaaugaagaauccaacaguugaugggauagucgcaaucgaucuagauccagugguauaugaugcuaaauuugaaaaacaguugggucagauuauguuauugauucucuguacuucacagauacugcuaaugagaacaacaugggcgcuaugugaaucuauuacuuuagccacugggccuuuaacuacauuaugggaaggaucgccaggaaaguucuggaauacuacaauagcaguauccauggcgaauauauuuagaggcuccuaccuagcaggagccggguuagccuuuucgcuaaugaaaucauuaggaggaggacggagggggacgggugcccagggagaaacacucggagaaaaauggaaaagacagcuaaaucaacuaaguaaaucggaauuuaauaccuauaaaagaucggguauaauggagguugacagaagugaagcaaaggaaggauugaagcggggugagacuaccaagcacgcgguaucgaggggaacagcaaaacuuagaugguucguagaacgcaaccuagucaagccugaagguaaagucauagacuuggggugcggucgugguggauggucguacuacugugccggauugaagaaagugacggaaguaaaggguuacacaaaaggcgggccagggcaugaagaaccaauuccaauggcuacuuacggcuggaacuugguaaaacuucauaguggaaaggacguuuucuuuauaccaccagaaaaaugugacacucuacuaugugacaucggggaaaguaguccgaauccgacgauagaagaaggaagaacauuaagaguuuugaaaaugguagagccuuggcuacgaggaaaccaauuuugcaucaaaauauuaaacccauauaugccauccguuguugagacccuggaacaaaugcaaagaaaacauggggguaugcucguuagaaacccuuuaaguagaaauucuacacacgaaauguauuggguuagcuguggcacugguaauauaguaucugccgucaacaugacgucacguauguugcuaaaccgauuuacuauggcucauagaaaaccaacuuacgaaagggauguagaccugggaacggguacuaggcaugucgcaguagagccagagguugcaaauuuagauauaauaggccaaaggauagaaaauauuaaacaugaacauaaauccaccuggcauuacgaugaagacaauccauauaaaacaugggcuuaucauggaucauaugaaguaaaacccucaggaucagcgucgucgaugguaaacggcguuguuaaacuauugacgaaacccugggacgucaucccuaugguaacccagauagcuaugaccgauacuacaccuuuuggacaacaaagagucuuuaaagaaaaaguugacacgagaacuccaaaagcaaagcgaggaacugcgcaaaucauggaagucacggcacguuggcucuggggauucuugucaagaaauaaaaagccaagaaucugcacucgggaagaauuuacgagaaaagucaggaguaacgcagcuauuggagccguguuuguagacgaaaaucaauggaauagugccaaagaagccguugaggacgaaagauuuugggauuuagugcauagagagagagaacuucauaaacaaggaaaaugugcaaccugugucuacaacaugaugggaaaaagggagaagaaauuaggcgaguucgggaaagcaaagggaucuagagcaauuugguauauguggcuaggagcuagauuuuuagaguuugaagcucugggcuuuaugaaugaagaucacugguuuaguagagaaaauagcuuauccgggguggagggggaaggacuacauaagcucgguuauauacucagagacaucucaaagauaccgggaggaaauauguaugcagacgauacggcugguugggacacacggauuacugaagacgaucuucagaaugaagcaaaaauuacugacauaauggagcccgagcaugcacuacuggcuaaggcaauauucaaacugaccuaucagaauaaagugguaagaguccaacgcccugcgaaaaacggcacaguuauggacguaauaagcaggcgagaucaaagaggaucuggacaagucggaacguacggcuuaaacacuuuuaccaacauggaagcgcaauuaauacggcaaauggaaagcgagggcauauucucaccuucugaguuagaaacuccaaacuuggccgaaagggcgcuagauuggcuagaaaaauacgguauagaaagauuaaaacgaauggcgauaucaggggacgauuguguugugaaaccaaucgaugaccgguuugcuacagcauuaacugcuuuaaacgacaugggcaaagugcguaaggauauaccacagugggagccauccaaaggauggaaugauuggcaacaaguaccguucuguagucaucauuuccaucaguugauaaugaaagaugggagagaaauagucgucccgugccggaaucaggaugagcuaguugguagagcuaggguaucgcaaggggcaggauggucauuaagagaaacagcuuguuuaggaaaaucauacgcacagauguggcaacuuauguauuuucaucguagagauuuaagacuggcagcaaacgcaauaugcucggcuguaccaguugacugggugccgaccucaagaacaacuuggucuauucaugcccaccaucaguggaugacaacagaggacaugcuuuccgucuggaaucggguuuggauagaggagaauccauggauggaagauaaaacucauaucagcucaugggaagacguaccuuaucucggaaagcgugaggaucaaugguguggaagccuuauaggcuuaacugccagagcaaccugggcgacuaauauacaaguggcuauaaaccaaguaagacgacuuauaggaaaugaaaauuaucucgacuauaugacuucaaugaaacgguucaaaaaugaaaccgaccccgaaggcgcacuaugguaa

SEQ ID NO: 21959 - RNA, 9879 nt, Artificial Sequence
  derived and/or modified CDS sequence (opt6) from DENV-1__EU482526__SS-prME
uccgugacuaugcuuuugauguugaugcccacagcgcucgcauuucaucuuacgacgagaggaggggaaccucacaugauugucacgaaacaagaaagagguaaaucguugcuuuuuaaaacaucugcaggaguaaacaugugcacguugauugcaauggauuuaggugaacucugcgaagauacaaugacauauaaauguccuagaauaacagaagcagaaccagaugacguagacuguuggugcaaugcaacggauacaugggucacguacggcacaugcagucaaacuggagaacacagaagggacaaaaggagcguagcacuagcaccacaugucggauugggauuagaaacgagaacagaaacuuggaugaguucagaaggcgccuggaaacaaauucaaagaguugaaaccugggccuuaagacauccuggguucacaguuauagcucuuuuccuagcucaugccauaggaacgucaauaacccaaaaaggaauaauuuuuauacuucuuaugcucgucacacccuccauggcaaugcgcuguguaggcauugguucucgagauuucguugaaggauuaucaggcgccacuugggucgauguaguucucgaacaugggaguuguguaacaaccauggcgaaagauaaacccacgcuagacauagaacuguuaaaaaccgaagugaccaauccugcaguccuccggaaacucuguauagaggccaaaauaagcaauacaacgacagauucaagaugcccaacccaaggggaggccacguuaauggaagaacaagaugcaaacuuuguauguagacgaacguucgucgacaggggguggggaaaugguugcggauuauucggaaaaggcucgcuaauaaccugugcaaaauuuaaauguguuacuaaacuggagggcaaaauagugcaauaugaaaaucuuaaguacucaguaauaguaacaguccacacaggagaucagcaccagguaggaaaugaguccaccgaacauggaacuacagcaacgauaacuccucaagcaccuacaagcgaaauacaacuaacggacuacggcgcgcuuacuuuagauugcagcccuaggacaggguuagauuucaaugagauggucuuguuaacgaugaaagaaaagaguuggcuagugcacaagcaaugguuucuugaucuuccauuaccuuggacaagcggggcuucaaccucgcaagagacguggaaccgccaagacuuauuagugaccuuuaaaacugcacacgcgaagaaacaagaaguaguaguuuuagguagccaggagggagcaaugcacacugcucucaccggugccacagaaauccaaacaucagguacaacaacaauuuuugccggacaccuuaaauguaggcuuaaaauggacaaacuaacacuaaaaggaaugucauacgucaugugcacagggagcuuuaaauuagaaaaagaaguggcggaaacgcaacauggcacuguuuuaguacaaauaaaauaugaaggaacagaugcaccauguaaaauaccuuucucgacccaggacgaaaaaggaguaacgcagaacggccgucuaauaacggcgaauccuaucguuacugauaaagaaaaacccguuaauauagaggcagagccaccguuuggggaaucauauauuguaauaggcgcaggcgaaaaggcguuaaaauuaucaugguucaagaaagggucuucuauaggaaaaauguuugaagcuaccgcccguggagcgaggcggauggcaauuuugggcgauacagcaugggauuuugguucaaucggaggaguauucacaucaguggguaaacuugugcaucagaucuucggcacagcauauggaguacucuuuagugguguaucuuggaccaugaaaaucggaauuggggugcuacucacguggcucggucuaaacagcagaucuacuucauugucaaugacuuguauagcuguaggcuuagugaccuuauacuuaggagugaugguacaagcagauaguggcugugucauaaauuggaaaggacgggaacucaaaugugguucugggaucuuuguuacuaacgaaguacacaccuggacagaacaguauaaauuucaggcagacagcccgaaaagauuguccgcagccauaggaaaggcuugggaagaaggcguuugcgggauacguucggcgacacgguuggaaaauauaauguggaaacagauuuccaaugagcuaaaccauauacuucuagaaaacgacaugaaauuuacggucguaguuggugaugugguugggauacuagcacagggcaagaaaaugauacgaccacaacccauggaacauaaguauaguuggaaaucauggggaaaagcgaaaauaauuggcgcggauguacaaaauacgacauuuauuauagauggacccaauacuccugaauguccagaugaccagagagcauggaacauaugggagguugaagauuacgguuucggcauauucacuacaaauaucugguugaagcugcgagacucguauacacaagugugcgaucaucguuuaaugucagcugcuauuaaagacucaaaagcgguucaugccgacaugggcuauuggaucgaaucagagaaaaacgaaacuuggaaguuagcgagagccucauuuaucgaggucaaaacuugcauauggccuaaaucccacacauuguggaguaacgguguacuagaaucugaaaugauaauuccaaaaauauacggaggcccgauaucacaacauaauuaucggccaggauauuucacucaaacggcugggccuuggcaccuuggaaaguuagagcucgacuucgauuuaugcgaaggaacaacagucgugguugaugaacacuguggaaacagagggccaucauugagaacaacuacaguaacagguaaaauuauacaugaaugguguuguaggucauguacuuugccuccacugagauuuaaaggagaagacggguguugguauggaauggagauacguccagucaaggaaaaagaagaaaaucuaguuaagucaaugguaucagcagguucuggggagguugauucguuuaguuugggcuuauuauguauaaguauuaugauagaggaagucaugaggaguagauggaguagaaaaaugcucaugaccgguacacuugcaguauucuuacuuuuaauaaugggucaacucacauggaaugaucuuauccguuuauguauuaugguuggagcuaacgcaucugauagaaugggaauggggaccacuuacuuagcccuuauggcaacuuuuaaaaugagacccauguucgcgguaggccuacuguucagacgacuaacgaguagggaggugcuguuacucacaauaggacugagucuagucgcuuccgucgaauuaccuaacaguuuagaagaauuaggcgacggacuggcaaugggaauaaugauacuaaaacuacuaacugauuuucagucccaccagcuaugggcaacucuccuaucauuaacauuuauaaaaacaacauugucccuacauuaugcguggaaaacgauggcaaugguccuaucgauaguaucccuuuucccuuugugcuuguccacaaccucacaaaagacgacuuggcuaccaguacucuuaggaagccucggcuguaaaccucucacuauguuucuuauugcagaaaauaaaauauggggccgaaaaaguuggccacuuaaugaggggauuauggcagucggaguugucucaauacuacuuucaucauuguuaaagaaugauguaccucuugccggaccacuaauagcuggagguaugcuaauagcaugcuaugugauuucagggucgucagccgacuuaagucucgaaaaagcugcugaaguaagcugggaagaggaagcagaacauucuggagcuucgcacaacauccuaguugagguacaagaugacggcacaaugaaaauuaaagaugaggaacgugaugauacccugacgauucuccuaaaggcuacacuacuagcaguaaguggcguuuacccguuaucgauucccgcgacucuguuuguaugguauuucuggcagaagaagaaacaacgaagugggguauuaugggauacuccaaguccacccgaagucgaaagggccguucuugaugauggaauauacaggaucaugcagcgaggacuccuagguagaucacaggugggaguagggguuuuucaggaaaauguauuucauacaauguggcauguaacaaggggagccguccuuauguaucaagggaaaagacuugaaccuagcugggccagcgugaagaaagaccucauaaguuacggaggaggguggcgacuacaaggcucuuggaauaccggcgaagaaguacaggucauagccguugagccagguaaaaauccgaaaaacguacaaacagcccccggaaccuuuaaaacaccagaaggagaaguaggagccauagcguuagauuucaagccugguacaaguggaucaccaauaguaaauagggaagguaaaauuguaggauuauacggaaacggaguaguuacgaccucugggacuuaugucucugcgauugcucaggcuaaagcaucacaagaaggaccacuaccugagaucgaagaugagguuuuuaggaagagaaauuuaacgaucauggaucuccauccgggaaguggaaaaacuagacguuaucuucccgcuauuguacgagaagcaauuaaacguaaguuaaggacucugauauuagcgccaacacgaguugucgcaagugagauggcagaagcacuuaaaggaaugccuauacgauaccagacuaccgcaguaaaaucugaacacacaggaaaagaaauagucgaccugaugugucaugccacuuuuacaaugcgcuuacuaucacccgugagaguucccaauuacaacaugauuauuauggacgaagcgcauuuuacugaccccagcucaauagcugcgcggggcuacaucucgacaagaguugguaugggagaagcugccgccauuuucaugaccgcgaccccuccaggaucaguugaggcuuuuccucaaagcaacgcaguaauacaagacgaggaacgggauauaccugaacgaucuuggaacucagguuaugaauggauaacagauuuuccaggaaagacaguaugguuugugcccaguauuaaaucugggaaugacauagcaaauugccugaggaaaaauggcaaacgaguaauacaguuaucucgaaagacguuugauacagaauaucagaaaacuaaaaauaaugacugggacuauguaguuacuacagauauuucagagaugggggccaauuuuagagccgauaggguaauagauccucgacgauguuuaaaacccguuauauuaaaagacgguccggagagaguaauauuagcuggaccaaugccgguaacaguagcaagugcagcccaaagaagaggacgcaucgguagaaaucauaauaaagaaggagaccaauacauauacaugggacaaccacuuaacaaugaugaagaccacgcacauuggacggaagcaaaaaugcuacuugauaauauuaacacgccagagggaauuauuccugcgcuauucgagccagagagagagaaaucggccgcuauagauggagaguaccgucuaagaggagaagcgagaaagacguuuguagaacuuaugcgaagaggagaucucccaguguggcucucguacaagguugcaagcgaaggauuucaauacagcgauagaagaugguguuucgacggggagagaaauaaccaggucuuagaagaaaauauggauguagaaauauggaccaaagaaggggaaagaaagaaacuaagaccccguugguuggaugcuagaaccuauagcgacccgcuggcccuuagagaguuuaaagaauuugcagccggaagaagaucaguaucuggggaccuaauauuagaaaucggcaagcuaccccaacauuuaacccaacgagcccaaaaugcucuugacaaccuaguaaugcuacacaacucagaacaaggagggagagccuauaggcaugcgauggaagaacuuccugacaccauugagacacugaugcuacuagcgcuaauagccguacuaacaggaggugugacacuauuuuuccuaucaggcagaggauuggggaaaacaucgauuggauuacuguguguaauggcuucuucagugcuacuguggauggccucaguugaaccacauuggauagcugcuagcauaauacuagaguucuuucuuaugguacuccuaauaccagaaccggacaggcaacguacuccgcaagauaaucaauuagcuuacguaguuauaggucuucuuuuuaugauccuuacagucgcugcgaaugaaaugggacuguuagaaaccacuaagaaagaucucgggauaggacacgucgcaguagaaaaucaucaccacgccaccaugcuggacguugaucuucacccagcgagugcauggacguuauaugcuguagccaccacaauaauuacuccuaugaugcgacacacuauagaaaauacaacugcgaacauaaguuugacagccauagcaaaucaggcggcuauucuuaugggcuuagauaaagguuggccgauaaguaaaauggauauaggaguaccauuguuagcuuuaggcuguuacagucaaguaaacccgcucacacugacggcagccgucuugauguugguagcucauuacgcaauuauaggaccgggcuugcaggcgaaagccacuagggaagcucaaaagcgaacugcggcugguauuaugaaaaauccaacugucgaugguauuguagcaauagauuuagacccuguuguuuaugaugcaaaauucgaaaaacaacuaggucaaauuauguugcugauucuaugcaccucacaaauauuauuaaugagaaccacaugggcuuuaugcgaaucaauaacauuggcaacaggaccauugacuacauuaugggaaggaucgccaggaaaauuuuggaauacaacuauagcaguuaguauggcuaacauauuuagagguucauauuuagcuggugcuggauuagcguuuagucugaugaaauccuuaggagggggacggcgaggcacuggagcucaaggagaaacuuuaggagaaaaauggaaaagacaacuaaaucaacuuagcaaaagugaguucaauauuuauaaacguagugguaucauggaagucgaccgcagcgaggcaaaggaaggauugaagcgaggcgaaacgacuagacacgccguaucccggggaacagcaaaacuccgaugguuugucgaaagaaaucuaguaaaacccgagggaaaaguuauugauuuagguuguggacgagggggcuggaguuauuacugugcgggacuaaagaaaguaacagaagugaaaggguacacgaagggcggaccaggacaugaggagcccauaccaauggcaaccuauggcuggaacuugguuaaauuacauucaggaaaagauguauucuuuacaccgccagagaaaugcgauacgcuuuugugugauauaggcgagucgaguccaaauccuacaauugaagagggucgaacauuacgaguccugaaaaugguagaaccguggcuuagaggaaaucaguuuuguauaaagauauuaaacccauauaugcccucaguaguggaaacucuggaacaaaugcaacgaaaacauggugguaugcuuguucgaaacccauuaagccggaacucaacacacgagauguacuggguaucaugugggacaggcaauaucguuucggcaguuaauaugaccucuagaauguuacucaacagauuuaccauggcacauagaaagccuacauaugagcgagacguagacuuaggugcagggacuagacauguagcuguagagcccgaagucgccaauuuggauauaauaggacaaagaaucgaaaacauaaaacaugagcacaagucuacauggcauuaugaugaagacaauccguacaaaacgugggcuuaccaugguagcuacgaagugaaacccucaggcagugcuagcagcaugguaaaugguguuguuaaacuccuuacaaaaccgugggauguaauacccaugguuacccaaauugcuaugacggacacaacuccauucggucaacagaggguauucaaagaaaaaguggacacgagaacaccaaaagcaaaaaggggaaccgcacaaauuauggaagugacagcucguugguuauggggauuucuuaguagaaacaagaaaccucgaauuuguacucgagaagaguucacaaggaaggugagauccaacgcugcuauuggugcgguauuuguagaugaaaaccaauggaacagcgcuaaggaggcaguggaagaugagcguuuuugggaccuugugcagaaagaaagggagcuccacaaacaaggaaaaugugcaacuugcguauauaauaugauggggaaaagggagaagaaauuaggugaauuuggcaaagcuaaagggaguagagcuauuugguauauguggcuaggagcacgguucuuagaauuugaagcacuaggguuuaugaaugaagaccauugguuuucccgagaaaacucauuaucagguguagagggagagggucuacauaaacucgguuacauuuuaagggacauaucuaagauaccgggaggaaauauguaugcugacgacaccgccggcugggacacccggauaacggaagaugaccugcaaaacgaagcgaaaauaacugauauuauggaacccgagcaugcauuacuagcaacaucgauauuuaaauuaacauaucaaaauaaaguuguaagggugcagcguccugccaaaaacggaacaguaauggacguaauaaguagacgagaccaacgagggaguggacaaguaggaacguauggucuaaauacguuuacaaauauggaagcucaacugauuaggcaaauggagagcgaagggauauucucuccauccgaguuagaaauacccaaccucgcugaacgugucuuagacuggcuggaaaaauacggaguggaaagauuaaaacguauggcuaucaguggggaugacugcguugugaaaccgauugaugaccgauuugcaacggcauuaaccgcucucaacgauaugggcaaggugagaaaggauguuccucaaugggaaccgagcaaaggcuggaacgacuggcaacaggucccuuuuuguucucaucacuuucaucaauugauuaugaaagaugggagagaaauaguaguuccaugccgcaaucaggaugaacucguaggucgggcuagagucagucaaggggccggauggagucucagagaaacugcuugccuagguaaauccuacgcccaaauguggcaacuaauguacuuccauagaagagaccuaagauuggccgccaacgcuauuugcucagcuguaccuguugauugggucccaacaucaagaacgaccuggaguauacacgcccaucaccaauggaugacaaccgaggacaugcuuucggucuggaaucguguauggauugaagaaaaucccuggauggaagauaaaacccacguaucgaguuggggcgaugucccguaccuugguaaaagagaagaucaauggugugggucucucauaggacuuacagcacgugccacaugggccaguaauauacaagucgcaaucaaucagguaaggagacuaauaggaaaugagaauuaucuugauuacaugacgucaaugaaaagauucaagaaugaaggugauccagaaggugcauugugguag

SEQ ID NO: 21960 - RNA, 9879 nt, Artificial Sequence
  derived and/or modified CDS sequence (opt6) from DENV-1__EU482527__SS-prME
agcgugacgauguuauuaaugcuuaugcccacagcacuagcuuuccacuuaacaacaagaggaggcgaaccacauaugauuguaaguaaacaagaacgggguaaaagucuucuauuuaaaacaagcgcaggaguaaauauguguacgcuaauagcaauggauuugggcgaguucugugaagacacaaugacauacaaauguccgagaauaacggaagcugaaccagacgauguugacuguugguguaaugcaacggacacguggguuacauaugguacguguagccaaacgggagaacaucguagggacaaacgauccguagcucuugcaccucaugugggauuaggcuuagaaacacguacugaaaccuggaugucaagugaaggagccuggaaacaaauccaacgcguggaaacaugggcccuucgacauccaggauuuacgguuaucgcauuguuucuagcacacgcuauuggcacaucuauuacacaaaaaggcauaaucuucauauuauuaauguuaguaaccccgucuauggcaaugcgcuguguaggaauaggcucuagagauuucgucgaaggccuaucgggagcuacuugggucgaugucguccuagaacacgguucauguguuacaaccauggcaaaagauaaaccuacauuagauauagaacuguugaaaacugaagugacaaauccugcaguuuuacggaaauuaugcauagaagcaaaaauuucaaauacaacaacugacagccgauguccaacacaaggcgaagcaacucugguagaagaacaagacgcaaacuuuguguguaggaggacuuucguagaucguggguggggaaacgggugcggacuauuuggaaaaggaagucucaucacuugcgcuaaauucaaaugcguuaccaaauuagaaggcaaaauaguacaauaugaaaaucuaaaauauaguguaauaguaacaguacauacuggagaucaacaccaaguugguaaugaaucaacugagcacggaacaacugcgacuauuacaccacaggcuccuucaacugaaauucaauuaacagauuacggagcguuaacccuagauuguuccccaaggacgggacuggacuuuaaugaaaugguauuacugacgaugaaagagaaaucauggcuuguacacaaacaaugguuccuugacuuaccuuuaccauggacuagcggggcuaguacaagccaagaaaccuggaauagaaaagauuuauuggucacauuuaaaacagcacacgccaagaaacaagaaguagugguucuaggaucacaagaaggugcuaugcauacugcauuaacuggagccacggagauccaaaccagcgguacuacaacgauauucgcuggacaccuaaaauguagguuaaaaauggacaaauugacucuaaaaggcaugucauacguaauguguacuggaucauuuaagcuggagaaagaagucgcagaaacacaacauggaacuguccucguccaaauaaaauacgaaggcacagacgcucccuguaaaauaccauuuaguacucaagacggcaaaggaguuacacaaaacgggagacugauaacagcaaacccuaucguaacugauaaagaaaaaccagucaacauagaggcggagccaccguucggugagaguuauauaguaauuggagcaggagagaaagcacuuaaacuaucaugguuuaagaaggggucaucaauaggaaaaauguucgaagcgacggcacguggagcuagacguauggcuauuuuaggugauacagccugggacuucggaucaaucggaggaguauucacaucaguuggaaaauuaguucaucagaucuuugguacagcauauggaguuuuauuuucaggaguaagcuggacuaugaagauaggcauuggagucuuauuaacguggcuuggauuaaauucucgguccacuagcuuaaguaugaccugcauagcaguaggucuggucacuuuauaucuugguguuauggugcaagcagacucaggauguguaauaaauuggaagggacgggaacuaaaaugcgggucuggaauuuucguaacuaaugaaguacauacuuggaccgaacaauacaaauuccaagcagacucuccaaaaagacucucugcggcaauugggaaagcaugggaagaaggaguaugcggaauaagaagcgcgacuagacuagaaaacauuauguggaaacaaauaagcaacgaauuaaaccauauccuguuggaaaaugauaugaaauuuaccguugucguuggagauguagccggaauccuugcucagggcaagaaaaugauuagaccacagccuauggaauacaaguauucauggaaaucauggggaaaagcuaagauaauaggggccgacguccaaaacacaacuuuuauaaucgauggacccaauaccccagaguguccagaugaucaaagggcauggaauauaugggaaguugaagauuacgguuuugguauuuuuacaacgaauauuuggcuaaagcuaagagauagcuauacccaaguaugcgaucaucgguuaaugagcgccgcaauuaaggauucgaaggcgguccaugccgauaugggauacuggaucgaaagugagaaaaaugaaacauggaaauuagcacgagcaaguuuuauugaaguuaaaaccugcauauggccaaaaagccacacgcuuugguccaacgguguucuagagucagagaugauaauaccgaaaauuuauggaggaccaauaagucagcacaacuaucgaccaggguauuuuacucagacugcaggucccuggcaucuugguaaacucgaacuagauuucgaucuuugcgagggaaccacggucgucguugacgagcacugcgguaacagagggccuagcuuaagaaccacuaccgucacaggaaaaaucauacacgaaugguguugucgcaguuguacucugccgccucuuagauuuaaaggagaggacggauguugguauggaauggaaauccggccuguuaaagagaaagaagaaaauuuagucaaaucaaugguuagugcagguagcggggagguugauuccuuuaguuuaggucuacuuuguauaucgaucaugauugaggagguuaugaggucucgauggagucggaaaaugcuaaugacaggcacauuagccguauuuuuccuacugauaaugggacaacuaacauggaaugaucuuauccgacuauguauaaugguuggggcaaaugcuucugauagaaugggaauggggacaacauacuuagcucucauggccacauucaaaaugcgaccaauguucgccguggggcuacucuuucgaagacucacaagcagagaagugcuauuacugacgauaggacuuagcuuaguagcauucguagaacuuccuaacagcuuagaagaguuaggugauggauuagccaugggaauuaugauuuuaaaauuacuuaccgacuuucaaucgcaucaacuaugggcaaccuuauugagccuuacauuuauaaaaacuacguucaguuuacauuaugccuggaagacuauggcaaugguacuaaguauaguuucguuauuuccacuuuguuugucuacaacuucacagaaaacuacaugguuaccagugcuguuagggucauugggaugcaagccacuuacgauguuccuuaucgcagaaaacaaaauaugggggaggaagucguggccguuaaaugaaggaauaauggcagucggaaucguaagcauacugcuaucaucacuucuuaagaaugauguaccuuuagccggcccacuaauugcaggagggaugcuaauugcauguuauguaaucucaggaucuagcgcagacuuaagccuagaaaaagcugcagaggucucuugggaagaagaggcagaacacuccggcgcaagccacaauauauuaguagagguacaagaugauggaacgaugaaaauaaaagacgaagaacgggaugauacucucacuauucuuuugaaagcuacguugcuggcgguuucaggagucuacccacuuucuaucccagcaacacucuucgugugguauuucuggcagaagaagaaacagagaagcggagugcugugggauaccccuaguccgccggaggucgagagagcgguacuagacgacggcauuuaccgaauaaugcaacgaggacuacuaggccguucacagguagguguagggguuuuucaagaaaacgucuuccacacgauguggcauguaacaagaggagcgguacugauguaucagggcaaacgguuagaacccaguugggcaagcgugaagaaagaccucauuaguuauggagggggcuggagauuacaagggucuuggaacacaggcgaggaagugcaaguaaucgccguagaaccggggaaaaauccaaagaauguccaaacagcaccugguacuuuuaaaacguccgaaggagaaguuggugcuauugcauuggauuucaaaccaggaaccucagggagcccaauuguaaacagggaaggcaaaauaguugguuuauaugguaacggagugguaacaacuucgggcaccuauguaucugccauagcacaagcuaaagcuagccaggaagguccucuacccgaaauugaggaugaaguuuuucgaaaacgaaauuuaacaaucauggauuuacacccaggaagcggaaaaacaagacgguacuuaccagcgauaguuagggaagcuauaaagcguaaacugaggacgcuuauauuggcgccaacaagaguaguugcuucagaaauggcggaagcacuaaaaggcaugccgauacgauaucaaacaacagcaguaaaauccgaacauacaggaaaagaaauaguugaccuaaugugccacgcuaccuucacuaugagguugcuaucgccaguacggguuccaaauuauaauaugauaaucauggaugaagcacacuucaccgaucccaguaguaucgcggcuaggggauauauaucgacgagaguuggaaugggagaagcggcagcaauuuuuaugacagcgacacccccuggaucaguugaagcauuuccucaguccaaugccgucauacaagaugaagaaagagauauaccggaacgcaguuggaacucugguuacgaauggauaacggacuuuccagguaagacugugugguuuguccccucaauaaaaucuggcaaugacauagcuaauugucuaaggaaaaauggaaaacgcgucauacagcuaaguaggaaaacguucgauacagaauaccagaaaacuaagaauaaugacugggacuauguggugacgacagauauaucagagaugggcgcuaauuucagggcugaccgugugauagaucccagacgaugucuuaagccaguaaucuuaaaggauggaccagaacgugugauuuuagcagguccaaugccugucacgguagcaucagcggcacagaggcgaggaaggauagguagaaaccauaauaaagaaggagaucaauacauauauaugggacaaccguuaaacaacgaugaagaucaugcucauuggacagaagcaaaaaugcuauuagauaauauuaacacacccgagggaauaauaccagcauuguucgaaccagaaagagaaaaaucugcugcuauagauggggaauaucgacucagaggugaggcccgcaaaacauuuguggaauugaugcgaaggggagacuuacccgucuggcuuagcuauaaaguagcuagugaaggcuuucaauauucagauagacgaugguguuuugauggagaacgaaauaaccagguccucgaagagaauauggaugucgaaauuuggacaaaagaaggggaaagaaagaaacucagaccgagauggcuugacgcaaggacauauagugacccccucgcucuccgggaguucaaagaguucgccgcaggaagaaggucagucucaggugauuuaauacuagagauugguaaguugccacaacauuuaacacagcgggcucaaaaugcgcuugauaaucuuguuaugcuccauaauagugaacaaggagggagagcauacaggcaugcaauggaagaacucccagacacaauagaaacuuuaauguugcucgcacuaauagcuguccuuacgggcggcgugacauuguucuuucugaguggacguggucuaggaaaaacgucaauaggacuauuaugcgucauggcuucaucagugcugcuguggauggcgucgguagaaccacauuggaucgcggcuagcauaauccuagaguucuuucugaugguauuacuuaucccggaaccagauagacaacgaacuccgcaagacaaucaauuagcuuacguaguaauaggauuauuauucaugauucuuacaguagcagcuaacgaaaugggacuauuggaaacuaccaagaaagauuuaggaauagggcauguggcugucgagaaccaccaucacgcugccauguuagaugucgaucuacacccugcaucggcauggacauuauaugcaguugcgacaacgauuauuacccccaugaugcgacauacuauugaaaauaccaccgcgaacauaucacuuacagcaauugccaaccaagcugcaaucuuaaugggauuagauaaaggguggccgaucaguaagauggauauuggugugccguuacuggcacuugguugcuauucacaaguaaauccacuaacgcuaaccgcagcuguguugaugcuagucgcucacuaugcuauuauugggccuggccuacaggcaaaagcuacgagggaagcacagaagcggacagccgcaggcauaaugaaaaacccaacuguagauggaauagucgcaauugacuuagauccugucguauacgaugcuaaauucgaaaaacaacuuggucaaauaauguugcuuauccuaugcacgucgcaaauucuacuuaugcgaacuaccugggcgcuaugcgaaucuauaacacuagcaacagguccccuuacaacauugugggaaggaucgccagggaaguucuggaacacuacuaucgcaguaaguauggcaaauauuuuccgugggucauaucuagccggugcaggcuuagccuuuagcuugaugaaaagccuaggaggaggaagaagagguacgggagcacaaggcgaaacacuuggagaaaaauggaaacgacaacuaaaucaauuaucuaagagugaguuuaacacuuauaaaagaucagggaucauggaaguagaucgauccgaggcaaaagaaggucuaaaacgaggggagacaaccaaacacgcugucucaagagggacagcgaaacuacgcugguuuguugagagaaauuugguuaaaccagaggguaagguaaucgaucuggguugugguagaggaggguggagcuauuacugcgcggggcuuaagaaagucacggaggucaagggguauacuaaagguggucccgggcacgaagaaccaauaccaauggccacauacggauggaauuuaguaaagcugcauagcgguaaagacguguucuuuaucccacccgaaaagugugauacucuucuaugugacauaggugaaagcucgccaaacccaacgaucgaggagggaaggacacuucguguuuuaaaaaugguggagccauggcucagagggaaucaguucuguauaaaaauucuaaauccauauaugccgucaguaguggagacucuagagcaaaugcagagaaaacacggagguauguugguccgcaauccauuaucgcgaaacucaacgcaugagauguacuggguuucaugcgggacuggaaauauagucagugcuguaaauaugacaucuagaauguuauuaaauagauucacuauggcgcauagaaaaccgacuuaugagagggacguggaccuuggggcgggcacacgacauguagccguagaaccagagguagccaaccuugauauuauuggacaaagaauagaaaacaucaagcaugaacauaagucaacauggcacuaugacgaggauaauccguacaaaacgugggccuaucauggauccuaugagguuaaacccaguggaagugcaaguaguauggugaacggcguagugaaguugcuaaccaaaccgugggaugugaucccuauggugacccaaauagcaaugacggauacgacaccuuucggacaacagcguguuuucaaagagaaaguugacacucgcacaccaaaagcuaaacggggaacggcacaaauaauggagguuacagcuaaauggcuauggggauuccugagccgaaauaagaaaccaagaaucugcacaagagaagaauuuacucggaaaguaagaucgaacgcagcuauaggagccguuuucguagacgagaaccaauggaacagugcaaaagaagccguagaggacgaaagauuuugggauuuagugcaccgagaaagggaauuacauaagcagggaaagugcgcgacauguguuuacaauaugaugggaaaacgcgagaagaaauugggggaguucggaaaggcuaaagguucacgggcuauaugguauaugugguugggagcgagauuccuagaauuugaagcguuaggauucaugaaugaagaccauugguuuucaagagaaaauucucuuucgggagucgagggggaggggcuucauaaacuuggcuauauccuuagggacauuucaaaaauuccugguggaaacauguacgcggaugauacagcggguugggauacuagaauaacagaggaugaucuacaaaaugaggcaaagaucacugauaucauggaaccagagcaugcauuauuagcuaaaucgauauuuaaacucacauaucagaacaaaguuguaagagugcaaaggccugccaaaaacggaacgguaauggaugucaucucacgucgagaucagcgaggaucaggacaagugggcacuuauggccuaaacacuuuuacaaacauggaagcucaauugauacgucaaauggaauccgaggguauauuuucaccaagcgaauuagaaacaccaaaucuagcaggacgaguucuagauugguuagaaaaacacggaguggaacgauuaaagagaauggcuauaucaggagaugauugcguuguaaaaccaauagaugauagauuugccacugccuuaacagcacucaacgauauggggaaaguccguaaagacaucccucagugggaaccauccaaagguuggaaugauuggcaacaaguaccauuuugcucacaucauuuucaucaauugauaaugaaagaugggagagagaucguaguuccuugccgaaaucaggacgaacucguugguagagcuagagugagucaaggugcuggauggaguuuaagagaaaccgcuugucuaggaaaaucauacgcucaaauguggcaacuuauguauuuccauagaagggauuugagauuagcagcuaacgcgauauguucagccguaccaguagacugggucccaacaucgcgaacgacguggucuauacaugcacaucaccaauggaugaccacagaagacauguugagcguuuggaauagaguuuggaucgaggagaacccguggauggaagacaaaacacauaucuccucuuggggagaugugccauaucuuggcaagcgugaggaccaaugguguggaucccuuauaggacuaaccgcucgugcuaccugggcaacaaauauccaaguggcgauuaaucaaguuaggagacuaauuggaaacgaaaacuaucuagacuauaugacgucgaugaaaagauuuaaaaacgaaucagacccggaaggggcuuuaugguaa

SEQ ID NO: 21961 - RNA, 9879 nt, Artificial Sequence
  derived and/or modified CDS sequence (opt6) from DENV-1__EU482528__SS-prME
ucagugacuauguuacuaaugcuuaugccuaccgcacuggcauuucauuugaccacgcgaggaggagaaccgcacaugauuguaucaaaacaagaaagaggaaaauccuuacuauuuaaaacaagugcagggguuaauaugugcacauuaaucgcuauggaucuuggggaguucugugaagauacuaugacguacaaauguccuaggauaacggaagcugagccggaugacguugacuguuggugcaaugcuaccgauacguggguaaccuauggaaccuguucacaaaccggugagcauaggcgcgauaaacggucuguugcacuagcaccacacgugggacuagggcucgaaacaagaacugaaaccuggaugaguagugaaggagcauggaaacaaauacaacgaguugaaacaugggcccuacgacauccgggcuuuacaguaauagcacuauuccucgcacaugcaauuggaacaaguaucacccaaaaagguaucauauucauacucuuaauguuaguaaccccaucgauggcaaugcggugcguugguauaggcaguagagauuucgucgaaggccucucgggggcuacuugggucgauguaguacuagagcacgggagcugugucacgaccauggcaaaagauaaaccaacucuagauaucgaauuauuaaaaaccgaaguaacaaacccugcuguauugagaaaauuauguaucgaagcgaaaauaucaaauaccacaacagauuccagauguccgacgcaaggagaagcuaccuuagucgaggaacaagaugcaaauuuuguuuguagaaggacguucguagauagagguuggggcaaugguugcggacuauucgguaaaggaucauuaauaacuugugcuaaauuuaaguguguuacaaaguuggagggaaaaacgguacaauaugaaaauuugaaauauucuguaauuguuaccguccauaccggagaucagcaucaagucggcaacgaauccacggagcaugggacaacagcaaccauaacaccucaagcuccuucaacagagauacagcucacugauuauggagcucuaacucuggacuguucaccaagaacugguuuggauuuuaacgaaaugguucucuuaacgaugaaagaaaaaucauggcuuguacauaaacagugguuucuagaccuaccacuaccauggacaucuggggcgucaacaagucaagaaacauggaaucguaaggacuuguugguuaccuucaaaacugcacacgccaagaaacaggaaguaguuguuuugggcagucaggagggggcuaugcacacagcuuugacaggagccacagagauucaaacaagugguacuacaacgauauuugcaggccacuuaaagugucgauuaaagauggauaaauugacuuuaaaaggcaugagcuacguaauguguaccgguagcuuuaaacuugaaaaggaaguagcugagacucagcaugggacagucuuaguacaaaucaaauaugagggaacagacgcgccuuguaaaauacccuuuucaacccaagaugaaaaagguguuacgcaaaacggaagacuaauaacagcaaaccccaucgucaccgauaaagaaaaaccgguaaacauagaagcagaaccucccuuuggagaaaguuauauagucauaggagcuggugaaaaggcuuugaaauuaaguugguucaagaaagggucaaguaucgggaagauguuugaagcgacggcgaggggagccagacgaauggccauacuaggagacacugcaugggacuuuggaagcauaggcggagucuucacuucagugggcaaauuaguccaucaaaucuucggcacagcauacggaguacuauuuucagguguuaguuggacuaugaagauaggaaucgggguacuacuaacaugguuagguuuaaauucacgcucaacaagucucucgaugaccuguaucgccgucggccuuguaacccuguaccugggagccaugguccaggcugacucagggugcguaauuaauuggaaaggaagagaacuuaaaugcgguagcggcauuuuuguaacaaacgaaguacacaccuggacagaacaauacaaauuucaggcugauucuccaaagcgucuaagcgccgcuauaggcaaggccugggaggaagguguuuguggaauccguagugcaacuagacuagaaaauauaauguggaagcaaauaucaaacgaguuaaaucacauucuauuggaaaacgacaugaaauucaccgugguagugggggacguugcuggaauacuggcccagggcaagaaaaugauucgaccccagccaauggaauauaaacauucauggaaaaguuggggcaaagcuaaaauuauaggugccgacguucagaauacaacauucauaaucgauggaccuaacacgccagaaugccccgaugaucaaagagcguggaauauuugggaggucgaagauuauggauuugggauauucaccaccaauauauggcucaaauuacgcgacaguuauacucaggucugugaccaccgccuuaugagcgccgcuaucaaagacucgaaagcugugcaugcugacaugggauauuggauagaaagcgaaaagaacgaaacauggaaauuagcgcgcgcaucuuuuauagaagugaaaaccuguauuuggccaaaaagucacaccuuauggucuaacggcgucuuagagagugaaaugaucauaccuaaaaucuacggaggcccaauaucgcaacauaacuacagaccuggauauuucacucaaacugcagguccauggcauuugggaaaauuagaacuagacuucgauuuaugugaagggaccacugucguaguagaugaacauugugguaauagagggccaaguuugagaacuacaacaguaaccggaaagaucauacacgagugguguugcaggucaugcacacuuccaccucugcgauucaaaggggaagauggauguugguacggcauggagauucguccuguaaaagagaaggaagaaaacuugguaaaaagcaugguaagcgcaggcaguggggaaguugauucuuuuuccuuaggauugcuguguauaagcauuaugauagaggaagugaugaggucacguugguccagaaaaaugcugaugaccggcacacuagcgguauucuuucuauugauuaugggucaauuaacuuggaaugaccuaauaagauuguguauaaugguaggagcaaaugcaucagaucgaaugggcaugggaacaaccuaucuugcucucauggccacauucaagaugcgucccauguucgcugugggucuucuauucagaagauuaacaucgagagagguacucuuauugacuaucggacuaucucuaguagccuccguagaacucccaaauucccuggaagaacuaggugauggccucgcuauggguauaaugauacuaaaguuguuaacagauuuucaaagucaucaauuaugggccacccuacugucccuuacauuuaucaaaacaacuuucucacugcacuacgcuuggaaaacgauggcuaugguucucucgauuguaucuuuauucccuuuaugccuaagcacgacaucacagaaaacuacuugguuacccguacuauuaggcagcuuaggaugcaaaccacuuacaauguuuuugauagccgaaaauaaaauuugggguagaaaaucuuggccauuaaaugaaggaaucauggccguaggaauuguaaguauauuacuuagcucgcuacucaagaacgaugucccuuuagccggaccucuuauugcaggagggaugcuaauagcauguuauguaauaucgggcaguucggcggaucugucuuuagagaaagcugcagaagugaguugggaggaagaagcggagcacagcggggcgagucauaacauauugguugaagugcaagaugacgggacuaugaagauaaaagaugaagaaagagaugauacacuaacuauacuucucaaagcaacuuuauuagccgucucaggaguauauccacuaaguauaccagccacccuauucguaugguauuuuuggcagaagaagaaacaaagaagcggagugcugugggacacacccagcccucccgaaguagaacgcgcaguacuugaugaugguauauacaggauaaugcagaggggucuccugggcaggucccaaguaggcgucgguguguuucaagagaacgucuuccacacaauguggcauguaacucgaggugcaguauuaauguaccaaggcaaaagauuagaaccaagcugggcguccguuaagaaagacuugauaucauauggagguggauggagguuacaaggaucauggaacaccggagaagaaguccagguaauugcaguagaacccgguaaaaaccccaaaaauguccaaacagcuccuggaacauucaaaacuucagaaggugaaguaggugccauagcgcuagauuucaaaccagggacaaguggaucgccaauagucaauagagaagguaaaauaguaggucuuuacggaaacggagugguaacuacaucaggaacauauguaucagcgauugcgcaggcuaaagcuagccaagaggggccgcuaccagaaauugaagaugaaguauuccgaaagagaaauuuaacaauaauggaccuacacccagggagcggcaaaaccagaagauaucucccugcuauuguaagagaagcaauuaaacgaaaacucagaacacugauuuuggcaccuacuagagugguagccagugaaauggcugaggccuugaaagggaugccgauuagauaucagacaacagcaguaaaaucugaacacacugguaaggaaauaguugacuuaaugugucaugccaccuuuacuaugagacuucuuucgccaguuagagucccuaauuacaauaugaucaucauggaugaagcccacuuuaccgacccuaguaguauagccgcuagggguuauaucaguacaagagucggcaugggugaagcggccgcuauauuuaugacagccacaccacccgggagcguggaggcuuucccacaaucuaaugcagucauacaagacgaagaacgagauauuccagaacguucguggaacucagguuaugaguggauaacagauuuuccggguaaaacaguaugguuugugccaagcaucaaaucaggcaaugauauugcuaauuguuuaaggaaaaacggaaagcgugucauacagcuaucuagaaaaacauucgauacugaauaucagaaaacgaaaaacaaugacugggacuacguaguuacgacggauauaucagaaaugggcgcgaauuucagggcagaucgcguuauagauccaaggcguugcuuaaagccuguaauacugaaggauggaccagaaagaguaauccuagcugguccuaugccugugaccguagcuagcgcagcucaacgucgcggacgaauuggacgaaaucauaacaaagaaggagaccaauauauuuacaugggccaaccacuaaacaaugacgaagaccacgcacauuggacagaagcgaaaauguuauuagacaauauaaauacucccgagggaauaauacccgcauuauucgagccagaaagagaaaagucugcagcuauugacggugaauauagacuccgaggugaagcacgcaaaacguuuguagaacucaugcguaggggagacuuaccaguauggcuuucuuauaagguugccucagaaggauuccaauacucugaccgucgcuggugcuucgacggagaacggaauaaucaaguacuagaagaaaauauggacgucgaaauuuggaccaaagaaggggagaggaagaaauuaagaccacgauggcuggaugcgcguacguauagcgauccucucgcguuaagagaauuuaaagaguucgcagcugguagaagaucugucuccggagauuuaauauuagagauuggaaagcucccucaacauuuaacccagagagcacaaaaugcucuagauaaucuuguaaugcuacauaauagugagcagggugguagagcauaucgccaugcgauggaggaacugcccgacacaauagaaacgcucaugcuucuugcacuuauugccguacuaaccggagguguuacauuguuuuucuuauccggaagaggccuaggaaaaacaucuauaggucuucuauguguaauggccaguuccguauuacuauggauggcgucgguagagccacacuggaucgcagcgucuauaauauuggaauuuuuccuuauggugcucuuaauacccgaacccgauagacagagaacuccccaagauaaccaguuggccuauguggugauagguuuacuauuuaugauucugacgguagcugcaaaugagauggguuuguuagaaacaacuaagaaagaucucggcauuggacacguagccguugaaaaucaccaucaugccgcaauguuggauguugacuugcauccggcauccgcuuggacauuauacgcuguugcaacuacaauaauaacaccaaugaugagacauacaauugaaaacacaacagcuaauaucaguuuaacagcuauagccaaucaggcagccauuuuaaugggauuggacaaaggauggccaaucaguaaaauggauauagggguucccuuauuagcacuaggaugcuauagccaagugaauccauuaacccugacggcagcugugcuuaugcuaguggcacacuacgcuauaaucgguccuggauugcaagcaaaggcgacaagagaagcucagaaaagaacugcagccggaauuaugaaaaauccaacugucgacgggaucguggcaauugaccuagauccuguuguuuacgacgcuaaauucgaaaagcaacuuggccagaucaugcuacuaauucuauguacuucacaaauauuacucaugcgaacaacaugggcucuuugcgagucuauaacccuagcaacugguccauugacuacacuaugggagggcucgccagggaaauucuggaacacuacaauugccgucaguauggcgaacauauuuagaggcucauauuuagcaggagcaggacuagcauucucacuuaugaagucuuugggagguggcagaagagguacaggagcacagggagaaacgcucggagaaaaauggaagcgacaacuaaaccaacuaagcaagucugaauuuaauacauacaaaagaucggggauaauggaaguagaucgaucagaagccaaagaaggcuugaaacgcggagagaccacgaaacaugcuguaucacgaggcaccgcuaagcuaaggugguuuguagaacgcaaccuagugaaaccugaaggaaaagugaucgaucuaggcuguggccgagguggcuggucguauuauugugcaggucuuaagaaaguaacagaaguaaaagguuauacaaaaggaggccccggacacgaggaaccuauuccuauggcuaccuauggguggaauuuaguuaaacuacauucuggaaaagacguauuuuucauaccaccagagaaaugugauacuuuauugugcgacaucggcgaaagcagucccaaccccacaauugaagaaggucgaacacugagaguauuaaaaaugguggaaccaugguuaagagggaaucaguuuugcauaaaaauacuuaauccauauaugccuagcguagucgaaacucuugaacagaugcaacgaaaacacgguggaaugcuggugcgaaacccacugagcagaaauucuacccaugaaauguauuggguaucgugugguacuggcaauauaguaagcgcuguuaacaugacaucaagaauguuguuaaaucgauuuacgauggcgcauaggaaaccaacauaugaacgagacguagaccucggcgcagguacccgacacguugcagucgaaccagaggucgcaaacuuagauauaauaggacaacguauagaaaauaucaaacaugaacauaagaguacauggcacuaugacgaggacaaccccuauaaaacaugggcauaccauggaaguuacgaagugaaacccagcggcuccgcuucgucaauggucaauggaguagucaaauuauuaacuaaaccgugggaugucauaccaauggugacacaaauagcuaugacagacaccacgcccuuugggcaacaaagaguauuuaaagaaaagguagauacacgaacacccaaagcaaaacgaggcacggcacaaaucauggaaguaacagcaaaguggcuauggggauuuuugaguagaaauaagaaaccuagaauuugcacuagagaggaauuuacccgcaagguacgaaguaaugcugccaucggugccgucuuuguggacgaaaaccaauggaacagcgccaaggaagcagucgaagaugagcgauucugggaucugguucacagggagcgggagcuacacaaacagggaaaaugugccacaugcgucuauaacaugaugggcaaaagagaaaagaaacuuggugaguuuggaaaagcuaagggauccagagcaaucugguacaugugguugggugcuagauuccucgaauuugaagcacuuggauucaugaaugaagaucauugguucaguagggaaaauucgcuuucuggaguagagggugaaggauuacacaaauugggauauauucuuagagacauaucgaaaauaccaggagguaacauguacgcagaugauacggcaggaugggacacucgaauaacagaagaugauuuacagaacgaagcgaaaauaacagauauaauggagcccgaacacgcuuuacuugcaaaaucuauuuuuaaacucacauaucagaacaaaguggucagggugcaaaggccagccaaaaauggaacuguaauggaugugauaagcagaagggaccagagagggucaggucaaguggguacuuacgguuuaaacaccuuuacaaauauggaagcgcaacugauucgccaaauggagucagaagguauauuuuccccaucugaauuagaaacacccaaccuugcaggucgaguacucgauugguuagaaaagcacgguguagagagacuuaaaagaauggcuauaucgggugaugauuguguagugaaaccaauugaugaucgauucgccacagcgcuaacagcguuaaaugacauggguaaagugaggaaagacauaccacaaugggaaccgucaaaaggauggaaugacuggcagcaaguuccuuucuguagccaucacuuccaucaguuaauaaugaaggacggccgugguaucgucguaccuuguagaaaucaagacgaauuaguagguagggccaggguuagccaaggagcaggaugguccuuaagagaaacagccugcuuagguaaaagcuaugcacaaauguggcaguugauguauuuccaucggagggaccugagacuagcugcgaacgcuaucuguucugcugucccaguagacuggguuccaacaucccguacaacauggucgauccacgcacaucaucaauggaugacaacugaggauauguuaucaguuuggaaccggguauggaucgaagagaaucccuggauggaagauaaaacucauauuagcaguuggggcgauguaccguaccuugguaaacgugaagaucaauggugugguucauugaucgguuuaacugcuagagcgacuugggccaccaauauacaagucgcaaucaaccaggucagacgccucauagggaacgaaaauuaucuagauuacaugacaaguaugaaaagauuuaaaaacgaaucagauccagaaggggccuugugguag

SEQ ID NO: 21962 - RNA, 9879 nt, Artificial Sequence
  derived and/or modified CDS sequence (opt6) from DENV-1__EU482529__SS-prME
ucaguuacaauguuauuaaugcuuaugcccacugcacuagcauuccaccuuacaacuagaggaggagaaccucacaugaucguaucaaaacaagaacggggaaaaucguuauuauuuaaaacaucggcuggagucaauauguguacguuaaucgcaauggauuuaggggaauuaugugaagacacuaugacguauaaauguccacguauuacagaaaccgaaccagaugauguugauuguugguguaaugccacugauacgugggucacauacgguaccugcagucaaacaggugaacacagacgcgacaaaagauccguagcuuuagcgccacauguuggacuaggcuuagaaacaagaacagagacauggaugagcucagaaggugcauggaaacaaauacaaagaguagaaacgugggcacuuagacacccaggcuuuacagucauagccuuauucuuggcacaugcuauagguacuucaauaacccagaaaggaauuauauucauacugcugaugcuaguuacccccaguauggccaugcgcugcguaggaauuggaagucgggauuuuguggaggguuuguccggagcaacuuggguugauguaguucuggaacauggaucaugcguaaccacuauggcuaaagauaaaccuacguuggacauagaauugcuuaaaacagaaguaaccaauccagccguauugaggaagcuguguauagaagccaagauuucgaauacgacgacggacagccgguguccaacacaaggcgaagcaaccuuagucgaagaacaagacgcaaauuuuguuugcagaaggacuuucguagaucgaggguggggcaauggaugcggucuuuucggaaaaggcagcuuaauuacgugcgccaaauucaaaugugugacaaaacuagaaggaaaaauaguccaauaugaaaaucucaaguacucagugauagugacaguucauacaggggaucagcaucaaguagguaaugaaagcacagaacauggaaccacagcuacgauuacuccacaagccccuacaacagagauacaacuaaccgauuauggugcuuuaacacuagacuguagccccaggacaggccuagauuuuaaugagauggugcuacuuacaaugaaagagaaaaguuggcugguucacaaacaaugguuucuggaucuuccgcuaccguggaccagcggugcaaguacccugcaagaaacauggaaucgccaagaucuucuagucaccuucaaaacugcccaugcuaagaaacaagaaguaguaguacuagguagccaagaaggugccaugcauacagcccuaaccggcgcuaccgaaauacagacgagugguacaaccacgauuuucgccggucaccuuaaguguagauuaaagauggauaaauugacacucaaaggcaugagcuacgucaugugcacaggcagcuuuaaacuugagaaagagguagcagagacccaacaugguaccguuuuagugcaaauaaaauaugaaggcaccgaugcaccaugcaaaauaccguucaguacgcaggaugaaaaaggggucacacaaaaugggcgacuaauuacagcgaaucccaucgugacagacaaagaaaagccaguaaacauagaagcagaaccaccauucggagagucauauaucauaauaggagcaggagaaaaagcacuaaagcucucgugguuuaaaaaggguucaucuauugguaagauguucgaggcuacagcaaggggagcaagaagaauggcaauacuuggagacacugcaugggacuucgggaguauaggcgggguuuuuacaucaguugguaaacucguacaccaaauauucgggacagcauacgguguccuuuucucagggguuucguggaccaugaagaucgguauagggguuuugcuaacuuggcucggacuuaauucucgaaguacuucucuuucaaugacauguauagccgucggacuuguaacacuauauuuagguguaaugguccaagcagacucaggauguguaauaaauuggaagggucgugagcugaagugcggaagcggaaucuucgucaccaacgagguucacacauggacagaacaauacaaauuucaagcagauagucccaaaagauugagcgccgcaaucggaaaagcaugggaggaaggaguuugugguauaagaucugccacacgacuugaaaacauaauguggaagcaaaucucuaacgaacucaaccacauauuauuagaaaacgauaugaaauucacuguuguuguaggggacguagcaggcauacucgcacaggguaaaaagaugauucgcccgcaaccaauggaauauaaguauucuuggaaaucuuggggaaaagcgaaaauuauaggugccgacguccagaauacaacauuuaucaucgacggacccaauacaccugaauguccggacgaccaaagagcauggaauauaugggaaguagaggauuauggcuuugggauauucacuacuaauauauggcucaaauugagagacagccacacacaggugugcgaucacagguugaugagugcggcaauuaaagacuccaaggcaguacaugcugauaugggauauuggauugaaucugagaagaaugaaacguggaaacucgcuagagcuagcuuuauugaaguuaaaacguguauuuggccaaaaucgcauacucuuuggucuaaugggguuuuagaaucagaaaugauuauuccaaaaauauacggagguccaaucagucaacauaauuauagaccuggcuauuuuacucaaacugcuggaccuuggcaucuuggcaaacuugaauuagacuuugauuuaugcgaaggaaccaccgugguaguagacgaacacugcgguaaucguggaccgucauugagaacaacaacaguaacaggcaaaauaauucaugaaugguguugccgaucuuguacgcugccuccuuuacgauuucgcggagaagacggaugcugguacgggauggaaauccgaccuguuaaggaaaaggaagaaaacuuagugaagucaauggugagcgccggaaguggagaggucgauuccuucucucucggucuucuauguauaucaauaaugauugaagaaguaaugcgaaguagauggucucguaaaauguugaugacagguacacuagccguauucuuccuacucaucaugggacaacuuacauggaacgaucuaauuagacuaugcauuaugguaggggcuaaugcuuccgacagaaugggaaugggcaccacuuaccucgcauuaauggcaacuuuuaaaaugagacccauguuugcuguuggucuccuuuucaggagauuaaccaguagagagguacuuuugcuaacaaucgggcuuucuuuaguagcuucgguugaacuacccaacagccucgaagaacugggagaugggcuggcaauggguaucaugaucuugaaacuuuugacagauuuucaaagccaucaacucugggcaacacuucuuucucugacauuuaucaagacaacauuuagccuccacuaugccuggaaaacaauggcuaugguguuauccauugucagucuuuuucccuuaugccuaucuacaaccucacaaaagacuacaugguuaccaguacuuuuagggucauuggggugcaagccguuaaccauguuccuuauugcugaaaauaaaauauggggucguagaucauggccgcugaaugaaggcauaauggcagucgguauaguaagcauauuacucucaucucugcugaaaaaugauguaccacuagccgguccauuaaucgcuggagguaugcuaauugcauguuauguuauuucuggaucauccgcagaucugucauuagaaaaagccgcggaagucucaugggaagaagaagcggaacauagcggugccucacauaacauacuggucgaaguucaagacgacgggacuaugaaaauaaaggaugaagaacgugaugauacauuaaccauauuauugaaagcuacacuucuagcaguuagugggguauauccgcuuagcauuccagccacacucuuugugugguacuuuuggcagaagaagaaacaacgcucaggggugcuaugggacacacccucuccacccgaaguagaacgugcaguauuagaugaugggauuuaucggauaaugcaaaggggucuucuugguaggagccagguugguguaggaguauuucaagagaacguguuucacacgauguggcacguaacacguggugcagugcugauguaucaggguaaaagauuagaaccgucaugggcaaguguaaagaaagauuuaauuuccuauggaggaggcuggaggcugcaagguaguuggaacaccggcgaagaagugcagguaauugcaguugaaccugguaaaaauccgaaaaacguccagacugcgcccgggacauuuaagaccccggagggagaagugggagccauagccuuagauuucaagccuggaaccaguggcucgccgauaguuaaucgugaaggaaaaauaguaggucuuuacggaaacggaguaguuacaaccucagggacguacguaagugcaauagcacaagcaaaggcaagccaagagggaccacuaccagaaauagaagaugagguuuuucgaaaaagaaaucuuacaauuauggauuugcauccaggaucuggaaaaacccgacgauaucuccccgcaauagucagagaagcuauuaagaggaaacucagaacacuaauacuugcgcccacuagaguagucgcgagcgagauggcugaggcuuuaaagggaaugccuauaagauaccaaacaacagcggucaaaagcgaacauacuggaaaagaaauuguagacuugaugugccacgcgacuuuuacaaugaggcuuuuaucaccgguaagaguaccaaacuauaacaugauaauuauggaugaagcgcauuuuacggauccuucaucaaucgccgcacgaggguacauaagcacacguguaggaaugggggaagcagcagcuauauucaugacagccaccccaccuggaucuguagaggcauucccacaaucaaaugcaguuauccaggacgaagagagagacaucccagaacguaguuggaacucuggauaugaauggauaacggauuuuccagguaaaacagugugguucguuccguccaucaagagcgguaaugauaucgcaaauugcuuacgcaaaaacgguaagcgugucauacaauugucgagaaaaacauucgauacugaauaccaaaagaccaaaaauaacgauugggacuauguaguaacaacagacauaucggaaaugggagcaaauuuccgcgccgacagagugaucgauccgcgacggugcuuaaaaccuguaaucuuaaaagaugguccugagcgcguaauccuugcagguccuaugccuguaacggucgcaagugccgcacaacgacgagguaggauuggacguaaccacaauaaagaaggugaucaauacauuuauaugggacaaccguugaacaacgacgaagaccaugcccauuggacagaagcaaaaaugcuuuuggauaauauaaacaccccugagggaaucauaccugcacucuucgaaccagaacgagagaaaucugcugcuaucgauggagaguaucguuuacgaggugaggcacggaaaacuuuuguagaauugaugcgacguggugauuugcccguuuggcuaaguuacaaagucgcgucugagggcuuccaauauucugauagaagaugguguuuugauggcgaacguaauaaucaaguauuagaggaaaauauggacguagaaauuuggacaaaagaaggugaaaggaagaaauuacgcccuagguggcuggaugcuaggaccuacagcgauccacuagcgcuuagagaauuuaaggaauuugccgccgguagacgaagugucucaggggacuugauauuagaaauugggaagcuaccccaacaccucacucaacgagcccaaaacgcauuagauaaccugguaauguuacauaacagugaacaggguggcagagcauaccgccacgcuauggaagaacuuccagacacgauagaaacucuaaugcuuuuagcucuuaucgcaguacuaacuggcggaguuaccuuauuuuucuugucaggacgaggucucgguaaaacuagcauagguuuauugugcguuauggcuagcucuguccuccuguggauggccucaguugaaccacauuggauagcagcuucaaucauuuuagaguucuuucuaauggucuuauuaauaccagaacccgacaggcaacguacuccacaggacaaucaguuagcauauguagucauuggguugcuauucaugauacucacuguagccgcgaacgaaaugggauuacucgaaaccacgaaaaaggauuuagguaucggucacguggcaguagagaaucaucaccacgcagcuauguuagacguagaccuccauccagcauccgcauggacccuuuaugccgucgcaacuacuaucauuacaccaaugaugcgccacaccaucgaaaauacuacagcaaauauaucguugaccgcaauagccaaucaagccgcuauauuaaugggauuggauaagggguggccuaucaguaaaauggacauagguguuccgcuacuugcucuugggugcuacucacagguaaauccacuuacgcuuaccgccgcaguucuaaugcuaguugcucacuacgccaucauuggcccaggucuacaggccaaagcaacacgagaagcacagaaaagaacagcagcaggaauaaugaaaaacccaacugucgacgguauuguugcuaucgauuuagauccgguaguuuacgaugccaaguucgagaagcagcucggacaaauaaugcuuuuaauccuaugcacaucccagaucuuacuaaugagaacaacaugggcacucugugaaaguauaacuuuggcaacaggaccguuaaccacgcucugggaaggaucgccuggaaaauuuuggaauacuacgaucgcaguaucaauggcgaauauauucagaggaucuuaucuagcaggggcgggccucgcuuuuucucucaugaaaagccuaggaggaggacgacgugggacaggcgcccaaggugaaacacuuggagaaaaauggaagagacaacuaaaucaauuaucaaaaagcgaguucaacacuuauaaacggucagguauaauggagguggaucguagcgaggcuaaagaaggucuaaagcgcggugaaacaacuaagcaugcaguaucaagaggaacggccaaacuucgaugguuuguagaaagaaauuuaguuaaaccagagggaaaagucauagaccuuggcugcggaagaggcggguggaguuauuauugcgcaggacuuaagaaaguaacggagguaaaaggcuauacgaaaggcgguccaggucaugaagaaccaauaccaauggcaacguauggauggaaccuaguaaaacuucauagugggaaagauguauucuuuauuccaccugaaaagugcgauacauuauugugugacauuggagaaagcaguccaaauccaaccauagaagaaggaagaacguuaagaguauuaaaaaugguggaaccgugguuaagggguaaccaauucugcauuaaaauucuaaaucccuauaugccuagcguugucgaaacacuugaacagaugcaacggaaacacgguggcaugcuagugcgaaacccauuaucaagaaacucuacacacgagauguacuggguaucuuguggaacaggcaauaucguuucggccguaaauaugacaucacguaugcugcucaacagauuuacuauggcacacaggaaaccaacauaugaaagggauguggaucuuggagcugggacuagacauguagcuguugagccagaaguggcaaaucuagauauaauugggcaacgaauugagaacauuaagcaugaacacaaaucaaccuggcauuaugacgaagauaauccuuauaaaacaugggcuuaucaugguucguacgaaguaaaacccagcggcagugcaagcaguaugguaaauggcguagucaaacuucuuacgaaaccaugggacguuauuccuaugguaacacaaauugcaaugacagauacuacaccauuuggacaacaacgaguauucaaagaaaaaguugacacuagaacgccaaaagcuaaacgugguacagcacagaucauggaaguaacggccaaguggcugugggguuucuuaucgcguaauaagaaaccccgaauauguaccagagaagaauuuaccagaaagguccgauccaacgcugcaaucggugcggucuucguugacgaaaaucaauggaacucggcuaaagaagcaguagaggacgaacgauucugggaucuagugcacagggaacgagaauugcauaaacaggguaaaugugcuacauguguuuauaacaugaugggaaaaagggagaagaaguuaggugaguucgggaaggcaaagggaagucgugcaauuugguacauguggcuuggggcucgcuuuuuagaguucgaggcucuaggguuuaugaaugaagaccauugguucagcagggagaacucacucaguggaguugaaggugaaggacuacacaaauuaggguauauauuaagagacaucucaaaaauaccaggugguaauauguacgcagaugauacagcaggaugggauacaagaaucacugaagacgaucugcagaaugaagcaagaaucacagauauaauggaaccugagcaugcacucuuggccaaauccaucuuuaaacuaaccuaucaaaacaaagucguaagaguacagcgaccugccaaaaauggaacagugauggacgucauaucacgacgagaucaacggggaucuggacaaguugguacguacggcuuaaacacauuuacaaauauggaagcacaacugauaagacagauggaguccgaaggaauauucagucccagugagcuagaaacccccaaccucgcugagagaguccuagacugguuggaaaaauacggaguagagagacucaaaaggauggcgauuucuggugaugacugcgugguuaaaccaauugaugaccguuucgcgacugccuugacggcucuuaacgauaugggcaaagugcggaaagauauaccacaaugggaaccgaguaaaggauggaaugauuggcagcaaguacccuuuuguucacaccauuuucaucaauuaauuaugaaggauggacgggagauugucguaccuugucgaaaccaagaugaacugguaggaagggcaagaguaagucagggggcgggauggucauuaagggaaacugcguguuuagggaagaguuaugcccaaauguggcaguuaauguauuuucauaggagagauuuaagguuggcagcuaaugccaucugcagugcaguaccuguugacuggaucccaacaucaaggacgacauggucgauacaugcccaucaucaguggaugacuacagaggauauguugucagucuggaauagaguauggauagaagaaaauccauggauggaggacaagacacacauaagcucauggggagauguaccuuaucuugggaagagagaagaccaauggugcggaaguuuaauuggcuuaacagcgagggcaaccugggcuacuaacauccaaguggcuauaaaucagguuagacgacuuauagguaaugagaauuaucuugauuacaugacauccaugaaacguuuuaaaaacgaaggcgauccagagggugcauugugguga

SEQ ID NO: 21963 - RNA, 9879 nt, Artificial Sequence
  derived and/or modified CDS sequence (opt6) from DENV-1__EU482531__SS-prME
ucaguaacuaugcuauuaauguuaaugccuacugcacuagcauuucauuuaacuacacgcggaggagaaccacauaugaucguaaccaaacaagaacgcgguaaaucuuuguuauucaaaacaagugcgggaguuaacaugugcacauuaauagcaauggauuuaggcgaauugugcgaagauacaaugaccuacaaaugcccaagaauuacagaagcugaaccagaugauguagauugcuggugcaaugcuacagauaccuggguaacauaugguaccuguucccaaacuggagaacacagacgagauaaaagaucggucgcacuagcaccacacguugggcuuggucuugagacaagaacggaaacuuggaugaguuccgaaggagcuuggaaacaaauacaaaggguagaaacaugggcuuuacgccauccgggcuucacuguaauugcuuuauuuuuagcgcaugcaauaggaacgaguauuacccaaaaaggaaucauauucauauugcugauguugguuacaccaucaauggccaugcgcuguguaggcaucggaucucgagauuuuguagaaggguugaguggagcgacuuggguggauguaguacuagaacaugguucauguguaacaacuauggcgaaagauaaacccacucuugauauagaacuacuaaaaacugaaguaacuaacccggcgguccuuaggaaacucugcaucgaagcgaaaauaaguaauacaacaacugacucacgguguccuacucaaggagaagcuacauuaauggaagaacaagacgcaaacuucguguguagacggacguuuguagacagaggcuggggaaauggaugugguuuguuugguaaagggucguugaucacgugcgccaaauucaaaugcguaacgaaauuggaagguaaaauuguacaauaugaaaaucucaaauauagcguaauaguaaccguacacaccggggaucagcaucaagucgguaaugaaucuacagaacacggaacaacagccacgauaacaccacaagcuccgacuucugaaauacaauuaacagauuacggagcauugacacuagacuguucaccccggacagguuuagauuuuaacgaaauggugcuccucacuaugaaagaaaagucguggcuaguacauaaacaaugguuucuagauuugccauuaccauggaccagcggcgcuagcaccagucaggaaacuuggaacagacaagauuuacuuguuacauucaaaacggcccacgccaagaaacaggaaguggugguucuugguagucaagaaggcgccaugcauacagcacuaacaggggcgacugagauacaaacaagugggacuaccacaauauuugcgggccaucuuaaauguaggcuaaaaauggauaaacuaacguuaaaaggaaugucauacgugauguguacagggucuuucaaacuagagaaggagguagcagagacgcaacacggcacaguuuuaguacaaauaaaauaugaagggaccgacgccccauguaaaauaccauuuucuacccaagaugagaaaggaguaauacaaaauggacgucuuaucacggcuaaucccauugucacggauaaagaaaagccgguaaauaucgaggcagaaccaccauucggagaaucuuauauuguaauuggaguuggggaaaaagcacucaaauuaaguugguuuaaaaaggggagcucgauaggaaaaauguucgaagccaccgccagaggagcccguaggauggcuauucuaggagauacagcaugggauuucggcucaaucggaggaguauuuacuuccguagguaaguugguucaucaaauuuucggaaccgccuauggcgucuuauucucaggagucagcuggacgaugaaaauugguauagggguucuauugacuuggcucggucugaauagcagaucaacgucauuaaguaugacauguauugcugugggcuuaguaacauuauaccuuggugucaugguacaggccgauagugguugugugauaaacuggaaaggacgagagcugaaaugugguucaggaauauucguaaccaaugaagugcacacuuggacggaacaauacaaguuucaggcggauucuccgaaaaggcuaagcgcagcaauaggaaaagccugggaagagggugucugcggaauaagaagugcuacuagacuugaaaacaucauguggaaacagauuucgaaugagcuuaaucauauucuucuugagaacgauaugaaauuuaccguaguaguaggggaugucguagguauauuggcucaagguaagaaaaugauacguccacaaccaauggaacauaaauauucauggaaaaguuggggaaaagcaaaaaucauaggggcagacguccaaaacacaacguucauaauagacggcccuaauacacccgaauguccaaacgaccagcgagcauggaauauaugggaaguagaggauuaugguuuugguauuuuuacaacgaauauauggcugaaacuuagagauagcuauacucaggcaugugaccaucgacucauguccgcugcgauuaaggauagcaaggcgguacaugccgacaugggauacuggauagaaucugagaaaaacgaaacauggaaacuagcucgcgcuucauuuauagagguuaaaacguguauauggcccaaaagccacacacuuuggagcaauggaguguuagagucagagaugguaaucccaaagaucuacgggggaccaauaagucaacauaauuaucguccuggauacuuuacacaaacagcuggcccauggcacuuagggaaacucgaauuagauuuugaucuuugugaggguacgacaguugucguagaugagcauugcgguaaccgugguccuucuuuaagaacuacuacugugacaggaaaaauuauucaugaaugguguuguagaaguuguaccuuaccaccuuuaagauuuaaaggugaagacggaugcugguauggaauggaaauacgaccagucaaagaaaaagaggaaaauuuggugaaaagcaugguuucugcgggauccggagaaguugacuccuucucccuaggccuccuaugcaucaguauaaugaucgaagagguaaugcgaagcagauggucgcgaaaaaugcugaugaccgggacauuggcggucuuucuccuguugauaaugggccaacucacauggaacgacuuaauaagacuaugcauaaugguuggagccaacgcaucagauagaauggguaugggaaccacauauuuagcauuaauggcuacauuuaaaaugagaccaauguucgcagucggccucuuauucaggagguugacaaguagagaaguucuguugcuaacgauaggucuaucuuuaguagcuucaguagaguuaccuaauucguuggaagaacuaggagacggcuuagccaugggcauaaugauacucaagcuccucacggauuuucaaucccaucaguuaugggcgacucuuuugucucuuacguucauuaaaacaacguuaucuuuacacuacgccuggaagacuauggcaaugguauuauccaucguaucuuuguucccuuuaugcuuaucaacuacgucgcagaaaacgacgugguuacccguacuguugggaucucucggguguaaaccucuuacaauguuccuaauagcagaaaauaaaauuuggggccggaaguccuggccccucaaugaaggaauaauggcgguaggagucguaucaauauuacuaucuucacuacuuaaaaaugauguaccauuagcgggccccuugauagcaggaggaauguugauugcauguuacgucauuagugggagcagugcagaccugucgcuggaaaaagcagcggaaguuucaugggaagaggaagcugaacauucuggugcaagucacaauaucuuaguugaaguacaagacgauggaacgaugaaaauaaaagaugaagagagggaugauacauuaacuauauuacuaaaagccacauuauuggcagucucaggaguauauccguuaagcauccccgcuacacuauucguaugguauuuuuggcagaaaaagaaacagagaucagggguacugugggauacaccaaguccacccgaagucgagagagcgguuuuagaugacggaauuuacagaauuaugcaaagagguuuacuaggccgaagccaaguugguguugguguauuucaggaaaacguauuccauacaauguggcaugucacccgcggggccguccucauguaucaagguaaacgacucgaaccaagcugggcguccgucaagaaagaucuaauuagcuacggaggcgguuggagauuacaaggaucguggaauacaggugaagaaguucagguaaucgcgguagagccagguaaaaacccuaaaaauguucagacagcacccgggaccuuuaaaacaccagaaggggaaguaggagcaauagcccuggacuuuaaaccuggcacaucaggcucaccaauagucaaucgagaaggaaaaauuguaggucuuuauggaaauggagugguaacaacaucaggaacuuauguaucugccaucgcacaagcaaaagccagucaagaagguccauugccagaaauagaagaugaaguuuuuagaaaacggaacuuaacgauuauggaccuacauccggguagugguaaaacucgccgauacuuacccgcgauuguucgagaagcgauuaagagaaaauugaggacauugauacuggcaccaaccagaguaguugcuucggagauggccgaagcauuaaaggguaugccgauuagguaccaaaccacugcgguuaaaagcgagcauacagggaaagaaaucguggaccuaaugugccaugccacauuuaccaugagauuauuaucuccgguucgaguucccaauuacaauaugauaauuauggacgaagcucacuucacagauccgucauccauugcugcaagaggauacauauccacaagaguagggaugggcgaagcggcagccauauuuaugaccgcaacaccaccugguuccguagaggcuuucccucaaucaaaugcagugauccaagaugaagagagagauauucccgaaagguccuggaauagugguuacgaauggauuaccgacuucccagguaagaccguaugguucgucccaagcauuaaaagcgguaacgacauagcaaauuguuuacggaaaaauggaaagcguguuauacaauuaagccgcaagaccuuugauacagaauaccagaaaaccaagaacaacgacugggauuacguggugacaacagacaucagugagaugggugcaaauuuucgggcagauagaguaauagauccgcgccgcugcuuaaaaccuguaauauuaaaggacggaccugaacggguuauacuugcaggacccaugccugucacugucgcauccgcagcccaacgacgaggcagaaucggacgaaaucauaauaaggaaggggaccaauauauuuauaugggucaaccacugaacaacgaugaagaccacgcgcauuggacggaagcuaagauguuacuagauaacauaaacacuccggaagguauuauaccagcauuguuugagccagaaagggagaaaagcgcagccauagacggugaauaucguuuacgaggagaagcaagaaagacguuuguagaacucaugagacguggggauuuaccgguuugguuaucguacaagguugcuucugaaggcuuucaauacucggauagacgaugguguuuugauggagagagaaauaaucagguucuagaagaaaauauggaugucgagauauggacgaaagaaggggagaggaagaaauuaagaccucgcugguuggacgcaagaacauauucagauccacucgcgcuaagagaauuuaaagaguucgcugcuggucguagaucgguaagcggcgacuuaauucuagaaaucgggaagcugccacaacacuuaacacagcgagcacagaaugcucuggauaaccuagucaugcuucacaauuccgaacagggagguagggcauaccggcacgcaauggaagaauuaccugauacgauagaaacgcuaauguugcuagcacucauugcuguuuugacgggcggagugacuuuauucuuucuuagcggcagaggauuagguaaaaccucaauuggcuuguugugcguuauggcaaguaguguauuacuuuggauggcuaguguggaaccgcauuggaucgcagcgaguauaauauuagaguucuuccuaaugguuuuacuaauaccagaaccugacagacagcgaacuccgcaagauaaccaauuggcauaugucguuauuggacuacucuucaugauccuaacugucgcugcaaacgagaugggguuguuggagacaacuaaaaaggaccuugguaucggucacguugccguugaaaaccaccaucaugcaaccauguuagauguggaucuacauccugccucagcuuggacacucuaugccguagcaacgacgauuauaaccccaaugaugcgacacacgauagagaacaccaccgcuaacauaaguuuaaccgcgaucgccaaccaagcggcuaucuuaaugggacuagauaaaggcuggccgauuaguaaaauggacauaggaguaccucuauuggcucuugguuguuacucucaagucaauccguugacauuaacagcggccguucuaauguuaguggcccauuacgccauaauuggaccaggauugcaagccaaggcaacaagagaggcucaaaaacgaacagcagccggaauaaugaaaaacccaacagucgaugguauagucgccauagauuuagaucccguaguguaugaugcuaaauuugagaaacaacuaggacaaauuauguuacucaucuugugcaccucucagaucuuacuaaugcgaaccacaugggccuuaugugaauccaucacuuuagcuacuggaccguugacaacauuaugggaaggaaguccaggaaaauuuuggaauacgaccauagccguauccauggcuaauauuuuccgugguaguuaucuugccggugccgggcuagcauucagucucaugaaaucucuggguggaggacgaagagguacaggagcacagggagaaacgcugggagaaaaguggaaaagacagcucaaucagcuuagcaaguccgaguucaauaucuauaaacgauccggaauaauggaaguagauagaagugaagcuaaagaagguuuaaagaggggagaaaccacucgacaugcaguuucgcgugggacugcuaaauugagaugguuuguggaaaggaaucugguuaaaccugaagguaaaguaauugauuuaggcuguggacgaggaggauggucguacuacugugcuggacuaaagaaggucaccgaaguaaaaggguauacaaaaggggguccugggcaugaagaaccuauaccaauggcgacuuauggguggaaccucgucaaguugcacaguggcaaagauguauuuuucaccccgccagaaaaaugugauacguuauuaugugauauaggagaaucuucaccaaauccaacuauagaagaaggucgaacguuacgaguguuaaaaaugguagaaccauggcuacguggcaaccaauucugcauuaaaauauuaaauccauauaugccuaguguaguagaaacucucgagcagaugcaaagaaaacacggcggaaugcuuguucgaaauccccuaucgaggaacaguacacacgaaauguauugggugaguuguggaacgggaaauaucguuagugcuguuaauaugacuagcagaaugcuccuaaaccgauucacuauggcucaccguaagccuaccuaugaacgagauguagaucugggugcagggaccagacacguggccguugaaccugaggucgccaaccuagacauaauuggacaaagaauagagaauaucaaacacgagcacaaaaguacuuggcacuaugaugaggacaauccguauaagacaugggcguaucacggaucauacgaggucaaaccuuccggaagcgcuaguucuauggugaacggugucguuaaacucuuaacgaagccaugggaugucauacccaugguuacgcagaucgcaaugacagacacuacaccauucggucaacagcgaguauuuaaagagaaagucgacacaagaacacccaaagcuaaaagaggaacugcccaaaucauggagguaacagcccgguggcuuuggggauuuuuaucgagaaauaagaagccgaggauaugcacgcgagaagaguucacgcgaaaaguacgauccaacgccgcuauaggggccguauuugucgacgaaaaccaguggaauagcgcgaaagaagccguagaagacgaaagauuuugggaucuaguacaaaaagaaagagagcuacacaagcaagguaaaugugcaacuuguguguauaauaugauggguaaacgagaaaagaaacuaggugaauuuggaaaagcaaaagguaguagagccauaugguacauguggcucggggcuagauucuuagaguucgaggcuuuaggguucaugaaugaagaccacugguuuagcagagaaaauucgcucucagguguagaaggcgaaggacuacauaaacuaggauauauucuccgggauauuucaaagauaccugguggcaauauguacgcugacgauaccgcagguugggacacacgcauaacugaagaugaucuacaaaaugaagcgaaaauaaccgacauaauggaaccagagcaugcauuacucgccaccaguauuuuuaaacuaacguaucaaaacaaaguugugcgaguucagagaccagcuaaaaacgggacaguaauggauguaaucucaagaagagaucaacgcggaagcggccaagugggaacuuauggauuaaauacauucacaaacauggaagcacaguuaauuaggcaaauggaaucagaaggaauauuccuuccuucagaauuagagacuccaaaucuagcagagcgaguucuagacuggcucgaaaaacaugguguagaacgcuuaaaaaggauggcaauaucgggcgacgacuguguaguuaaaccgaucgaugaucguuuugccacggcauuaacggcacuaaacgacauggguaaaguuagaaaggauauaccacaaugggagccaaguaagggauggaacgauuggcagcaaguuccguucugcagucaucauuuccaucaauugaucaugaaagaugguagagaaauuguuguaccgugccgaaaucaagacgaacuugucggcagagcgagagugucacagggcgcaggauggucguugcgagagacugcaugucuaggcaagucauaugcacagauguggcaacuuauguacuuucaccgaagagaccuacgguuagcagcgaaugcgauauguagugccgugccaguugacuggguuccuacaaguagaacuacuuggagcauacacgcucaucaucaguggaugacgacagaagacauguuaaguguauggaauagaguuuggaucgaagagaaccccuggauggaagacaaaacucacguuagcaguuggggugacguacccuaccuaggaaagagagaggaucaauggugcgggucacugauugguuuaacugcccgugcuacaugggcgaguaauauacaagucgcgauaaaccaaguaagaagacuaaucgguaaugaaaauuaucuugacuauaugacgucgaugaaacguuuuaaaaacgaaggugauccagaaggagcacucugguaa

SEQ ID NO: 21964 - RNA, 9879 nt, Artificial Sequence
  derived and/or modified CDS sequence (opt6) from DENV-1__EU482532__SS-prME
ucaguuacuauguuacuaaugcugaugccuacugcauuagcauuccacuugacgacacgcgguggggaaccgcacaugauaguaaguaaacaagaacgugguaaaucauuacuauuuaaaacgagugcggguguaaauauguguacauugauagcaauggacuuaggugaauuuugcgaagauacgaugaccuauaaaugcccacguauaacugaagcagaaccugaugauguggauugcugguguaaugcuacagauacauggguaaccuaugguaccuguucucaaacgggagaacacaggcgugauaaacgaagcguagcacucgccccacacgugggacuuggacucgaaacccgaacggagaccuggaugaguagcgaaggugcguggaaacaaauacaaagaguagaaacaugggcgcugagacauccuggauuuacuguaauugcauuguucuuagcgcaugcuauaggaacuucgauaacucagaaggguauuaucuuuauacuguugaugcucgugacuccuucaauggccaugagauguguaggcaucgguucuagagacuuuguagaaggcuugaguggugcaacaugggucgauguaguacuugaacauggcucgugcguaacgaccauggcaaaagauaaacccacacuagauauagaguugcuuaaaacagaaguuacuaauccugcaguccuaaggaaacugugcauagaagcuaaaauaaguaauacaacgacagacagccgaugucccacccaaggagaagcgacuuuaguugaagaacaagaugcaaauuucguaugucgaaggacuuuuguggacagaggaugggggaauggaugcggguuauuuggaaaaggaaguuuaaucacaugcgcaaaauucaaaugcgugacaaaauuagagggaaaaauuguccaauacgaaaaccuaaaauacagcguuauuguaacuguccauacgggcgaccagcaccaaguugggaaugaauccaccgaacaugguacgacagcaacaauaacgccacaagcacccaguacagaaauacaacuaaccgauuacggugcauuaacguuagacuguucaccuaggacaggguuagacuuuaaugaaaugguuuuauugacuaugaaagagaaaaguugguugguacauaagcaaugguuccuagaucuaccuuuaccuuggaccaguggggcuuccacuagccaggaaacuuggaauaggaaggaucuauuaguuacguuuaagacagcccacgccaagaaacaggaaguugucguacuggguucgcaggagggagcaaugcauaccgcuuuaaccggcgcaaccgagauacaaacaagugguacaacaacaauuuucgcuggacaucuuaagugcagauugaaaauggacaaacuaacauuaaaaggaaugucauacgucauguguaccggaucuuuuaaauuggaaaaagaggucgcugagacccaacaugggacaguccucguccagauaaaauacgaaggcacagaugcaccuugcaaaauacccuucucaacgcaagaugaaaaaggcguaacgcaaaacggaaggcuuauaacagcuaauccuauuguaacagacaaagaaaagccaguaaauauagaggcugagccucccuucggagagucuuauauagucauaggggccggagagaaagcccuaaaauuaagcugguuuaagaaaggaaguucaauaggaaaaauguucgaagcgaccgcaaggggagcacgcaggauggccauacucggagauacggcaugggauuuugggucaauaggcggaguguuuacaucaguagggaagcuaguucaucaaauauuugguacggcauacggaguucuguuuucuggaguaagcuggacgaugaaaauagggaucggaguacuguugacuugguugggucuaaacucuaggaguacaucacuaaguaugacaugcauagccguaggacuuguaacacuuuacuugggcguaaugguacaagcggauagugguugcguaaucaauuggaaagggcgcgaacuaaaauguggcucugggaucuuugucacaaaugaagugcauacguggacggaacaguacaaguuucaagccgacuccccaaagcgacucagugcggcuauugguaaagcaugggaagagggggugugugguaucagaagcacaacacgauuggaaaauauaauguggaagcaaauuuccaaugaacuaaaccauauccuccuagaaaacgacaugaaauuuacagugguuguuggagacguugcagggauauuagcccaagguaagaaaaugauacgaccccagccuauggaguauaaguauucauggaaaucaugggguaaagcuaaaauaauuggcgcagauguacagaacacgacauuuauaauagacggaccgaacacgccugaaugcccggaugaucaacgagcguggaauaucugggaaguagaggacuauggauuugggaucuuuacaacaaauauuugguuaaaacucagggacagucacacucaaguuugugaccacaggcuaaugagcgcagcuauuaaagacucaaaagcaguccaugcggacauggguuacuggaucgaaucagagaaaaaugaaacauggaaacucgcaagagcuaguuuuauagagguaaaaacuuguauauggccgaagucacacacacucuggucaaacgggguacuugaaagcgaaaugauaauaccuaagauauauggaggaccuauaagccaacauaacuaucgaucaggauacuuuacacaaacagcuggaccauggcaucuaggaaaacucgaacuagacuucgaccuaugugaggggaccacagucguuguagaugagcacugugguaaccgagggccaucguuaagaaccacaacggucacaggaaaaauuauucaugaguggugcugucguaguuguacccuacccccuuugagauuuaaaggagaagaugggugcugguauggaauggaaauucgucccguaaaagagaaagaagaaaaccuagugaaaaguaugguaucagcagguaguggugaaguagacaguuuuucauugggauuguuauguauuucaauaaugauagaagagguaaugagaucacgauggagucggaaaauguuaaugacaggaacguuagcuguauucuuucuucuaauuauggggcaauuaaccuggaacgaccuaauuagacucugcauaauggugggagccaaugccucagaccgaauggguaugggcaccacauauuuggccuugauggcgacauucaaaaugcgacccauguucgcaguuggucuucuauucagaaggcuuacaucuagagagguccuguuauuaacgaucggacuaagucuaguagcuagcguugaauuaccaaauagccucgaggagcuaggcgauggauuggccauggggaucaugauacuuaaacuuuuaacggacuuucaaagucaucaacucugggcaacacuuuuaucccugacauuuauaaaaacaacauucaguuuacacuacgcauggaagacaauggcaaugguauugagcauagugucauuauuuccucuuuguuuaaguacgaccucgcagaaaacgacauggcuuccuguacuacuuggcucacuuggcuguaaacccuuaacaauguuuuuaauugcagaaaauaaaauuuggggacgaaagucuuggccgcuuaaugagggaauuauggcugugggcauugugucaauauuacuuucgucuuuguugaaaaaugacguaccauuggcggguccccuuauugcagggggcaugcucauugcaugcuauguuauaagugggaguagugccgaccuuucacuggagaaagccgcugagguaucgugggaagaggaagccgaacauuccggagccucucauaacaucuuaguagaagugcaagaugauggcacuaugaaaauuaaagacgaagagagagaugauacuuuaaccauuuuauugaaagcuacauugcuugcaguaucaggaguauauccucuuagcauaccagcgacacuauuuguaugguacuucuggcagaaaaagaaacaaaggucaggaguacuaugggauacaccgagcccuccagaaguugaacgcgccguuuuagacgaugguauauaucgaaucaugcaaagaggucuauuaggaagaagucaagucggcguaggcguauuucaggaaaacguguuucauacaauguggcacguaacaagaggggcgguucucauguaccaaggcaaacgccuagaacccucgugggcauccguaaagaaagauuugauuuccuauggcgguggcuggcgucuccaggguagcuggaauacaggcgaggagguucaaguaaucgcagucgaaccugggaaaaaucccaaaaauguccaaacagcaccgggaacuuucaaaaccagugagggugaaguuggugcaauagcauuagauuuuaaaccagguacgucgggaucaccuauaguaaaucgagagggaaaaauaguuggacuuuaugguaacggcguaguaaccacaaguggaacuuaugucucggcuaucgcucaagcaaaagccucacaagaagggccacuaccugaaaucgaggaugaaguauuucguaaacguaaccuuacuauaauggaucugcauccuggaaguggaaaaacccggagauaccuuccagcgauuguccgggaggcaauaaaaagaaaauuacggacauuaaucuuagccccaacaagagugguugccucagagauggcagaggcgcugaaggguaugccuauucgcuaucaaacgacagcuguuaaaagugaacauacagggaaagaaauuguugaucuaaugugccacgcgacguuuaccaugagauuacuaucuccuguacgaguuccuaauuacaauaugaucauuauggacgaggcacacuucacugaucccucaaguauugccgcgcgcggauacauaucaacacgugugggaaugggcgaagcagcagccauauuuaugacugcuacacccccaggaucgguugaagccuuuccacaaucaaacgccgugauccaagaugaagaacgagacauaccggagcgaucauggaacaguggguacgaauggauaacagacuuuccaggcaaaacuguaugguuuguuccgaguauaaaaagcggaaacgauauagcaaacugcuugaggaaaaacggcaagagagucauucaacucuccaggaagacguucgauacugaguaccaaaagaccaaaaacaacgacugggauuauguggucacaaccgauauaucagaaaugggcgcgaauuuccgcgcugacagagugauagaucccagaagauguuuaaagccugugauacuuaaagaugguccagaacgaguaauucuagcuggaccaaugcccguaacuguagccucggcggcacaaaggagagguagaauagggcgaaaccacaacaaagaaggugaucaauauauuuauaugggucaaccccuaaauaaugaugaagaucaugcacacuggacugaagcaaaaauguuacuugauaauauaaacacuccggaaggaauaauuccagcguuauucgagccugagagagagaagucagcagcaauagauggugaguaucgguuaagaggugaagcgagaaagacguuugucgaacucaugcgucgaggagaucucccagugugguuaucuuacaaaguagcaagugaaggauuucaauauucagaucggcgaugguguuuugacggagaaagaaacaaccaaguccucgaggaaaacauggacguugagauuuggacaaaggagggugaacgaaagaaauuacgucccagauggcuagacgcucgaacuuauagugauccucuagcccuaagagaauuuaaggaauuugccgcagggagacguagcgucaguggggaucugaucuuagaaaucggaaaacuuccccaacaccuuacacagagagcacaaaaugcacuugauaaucuuguuaugcuucauaauuccgaacagggcggcagagcauaucgacaugcgauggaagaauuaccagacacuaucgagacauuaauguugcuagcguuaauagccguuuuaacaggcggcguuacacuauuuuuccuguccgguagaggacuuggaaaaacauccaucggcuugcucuguguaauggcaaguucaguccuauuauggauggcuucuguagagccacacuggauugccgcguccauaauacuugaguucuuucuaaugguacucuuaauaccugaaccagaucgacaaagaacaccacaagacaaccaauuagcauacguagugauaggccuuuuauuuaugauccuaacggucgcagcgaacgaaaugggucuacuagaaacuacgaagaaggaccuaggaauaggacacgucgcagcugaaaaccaucaucaugcugcuaugcuagacguagacuuacacccugcaucagccuggacacuauacgcaguagcaaccacaaucauaacuccuaugaugagacacacuaucgaaaauacaacugcaaauauuucacuuacugccauagccaaucaagcagcaauauuaauggggcuugacaaaggauggccaauaagcaaaauggacaucggugucccucucuuggcacuaggauguuauucgcaaguuaauccauugacgcuaacggcagcgguccuaauguuagucgcgcauuacgcuauaauuggcccugguuugcaagcgaaagcgacacgagaagcacagaaaagaacugccgccgguauaaugaaaaaccccacgguagacggcaucguugcaauagacuuagaccccguuguauacgacgcaaaauucgagaaacaacucggacaaauuauguuacucauuuuauguacaucgcaaauacuauugaugaggacuacuugggcacucugugaaucuauaacccuugcaacgggaccuuuaacaacacuuugggaaggaagcccugggaaauuuuggaauaccacuauagcugugucgauggccaacauuuuucgcggaagcuacuuggcgggagcggguuuggcauuuagccucaugaagaguuuaggggguggccguagagggacuggugcgcaaggagaaacccugggcgaaaaauggaagagacaauugaaucaauugaguaaaucugaauuuaauaccuacaaaagaaguggaauaauggaagucgaccgaagugaagcuaaagaaggucuaaaaagaggggaaaccaccaaacaugcaguaagucgcggcacggcuaaacuaagaugguuuguagaaaggaaucuagugaaacccgaaggaaaaguaauugaucuaggauguggcaggggagguuggaguuauuacugugcuggucugaagaaagucacagaaguaaagggcuacacuaaaggagguccuggacacgaagaaccaauaccaauggcaacuuauggauggaaucucgugaagcuacauagugguaaggauguauucuuuaucccaccagaaaaaugugacacguugcuaugcgauauaggggaaagcucgccuaauccgacuauugaagaagggaggacauuaagaguuuuaaagaugguugaaccguggcuuagggguaaccaauuuuguauuaaaauacugaauccguacaugccgaguguaguagagacucuagaacaaaugcagagaaaacauggaggaauguuagugcgcaauccucuuucuagaaauucgacacacgaaauguacuggguauccugugggacaggaaauauaguaucugcaguaaauaugaccucaagaaugcuauuaaacagguuuacaauggcgcauaggaaaccuacguacgagagagacgucgaucuaggggcaggaacgagacauguagccgucgagccagagguagcgaaucuugauauaauuggucagcgaaucgaaaacauuaaacacgaacacaagaguacauggcauuaugacgaagauaacccuuauaaaacaugggcuuaccauggaucauaugaaguaaaaccgucaggauccgcaucaaguauggucaacgguguagugaaacuacugacaaaaccaugggaugugauaccgauggucacacaaaucgcaaugacugauacaacuccuuuuggucaacaaagaguguuuaaagaaaagguagacacccguacaccaaaagcaaaaagaggaacagcacaaauaauggaagugacugcaaaaugguuaugggguuuucuuaguagaaauaaaaagccuaggaucugcacgcgagaagaauuuacacguaaaguacguaguaacgcagcuauaggcgcaguauuugucgaugagaaccaauggaacuccgccaaggaagcugucgaggacgaacgcuuuugggaucucguacauagggagagggaacuucauaaacaagguaaaugugccacauguguauauaauaugauggggaagcgagagaaaaaguugggagaguucgggaaagcaaagggaucccgggcuauaugguauaugugguuaggagcgagauuuuuagaauuugaagcauuaggauucaugaacgaagaucauugguucaguagagagaacagucuaucuggcgucgaaggugagggacuacauaagcucgguuauauacuucgugacaucaguaaaauaccaggagggaauauguaugcugacgauacugccggaugggauacucgaauaacagaagaugaucuucaaaaugaagcgaaaauaacugacauaauggaaccugaacacgcucuauuagccaaaagcauauuuaaacuaacauaucagaauaaaguaguaagagugcagaggcccgcuaaaaacgguacgguaauggauguaaucuccagacgagaccaaagaggcucuggucaggugggcacuuacggucuuaauacauuuacaaauauggaagcacagcuaauccgacagauggaaagcgaaggaauuuucaguccauccgaacuugaaacaccuaacuuagcgggcagaguuuuggacugguuggaaaaacacgggguggaaagauuaaaaaggauggcuauaaguggcgacgacugcgugguuaaacccauagacgaucgguuugcaacagcgcuaaccgcauuaaaugauauggguaaagugcggaaggauauuccacaaugggagccaucgaaaggauggaaugauuggcaacaaguaccauuuugcagucaucauuuucaucaacugauaaugaaggacggucgagagauuguaguaccgugccgcaaucaggaugagcuaguagggcgcgcacguguaucucaaggcgcuggguggucauugcgagaaacagcuugccuaggaaaaucuuaugcccagauguggcaacuaauguacuuucauaggagagauuuaaggcuugcagcgaaugcuauuuguagcgcagucccagucgauugggucccaacaucaagaacuacauggagcauucacgcccaucaucaguggaugacuacagaggauauguuauccguauggaaccgaguauggauagaagaaaacccguggauggaagauaaaacucacauaaguagcuggggagacgugccuuacuugggaaagagagaagaccagugguguggaagucuaaucgggcugacugccagggcgaccugggcaaccaacauucagguggcaauuaaccaaguuagaagauuaauaggcaaugaaaauuaucuagauuauaugacaaguaugaaacguuuuaaaaaugaaucggacccugagggagcauuaugguaa

SEQ ID NO: 21965 - RNA, 9879 nt, Artificial Sequence
  derived and/or modified CDS sequence (opt6) from DENV-1__EU482533__SS-prME
agcguuacuaugcucuuaauguuaaugccuacagcucuugcguuccaccuaacuacgcggggaggagaaccacacaugauaguaucaaaacaggaacgagggaaaucguuacuguuuaaaacgucagcuggagugaauauguguaccuugauugcaauggacuuaggagaauuuugcgaagacacaaugacauacaaaugcccucgaauuacugaagcggaaccagacgacguugauugcugguguaaugccacugacacauggguaacauauggaaccuguucgcaaacuggagaacacagacgugacaaacgaucaguugcacuugcuccccaugucggauuaggccucgagacgcgaaccgaaacguggaugaguagcgagggugcuuggaaacaaauucaaagaguagaaacuugggcuuuacgacacccgggcuucacugucaucgcauuauuccuagcccaugcaaucggaacgucgaucacacagaaaggaauaaucuucauacugcugaugcucgugacaccguccauggcaaugaggugugucgguauuggcucgagggauuuuguagagggauuaagcggcgcaacuuggguagauguaguacuggaacacggaaguuguguuacgacuauggcaaaagauaaaccaacgcuggauaucgaacuauuaaaaacagaagucaccaauccagcuguucuucguaaacuaugcauagaagcuaaaauaucgaauaccacaacggauagcagauguccgacacaaggagaagccacguuaguugaagaacaagaugcaaacuuuguuugcagacguacuuucguagacagaggcugggguaauggcugcggacuuuucgguaaaggaucacuaaucacgugugcaaaauuuaaaugcguuacuaaacuagaaggaaaaaccgugcaauacgagaaccuaaaauauucgguaauuguaaccguacacacaggcgaucaacaccaaguagggaaugaaagcacagaacacggaacaacggcaacaauaacaccccaagcaccgucaacagaaauacaauuaacagacuauggcgcguugacacucgacuguagcccaaggaccggccucgauuuuaaugaaaugguacuccucacaaugaaggagaaaucaugguuaguucacaagcaaugguuucuugaucuaccauuacccuggacaaguggagcaaguacgucacaagaaacauggaauaggaaagaccuccuuguaacauuuaaaacggcacaugcuaagaagcaggaaguaauuguacuaggaucucaagaaggagccaugcauacagcacuaaccggugcuacagaaauacaaacgucagggacaaccacaaucuuugcgggacaucuaaaaugucgguuaaaaauggauaaacuuacuuuaaaaggcauguccuacgucaugugcacaggaaguuuuaaauuagaaaaagaagucgcagaaacucagcacgguacaguccuaguacaaauaaaauaugaaggaacagaugcgccguguaaaauacccuuuagcacacaagaugaaaaaggagugacccaaaacgggcgguuaauaaccgcaaauccuaucguaacugauaaagaaaaacccguuaauauugaagcugaaccaccauuuggggagaguuauauaguuauaggagcaggggaaaaagcucucaaauuaucuugguuuaagaaaggcucaucaauagguaagauguucgaggcuacugcacguggagccagaagaauggcuauacuaggugacaccgcaugggauuuuggcaguauaggugggguauucacuagcguaggaaaauuaguacaucaaauuuucgguacugccuacggaguacuguuuuccggagucucauggacaaugaaaauuggaauuggaguucuguuaacaugguugggauuaaacucuagaaguacaagucuuucgaugacauguauugcuguuggacuggugacacuguaccugggaguuaugguacaggccgacagcgguugcgucaucaauuggaaggguagagagcuaaaauguggaagcggaauuuuuguaacaaaugaagugcacacuuggacugaacaauacaaauuucaagcggauucgccaaagcgacuauccgcagcaauaggaaaggcuugggaagagggugugugcggcaucaggagugcaacaagguuagaaaacaucauguggaaacaaaucucaaaugaguuaaaccauauacuauuggaaaacgauaugaaauuuaccguggucguaggugacguggcgggaauacuggcucaaggcaagaaaaugauucggccccaaccuauggaauauaaguacucuuggaagucguggggcaaggcaaaaauaaucggcgcagacguacaaaacgcuacuuuuauaauagacgguccgaauacuccugagugccccgaugaccaacgugcauggaauauuugggaaguagaagauuauggauucggaauauuuacaacgaauauuuggcuaaaauuacgggacucuuauacgcagguuugcgaucacaggcuaaugucggccgcuaucaaagacagcaaggcaguucaugccgauaugggauauuggauagaaucagaaaagaacgaaacauggaaacucgcacgugcauccuuuauugaaguaaagaccugcauauggccuaagagucauacuuuguggaguaacggcgucuuagaauccgaaaugauaauccccaaaauauauggaggcccaauaucucagcacaauuaccgccccggauacuucacacaaacagcuggcccauggcaccuaggcaaacuggaguuagacuuugaccucugcgaaggaaccaccguaguaguagacgaacacugcgggaaucgugggccaucacucaggacgacaacaguaacaggaaaaauaauccaugaaugguguugucggucauguacuuuaccuccauuaagguucaaaggugaagacggguguugguauggcauggaaauuagaccagugaaggagaaagaggagaaucuuguaaagaguauggucagcgcaggcucaggagagguugauaguuuuucauuagguuuacuuugcauaucaauaaugaucgaggaagugaugagaagcagauggucgaggaagaugcugaugacagguacgcuggccguauucuuuuugcuaauaaugggucaacuaacguggaacgaccuaauucgauuaugcauaaugguuggagcuaaugccagugacaggauggguauggguacuacauaucuagccuuaauggcaacuuuuaaaaugcgaccgauguucgcaguaggauuacuauuucgccgacuaacaagccgcgaagucuuauuauugacuaucggacugucacugguagcaaguguugaacuccccaauagccuggaggaacuaggagauggacuagcaaugggaauuaugauccuuaaauuacugacugauuuucaaagucaucaacuaugggcgacauuacuaucacugacauucauaaaaacaaccuucucauuacauuacgccuggaagacaauggcaaugguacuaucaauaguuagcuuauucccuuuauguuuaucaacuacuucacagaaaacuacguggcugccgguccuacuaggaucgcucggaugcaaaccacuaacgauguuuuuaauugccgaaaacaaaauauggggacgaaaaaguuggcccuugaaugaaggaaucauggcagucgguauaguuuccauauugcuuagcagcuuacuuaaaaacgauguccccuuagcagguccucugauugcaggaggaaugcuaauagcauguuauguaauaucaggaucaucggcggauuugucauuagaaaaagcagcagaagucaguugggaagaggaggcugaacauaguggagcuagccauaauauucuuguugaaguucaagacgacgguacaaugaaaaucaaagacgaagaaagagacgacacguugaccauacuacuuaaagcaacccuauuagccgucagugguguguauccucuaucaauaccggcaacccuuuuuguaugguauuucuggcagaagaagaaacaaaggagugggguauugugggauacuccuagcccucccgaagucgaacgagccgugcuagacgacggcaucuauaggauuaugcagaggggauuguuagguaggucucaaguagguguuggagucuuucaagagaauguauuccacacuauguggcauguaacgcgaggcgcuguacuaauguaucaagguaaacgucuagaaccuucaugggcaucugugaagaaagauuuaaucucuuauggcggggguuggagguugcaggggucuuggaacacaggggaagaagugcaaguuaucgcaguugaaccuggcaaaaaucccaagaauguacaaaccgcuccuggaacuuucaaaacaucugaaggagaaguuggagcuauagcacuagacuuuaaacccggaacaucuggaagccccauagucaauagagaaggaaaaauaguaggucuguauggaaacggugugguaaccacgucaggaacauacguaucagcaauagcgcaagcuaaagccagucaagaggggccacuacccgagauagaagaugaaguuuuccguaaaaggaaccugacuauuauggacuugcacccaggcucggguaagacaaggcgguaucuaccggcaaucgucagagaagcaauaaaaagaaaacuaagaacuuuaauauuagcgccaacuagaguaguugccucagagauggccgaagccuuaaaagggaugccaauccgauaccaaaccacagcagucaaaagugagcacacagguaaagaaauugucgaccucaugugccacgccacauucacuaugagauuguuguccccgguaagaguaccuaacuacaauaugauaauaauggacgaggcacauuucacggauccaucgagcauagcugccagagguuacauauccacacguguaggaaugggagaagcggcggcgauuuuuaugacagcuacuccaccaggaucgguagaagcauuuccacaaucgaaugccguaauccaagacgaagaacgggacauaccugaacgcucuuggaacaguggauacgaauggauuacagauuuuccaggaaagacaguuugguuuguccccucaauaaaguccggcaacgacaucgcaaacugucugaggaaaaaugggaaaagaguuauccaacuuucacgaaaaacauuugacaccgaauaucaaaagacuaaaaauaaugauugggacuaugugguaaccacagauauaucagagaugggagcaaacuuucgcgcagauagaguaauagauccgagaagaugucugaaacccgucauauuaaaagaugguccagaacgaguaauccuugccgggccaaugccaguaaccguggcuuccgccgcacagcgacggggaaggauaggcaggaaccacaacaaggagggagaucaauauauuuacaugggacagccacucaauaaugaugaagaccaugcgcauuggacggaagccaaaauguugcucgauaauauaaacacacccgagggcauuauaccagcauuauuugaaccagaacgugagaaaagugcagcgauugacggcgaauaucggcuacguggugaggcaaggaaaacuuuuguugaauuaaugagacgaggagacuuaccuguuugguuaagcuacaaaguggcaagcgaaggauuccaguauucugauagacgcuggugcuuugauggcgaaagaaauaaucaaguacucgaggaaaacauggauguggaaaucuggaccaaggaaggagaaaggaagaaauuaagaccacggugguuagaugcgcgaacauauucagauccacucgcgcugagagaauuuaaagaguuugcggcuggaagacggucagucucaggagaucuaauauuggagauaggaaagcuaccucagcacuugacacagagagcacaaaacgcguuagauaauuuagugauguugcauaacucugaacagggcggucgagcauauaggcacgcuauggaggaacuuccugacacaauagagacacuaauguuguuagcauuaauagcuguauuaacagguggaguuacucuguuuuuccugucgggaagagguuuagguaaaacaaguauugggcuuuuaugugugauggcaucgucaguauuauuauggauggcuucgguagaaccccacuggauagcugcaucuaucauacuugaguucuuucugauggucuuacuaauuccugaaccugauaggcagcgcacuccacaagauaaccaauuagcuuauguaguuauagguuuacuguuuaugaucuugaccgucgccgccaacgagaugggcuuacuugaaaccaccaagaaagaccuagggauaggccaugucgcgguggaaaaccaccaucaugcggcgaugcuagacgucgaucuccauccagcuucggcauggacacuguaugcuguagcuacaacuauaauaacaccuaugaugagacauacuauagaaaauacgacagccaacauaaguuuaacggcaauagcgaaccaagcugcaauauuaauggguuuagauaaagguuggccaauaucuaagauggauauaggagucccauuauuagcccuaggauguuacagccaaguuaauccuuuaacacuaacagcugccgugcuaaugcuaguagcacacuacgcuauuauugguccuggauuacaagccaaggccacuagagaagcacaaaagcgaacagcagcaggaauaaugaagaaccccacaguagacggaauagucgcgaucgaccuagacccuguaguauaugacgcaaaauuugagaaacaguuaggacaaauaaugcuacuaauucuuuguacaucccagauauugcugaugcgcacgacgugggcccuuugcgaaucuaucacauuagcaacaggucccuuaacuacccuuugggaaggcucccccgggaaauucuggaacacuacuauagcgguaucaauggcuaauauauuucgcggcaguuauuuagcaggagcuggucuugcguuuagcuuaaugaaaaguuugggaggcgguaggagggguacaggugcccagggggaaacucuaggagaaaaauggaaacgacaacugaaucagcucucaaaaagcgaauuuaauacauacaaaagaucaggaauaauggaaguagacaggucugaagcuaaagaaggacugaaaagaggggaaacuacuaagcaugcuguuaguagaggaacugcaaaauuaaggugguucguugaaagaaaccuagucaaaccggaagguaaagugauagaucuaggaugcggaaggggcggcuggucuuacuacugugccggauuaaagaagguaacagaggugaagggauacacgaaaggagguccgggucacgaagaaccaauaccaauggcaacauacggauggaaccuaguaaaauuacacuccggaaaagauguauucuuuaucccuccagaaaagugugacacacuguugugugauaucggagaaucuaguccuaauccaacaaucgaagaaggccguacucucaggguauuaaagaugguggagccuuggcuucgggggaaccaguuuuguauaaaaauacuuaacccuuauaugccuaguguuguugaaacauuagagcaaaugcaaaggaaacacgguggcaugcuuguuagaaauccccuuucacguaacucaacacaugaaauguacugggucucauguggcacagggaacauaguuucagcagugaacaugacaaguaggaugcuccuaaacagguuuacuauggcacauagaaagccaacauaugaaagagacguagauuuaggggcagguacacgccauguagcuguagaaccagaaguagcuaaccucgacauaauagggcaaagaauugaaaacauuaagcacgaacauaaaucgaccuggcauuaugacgaagacaauccuuacaaaacaugggcguaucauggaucauaugaaguaaaacccucgggaagcgcgaguagcaugguaaaugggguaguaaaauuauuaacgaaaccaugggacguaaucccaaugguuacgcaaauugcgaugacugauacaacaccguucgggcagcaaagaguauucaaagagaaaguggauacucgaacaccuaaggcuaaacgcgggacagcccagauuauggaaguuaccgcaaaauggcuuuggggauuccuaucacguaauaaaaagccaagaauaugcacccgugaagaguucacuaggaaaguaaggaguaaugccgcuauuggagcaguuuucguagacgaaaaccaauggaacucagccaaagaagcuguugaagaugagagauuuugggaccuagugcacagagagcgagaguugcacaagcagggaaaaugcgcaacauguguauauaacaugaugggaaagcgagagaagaaauugggagaauuuggaaaagcuaaaggaucucgagcaauuugguacauguggcuuggagcaagauuuuuagaguucgaagcucuaggcuuuaugaaugaagaucacugguuuucucgugaaaauucacucaguggcguugaaggcgagggacuacauaagcuagguuauauacucagggacauaaguaaaaucccagguggaaacauguacgcagaugauacagcagguugggauacaagaauaacagaagacgaucuacagaacgaagcuaaaauaacggauauaauggaacccgaacaugcacuccuugcuaaaucgauauuuaaauuaacauaucaaaauaaagucguucguguucaaaggccggcgaaaaaugggaccguaauggacguuaucucacgccgcgaucaacgaggaagcggccaaguuggaacauauggucuuaauacauucaccaauauggaagcucaguuaaucaggcaaauggaaagugaggggauuuucagccccuccgaacuugaaacacccaauuuagcaggaagaguacuugacuggcuugaaaagcaugggguagaaagauuaaaaagaauggcaauuuccggcgaugauuguguuguaaaacccaucgaugacagguucgcaacagcuuugaccgcacuaaaugauaugggaaaaguaaggaaagauauuccacaaugggaaccuaguaaaggauggaaugauuggcaacaggucccuuucuguagccaccauuuucaccaauuaauaaugaaagauggacgagaaauagucguaccguguagaaaccaggaugaauuaguggguagagcccgaguaagucaaggagcagguuggucucugagggaaacagcuugucugggaaaauccuacgcacaaauguggcagcugauguacuuucaucguagggaccuccggcuagcagcaaaugcgauauguagugccgugccuguagacuggguccccaccucucggacaaccuggucuauccaugcucaucaucaauggaugacuacagaggauaugcucaguguauggaaccgcguguggauagaagaaaacccuuggauggaagauaaaacucauauaagcucguggggugauguuccguaccuuggcaaaagagaggaccaaugguguggcucauugauuggguugacugcgagagccacaugggcaacaaacauucaaguagcuauaaaucaaguuagaagauuaauagguaaugaaaacuaucuugauuauaugaccucuaugaagcgguucaagaacgagagcgauccggaaggagcuuugugguaa

SEQ ID NO: 21966 - RNA, 9879 nt, Artificial Sequence
  derived and/or modified CDS sequence (opt6) from DENV-1__EU482534__SS-prME
agugucacgauguuauuaauguuaaugcccacugcauuggcauuucaucuaaccaccagaggaggugaaccccauaugauagugaguaaacaagaacgugguaaaagucuacuauucaaaacaucugcagggguaaacaugugcacacucaucgccauggacuuaggagaauuuugugaagauaccaugacguacaaauguccaagaauaacagaagcagaaccagacgauguugauuguuggugcaaugccacagauaccuggguaacguauggaacuuguucucaaaccggcgaacacaggagggauaaaagaagcguugcucuugcuccgcacgugggacuaggcuuggaaacucgaacagaaacguggaugucaagcgaaggagcauggaaacaaauacaacgaguagaaacgugggccuuaagacacccaggguucacagugauagcacuauuucuugcacacgcaauaggcacgucgauaacacaaaaagguauaauauuuauucuucugauguuaguuacaccaaguauggccaugcgguguguaggcauaggcagcagagacuuuguugaaggguugagcggugcuacguggguugaugugguauuggaacacggauccugcguuacuacaauggccaaagacaaaccuacuuuagauauugaauuauuaaaaacagaagucacaaacccggcaguacuucgcaaacuuuguauagaagcgaaaauuaguaacacaacuacggacucccgaugcccaacacaaggcgaagccacgcugguugaagaacaagacgcaaauuucguuugccgacgaacauuuguagaucgaggauggggaaacgggugcggacuuuucggcaaaggcagucuuauuacuugugcaaaguuuaaguguguuaccaaacuagaagggaaaauaguucaguaugagaauuugaaauauaguguaauaguuacaguucauacgggcgaucaacaccaaguggguaaugaaucgacugaacacggaacuacagcaacaauuacaccgcaggcacccaguacugaaauucaauuaacggacuauggugcucucacccuugauuguucgccccgcacuggacuggacuucaaugaaaugguuuuauuaacuaugaaggaaaaaucuuggcuaguucacaagcagugguuucuugaucucccacucccauggacaucuggagcuucuacaucucaggaaacauggaacagacaagauuuguuagucacauuuaaaacggcccacgccaagaaacaagagguugucguauuggguucucaagagggagcuaugcacacugcguuaacuggagccacagaaauucagacaagcggaacaaccacgaucuuugccggucauuuaaagugucgacuaaagauggacaaauuaacacucaaaggcaugucauacgucaugugcacugggucuuuuaagcucgagaaagaaguagcagaaacucaacaugggacagucuuaguucaaauaaaauaugagggcacagaugccccauguaaaaucccauucucaacccaagaugagaaaggcgucacacagaacgguagauuaauaacugccaauccuaucgucacugauaaagaaaaaccggucaauauagaagcagagccacccuuuggagaaagcuacauagugauuggugcuggagaaaaagcacuaaaauuaucgugguucaagaaaggaucgucuauuggaaaaauguuugaagcaaccgcaagaggagcaagacgaauggcaaucuugggagauacugcaugggauuuuggaaguauagggggugucuucacaaguguugggaaacucguacaucaaauauuugggacagccuauggcguauuauuuagcggaguauccuggacgaugaagauuggaauaggcguucucuuaaccuggcuuggauuaaauucgagaucaacuagccuuucgaugacgugcauugcaguugggcuaguaacuuuauaccuaggaguaaugguccaagcagauaguggcuguguaauaaauuggaaaggcagagaacuaaaguguggaucagguaucuucguaacaaacgaaguacauacauggacggaacaauacaaauuccaagccgacaguccaaaacgauuaucagcagcaauugggaaagcaugggaagaaggagugugugggauuagaucugcaacaagacuagaaaauauuauguggaaacaaauuucaaacgagcuuaaucauauauuguuagaaaacgacaugaaacuuaccguuguugugggagacgucgcagguauauuggcacaaggcaagaaaaugauaagaccucaaccaauggaauacaaauacuccuggaaaucgugggggaaagcaaaaauaauaggagcagauguccaaaauacaaccuuuauaauugacggcccuaauacuccugaauguccagaugaucaacgugcguggaacauaugggaagucgaagauuauggauucgguauauuuaccaccaauauuuggcugaagcuacgugacagcuauacgcaagugugcgaucauaggcuaaugucugccgccauuaaagauucaaaagcagugcacgcagacaugggauacuggaucgaaagcgagaaaaacgagacauggaaacuagccagagcaaguuucauagagguuaaaacaugcauauggccaaaaucccacacccuuuggaguaauggcguguuagaaagugaaaugauaaucccuaaaauuuacggugguccgaucucgcaacacaauuaccgaccuggauauuuuacacaaacagccgguccuuggcaucuaggaaaacuagagcucgauuucgaucucugugaagguacgacgguaguuguagacgagcauugcgguaaucgagguccuagcuugcgaacuacuacugugaccggcaaaaucauccacgaauggugcuguagaaguuguacacuuccgccacuuagauuuaaaggagaagauggauguugguauggcauggaaauucgaccaguaaaagagaaagaagaaaacuuaguaaaauccauggugagugcagguucuggagaaguugacagcuuuagccuaggauuacuaugcauaucgauaaugauagaagagguaaugcguucaagguggucaagaaagaugcuuaugacgggcacauuagcuguguuuuuccuuuuaauaaugggacaacuaacuuggaacgaucugauuagacucuguaucaugguuggugccaacgcaagcgaccgaauggguaugggaacuacauaucuugcacugauggccacguuuaaaaugagacccauguuugcgguaggauuauuguuccguagacuaacaucuagagaaguauuauuacuaacgauuggccuuucauugguggccaguguugaacucccuaauuccuuagaagaauugggugauggccucgccaugggaauuaugauacugaaacuacuaacagacuuucaaagccaucaacuuugggcuacgcuacuuucacuaacauucgugagaacaacauucaguuuacacuacgcauggaaaacuauggcuaugguauuaagcauaguguccuuguucccucuaugucuaucgaccaccucucagaaaaccacgugguuaccaguucugcuuggcagccuuggcuguaaaccacuuacaauguuccuaaucgcugaaaauaaaaucuggggaagaaaaucauggcccuuaaaugaagguauuauggcagucggaauaguaaguauuuuacuaaguucacuucucaaaaaugacgugccauuagcuggaccacuaauagccggagggaugcuuauugcuugcuacguaauaucagggagcagugccgaucuaucgcuugaaaaagcagcaguaguuaguugggaagaggaagcugaacacucuggagcaagucacaauauacucgucgaaguucaggacgauggaaccaugaagauaaaggaugaagaaagagaugacacccuaacaauuuuauuaaaagccacucuccuugcagugaguggaguguacccauugucaauaccagccacacuauucguuugguacuuuuggcagaaaaagaaacaacggaguggaguauuaugggauacgcccaguccaccugagguagagcgagcgguacuagacgaugguauuuauaggauaaugcaacgaggacuacuggguagaucacaaguugggguaggcguauuucaggaaaacguguuucacacaauguggcaugucacaagaggcgcugugcugauguaucaggguaaaagauuagaacccucaugggcuuccgucaagaaagacuuaaucucauauggugguggguggcgguuacaagguuccuggaacacuggggaagaggugcaaguaauugcuguugaaccaggaaagaaccccaaaaauguacaaacagcccccggaacauucaagacaucagaaggggagguaggugcuauugcgcuagauuuuaaaccagguacuucaggaaguccaaucguaaauagggaagggaaaauugucggucucuacggaaaugguguuguaacaacaucuggcacauacguuuccgcuauugcgcaagcaaaggcuucacaagaaggaccacuaccugaaaucgaagaugaagucuucagaaaaagaaaucugacaauaauggacuugcacccgggaucugggaaaacgcgaagauacuuaccagcaauuguaagagaagcgauaaagaggaaacuaagaacucuaauccuagccccaacaaggguaguggcaucagagauggcugaagcauuaaaagggaugccaaucagauaccagacuacagccgucaaaucugaacacacuggaaaagaaauaguagaucuaaugugucaugcuacauucacgaugaggcuauuaucacccguuaggguacccaauuauaauaugauuaucauggaugaggcucauuucacggauccuagcagcauagcagcaagaggauauauaucaacuagagucggaaugggggaagccgcagcaauuuuuaugacagcaacacccccagggucgguagaagcguuuccucaaaguaaugcuguaauacaggacgaagaaagggauauaccagagcguaguuggaacucaggauacgaauggaucaccgacuuuccaggcaaaaccguuugguucguuccaucaaucaaaucagggaaugacaucgcaaauuguuuacgaaagaauggcaagagagugauacaacuuucaagaaaaacuuuugauacugaauaucagaaaaccaaaaauaaugauugggauuaugugguuacaacagauauuagugagaugggcgcgaauuuucgugcagaucgagucaucgauccaaggaggugucuaaaaccgguaauacugaaagacggaccagaacgagugauucuagcaggaccuaugccaguaacagucgcaagugcugcgcaaagaagagggagaaucgggagaaaucacaauaaagaaggugaccaauacaucuauaugggucagccacuaaauaacgacgaggaccaugcucauuggacagaagcaaaaauguuauuggauaauauuaacacccccgaaggaauuauuccggcacucuucgaacccgaacgagagaaaagcgcagccauagacggugaguauaggcuacggggagaagcaaggaaaacuuucguagaacuuaugcgaaggggcgaucuaccgguuugguuaaguuauaaaguggccagcgaaggauuucaauauucagaucggaggugguguuucgauggugaaagaaauaaucaaguuuuagaggagaacauggacguugaaauuuggacgaaagaaggggaaaggaagaaauugcguccucgauggcuagacgcuagaacguacagcgauccccuugccuuacgggaauuuaaagaauuugcugccggucguagaucaguaucgggagacuugauacuugaaauuggaaaacuuccgcaacacuugacacaacgggcgcagaaugcacuagacaacuugguaaugcuacacaacucugaacagggugggagagcguauagacaugcaauggaagaacuucccgacacuaucgaaacuuugaugcugcuagcucuaauugccguuuugacaggagguguuacguuauucuuuuuaaguggaaggggacucggcaaaacaucgauuggccuguugugcguaauggcuagcucuguucuuuuauggauggcaucaguagaaccacauuggauagcggcaucuauaauauuagaguucuuuuuaaugguccuauuaauaccggaaccugaccgucaaagaacaccgcaagauaaucaacuugcauaugugguuauaggacucuuauucaugauacucacggucgcagcaaaugaaaugggucuguuagaaacgaccaaaaaggacuuggggauuggucacguugcaguugaaaaucaucaccaugccgcaaugcuugauguagaccuacacccagcuagugcuuggacucucuacgccguagcaacaacaauuauaacacccaugaugaggcauaccauagaaaauacaaccgcaaacauaucccugacugcaauugcuaaucaagcagcuauacucaugggacuugauaaaggauggccaauaaguaagauggacauuggaguaccacuucuagcuuuggguugcuauagccaaguaaacccgcuaacauugaccgccgcagucuuaaugcuuguggcgcauuaugcgauuaucgguccgggauugcaggcaaaggcgacaagagaggcgcagaaacgaacagccgcaggaauuaugaaaaaccccacuguagaugggauuguugcaaucgaucuagauccuguaguuuacgaugcuaaauuugaaaaacaacuaggucaaauaaugcuacuuaucuuaugcacuucucagauauugcuuaugcgaacaaccugggcuuuaugugaaaguauaacacucgcgacagggccuuuaacuacacugugggaaggaucgccugguaaauucuggaauacaacgauugcaguaaguauggcuaacauauuccgaggcucauaucuggccggagcaggauuagcauuuucgcuaaugaaaagucuuggaggaggaagacgggguaccggggcacagggagaaacacugggugaaaaauggaagagacaacuaaaccaauuaaguaaaucggaauuuaacacguacaaacguagcgguauaauggagguagacagaucagaagccaaggaaggauuaaaaagaggugaaaccacgaaacaugccguuucacgugguacagcuaaguuaaggugguucgucgaacgaaacuuagugaaaccagaaggaaaaguaauugaucuaggaugcggucgaggagggugguccuacuauugcgcaggucuaaagaaagucacugagguuaagggauauacgaaaggaggaccaggacaugaagaacccaucccuauggcuaccuauggauggaaccuaguaaaacugcacucuggaaaagacgucuucuuuauaccaccagagaagugugauacacuacuaugugauauaggugaaagcaguccaaauccaacuauugaagagggacgcacuuuaagaguacucaaaaugguagagccguggcuccgggggaaccaguuuuguauaaaaauauuaaauccauauaugccaagcguaguugaaacauuagaacagaugcagcggaaacauggaggcauguuaguccggaauccuuuauccagaaauucaacgcaugaaauguauuggguaucgugugguacaggcaauaucgugagugcagugaauaugacuagccgcaugcucuuaaauagauucacaauggcacacagaaaaccuacguaugaaagggauguugacuuaggagcugguacaaggcacgucgcgguggagccggaagucgccaaccuugacauuaucggucagaggaucgaaaauauaaaacaugagcacaaauccacauggcauuaugaugaagacaauccauacaaaacaugggcuuaccacggaucuuacgaaguaaagccaagcggaucugcaucaaguaugguaaauggagucguaaagcuacuaaccaaaccuugggacgugauuccgauggucacacaaaucgccaugacagauacgacgccauucgggcaacagcgcguauuuaaagagaaaguggauacaagaacgccgaaagcuaaaagagguacugcucaaauuauggaaguuacagcuaaauggcuauggggguuccugaguagaaacaagaaaccucgaauauguacccgagaggaauuuacaaggaaagugcgaucgaaugcggcuauaggagcaguauucguugacgaaaaucaauggaacucugccaaagaagccguugaagaugaaagguuuugggaucucguucaucgggaacgagaacuacacaaacagggaaagugugcaacauguguguauaauaugaugggaaaacgggagaagaaauugggcgaguuuggaaaagcaaaaggcucuagagcaauaugguacauguggcucggcgcgagauuccuggaauuugaagccuuaggauuuaugaacgaagaucacugguuuagcagagaaaauucuuugucuggaguugaaggagaagguuugcauaaacuugguuacaucuuaagggauauuagcaaaauaccaggaggcaauauguaugcagaugacacugcggguugggauacgcgaauaacugaagaugaccuacaaaaugaggcuaaaauaaccgauaucauggaaccggagcaugcuuuguuagcaaaaaguauuuuuaaauuaacuuaccaaaacaaagucguaaggguucagagaccggcuaaaaauggcacgguaauggauguuauauccagaagagaccaaagaggcucggggcaaguaggcacauacgguuugaacacguuuacgaauauggaagcucaacuuauaaggcaaauggaaucugaaggcauauuuaguccaucggaguuagaaaccccuaauuuagcaggucgaguucuggacuggcucgagaaacacggaguugaaagacucaaaaggauggccauaucaggagacgacugugugguaaaaccuauugacgaucgguuugccacagcuuugaccgcucuuaaugauaugggcaaaguaagaaaagacauuccccaaugggaaccaucaaaagguuggaaugauuggcaacaaguacccuuuuguucgcaucauuuucaccaauugauaaugaaagaugguagagaaauuguagucccuugcagaaaccaagacgaacuuguuggcagagcaagagugagucaaggcgcugguuggagccuuagggagaccgcgugcuuaggaaaaaguuacgcucaaauguggcaacuuauguauuuucacagaagagauuuacguuuagcugcuaaugcaauaugcucagccguaccaguugauugggugccuaccagcaggacgacauggucaauacacgcgcaccaucaauggaugacaaccgaagauaugcuuaguguuuggaacagaguauggauagaggagaauccguggauggaggacaaaacacauauaagcucuuggggagauguaccguaucuagguaaacgggaggaccaguggugugguagcuuaauagguuuaacagccagggcuacaugggcaacaaauauucaaguugcaauuaaccaagucagacgacuauuaggaaaugaaaauuacuuagauuauaugacaaguaugaaaagauuuaagaacgagucggauccugaaggcgcuuugugguga

SEQ ID NO: 21967 - RNA, 9879 nt, Artificial Sequence
  derived and/or modified CDS sequence (opt6) from DENV-1__EU482535__SS-prME
ucaguuacuauguugcuuaugcuuaugcccacagcacuagcauuucauuuaaccacaagaggaggagaaccacacaugauagugacaaaacaagaacgcggaaaaaguuuguuauuuaaaaccagcgcuggaguaaauauguguacauuaauugcuauggauuuaggagaacuuugcgaagauacuaugacuuauaaaugcccccgaauuacagaagcagaaccagacgauguugauugcugguguaacgcaacugauaccuggguaaccuauggaacuugcagucaaacaggagaacaucgacgugacaaaagauccgucgcauuggcuccucauguuggucugggauuagaaacgagaacugaaacauggaugagcucagaaggagcauggaaacaaauacaaagaguagaaacgugggcuuuaagacacccugguuuuacaguaaucgcauuauuccuagcacacgcaauugggaccucuaucacucaaaaaggaauuauauucauacuauuaaugcucguuacucccuccauggccaugagaugugugggcauuggaucgagagauuucguggaagguuugucaggagccacauggguagacguugucuuagaacauggaucuugcguuacgacaauggcaaaagauaaaccaaccuuagacauagaauuacuaaaaacggaaguaacgaauccggcuguacuacggaaauugugcaucgaagcgaaaauaucaaacacgaccacugauucccgaugcccgacacaaggugaagcuacuuuaauggaagaacaggaugccaauuuuguaugcagacgaacuuucguugacaggggcuggggaaauggaugcggcuuguuuggaaaaggcaguuuaauuacaugugcaaaauuuaaauguguuacuaaacuugaagggaaaauaguacaguaugaaaaccucaaauauagcguaauaguaacaguucauacuggggaucaacaucaagucgguaacgaaucaaccgaacacggaacuaccgcaaccauuacuccucaagcuccuacuucagaaauacaacugacagacuauggcgcucuuacuuuagacugcucaccaaggacuggacucgauuucaaugaaaugguccuccuaaccaugaaggagaaaaguugguuggugcauaaacagugguucuuagaucuaccuuugccuuggacaucaggagcaucaacaucucaagaaacauggaauagacaagaucucuugguaacauuuaagaccgcacacgcuaagaaacaggaagugguaguccuagggucacaagaaggagcgaugcacacugcacugacuggugcgacagaaauacaaacaucaggaacaacaacaauauucgcaggacaucuaaaauguagacucaagauggauaaguuaacucugaaggggaugucguauguuaugugcacuggcagcuucaaacuagagaaagaagucgcagagacacaacauggaaccgucuuaguacaaaucaaauacgaaggaacugaugcaccguguaaaauuccauuuagcacccaagaugagaaaggcgucacacaaaauggaagacugauaacugcuaacccaaucgucacggauaaagaaaaaccgguuaauauugaagcggaacccccuuucggggaaaguuauauagucauaggugccggugaaaaagcauuaaaauuaagcugguucaagaaaggcaguagcauuggaaagauguuugaagcaacugcgcgaggagcaagaagaauggcuauccuuggagauacugcaugggauuuuggcucuauugggggaguuuucacaucaaucggcaaacugguacaccaaauuuuuggcacagcuuauggaguacuauuuucaggcguaucuuggacgaugaaaauaggcaucggcguacuguuaacauggcuuggacuuaacucaaggaguaccagucuuaguaugacuuguauagcgguugguuuaguaacacucuaccuugguguaaugguacaggcugauucuggauguguuauaaauuggaaagguagagagcucaaaugcgggagcggaaucuuuguaacuaaugagguacauaccuggacugaacaauacaaauuucaagcagauagcccuaaacguuuaucagcagcgauagguaaagccugggaagaaggugucugugguaucagguccgccacaaggcuagaaaacauuauguggaaacaaaucaguaaugaguuaaaccauauauuacucgaaaaugauaugaaauucacgguugugguaggcgaugucgucgguauacuggcacagggcaagaaaaugauucguccgcaaccuauggagcauaaauacagcuggaaauccuggggaaaagcaaaaauaauaggugcggauguacaaaauacgacauuuauaauagaugggccaaauaccccugaguguccugaugaucagcgcgcuuggaauauaugggaaguagaagauuacgguuuugguaucuucaccacuaauauuuggcugaaaaugcgagauucauauacacagguaugugaucauagacuaaugucggcagcaauuaaagacaguaaagcaguacacgcugauauggguuacuggauugaauccgagaaaaaugaaacuuggaaauuagcaagggccucguucauugaggucaagacuuguauuuggcccaaaagucauacgcucuggucaaauggaguguuagaaucagagaugaucauuccuaaaaucuaugguggaccuaucagucaacauaauuaucgcccaggcuauuucacgcaaaccgcagggccuuggcauuuggguaaguuggaacuggauuucgaccugugugaaggcacaacaguuguaguagacgaacacugcggaaauagggguccaagucuuaggacgacgaccguuacuggaaaaaucauucacgagugguguuguagaagcugcacucuaccuccgcuaagauucaagggagaggauggauguugguauggaauggagauaagacccguaaaagaaaaggaagagaacuuaguaaagagcauggugucagccggcucuggugagguggauaguuucucguuagggcuauuaugcaucucgauaaugauagaagaaguaaugagaucaagguggucaagaaagaugcuaaugacugguacccuggccgucuuuuuguuacugauaaugggacaacuaaccuggaacgaucugauucgauuauguauuauggucggcgcgaacgcaucagauagaaugggcauggguacgacauaucuggcacuaauggcuacguucaagaugagaccuauguucgcuguaggacuauuauuuagaagacuaacgucacgagaaguacuauuacuaaccauaggauuaucauuaguugcgucaguagaacuaccaaauagucuugaggaacuaggggacggacuagcaauggggauaaugauacucaaacuacuaacugauuuucaaagucaucaacuuugggcaacacuucugagucucaccuucauuaagacuacccuaucucuacacuaugcguggaagacaauggcuaugguucuaaguaucguaucauuaaucccucugugcuugucuacaacuucacagaaaacaacuugguuaccaguacuacuaggcagccuugguugcaagccucuaacaauguuccuuauagcagaaaacaaaauuuggggaaggaaaucauggccuuuaaaugaaggaaucauggcagugggaguuguaucaauacuacucuccagucugcucaaaaacgacguaccgcuagcagggccucuuauagcgggaggaaugcucauugcguguuaugugauaagugguucaagcgcugacuuguccuuggaaaaggcugcggaaguaucuugggaagaggaggcggaacauucuggagcgucacacaauaucuuaguugaaguucaagaugauggaacaaugaaaauaaaagaugaagaacgagacgauacacuuacaauacucuuaaaagccacuuuauuagccguuucuggaguauauccacuguccauaccugcuacccucuuuguuugguauuuuuggcagaagaagaaacagagaaguggaguauuaugggacacuccaagcccacccgaagucgagcgagccguguuagaugaugggauauauagaauuaugcaaagggguuuacuugggagaucccaaguaggaguuggaguauuccaagaaaacguuuuucacacgauguggcacguaacccgaggagcuguuuuaauguaucaagggaaaagguuggaaccaaguugggccucagugaagaaagaccuaaucagcuacggcgggggauggagauuacaaggcaguuggaauaccggggaagaaguccagguuaucgcuguugagccacgcaaaaaccccaaaaauguccaaacggccccugguacuuuuaaaacuccggagggagagguaggcgccauagcguuagauuuuaaaccaggaacgucuggaaguccuauuguuaauagagaaggaaaaauagucgggcuauauggcaacggugugguaacaacaucaggcacauauguguccgccauagcgcaagcuaaggcgagccaggagggaccuuugcccgaaaucgaagaugaaguauucagaaaacguaaucuaacaauaauggaccuacauccaggcucagggaaaacucggcguuauuuaccugcaauagucagagaagcaauuaaacguaaacuucgaacccuuauauuagccccuacucgggugguagcuuccgaaauggcugaggccuuaaaaggaaugccuauaagauaucaaacuacagccguaaagucagagcauaccggcaaagaaauaguggauuugaugugucaugcaaccuuuacaaugcgucuuuuaaguccgguaagagugccgaauuauaacaugauaauuauggacgaagcgcacuuuacagacccuucaucuauagcggcaagagguuacauuucuaccagagucgguaugggagaggccgcggcgauauucaugacggcaaccccaccuggcucuguagaggcuuucccucagaguaacgccguuauucaagacgaggagagagacauaccggaaagaagcuggaacagcggguaugaauggauaacagacuuuccugguaaaacagugugguuuguuccgucuauuaaaucagggaacgauaucgccaauugucuuaggaaaaacggcaaaaggguaauacaacuuucaagaaaaacauucgauacagaauaccagaaaacuaagaacaacgacugggauuacguuguuacaacagauauuucugaaaugggagcaaacuuccgcgcagaucggguaaucgacccccgucgguguuuaaagccagucauuuuaaaagacggaccugaacgaguaaucuuagcaggaccuaugccaguaacugucgcuagugcagcccagagacggggacgaauagguagaaaucacaauaaagaaggagaccaauacaucuacauggggcaaccuuuaaacaaugacgaagaccacgcacauuggacagaggcaaagaugcuuuuagauaacauaaacacuccugaaggaauaaucccggcccucuucgagcccgagagagagaaaagugcggcuauugacggugaauaccgguuacguggugaggcaagaaaaacauucguggaauuaaugcggcgcggagaccucccgguaugguuaucuuauaaaguagccagcgaagguuuucaguacagcgacagaagaugguguuuugauggagagcgaaauaaccaaguauuagaagaaaauauagauguggaaauauggacgaaagaaggagaacgaaagaaauuaagaccaagguggcucgaugcucgaacauacucugaucccuuagcucugagggaguucaaggaguucgcagcuggaagaagauccguauccggagaucuaauacuugaaaucgguaagcugccacaacaccuaacgcaacgggcucaaaaugcucuagacaaccuaguaaugcuucauaauucugaacaagguggacgagcauaucgacaugccauggaggaacuaccagacacgaucgaaacauuaaugcuacuagcucucauugcaguauuaacaggaggaguaacacuuuucuuucuaucagguagaggucucgguaaaacauccaucgguuuacugugugugauggccucaucuguccuuuuauggauggcgagcguggagccccauuggauagcagcuaguauaauacuagaguucuucuuaaugguacuucucauuccagaaccugacagacaaagaacaccgcaagacaaccaacuagcauauguggucauuggauuauuauuuaugauacuuacuguugcggcuaaugagaugggacugcucgaaacuaccaaaaaggauuuaggaauaggacaugcagcagucgagaaucaccaucaugccacuaugcuagauguagauuuacacccugcuagugcguggacccuauaugccguagcuacuaccauaauaacccccaugaugaggcauacuauugaaaacacaacagcaaauaucucccuuacugcaauugccaaucaagcugcuauauuaaugggguuagauaaagguuggccaauaaguaagauggauauuggcguuccguuauuggccuuaggauguuauagucaaguaaauccacuuacacuaaccgcugcgguacuaaugcuaguugcucacuaugcuauaaucggucccggccuacaggccaaagcaacaagagaagcccaaaaacgaacggccgcuggcauaaugaagaauccaacaguagauggaaucguggcaauagauuuggaucccguaguguaugacgcaaaauuugagaaacaacugggccaaauuauguuauugauacuaugcacuucucaaauccucuugaugaggacaacuugggcuuugugugaaaguaucacacuugccacaggcccacucacaacucuuugggagggcagcccagguaaauuuuggaauacaacuauagcgguuucaauggcaaacauuuuucgcgggaguuaccuagcuggugccggguuagcauucucacucaugaagaguuuaggggguggucgcagagggacgggugcacaaggagaaacauugggugaaaaauggaaacgucaacuaaaucaacucagcaaaucagaguucaacauuuauaagagaucagggauuauggaagucgauagaagcgaagcaaaggaaggucuuaaacguggggaaacgaccagacaugcaguuagccguggaacugcaaaauuaaggugguuuguagaacguaauuugguaaagcccgaaggaaaaguuaucgaccuggggugcggccgagguggcuggucauauuauugugcaggcuugaagaaaguaacggaaguaaaaggcuauacaaaaggcggcccuggucacgaggaaccuauaccuauggcaacauauggauggaaucuuguaaaacugcauucagguaaagaugucuucuuuacaccacccgagaaaugcgauacuuuauuaugcgauauaggcgagucauccccgaauccaacuaucgaggaggggaggacacuccgaguguugaaaaugguggaaccauggcuuagagguaaucaauuuuguaucaaaauacuuaauccguacaugcccaguguuguagaaacccuggaacaaaugcaaaggaagcauggaggaaugcucguaaggaauccgcucucgagaaacucgacacacgaaauguacuggguuaguugcggcacaggaaacauaguaagugcugugaauaugacgucgagaaugcuucuaaaucgcuucaccauggcccacagaaaaccuacuuacgagaaagaugucgauuuaggagcaggaacaaggcauguugcggucgaaccagagguagcaaauuuggauaucauaggacaacguaucgaaaauauaaagcacgagcauaagucaacauggcacuaugacgaagacaacccauacaagaccugggcauaccacgguaguuaugaggugaagccauccggaucugccaguuccauggugaaugguguaguaaaacugcuaacuaaacccugggaugucauacccaugguaacacaaauugccaugacugauacuacaccauuugggcaacaacguguguuuaaggaaaaaguugacaccagaaccccaaaagcaaagcggggaacaguucagauaauggaaguaacugcuagaugguuauggggauuuuugagcagaaauaagaaaccuaggauuuguacacgggaggaguucacgagaaaagucagaucaaacgcugcaauuggugcaguauuuguagaugaaaaccaauggaacucagcaaaagaggcugucgaagaugaaagauucugggaucuugucaagaaagaacgugagcuccacaaacaaggaaagugcgcaacaugcguauacaauaugaugggaaaacgugagaagaaacuaggugaauuuggcaaagcaaaagguucucgugcaauaugguauaugugguuaggugccagauuuuuagaauuugaggcuuuaggauucaugaaugaagaucauugguucucaagggaaaauucuuuaaguggcguggaaggcgaaggacuucauaaauuggguuauauucucagggauauaaguaaaauaccuggaggaaauauguacgcggacgauacggcaggcugggacacuagaauaacggaagaugaucugcaaaacgaagcuaagaucaccgacaucauggaaccugaacaugcuuugcuagccacgucgauauuuaaacugacauaccaaaauaaaguaguucggguccaacgaccagccaaaaacgggacaguuauggacguaauaagcagacgagaucaacgagggaguggacaagugggaaccuacggcuugaauacauucaccaacauggaagcgcaguuaauaagacaaauggaaucggaaggcauauuccuuccuagcgaauuagaaacuccaaacuuggcggagagagugcuugacugguuagaaaaauauggaguugagaggcuaaaaagaauggcaauaaguggagaugauugugugguaaagccaaucgacgauagauuugcaacagcauuaacagcgcuuaaugauaugggcaaaguccgaaaagauauaccccaaugggaaccgagcaaaggauggaaugacuggcaacaaguaccauuuugcucucaucauuuucaucagcuaauaaugaaagauggccgagagauuguagugccaugccgcaaccaagaugaguugguagguagagcaaggguaucacaaggggcgggauggucuuugagagagacugcaugcuuaggcaagucauacgcacagauguggcaacuuauguauuuucauagaagagauuugcgauuggcagcaaacgccauauguagcgcaguaccagucaacugggucccaaccucuagaaccaccuggucuauacaugcacaccaccaauggaugacgacagaggauaugcucucaguauggaacagggucuggauagaagaaaauccuuggauggaggacaaaacucauguuagcucguggggagaugugccauauuuaggcaaacgugaagaucaguggugcgguucuuuaaucggauuaacugcaagggcgacgugggcaucgaauauacaaguagcuaucaaucaaguuagaaggcucauaggcaaugagaacuaucuggacuacaugacaucgaugaagcgcuuuaaaaaugaaggagacccagaaggagcauugugguaa

SEQ ID NO: 21968 - RNA, 9879 nt, Artificial Sequence
  derived and/or modified CDS sequence (opt6) from DENV-1__EU482536__SS-prME
aguguuacuaugcuacuaaugcucaugccuacagcauuggcguuucacuuaacaacgcgcggaggggaaccgcauaugaucguuucaaaacaagaacguggaaagagcuuauuauuuaaaacaucagcuggaguuaauaugugcacgcuaauagcaauggaccuaggggaauuuugcgaagauacaaugaccuauaaauguccaagaauaacugaagcugaaccggaugacguagacugcugguguaaugcaacugauacaugggugaccuacgguacauguagucaaacgggugaacaccggcgcgauaaaaggagcgucgcauuagcaccucauguaggguuggguuuagaaacacgaacugaaacuuggaugucaucagaaggugccuggaaacaaauucaaagaguugaaacaugggcucucagacauccagguuuuacggugaucgcauuauuucuagcucaugcuauaggaacuuccaucacacaaaaaggaaucauauuuauauuauuaauguugguaacccccucgauggcgaugcgaugcguagggauaggauccagagacuuuguugaaggacugagcggagcuacgugggucgauguaguacuugaacacggaucauguguuacuacaauggcaaaagauaaaccaacuuuagacauugaacuauugaaaacagagguuacuaauccggcuguacuaagaaaauuaugcauugaagcuaaaauaucgaauacaacaaccgauucaagaugucccacccaaggagaagccacacuuguggaagaacaagaugcuaacuuuguaugccgaaggaccuuuguggaccgaggaugggguaauggaugugggcuauuuggaaaagguagcuuaauaacuugugcaaaauucaaaugugucaccaaacuagaagggaaaauaguccaauaugagaauuuaaaauacaguguaaucguuacaguccacacuggcgaccaacaccaaguggguaacgaaucuaccgagcauggaacaacagcuacaauaacaccacaagcaccuagcacagaaauucaguuaacggauuauggagcuuuaacccuggacugcucuccgcgaacuggauuggauuuuaaugaaaugguacuuuugacaaugaaagaaaaaucguggcuaguacacaaacaaugguuuuuagaucuuccgcuaccguggacgagcggagcaucgacuucacaggaaacguggaauagacaggaucuacucguaaccuucaaaacggcccaugccaagaaacaagaaguuguugugcuggguagucaagaaggcgcuaugcauacagcauuaacuggagcgacggaaauucaaacaucaggcacgacuacgauauuugccggacauuuaaaaugucgacugaaaauggauaaauugacucugaaaggaauguccuacguaauguguacuggaucauuuaaauuagaaaaagagguugcagaaacacagcauggcacaguucucgugcaaauaaaauacgaggggaccgaugcuccuugcaaaauaccauucaguacacaggaugagaaaggcguaacacaaaacggacguuuaauaaccgcaaauccgauaguaacugauaaagagaaaccgguaaauauagaggcagaaccaccuuucggagagaguuauauaguaauaggagcgggcgaaaaggcuuuaaaacuuucaugguuuaagaaaggaucgagcauaggcaaaauguuugaggcaacagcccguggcgcaagacggauggcaauacucggcgauacagcaugggacuuugggagcaucggcggaguauuuacaucagucggcaaguuaguccaucaaaucuucgggacugcauauggagucuuauucuccggcgucucuuggacaaugaagauaggcauagggguacuauuaacgugguuaggauuaaauaguaggaguacaagucuuaguaugacaugcauagcaguaggccuaguuacccuauauuuaggcgugauggugcaggccgacucuggcuguguuauaaauuggaaaggcagagaguuaaaaugcggaucggggauuuuuguuacgaaugagguacauacauggacugagcaauauaaguuucaggcagacagccccaaacgucucucagcggcgauaggaaaggccugggaggaagguguaugcgguauuaggucagcuacucgauuagaaaauauaauguggaaacaaauuucgaacgaacucaaucauauucuacucgagaaugauaugaaauuaaccgugguuguaggggacguugcuggaauacuagcacaaggcaagaaaaugauccgcccccagccuauggaauacaaguauuccuggaaaucuuggggcaaggcaaaaauaaucggugcggacguccaaaacacuacuuucauaauagauggaccuaauacacccgaguguccagacgaucaaagggcauggaauauuugggagguagaggauuaugguuuugggauuuucacuacaaacauauggcuaaaacuaagagauucauauacacaaguaugcgaccaucgguuaaugucagcagcuauaaaagauucuaaggcaguacacgcggacaugggcuauuggauugaaagcgagaaaaaugaaaccuggaagcuagccagagcaucauucaucgaaguuaaaaccuguauauggccgaaaucccauaccuuauggaguaaugggguccuagagagugaaaugauaauuccaaaaauuuacgguggcccuauaucacaacauaacuauagaccaggauacuuuacacaaacagccgguccauggcacuuaggcaaauuagaauuggacuuugauuuaugcgaggguacaacugucguggucgaugagcauuguggaaaucgaggcccuucccuacgaacuacuacaguuaccggaaaaauuauucacgaaugguguuguaggucuuguacacuacccccgcuucgauuuaaaggagaagacgguuguugguacggaauggaaauuaggccuguaaaggagaaagaagaaaaucuggucaaaucaaugguuagcgcggggucgggcgaaguagacaguuucucccucggauugcuaugcauuucaaucaugauagaggagguaaugcguagucguuggaguagaaaaaugcuaaugacaggcaccuuagccguauucuuuuuauuaauuauggggcaguuaacauggaacgaucuaauucgauuauguauaaugguaggagcaaacgcaucagauagaaugggcauggguacuacauacuuagcucuuauggcgaccuuuaaaaugcgccccauguucgcaguaggacuacucuuccgaagacuuacaucaagagaaguucucuuauuaaccauuggccuaaguuuaguagcaagcguggaauuaccaaauucgcuagaagaauuaggggacgggcuugccauggguauaaugauuuuaaagcucuuaacggauuuucaaucacaccaauuaugggccacucuucugagcuuaacauuuauucgaacuaccuuuucgcuucauuacgcauggaaaacgauggcuaugguauuaaguauagucagucucuuuccacuaugccugagcacgacaagccagaaaacuacauggcuacccguauuauuagggucguuaggauguaaaccauugaccauguuuuuaaucgcagagaauaaaaucugggggagaaaaucauggccucuaaaugaagguauuauggcaguagggauuguuaguauacugcuaucaaguuuacuaaagaacgacguaccauuagcaggcccacucaucgcugguggcaugcuuauagcauguuacguaauuucugguucuagugccgacuuaucauuagaaaaagcugcagaaguuucaugggaagaagaggcggaacacuccggcgcaagucauaacauuuuagucgagguacaggacgacgguacaaugaaaauaaaggacgaagagagggaugauauguuaacaauuuuauugaaagcgacacuucuagcaguuaguggaguguauccguuaagcauuccagccacauuauuuguuugguacuuuuggcagaaaaagaagcaaagaucgggaguucuaugggacacacccucaccuccggagguggagcgagcagugcuggaugaugguauuuaucgaaucaugcaacgaggacuguuagggagaucacaagucgguguaggagucuuucaagaaaacgucuuccauacgauguggcauguaacacguggcgcaguauuaauguaucaaggaaaaagacuugaaccuucaugggcuucagugaagaaagaucuaauaucauacgggggugguuggagacuucaggguucguggaauacaggagaagagguacaaguuauagcuguagaaccaggcaaaaauccuaaaaauguccaaaccgcacccgguaccuucaaaacuucagaaggggaaguaggagccauagcucucgacuucaagccggguaccagugggagucccauugucaauagggaagguaaaaucguuggauuguacgguaauggaguaguuacaaccaguggcacauaugucuccgcaauagcgcaagcuaaggcgagucaggagggaccguuaccagagaucgaagaugaaguguuuagaaaaagaaauuuaacaaucauggaucuccacccagggucugguaaaacucgaagguaucuuccugcuauaguccgagaagcaauaaaacgucgucucagaacgcucauucuagcaccaaccaggguaguugcaagugagauggcugaggcuuuaaaaggaaugccgauccgauaucaaacuacugcuguuaaaagugaacauacugguaaagaaauaguugauuugaugugucacgcgacauuuaccaugagguugcuuucaccaguucgaguccccaauuauaacaugauaauaauggaugaagcucauuucacagacccgucaagcauugcugcaagagguuacauauccacucgaguagguaugggagaagccgcagccauuuuuaugacagcaacaccacccgguaguguugaggcguuuccccaaucaaaugcagucauccaagacgaggaacgggauaucccagaaaggaguuggaacaguggcuaugaguggauaacagauuuucccgguaaaaccgucugguuugucccuaguauuaaaucgggaaaugauauagcuaauuguuugcggaaaaauggaaaaagaguaauccagcuaucuagaaaaacauucgauacggaauaucaaaagacgaagaauaacgacugggacuacguagugacaacugauauaagcgagaugggcgcgaauuuccgugcggauagaguuaucgauccaagaagaugcuuaaaacccguuauacuuaaggaugggcccgaaagaguaauuuuagcaggaccaaugccuguaaccguggcguccgcagcacaacgaagaggacgcauagggcggaaccauaauaaagaaggagaucaauacauuuacaugggccaaccgcuaaauaaugacgaagaucacgcacacuggacggaggcgaaaaugcuuuuggacaauauaaacacucccgagggaauaauaccggcacucuucgaaccugaacgagaaaagagcgcagcgauugacggggaauacagacuuagaggagaggcaaggaagaccuuuguagaauuaaugaggagaggagauuugccaguauggcugagcuauaagguggcaucugaaggguuccaauauucagauagacggugguguuucgauggugaaagaaacaaccagguacucgaagaaaacauggauguagaaauauggacaaaagaaggugagcgaaagaaauuaagaccacgcuggcucgaugcacggacauauucggaucccuuggccuugcgcgaguucaaagaauuugccgcgggcagaaggaguguuucaggugaccuuauuuuagaaaucgguaaauuaccucagcauuuaacacaacgcgcacaaaacgcccuggauaauuuaguuaugcuccauaauucagagcagggagguagggcauaccgucaugcaauggaagaacucccagauaccauagaaacccuuauguuauuggcuuugauagcuguucuaaccggaggaguuacccuauucuuuuugagcgggagaggauuagguaagacuuccauaggacugcuuuguguaauggcuagcagcguucuacuauggauggcuagcguugaaccgcauuggauagcugccucaauaauacuugaauuuuuccuuaugguacuacuuaucccugagcccgaccgucaaagaacaccucaggacaaccagcuagccuacgugguuauuggacuucucuucaugauacugacgguagcagcuaaugaaaugggguuguuagaaacaaccaagaaagacuuaggaauaggccacguagcagucgaaaaucaucaccacgcugcgaugcuugacguagaccuacauccagcgagcgcauggacauuauacgccguagcuacaaccaucauaacuccaaugaugagacauaccauugaaaacaccacagcaaauauaagccuuacagcuaucgcaaaccaagcagcaauacuaaugggucuugauaaaggcuggccuauuaguaagauggauauugguguaccucuauuggcguuaggaugcuacagucaaguaaauccccuaacuuuaacugcggccguacuaaugcuaguagcucauuacgcaauuauuggaccaggccuacaagcuaaggcaacucgagaagcgcagaaaagaacugcagcuggaauaaugaagaacccaacugucgauggaauaguugccauugaucucgacccaguuguuuacgaugcaaaauucgagaaacaacuuggccaaauuaugcuacuuauccuaugcacuucgcagauucuauuaaugagaacuacuugggcccuuugugaauccauuacccuugcaacgggaccgcuaacaacacugugggaaggcagcccgggaaaauuuuggaacaccacuaucgcugucucuauggccaacaucuucagagggaguuacuuggcuggugcaggacuggcauuuucacuaaugaaaucuuuagguggaggacgaagggguacaggugcccagggagaaacacuaggcgaaaaauggaaacggcagcucaaccaauugaguaaaucagaauuuaauacuuauaagaggagcggcaucauggaagucgaucgaagcgaagcuaaggagggacuaaaacgaggcgagacaacuaaacaugcgguuucuagagguacagcuaaacuuaggugguuuguagagagaaaucuuguuaagccggagggcaaaguaaucgaucuggguuguggccgaggcggauggaguuauuacugugcaggauugaagaaaguuacggaggugaaaggcuauaccaaagguggcccgggucaugaagaaccaauuccaauggcaacuuauggauggaauuuagucaaacuacauucggguaaagauguauucuuuauucccccagaaaagugugauacauuacuuugcgauauuggugagaguagucccaaucccacgauagaggaagguagaacccugcguguauuaaaaaugguugaaccauggcucagaggaaaccaauuuugcauuaaaauuuuaaacccauacaugccgucaguaguugaaacacuagagcagaugcaaaggaaacauggaggaauguuaguaagaaauccauuaucgcgaaacucaacacaugaaauguacuggguuucuuguggaacgggaaauauugugagugcaguuaacaugacgucacgaauguuguuaaauagguuuacaauggcccaccgcaaaccaacuuaugaaagagauguagaucuuggggcgggaacgaggcauguagcuguugaaccagaaguagcuaaccuagacauaaucggccaacguaucgaaaauauuaaacaugaacauaagucuacauggcacuaugaugaggacaauccguacaaaacuugggcauaucauggcaguuaugaagucaaaccuucggggagcgcaaguagcauggucaaugggguuguaaaauuacuaacaaaaccaugggaugugauucccaugguaacccaaauagcaaugacggacacuacgcccuuuggacagcagcguguauuuaaggagaaaguagauacacgaaccccuaaagcuaagcgcgggacugcacaaauaauggaaguuacugccaaaugguuaugggguuuccuaaguaggaauaagaaaccaaggaucugcacacgagaagaauuuacacgaaaaguaagaaguaacgcagcuauaggagcagucuucguggaugaaaaucaguggaacagugcaaaagaagccguagaggacgaacgauuuugggacuuaguucacagagaaagagagcuacacaagcaaggaaagugcgcuaccugcguguacaacaugauggggaaaagagagaagaaauugggagaauuugggaaagcaaaagggucccgugcgauaugguacauguggcuaggagcaagauuuuuagaguuugaagcgcuaggauuuaugaaugaggaccauugguucaguagggaaaauucauugucuggaguugagggcgaagguuuacacaaacuaggauauaucuuaagagacaucagcaaaauuccgggcgguaauauguacgccgacgacacagcggguugggacacacguauuacagaagaugauuugcaaaacgaagcuaaaauaacugacauaauggagccggagcacgcccuucucgcaaaaucgauauucaaacucacuuaucaaaauaaaguuguaagaguacagcgcccagcuaaaaaugguacuguaauggacgugaucaguaggagagaucaaagagguaguggacaaguaggcacauauggcuuaaauacauucacaaauauggaagcacaacuaauuaggcaaauggaaucagaagguauuuuuagcccuagcgaauuagaaacaccaaaccuagcaggaagggugcuggauuggcuugaaaaacaugguguugaacgucugaaaagaauggccauaagcggagaugacugugucgugaaaccaauugaugaccgcuucgccacugcacuaacugcguugaaugauaugggcaagguccguaaagauauuccacagugggagcccucgaagggauggaacgacuggcaacagguaccauuuuguucgcaccacuuucaucagcucauaaugaaggacggacgagaaauagucgugcccugccgaaaucaagacgagcuaguugggcgagcacgaguaucccaaggagccggcuggucuuugagagaaaccgcuugccuagguaaaucuuaugcacaaauguggcaacugauguauuuucauagaagagauuugagauuagcugcaaaugcgauauguucagcugugccgguagauugggugcccacaaguagaacuacuuggagcauccacgcacaccaucaauggaugacaacagaagauauguugagcguuuggaauaggguauggaucgaagaaaacccuuggauggaagacaaaacacauguuagcaguuggggagaugugccuuaccuaggcaaacgagaggaucaauggugcggcucguugauaggguugacagcgcgcgcaacaugggcaacaaacauucaaguagccaucaaucagguucgaagacuauuggggaacgaaaacuaucuggacuauaugacaucaaugaagagguuuaagaacgagucagauccagagggcgccuugugguaa

SEQ ID NO: 21969 - RNA, 9879 nt, Artificial Sequence
  derived and/or modified CDS sequence (opt6) from DENV-1__EU482537__SS-prME
agugugacuauguuacuuauguuaaugcccacggcuuuagccuuucaucuaacaacacgaggaggugaaccccacaugauuguuacaaaacaagaacgcgguaagaguuuacucuucaaaacauccgccgguguaaacaugugcacacuaauagcaauggaucugggugagcuuugugaagauacaaugaccuauaaaugcccgagaauuaccgaagcagaaccugacgauguagauuguuggugcaacgcuacagauacgugggucacauaugguaccuguagccaaaccggcgagcauagacgggauaagcgaagugucgcucuugcuccacauguagguuuaggauuagaaacaagaacugagacguggaugucaagugagggcgccuggaaacaaauacaaagagucgagacaugggccuuacgacacccaggauucaccgucauagccuuguuuuuggcacaugccauugggacaaguauaacucaaaaagguauaauauucaucuuauuaauguugguaacgccaagcauggcaaugagauguguagguauuggaaguagagauuuuguugagggguuaagcggcgcuacuuggguagaugucguauuggaacaugguaguuguguaacaacuauggcaaaagauaaaccaacccuagacauugaguuauuaaaaacagaaguaaccaacccagccguauugcgaaaguuauguauagaggcgaagaucaguaauacaacaacagacagccgaugcccuacacaaggggaggcuacauugauggaagagcaagaugcaaacuuuguauguagaaggaccuucguugaucguggguggggaaauggcuguggucucuuuggaaaggguucucucauuacaugugcaaaauucaaaugugucaccaaacuagaggguaaaaucguucaauaugaaaaccugaaauacucaguaaucguaacaguucacacaggagaucaacaucaagucggaaaugaaagcacugaacacggaacaacagcaacuaucacgccucaagcacccacauccgagauccaacucacugauuauggagcauugacauuagacuguuccccuaggacaggauuagacuuuaaugaaaugguacuauuaacuaugaaagaaaaaucuugguugguacauaagcaaugguuucuugaccuuccauuacccuggacaaguggugcaaguacuucgcaggagacuuggaacagacaggaucugcuagugacuuuuaaaaccgcacaugcuaaaaaacaagaaguuguagugcucgguucgcaggaaggcgcgaugcauacggcacuuacuggcgcuacagagauccaaacaucggggacaacaacgauauucgcuggacauuuaaagugccgucuuaaaauggauaaguugacuuuaaaagguaugucauaugucaugugcacggggucauuuaaauuagaaaaggagguagcagagacacaacaugggacaguccugguacaaaucaaauaugaggguaccgaugcaccuugcaagauucccuuuaguacacaggaugaaaaggguguaauccaaaauggucgauuaaucaccgcaaauccuauugucacugauaaagaaaaaccagugaacauugaggcugagccgccauuuggagagucauacaucguuauagggguaggugagaaagcguugaaauuauccugguucaagaaaggaucuucaauuggaaaaauguucgaagcgacagcacguggugccagaaggauggcaaucuuaggagauacagcuugggauuucggaucuauaggagguguuuuuacaucgguuggaaaacuaguacaccaaaucuucggaacggcauauggcguguuauuuaguggagugaguuggacuaugaaaauaggaauagggguucuucuuacuugguugggacuuaauaguagaucaacaaguuuguccaugacaugcauugcaguaggcuuagucacucucuauuuggguguaauggugcaggcggauucaggauguguuauaaauuggaaaggaagggaauuaaaaugcgguaguggaauauucguuacgaacgaaguucauacauggaccgaacaauauaaguuccaggcagacagccccaaaagacuuucggcagcaauaggaaaggcaugggaagaaggaguauguggaauucgaagugcaacuagauuagaaaacauaauguggaaacaaauauccaacgaguugaaucauauucugcucgaaaacgauaugaaauuuacgguagucguaggugauguuguaggaaucuuagcccaaggaaaaaaaaugauacguccccaaccgauggaacauaaauacucuuggaaaucgugggggaaagcaaaaauaauuggugcugacgugcaaaauacgacauucauaauugauggaccgaacacuccagaauguccugacgaccaaagagcauggaauauaugggaaguugaagauuaugguuucgguauauucacgacaaacauuugguuaaaacuacgcgauagcuauacccaagcuugcgaucacagauuaaugagugccgcgauuaaagauagcaaagcgguacaugcggacauggguuauuggauagaaucagaaaaaaaugagaccuggaaauuagcucgggcaaguuuuauagaaguuaaaacauguauuuggccuaaaucacacacacuaugguccaacggcgucuuggagucggagaugguaauaccuaaaauauaugguggcccuaucagucagcacaacuauagacccggcuauuucacgcagacagccgguccauggcaucuaggaaaauuagaauuagacuuugaccuuugugaagguacaaccguuguggucgaugaacacugugguaauagagguccuagucuaagaacaacuacuguaacggguaaaauaauucacgaauggugcugucgaaguugcacucuacccccccuuagauuuaaaggagaagaugguuguugguauggaauggagauuagaccugugaaagaaaaagaagaaaauuuggugaaaaguaugguuucagcuggcucgggagagguagacuccuuuucacuaggacuacuauguauauccauuaugauagaagaaguaaugagaaguagauggucccgaaaaaugcuaaugacaggaacguuggcuguauuccugcuacuaauaauggggcaacuaaccuggaaugaccuaaucagauuauguaucaugguaggggccaaugcauccgauagaaugggaauggggacuacuuacuuggccuuaauggcuacuuuuaagaugagacccauguuugcuguaggacuacuuuucaggcggcucacgucgagagaaguccuucugcugacgaucggguuaucucuugucgcuucaguagaauuacccaacagcuuagaggaauuaggugauggauuagcuauggguauuaugauuuuaaaauuacuuacagauuuccagucucaucagcuaugggccacucuauuaucgcuaacauucauuaaaacgacucucucauuacauuaugcauggaaaacaauggcuaugguacucucuauagucucccuguuuccucuuugucucagcacgacaucacaaaaaacuacauggcuuccaguccuccuugggagucugggcugcaaaccacuaacgauguucuugauugcugaaaauaaaaucuggggucguaaaucauggccccuaaaugaagggauuauggccguuggagucguuucaauauugcuaagcagucuacuaaagaaugacgugccauuggccggaccauuaauagccgggggaauguuaaucgcguguuaugugauuagcgguuccagcgccgaucuuucguuggaaaaagccgcagaagugucaugggaagaagaagcagaacauucuggugccucccacaauauacuuguagaaguccaagaugauggcacaaugaaaauaaaagacgaagaacgagacgacacacugacuauauuguuaaaagcaacccuccuagcaguuucggggguuuacccguugagcauaccugccacauuguuuguaugguacuuuuggcaaaagaagaaacaaagaucuggaguauugugggacaccccuaguccaccugaaguagagcgagccguauuagacgauggaauuuauaggauaaugcaaaggggguuauuaggaagaucucaaguagguguaggcguauuucaagaaaacgucuuucacacuauguggcaugucacucguggcgcaguauugauguaucaggggaagagauuagaaccuuccugggcaucuguuaaaaaagaccucauaaguuacggcggggguuggcgucuacaaggaaguuggaauaccggggaagaaguucaagugauagcaguagagccaggcaaaaaccccaaaaauguacaaacagcgcccgguacuuuuaaaacgccugaaggagaaguaggcgccauugcccucgauuucaaaccagguacuucagguagcccaauagugaaucgugagggaaaaauuguugguuuauacggaaaugggguaguuacuacaucuggaaccuacguuucagcaauagcccaagcaaaggcuucucaagaaggaccuuuaccagaaauagaggaugaaguguuccggaaacgaaaucucacgauaauggacuuacauccagguucaggaaaaacgcguagauauuuaccugcaauuguuagagaagccaucaaacgaaaacuaagaacacuaauccuagcuccaacaagaguaguagcgucugagauggcagaagcucucaaaggaaugccaauaagauaccaaaccacagcgguuaaauccgaacauacaggcaaggaaauuguagacuugaugugccaugccacauucaccaugagacuucuuaguccgguacguguacccaacuacaacaugauaaucauggaugaagcacauuuuacagacccuaguucaauugcggccagagguuauauuaguacacguguagguaugggagaagcagcagcaauuuucaugacggcuacucccccuggcucaguagaagcguuuccacaaucaaacgcggugauacaagaugaggagagagacauuccagagagaagcuggaacagcggcuaugaauggauuacagacuuucccggaaaaacuguaugguuugugccaaguauaaagaguggaaaugauauugcuaauuguuuacggaaaaauggaaagaggguaauccaguuaucgagaaaaacauuugacacggaauaucagaaaacgaagaacaaugauugggacuacguggucacuacggauauuagcgaaaugggagcaaauuuucgcgcagacaggguaauagacccgagaagguguuugaaacccgucauacuaaaagacggacccgaacgaguaauuuuggcgggaccuaugccaguaacgguggcaagcgcggcacagcgaagaggcaggauagggaggaaccauaacaaagagggggaccaauauauauacaugggucagccucucaauaacgacgaagaucaugcacacuggacugaagcaaagauguuauuagacaauauuaacacgcccgaagguauaauaccugcauuguuugaaccugaacgcgaaaagagugcagcgauugacggugaauaucgucuaagaggagaagcucgaaaaacauuuguugaguuaaugaggagaggagauuuaccaguauggcuaaguuauaaaguagcuagugaagguuuccaauauucagaccgaagauggugcuucgauggcgaaaggaacaaucaaguccuggaagaaaauauggaugucgagauauggaccaaggagggggaaagaaaaaaacuaagaccacgauggcuagaugcgagaacauacuccgauccguuagcauuaagagaauucaaggaauucgcagcuggcagaagaucaguauccggcgauuuaauccucgagauaggaaaacuaccacaacacuuaacacagagagcccaaaacgcauuagauaaccuugugaugcuacauaauagcgaacaagguggacgagcauauaggcaugcaauggaagaauuaccugacacgauagaaacuuuaauguuacucgcauuaauagccguguuaacugguggugucacacuauucuuuuugucaggacguggauuggggaaaacuucgauaggauuauuaugugugauggcaucaagcguacucuuauggauggccucaguugagccucacuggaucgcagccagcauaauccuagaauuuuucuugaugguauuauugaucccagaaccggaccgccagagaacgccacaagacaaccaacucgcauacguaguaauaggucugcuuuucaugauauuaacuguggcagcaaaugaaaugggguuauuagaaacaacaaaaaaagauuuggggauaggucauguagcaguggaaaaucaccaucaugcaacuaugcuugacguagauuuacauccggcuagugccuggaccuuauacgcaguggcgacgacaauaauuacaccuaugaugcgucauacgauagaaaacacgacggccaauauaucguuaaccgcgauagcgaaccaggcagcuauuuuaaugggauuagauaaaggguggccgauuucaaaaauggacauugggguuccgcuacuagcauuaggaugcuacucacaaguaaauccacugacccugaccgcugcagugcuuaugcuaguugcacauuaugcgauaauagggccagguuugcaagcaaaggcaacgagagaggcccaaaaaagaacugcagcggggauuaugaaaaaccccacuguagaugggauuguugcgauagaucuagaccccgucguauaugaugcuaaauucgaaaaacaguuaggucaaauaauguuauuaauauuaugcacuucucaaauucucuugaugaggacgacgugggcccugugugaaaguauaacacucgccacgggaccauuaacuaccuuaugggaggguucuccaggaaaauuuuggaauacgacaauugcaguaucaauggcgaauauuuuucgaggaagcuaccuagcaggggccggauuagccuuuucacuaaugaaaaguuuagguggggggagaagaggcacaggggcccaaggagaaacacuuggagaaaaauggaagagacaacuaaaccaauuaaguaaauccgaguuuaauauauacaaacgaucaggcauuauggaggucgauagaagugaggcaaaagaaggccuuaaaagaggggaaacaacccgacacgccguaucucgcgggacggcaaaacuacgcugguucguagaaagaaaccugguuaaaccggaaggcaaagugauagaucuagguuguggcagagguggauggucauauuauugugcuggauugaaaaaaguaacagaaguaaaggguuacacaaaggggggucccggucacgaagaaccuauuccuauggcaacguaugguuggaacuugguuaaauuacacaguggcaaagacguauuuuuuaccccuccugaaaaaugcgacacauugcugugugauauaggcgaaagcucccccaacccgacaauugaagaagguagaacucugaggguucuuaaaauggucgaaccguggcuuagaggcaaucaauucugcauaaagauauuaaauccauauaugccgagugucguagagacucucgaacaaaugcagagaaaacacggaggaauguuagucaggaauccuuuaucaagaaacucuacgcaugaaauguacuggguaucuugcgguacggggaauauaguaucggccguuaacaugacguccaggauguuacuuaaccgcuuuacuauggcucaccgaaagccaacguacgaaagagauguagaucuaggagcagguacgagacauguugccguggaaccagagguugcuaaucuagauauaaucggccaacguauagagaauauaaagcacgaacauaaaucaacuuggcauuacgaugaagacaacccauacaaaacuugggcguaucacggaagcuaugaagugaaaccaagugguucugcuaguuccaugguaaauggcgucgugaaauugcuuacaaaaccaugggauguaauaccuaugguaacacaaauagccaugacagauacaacgccuuuuggacagcaaagaguguuuaaagaaaaaguagauacacggacaccaaaggccaagagaggaaccgcgcaaauuauggaagucacagcuagaugguuauggggauuuuuguccagaaacaaaaaaccgagaauaugcacgcgugaagaauuuacaaggaaagugaggucuaacgcagcuauaggagcagucuucguugaugagaaccaauggaauagugcuaaagaggcgguagaagaugagcguuucugggaccuaguacaaaaggaaagggaauuacauaagcaaggcaagugugccacuugcguauacaauaugaugggaaaaagagagaaaaaguugggagaauucggaaaagcaaagggaagucgagcgauaugguacaugugguugggugcaagauuucuggaauucgaagcucuugguuucaugaaugaagaucauugguucucgagagaaaacagucuuaguggaguugaaggggaaggccuccauaaauugggcuauauucuuagagauauaaguaagauaccagggggaaacauguacgcggaugauacagcuggcugggacacucguauaacagaagaugacuuacaaaaugaggcgaaaauuacagauauaauggaacccgaacaugcacuauuagcuaccucaaucuucaaauuaacauaucaaaauaaaguaguccggguacagcgacccgcgaaaaauggaaccgugauggacgugauaucgcgaagagaucagagggguaguggacaaguuggcacauauggacuaaauacauucacuaauauggaagcccaacugauaagacaaauggaauccgaagggaucuuccuaccgucagaauuagaaacaccaaaucuugcagaacggguuuuagauuggcuggaaaagcaugguguugaacguuuaaaacgaauggcgaucucgggggacgacuguguuguaaaaccgauagaugacagauuugcuacugcacucacagcucugaaugauaugggaaaggugaggaaggauauaccacaaugggaaccuucaaaagguuggaacgacuggcaacaaguaccguucuguucgcaccauuuucaccaguuaaucaugaaagauggucgugaaauaguuguaccgugccggaaccaagaugaacuaguagguagagcuagaguaagccaaggugcuggcuggucucuaagagaaacagcaugccuagguaagucuuacgcacaaauguggcaauugauguauuuucacagaagagaccuaagauuggcagcaaacgcgaucugcagcgcgguacccguagauuggguaccgaccucuaggacaacuuggaguauacaugcgcaccaucaguggaugacuacugaggauauguuaucaguauggaaucgaguauggauagaagagaacccuuggauggaagacaagacucacguaucaucuuggggagacguaccguacuuaggaaaaagagaagaucagugguguggaucucuaauaggacuaacugcucgagcaacaugggcuucaaauauacaaguagccauuaaccaaguacggcguuugauaggcaaugaaaacuaccucgacuauaugacaaguaugaagagauucaaaaaugagggggaccccgagggugcauuaugguag

SEQ ID NO: 21970 - RNA, 9879 nt, Artificial Sequence
  derived and/or modified CDS sequence (opt6) from DENV-1__EU482538__SS-prME
aguguuacaauguuguuaauguuaaugcccacggcuuuagcguuucauuugacaacacgugguggggaaccgcacaugauaguaucuaaacaagaaagaggaaaaucacuguuauuuaaaacaucagcaggcguaaacaugugcacauuaauagcuauggauuuaggggaauuuugcgaagauacuaugacuuauaaaugcccgaggauaacggaagcggaaccagacgauguugacuguugguguaaugcaacagacacguggguaacauauggaacuuguagccaaacaggagagcacagaagagauaaacgcucggucgcuuuagcaccacaugugggauuaggucuugaaacaagaacggagacauggaugaguucugaaggggccuggaaacagauccagcgaguagaaacgugggcuuugaggcauccaggauuuacaguuauagcucuauuccucgcacacgcaauaggcacauccaucacucaaaaagguauuauauuuauacuguuaaugcuugugacaccaagcauggcuaugcgguguguagguauaggaaguagagauuuuguagaaggauuguccggagcuacgugggucgaugugguacucgaacacggaucaugcguuacaacuauggcaaaagauaaaccuacauuggacaucgaacuauuaaaaaccgaagucacuaauccggcuguucugcggaaauuguguaucgaagcgaaaauaucaaacacuaccacugacagccggugcccuacgcaaggagaagcuacucuuguugaagaacaagacgcaaacuucgugugcaggcgaaccuuuguagauagaggcugggguaaugguugugggcuauucggcaaaggcucguuaauuacgugugcgaaauuuaaauguguaacuaaacucgaaggaaaaauaguucaauacgagaaucuaaaauauagcguaauaguuacaguucauacaggagaucaacaucagguaggcaacgaaucuacggaacacgguacuacggcaacuauaacgccacaagcacccucaaccgaaauucaacuaacggauuacggggccuuaacucucgauuguaguccuagaacaggacuggacuuuaaugaaaugguccuuuugacgaugaaagagaaaaguuggcugguacacaaacaaugguuucuugaccuaccgcuuccauggacaucuggugcaucaacuagccaagagacguggaaucgucaagaccucuuaguaacuuuuaaaaccgcgcaugccaagaaacaagaaguaguuguacuaggcucacaagaaggagcuaugcacacugcguugacaggugcaaccgaaauucaaaccucagguaccacaacgauuuucgcgggucaccuuaaauguagacugaaaauggacaaauugacacucaaagggaugucauaugugauguguaccggaucuuuuaaguuagaaaaagaaguagcagaaacgcaacauggaaccguacucgugcaaauaaaauaugaagggaccgacgccccuuguaaaauucccuuuucaacacaagaugaaaagggggugacgcaaaauggacguuuaauuacagcgaauccaauugugacagaccgugagaaaccaguaaacaucgaggcagagccgcccuucggcgaaucauauauaguaauuggugcuggugaaaaggcuuuaaaacuuuccugguucaagaaaggaucuucgaucgguaaaauguuugaagcuacggcaagaggcgcuagaagaauggccaucuuaggugauacagcuugggacuucggaagcauuggcggaguuuuuacaaguguugguaagcuagugcaucaaauauucggcacagcuuaugguguauuauucucaggagugucauggacuaugaaaauagggaucggcguauugcuaacauggcucggacugaacaguagaucgacgaguuuaucgaugacuuguaucgcuguuggguuaguuacuuuauacuuagggguaaugguacaagcugacagugggugcguuauuaauuggaaagggagggagcuaaaaugugggaguggcauuuuuguaacaaaugaaguacauacauggacugaacaguauaaauuccaggccgauagcccuaaaaggcuaucagcugcaauaggaaaggccugggaagaggggguauguggcauucgaucggcuacaagguuagaaaacaucauguggaagcaaauuucgaaugagcuaaaccacauacuauuggaaaaugacaugaaacucaccgugguaguuggugauguagccgguauauuggcacaaggaaagaaaaugauacgaccacaaccuauggaauauaaauauuccuggaaaagcugggggaaagcuaagauaauuggagcugacguucaaaauacgacuuuuaucauagacggaccgaacacgcuggaauguccagacgaucaacgugccuggaauauaugggagguagaagacuauggauucggcaucuucacuaccaauauauggcuaaaacucagagauagcuauacccagguaugcgaccauagauuaaugucggccgcaauaaaagauaguaaagcggugcaugcugauaugggauacuggauagaaagugagaaaaacgagacauggaaauuagccagggcuagcuuuauagagguuaaaacgugcauauggccaaagagucauacacuguggaguaacggagugcuugaaucagaaaugauaauaccaaagauauacggagguccuaucagucaacauaacuaucgcccugguuacuuuacacagacagcgggacccuggcacuuagguaaauuagaauuagacuucgacuuaugcgaaggcaccacgguggugguagaugaacacuguggcaauaggggaccaucccuaagaacuacaacagucacagguaaaauaauacacgaaugguguuguagauccugcaccuugccgccacuaagauuuaaaggggaggacggaugcugguacggcauggaaauuaggcccguaaaagaaaaggaagaaaauuuggucaaaaguaugguaucagcgggaucaggagaaguugacucuuuuagucuugggcuauuauguauuaguauaaugauagaagaagucaugaggucaagguggagucggaaaaugcuaaugacagguaccuuggcaguguucuuucuuuuaauaaugggacaguugacauggaacgauuuaauacgacuaugcauuaugguaggcgcaaaugcaagugacagaaugggaauggguacaacguaucuugcucuaauggcgacauuuaaaaugagacccauguuugcaguaggacuauuauuuagaaggcuuacuucucgagaagugcuacuucuaaccauaggucucagcuugguagcaucagucgaguuaccgaacagucucgaagaacucggugauggauuagcuaugggaauaaugaucuuaaaauuguuaacagacuuccaaucgcaucaguugugggcgacuuuacucuccuugacauuuauccgaacuacguuuagucuccacuacgcuuggaaaacgauggccaugguucucaguaucguaucucucuuuccauuaugucuuucgacuacuagccagaaaacuaccuggcuaccagugcuauuagguucacuaggauguaaaccacugacaauguucuugauagcggaaaacaaaauuugggguaggaaaagcuggccauuaaacgagggaauaauggcuguagguauuguaaguauacuauuaucuucuuuacugaaaaacgaugucccucuagcaggaccucuaauagccggagguauguuaauagcgugcuacguaauaaguggcuccucagcagacuuaucacucgaaaaagccgccgaaguaagcugggaggaggaagcugaacacucuggcgcaagccauaacauacugguugaaguacaagaugauggcacaaugaaaauaaaagacgaggaaagagaugauacauugacuauccuuuuaaaagcuacgcuuuuagcugugucggggguauacccacuuaguauaccggccacacuauuugucugguauuuuuggcaaaagaagaaacaaaggucgggaguucuaugggacacacccucaccaccugaaguagaaagagcugucuuagacgauggaaucuacagaauuaugcagagaggacugcugggucgaucacaagucggaguugggguauuucaggaaaacguauuccauacaauguggcacguuaccagaggagcugucuugauguaccaaggcaagagacuugaaccuaguugggcaagcguuaagaaggaucuaaucaguuacggaggaggguggcgacuacaagggucguggaacacgggugaggagguacaaguaaucgcagucgaaccuggcaaaaacccuaagaauguccagacagccccuggaacauuuaaaacuagcgagggugaagugggagcuaucgcgcuagauuuuaaacccgguacaagcggaucacccauaguaaauagagaaggcaagauaguuggacuauacggaaacggcguugucaccacgucuggaacauauguaagugccauagcacaaacgaaggcuucacaggaagggccgcuaccagagauagaagacgaagucuucagaaaacgaaaucuuacaauuauggauuuacaucccggauccgguaaaacuaggagauaccuuccugccaucgugagggaagcgauaaaaagacgauuaagaacucuuauacuagcaccaacgcgaguagucgcauccgaaauggcagaagccuugaaaggaaugccaauucgauaccaaaccaccgcuguaaagagcgaacauacuggcaaagagauaguagaucucaugugucaugcuacauuuacaaugcgacuauuaucaccugucagaguaccaaauuacaauaugauuauuauggacgaagcacauuucacagacccaagcuccauugccgcgcgcggauacauaucaacaaggguagguaugggugaggcagcugcaauauucaugacagcgacaccaccugggagcgucgaggcguuuccgcaaaguaacgccguaauacaagacgaagaacgagacauacccgaacguaguuggaacagcggcuacgaguggaucacagauuuuccaggcaaaacagucugguuuguaccuucaauaaagagugggaacgacauagcaaacugccuuaggaaaaacgguaagagagucauacaauuaucucgaaagaccuucgauacagaauaucagaaaaccaaaaacaaugauugggauuauguugucacuacugacauauccgagaugggagcaaacuuucgggccgaucgugugauagacccucgacggugcuuaaaaccagucauacuaaaggacggcccugagagaguuauacucgcagggcccaugccagucacuguagccucugcagcgcaacggaggggcaggauuggaaggaaucauaacaaggagggagaccaauauauuuauaugggucaaccauuaaacaaugaugaagaccacgcgcauuggacugaagcaaaaaugcuuuuagacaauauaaacacacccgaaggaauaaucccugccuuauuugagccugagcgcgaaaagagcgcagcaauagauggcgaauacagacuucggggagaagcgagaaaaacauuuguagaauuaaugagacgaggagaucuaccuguuugguuauccuauaaaguugcaagugaagguuuucaauauuccgauaggcgaugguguuucgauggugaacggaacaaccaagucuuagaggaaaauauggaugucgaaaucuggacaaaggaaggggaacgaaagaaacugaggccaagauggcucgaugcacguacguauucugauccccuagcacuacgggaauuuaaagaauuugccgcaggucgccgaucaguuucaggggaucuuauacuggaaauugguaaacucccucaacauuuaacucaaagggcucaaaacgcccuagauaaccuuguuaugcuacacaauagugaacaaggcggacgugcguacaggcacgcaauggaagaacuucccgauacuauugagacacuuaugcuguuagcacugauagcaguacuaaccggcggagucacacuguucuuccugaguggucggggguuaggaaaaacgucaauaggauuacucugugugauggcuaguuccguacuccucuggauggcauccguugaaccacauuggauugcugcaagcauuauacuggaguucuuucuaaugguauugcuaauuccagaaccagauaggcaacgaacuccacaggauaaucaauuagcauacgugguaauaggccuccuguuuaugauucugacagucgcagcaaaugaaaugggauuauuagaaacaacuaaaaaggaucuaggcaucggacacguagcaguggagaaccaccaucaugcagcaaugcuagaugucgauuuacauccugcuagugcauggacacuauacgcaguugcaacaacuaucauuacaccaaugaugaggcauacuauagaaaacacaacugcaaauauaucacuaacagcaaucgccaaccaggcggcgauccuuaugggauuggacaagggguggccgauuucgaagauggacauugguguaccauuacuggcguuaggauguuauagccaaguaaauccauuaacauuaacggcagcagucuuaaugcuuguggcucacuaugccauaauaggaccaggccugcaagcaaaagcaacacgagaagcucaaaaacgaacagcagcaggcauaaugaaaaacccaacuguagaugggaucguggccauagaccuugauccaguaguuuacgaugcaaaauucgaaaagcaacucgggcaaauaauguuauuaauucuauguacaagccaaauucuauugaugcgaacaacaugggcacuaugcgaaaguauuacacuugcuacuggaccuuuaacaacacuuugggaagggucuccggggaaauucuggaauaccacaauugcuguauccauggcgaauauauuucgaggcagcuauuuagccggagccgguuuggccuuuucuuuaaugaaaucacuaggaggaggaaggcggggaaccggggcacaaggcgaaacucucggcgaaaaauggaaacggcagcuaaaucaguuaucaaaaagcgaauuuaacacauauaagaggagcggcaucauggagguagacagaagcgaagcgaaagaagggcucaaaagaggugagacaacaaagcacgcuguuucacggggaacugccaaguuacguugguuuguagauagaaacuuaguuaaacccgagggaaaagucauagaccuaggaugugguagaggugguuggaguuauuauugugcaggacucaagaaaguaacggaaguaaagggguauacaaaagguggaccaggacaugaggaacccaucccuauggcgacauaugguuggaaucuggugaaauuacauucaggaaaagacguauucuuuauuccaccagagaaaugugauacuuuacucugcgauaucggagagucaucuccgaauccuacaauagaggaagguaggacucugagaguacuuaagaugguugaacccuggcuaagagggaaucaauucuguauuaaaauuuugaaucccuacaugccuucagucguugagacacuagaacaaaugcaacguaagcacggaggaauguuaguacggaauccacuuagcagaaauaguacgcacgaaauguauuggguuucgugugguacugguaauauugucucggccguuaacaugacaagucggaugcuacuaaacagauucaccauggcacauaggaagcccacguaugaaagagauguagacuuaggggcaggaacuagacauguugcgguggaacccgagguagccaauuuagauauuaucggccaacgaaucgaaaauaucaaacacgaacauaagucuaccuggcauuacgaugaagacaacccauauaagacgugggcuuaucacggaucuuacgaaguaaaacccucuggaagugcauccucaauggucaacgggguagucaaacuuuugacuaaaccgugggauguuauacccaugguaacccaaauagcaaugacagauacgacaccauuugggcaacaaagaguauuuaaagaaaaaguagacacacguacaccuaaagcaaaaagaggaacugcucaaauaauggagguaacugcaaaauggcuauggggguucuuaucacgaaauaagaaaccaagaauuugcacucgagaagaauuuacacgcaaaguaagaucuaaugcagcaauuggggcaguguuugucgacgaaaaucaguggaauagcgcuaaggaagcaguugaggaugaaagauuuugggaucuaguccaucgggagagagaauugcacaagcaaggaaaaugugcaacguguguuuauaacaugaugggaaagcgagagaagaaauuaggagaauuugguaaagccaaaggcaguagagccauaugguauauguggcucggugcacgauuccuugaguucgaagcucuaggauuuaugaaugaggaucauugguuuagucgagagaacaguuuguccggggucgaaggagaaggacuacauaaauuagguuacaucuugcgugauauuuccaaaauuccagguggaaacauguacgcugaugacacugcuggaugggacaccagaauaacugaagaugaucugcaaaaugaggcaaaaauaacggauauaauggaaccagaacacgcuuugcuggcaaaaucuauauucaaguuaacauaccagaacaaaguaguaaggguccaacguccagcuaaaaacggaacaguuauggacguuaucucucggagagaccaacguggcaguggucagguaggcacauauggauugaauacguuuacaaauauggaagcucaauugauacgacaaauggaaagcgaaggcauuuucaguccaucagaacuagaaacaccuaaucuagcaggccguguacuagacuggcucgaaaagcaugguguagaacgacuaaaaaggauggcuauuagcggagaugauuguguaguaaagccaauagaugaucgauucgccacagccuuaaccgcacuuaacgauauggguaaaguucgaaaagauauaccccaaugggaaccaaguaaaggauggaaugauuggcaacaaguccccuuuugcucacaccauuuucaucaguuaauaaugaaagacggccgggaaaucguugucccaugccgcaaucaagaugaacucguuggcagagcgagaguuucacagggagccggauggucgcuacgugaaacagcuugccuuggcaagaguuacgcucaaauguggcaacucauguauuuucaccggcgugacuuaagacuagcggcaaacgcaauaugcucggccgucccaguagauuggguuccuacuucccgcacaacuuggaguauucacgcucaccaucaauggaugacuacagaagauaugcucucgguuuggaauagagucuggauagaggagaacccuuggauggaagacaagacgcacguaaguagcugggaggauguacccuaucucgguaaacgagaagaucaaugguguggaaguuuaauuggacuuacagcucgagcaacaugggcuacaaacauacagguagccauaaaucagguacgaagauuacuaggcaaugaaaauuaucuagacuacaugacgaguaugaagagauuuaaaaacgagucagacccugaaggagcguuaugguaa

SEQ ID NO: 21971 - RNA, 9879 nt, Artificial Sequence
  derived and/or modified CDS sequence (opt6) from DENV-1__EU482539__SS-prME
agcgucacuaugcuucuaauguugaugccaacugcguuggcauuccaccuaacgacaaggggaggagaaccacacaugauaguuagcaaacaggaacgaggaaaaucacuauuauuuaaaacaagugcgggaguaaauaugugcacgcuaauugcuauggacuugggagaauuaugugaagauacaaugacauauaaauguccucggauaaccgaaacagaaccugaugacguagauuguuggugcaacgcaacagauacuuggguuacauacggaacuuguucacaaacgggugaacauagaagagauaaaagaucaguagcacucgcaccacacguaggucucggauuggaaacaagaacagaaacuuggaugaguagcgagggugcguggaaacagauacaaagaguagaaacaugggcauuaagacauccagguuuuaccguaauugccuuauuccucgcgcaugcaauugguacaaguauuacgcaaaaagguaucauauucauccuucuuauguuaguaacuccgagcauggcgaugcgcuguguaggaauaggaaguagggacuucguagaaggacuuaguggugcgacauggguagauguggugcuagaacauggcaguuguguuaccacgauggcaaaagacaaacccacauuagacaucgagcuguugaaaaccgaaguaacaaauccagcuguuuugaggaaauuguguaucgaagcaaaaauuucgaauacaacaacagacucacguuguccgacccagggugaagccacucuaguagaggaacaggaugcgaacuuuguuugucgacgaaccuuuguagaucgaggguggggcaauggcugcgggcucuuugguaaaggaucuuuaauaacaugugcuaaauuuaaauguguuacuaaauuagaaggaaaaauaguacaguacgaaaaccugaaauauagcguaauagugacaguacauacaggggaucaacaccaaguuggaaaugagucuacugagcaugggacaacggcgacaauaacgccucaagcgccaacaacagaaauucagcuaacagauuacggcgccuugacuuuggauuguaguccaagaacuggcuuagauuuuaaugagaugguccuuuuaacaaugaaagagaaaagcugguuaguccacaaacaaugguuuuuggaucucccauugccauggacuucuggggcaaguacaagucaagaaacauggaaucgacaagaucugcuugucacuuuuaaaacagcucacgcuaagaaacaagaagucgucguacuugguagucaagaaggugcaaugcauaccgcuuuaacaggcgcuacagaaauucagacaucaggaacuacaacaauauucgcaggacacuugaaauguagauugaaaauggacaaacugacauuaaaaggaaugaguuaugugaugugcacaggaucauuuaaacucgaaaaagaaguagcagaaacacaacacggaacggugcuaguucagauaaaauaugaaggaacagaugcacccugcaaaauaccguuuucaacacaagacgaaaaagguguaacacaaaacggaaggcucaucacggcaaauccuauaguuacugauaaagaaaagccagucaauauugaagcggaaccuccauuuggcgaaagcuauauaguuauaggggcaggcgagaaagcccugaaacucucgugguucaagaaaggaagcagcauagggaaaauguuugaggcuacggcacgaggagcacgucguauggccauacucggagacacagcaugggacuuugguagcauaggaggcguauuuacaucagucggaaagcucguacaucaaauauucggaaccgcauauggaguguuauuuucugggguauccuggacgaugaagauagguauuggcguauuauugacuugguugggacugaauaguagaucaacauccuuaucaaugacgugcaucgcagucggacuuguuacucuguaccuuggcgugaugguacaagcugacagcggauguguaauaaauuggaaagggcgugaguuaaaaugcgguagugguauuuuuguaacgaaugaaguacauacguggacagagcaguauaaauuucaggcugacagcccaaaacgucuaagugcggcuauuggcaaagcaugggaagaggguguaugcgggauaagaagcgccacaagauuggagaauauaauguggaagcaaaucucgaaugaacuaaaucauauacuauuagagaacgacaugaaauucaccguuguagucggcgaugucgcggggauucuagcgcagggaaagaaaaugauacggccccagccuauggaauauaaauauucguggaaaagcugggggaaagcaaaaaucauaggugcagauguacaaaacacaaccuuuauaaucgaugguccaaacacaccagaaugucccgacgaucagcgugcauggaacauaugggaaguagaagauuauggauuuggcauauuuacgacgaacauauggcugaaguugagggacaguuacacucaaguuugcgaccauaggcuuaugagcgcugcgauuaaagauagcaaggcaguacacgcggacauggguuacuggauugaaucagagaagaaugaaacguggaaauuagcucgagcuucauuuaucgaagucaaaaccuguaucuggccaaagucccauacacuauggucuaaugguguauuagaaagcgaaaugauuaucccuaaaauauacggagggccuauaucucaacauaauuaccgaccaggauacuucacacaaacugccgggccauggcaucuaggaaaguuagagcuagauuuugaucuuugugaaggcaccaccguagucguagacgaacauugugggaaccgcgggccgaguuugcgaacaacaacaguaacagguaagauaauacaugaaugguguuguagaucaugcacauugccaccucuaagguuuagaggagaggauggcugcugguacgguauggaaauaagaccuguaaaagaaaaagaagaaaacuuaguaaaaucaauggugagugccggaucuggugagguagacaguuuuucccuaggucuucugugcaucaguauaaugauagaggaagucaugagaaguagguggagcaggaaaaugcuuaugaccggcacacuugccgucuuuuucuuacuaauaaugggccaacuaacauggaaugaucugaucagauuauguauaauggugggagcuaaugcaagugaucgcaugggcaugggaacaaccuauuuggcauuaauggcaacauuuaaaaugcgccccauguuugcuguuggccuauuauuuagaagguuaacaagucgcgaaguccuccuucuaacgauaggcuugucuuugguagcuucgguugaguugccaaacagucucgaagaauugggagaugguuuagcaauggguauuaugauucuuaaacuauugacugauuuucaaucucaucaacucugggcaacgcuucugucacuuaccuuuaucaaaacaacuuuuucacuacacuacgcuuggaaaacuauggccaugguauuaagcauaguuucccuuuuuccccugugccugucuacuacaagucagaaaacgacauggcuacccguguuacucgguagcuuagguuguaagccucugaccauguuucugauagccgaaaauaaaauauggggcagacggagcuggccucugaaugaagggaucauggcuguaggcauagugucuaucuuacuuuccaguuuauugaaaaacgacguuccacuagccggcccauugaucgcaggaggaaugcuuauugccuguuaugucaucagugguucuagcgccgaucucucgcuagaaaaggccgcagaagugaguugggaggaagaagcugaacacaguggggcuagucauaacauucucguugaaguccaagaugauggaacgaugaaaauaaaagaugaagaacgagacgacacguuaacgauacuauuaaaagccacccuacuggccguaucaggcguauauccauuaucuaucccugcuacuuuguucgugugguauuucuggcaaaagaagaaacagcguagcgggguucuaugggauacaccaagcccuccagaaguaggacgagcuguacuugacgaugguauauauaggaucaugcagagagguuugcuaggcaggucacagguagggguuggcgucuuccaagagaauguuuuucacacaauguggcauguaaccagaggggcugucuuaauguaucagggcaaacguuuagagccaaguugggcgagcgugaaaaaggacuuaauaaguuauggcgggggauggcgacuacaagguucuuggaacacuggggaagaaguacaggucauagccguugagccaggcaaaaauccuaaaaacguacagacagcuccgggcaccuuuaagacaccagagggugaagucggagccauagcauuagacuuuaagccuggaacaaguggaagccccauagucaacagagagggaaaaauugugggauuauauggcaacggaguugucacaacaucaggaacauacguuucugcgaucgcacaagcaaaagcgucacaagaaggaccguugccggaaauugaagaugaaguuuuccguaaaagaaaucuaacgauaauggaucuacauccagguaguggaaaaacucgucguuauuuaccagcaauaguaagagaagcgauaaaacguaaguuaaggacacucauacuggccccaacaagggucgucgcuuccgagauggcugaagcacuaaaggguaugccaauacgauaucaaacaacagcuguaaaaucagaacacacugguaaagaaaucguagauuuaaugugucaugcaacauuuacuaugcggcuacuuaguccaguucgaguuccuaauuauaacaugauaauaauggacgaagcucacuucacggacccuaguaguaucgcagcgcgaggauauauuagcacuagagucgguaugggagaagcggcagcuauauucaugacagcaaccccaccaggcucgguagaggcuuuuccgcagucaaaugcaguuauucaagaugaagaaagggacauaccggagagaucguggaacucgggcuaugaauggauaacagauuuuccugguaaaacaguaugguucguaccuagcauaaaauccgguaaugacaucgcgaacugucuacggaaaaacggaaagagaguaauucaauugaguagaaaaacguuugauacugaauaucagaaaacuaaaaauaacgauugggauuacguuguaaccacggauaucagugaaaugggagcaaauuucagggcagacaggguaauagauccgcgacgaugcuugaagccuguuauucuaaaagacggaccugagcgagugauauuagccgggcccaugccuguaacgguugcaagcgcagcacaacgacgaggacgaauaggaagaaaccauaauaaagaaggugaucaauauauuuacaugggucaaccacuuaauaacgacgaagaucaugcacauuggaccgaggcuaagauguugcuugacaauauaaacacaccugaaggcauaauuccggcucucuuugaaccggaacgagaaaaauccgccgcaauagacggggaauaucgccuucguggugaagcaaggaaaacuuuuguugagcuaaugcgccgcggugauuuaccaguauggcuuucauauaagguugcuucagaggguuuucaguacucggauaggagauggugcuuugacggggaaagaaacaaucaaguacuagaagaaaauauggacguggaaaucuggacaaaagaaggugaacguaagaaauuacgcccccgaugguuggaugcacgaacauacucggauccacuugcuuuacgugaguucaaggaauuugcagcaggaagaagaagugucaguggagauuuaauucuugagauugguaagcuaccucaacaucuaacacaaagggcccaaaaugcacuugauaaucuaguaaugcuucauaauucugaacaaggcgggcgugcauacagacaugcgauggaggaauuaccagauacgauagaaacgcuuaugcuauuagcucucauugcagugcuuacgggaggaguuacuuuguuuuuccuaagcggucggggauugggaaaaacuagcauaggucuccuuugugugauggcuagcaguguguuauuguggauggccucuguagaaccacacuggauugccgcaucgauaauucuagaguucuuuuuaaugguccuacuaauaccagaaccugaucgacagcguaccccucaagacaaucaacuugcguaugucguaauaggauuacuuuucaugauuuuaacggucgcagcgaaugaaaugggacucuuggaaacuacaaagaaagaccucgguauaggacacguagcagucgaaaaucaucaucaugcugcaaugcuggauguagauuuacacccggcauccgccuggacucuauacgcaguagcaacuacaauaauaacgccaaugaugaggcauacuauugaaaauacgacagcuaacauaucguugacugcuauagcaaaccaagccgcaauuuuaaugggcuuagacaagggguggccuauaucuaagauggacauuggugugccacuuuuagcucuagggugcuacagucagguaaacccacucaccuuaacagcggcaguacuaaugcuaguagcacauuaugcaaucaucgguccuggguugcaagcaaaggcuacucgcgaagcacaaaagagaacagcggcaggaaucaugaaaaauccaacaguggaugguaucguagcgauagaucucgaucccguaguguaugaugccaaauucgaaaaacaacuuggacagauaauguuacuaauuuuauguacgcuccaaauacugcuaaugagaacuacaugggcgcuuugcgaaagcauaaccuuagcaacuggaccacuuacaacauuaugggaaggaagcccagguaaauucuggaauacaacaaucgcaguaaguauggcuaauauuuucagaggcucauauuuggcgggagcaggguuggcuuuuucucuuaugaagucgcucgguggagggagacgugguacgggugcacaaggagaaacauugggcgagaaguggaaaaggcaauuaaaccaacuaagcaaaagcgaguuuaauaccuacaaacguucgggcauuauggaaguagacagaucugaagcuaaagaagggcuaaaacgcggugaaacgacaaaacaugcuguaagccgagggacggcuaaacuucgaugguuuguagaacgcaaccuaguaaaaccugaaggaaaagugauagaccuggguugcggcagaggcggcuggagcuacuacugugcaggacugaagaaaguaacagaaguaaaagguuacacaaaaggcggcccgggacaugaagaaccuauaccaauggcaacguacggauggaauuuaguuaaacugcauucuggaaaagaugucuucuuuauaccuccagaaaaaugugauacccuacuuugcgacaucggagaaucaucuccuaauccuacuauugaagaaggacguacucuuagaguuuuaaagaugguagaaccauggcuaaggggcaaucaauucugcaucaagauccuaaauccauauaugccaucggucguagagacgcuggaacaaaugcaacguaaacauggcggaauguugguacgcaacccauuaucucgaaacucaacucaugaaauguauuggguuucuugugguacuggcaauauagugucugcagucaauaugacuucaaggauguugcuaaauagauuuacgauggcacaccgaaaaccuacauaugaacgcgacguugauuugggugcgggaacacgccauguagcuguagaaccugaaguagccaacuuagauauuaucggucagagaauagaaaacauaaaacaugaacauaagaguacauggcauuacgaugaagauaauccuuauaaaacuugggcauaccauggaaguuaugaagucaagccaaguggauccgcguccaguaugguuaacggcguaguaaaauuauugacuaagcccugggacgugauuccuaugguuacucagauagcaaugacagauaccacgccguuuggucaacaacgaguuuuuaaggaaaagguggauacuaggacacccaaagcuaagcggggaacugcucaaauaauggaaguuacugcaaaauggcuauggggauucuuaucaagaaacaagaaacccagaauuuguacacgagaagaauuuacaagaaaaguaaggucaaacgccgcaauuggugcggucuuuguagacgagaaccaauggaacucagcuaaagaagcgguggaagaugagcgauuuugggauuuaguacauagggagcgagaguuacacaaacaagguaaaugugccacauguguuuacaacaugauggguaaacgugagaagaaacucggugaauuugggaaagcaaaagguucgcgagcgauaugguacaugugguuaggggcacgauuccuagaauuugaagcucuaggauucaugaacgaagaccauugguucucuagggaaaauagcuuaucaggcguagaaggagagggacuacacaaauuaggauacauacuacgagauaucucuaauauaccgggagggaacauguaugcagaugacacagccgguugggauacaaggaucacagaagacgaccuccagaacgaagccaggauaaccgacauuauggaaccggaacaugcucuccuagcaaaaucaauauucaaauuaaccuaccaaaacaaaguaguuagaguacaaaggccugccaaaaacgguaccguaauggacguuauaagccgucgcgaccagagagggucaggacaaguaggaaccuauggacuaaacacuuucacuaauauggaggcucaguugauuaggcaaauggaguccgaggguauauuuucacccagugaauuagaaacuccgaaucucgcugaacgaguauuagauugguuggaaaaauauggagucgagagguuaaaacggauggcgauaagcggggacgauugcgugguuaagccgaucgacgaucgcuucgcaacagcacugacugcccucaaugauaugggcaaggugagaaaagacauaccccagugggaaccuaguaaaggguggaacgauuggcaacaagugccguucugcucccaucacuuccaucaacugauuaugaaggacggaagagaaauagugguaccauguagaaaucaggacgaauuaguagggcgagcaagagucucacaaggagccggauggagucuacgagagacagcaugccuuggaaaaaguuaugcccaaauguggcaguuaauguacuuucacagaagagaccuccgucuggcagcgaaugcgauaugcagugcagucccuguugacuggauuccgacuucaagaacaacauggucaauacacgcccaucaucaauggaugacuacggaagauauguuaucaguuuggaauagggucuggauagaggaaaaccccuggauggaggacaaaacccacauuucauccuggggagauguaccuuaccuaggaaaaagagaagaccaauggugcggcucuuugauaggucuuacagcucgcgcaacaugggcaacgaauauucaaguagcuauaaaccagguaaggcgucuaauuggcaaugagaacuauuuggacuauaugacaaguaugaaacgauuuaaaaaugaaucugaccccgaaggggcucuaugguag

SEQ ID NO: 21972 - RNA, 9879 nt, Artificial Sequence
  derived and/or modified CDS sequence (opt6) from DENV-1__KP188539__SS-prME
ucgguaacaauguuacuaaugcuuuuaccuacagcguuggcguuucacuugacuacgagaggaggugagccucacaugauaguaucgaaacaagaaagaggcaaaucgcuguuguuuaaaacaucagucggaguaaacauguguacauuaauugcaauggauuugggugaacucugugaagauacgaugacauauaaaugcccuagaauuacugaagcagaaccagacgauguagauugcuggugcaaugcaacagauacaugggucacauauggcacaugcucucaaacuggagaacauagaagagacaaacggucgguugcuuuagcaccacauguaggcuuagggcucgaaacacgaacagaaacguggaugucaucagaaggugcauggaaacaaauacaaaaaguugaaacuugggcccugcgacauccaggcuuuacuguuauugcacuauuuuuggcccaugcuauuggaacgaguauuacgcaaaaagguauaauuuuuauauuguuaaugcuagucacaccaaguauggcgaugcggugugucggaaucggaaauagggacuuuguugagggacuaucuggagcaacuuggguagauguuguacucgaacacgggucgugcgugacuacaauggccaaaaacaaaccaacacuagacaucgaguuguuaaaaacggaagugacuaacccagcaguucuuagaaaauuaugcaucgaagccaaaaucaguaacacgacaacugauagcagauguccaacucaaggugaggcuaccuuaguagaagaacaagacgcgaacuuuguauguaggcggacauucguugaucgaggcuggggaaacggauguggacuuuucggcaagggcucuuuauuaacaugugccaaauucaaauguguuacuaaauuagagggaaaaaucguccaauaugaaaauuuaaaauauagcguaauuguuacuguccacacaggagaccaacaccaagugggaaacgaaacgacggaacaugguacaauagcaauuauuacgccacaagcaccaacuucugaaauacaacuaaccgauuauggcgccuugaccuuagacuguagcccaagaaccgggcuggauuuuaaugagaugguuuuacucacgaugaaagaaaagagcuggcuaguacauaagcaaugguuccuugaucugcccuuacccuggacuucuggagccucaaccagccaagagaccuggaauagacaagaccuauuaguuaccuucaagacugcccacgccaagaaacaggaaguugucguuuuaggaucacaagaaggagcaaugcacacagcacuaacaggagcuacugagauucagacuucagguacgacaacgauauuugcuggacaucuaaaaugucgguugaaaauggauaaacugacccuuaaaggaaugucauacgucaugugcacaggaucauuuaagcuagaaaaggagguagcagaaacccaacauggcacaguacugguacaaguaaaauaugaaggaacugaugcgccguguaaaaucccuuucuugacucaggaugaaaaaggagucacacaaaaugguagauuaauaacggcgaauccaauaguaacugauaaggagaaaccuguaaacaucgaaacagaaccaccuuucggcgagaguuauauagucguaggugcaggagaaaaagcguuaaaacuaaguugguuuaagaaaggaaguaguaucggaaaaauguuugaggcuaccgcaaggggagccagaagaauggccauauugggagacacagcuugggauuuuggcagcaucgggggccucuucacaucuguagguaagcuaauacaccaaguauuugggacugcguaugguguccuauuuagcggaguuagcuggacuaugaagauuggcauugguauacuauugacauggcuaggauugaacucaaggagcacaagucucaguaugacuuguauagccguaggaaugguuacacuauaucugggaguaaugguacaggcagacucaggaugcgucauuaauuggaaaggacgugaacuuaaaugcggaucaggaauauucguaacaaaugagguucacacuuggacggaacaauacaaauuucaagcggacagcccuaaacgacugagugcagcaaucgguaaagccugggaagaaggggugugcggaauacgaucagcaacuagacuagaaaauaucauguggaaacaaaucagcaaugaauugaauuacauacuacuggagaacgauaugaaauuuacuguagucguaggagacguuaacgguauucuagcucagggaaagaaaaugauaagaccacaacccauggaacauaaauauucauggaaaagcuggggaaaggcgaagauaauaggugcagauauucaaaacaccacauuuauuauagaugguccggacacaccugagugcccugacgaccagagggcauggaacauuugggagguagaagauuaugguuuugguauauuuacaacgaacauuuggcuaaaauuacgagauucacacacacagaugugugaccacagacucauguccgcagcuauuaaggauucaaaagccguacacgccgacaugggauacuggauagaaagugagaagaaugaaacguggaaauuggcucgggcaucauuuauagaaguaaaaaccuguauauggcccaagagucacacguuauggagcaacggagugcuugaauccgaaaugguaauuccaaagauuuacggaggaccaaucucacaacacaacuacagaccaggcuauuuuacccaaacugccggaccauggcauuuaggcaaacuagaguuagauuucgaccuaugcgaaggcaccacaguagugguugacgagcacuguggcuacagagggcccaguuuaagaacaacaacaguuacuggaaaaaucauccacgaaugguguugucguucaugcacccucccaccauugcgcuuucgaggagaggacgguugcugguauggcauggaaauuaggccagucaaggaaaaagaagaaaacuugguuagaucgauggugagcgcugguucuggugaaauggacaguuuuucacuuggaauccucuguguuucaauacuuauagaagaagugaugcgaaguaggugguccaggaagaugcuaaugacgggaacgcuagcgguauucuuacuccuaauaaugggacaauuaacauggaacgaucugauucgucucugcauaaugguaggugccaaugcaucagacagaauggguauggguacaacuuaccuagcauugauggcuacguuuaagaugagaccaauguucgcugugggucuucuauuccgucgauuaaccucucgugagguacuucucuugaccguagggcuaucauuaguagcgaguguggaauuaccaaauucacuagaggaguugggggacggacuagcaaugggcaucaugauguuaaaauuauugacugauuuucagccgcaucaguuauggacuacgcuacuaucgcuuacauucauuagaacaucucucucacuggacuacgcauggaagacgauggccauggccuuaaguauagucagcuuauuuccauugugcuuaagcacaacgagccagaaaacgacauggcucccggugcuucuagggucguuuggaugcaagcccuuaacuauguuuuugauaacugaaaauaaaauauggggcagaaaauccuggccuauaaacgaagguauuauggccgugggaaucgugucaauauugcuaucuucucuauuaaaagaugacguaccauuggcgggaccguuaauugccggggguauguuaauugcuuguuaugugaucucgggaucuuccgcagaucugagucuagaaaaggcagcagagguauccugggaagaagaagcugagcacucaggaacaagucauaacauauuaguagaaguacaggaugacggaacuaugaagaucaaagacgaagaacgugaugacacauuaaccauacuguugaaggcaacguuauuagccguuucggguguauauccaaugaguauuccagcuacuuuguuuguuugguauuuuuggcagaagaagaaacagcggucgggaguucuuugggauacacccucuccuccagagguagaaagggcagucuuggaugaugguaucuauaggauucuacagagaggauuauuaggacgaucacagguagguguugguguauuucaggauggaguuuuccacacaauguggcauguuacuagaggggccguucucauguaccaagguaaaagauuagaaccaagcugggcauccguaaagaaagacuuaaucaguuauggcggggguuggcgauuucaaggcucuuggaauacgggcgaagaaguacaaguaauagcaguggaaccaggcaaaaacccgaaaaauguucaaaccacaccaggcacuuuuaaaaccccggaaggggaaguuggcgcaauugcguuggacuuuaaaccuggaacauccggcuccccuauugucaauagagaagggaaaauuguaggauuauacggaaaugguguagucacaacuuccgguaccuauguaucagcuauagcacaagcaaaagcgacacaagaagguccacuaccagaaauagaggaugaaguguuuaaaaagagaaauuuaacaauaauggacuugcaccccggaucggguaaaacuagacgcuaccuaccagcgauuguacgagaggcaauuaaaagaaaacugcguacccugaucuuggcaccaacacgagucguagcauccgaaauggcagaggcgcugaaaggaaugccaaucagauaucagacaacggccguuaagucugaacacacaggacgugagauuguugauuugaugugccaugcaacauuuacuaugcgacuauuaagcccuguacgagucccuaauuauaacaugaucauaauggacgaagcacauuuuacagauccagcaucuauagccgcucgggguuauaucucgacacgaguugguaugggagaggcagcagcuauauuuaugacggcuacuccucccggcucaguagaggcuuucccacaaucaaaugcggucauacaagacgaggaacgcgacauaccagagcgaucuuggaacucagguuaugacuggauuaccgacuuuccaggcaagacuguaugguuuguuccaucaaucaaaucuggaaaugauauagcaaauugccuuaggaaaaauggcaagagaguaauucaauuaagcagaaaaacauuugauacagaauaccagaaaacuaaaaacaacgacugggacuaugucgugacuacugauauaucagaaaugggggcaaauuuuagggcugacagaguaauagauccacgaagauguuuaaagccaguuauauugaaagaaggcccugagagggugauuuuagcagguccaaugccgguuacgguagcuucagcggcccagagacgcggcagaauaggaaggaaccaaaauaaagaaggggaccaguacauuuauaugggccaaccguugaacaaugacgaagaucacgcccauuggacagaagcgaaaaugcuacuagacaauaucaauacuccugaaggcaucauaccagcauuguucgaaccagaacgagaaaaaucagcggccauagauggggaguauagacuccgaggagaagccaggaaaacauuugucgaacucaugcggcgcggggaucucccuguauggcucucuuauaaaguagcaucugaaggauuucaauauucagaccgaagaugguguuucgauggagaaaggaauaaccagguuuuggaagaaaauauggauguagagaucuggacgaaagaaggcgagcgaaagaaauuacgaccgcguugguuagaugcgcggacauacagcgauccgcuggcacuuagggaauuuaaagaguuugccgcuggaaggcgaagugucagcagcgaucuaaucuuagaaauaggaaaacuaccacaacaucugacacuacgcgcgcaaaacgcguuggacaaccuaguaaugcuucauaacuccgaacagggagguaaagccuaucgacacgcaauggaggaacuaccagauacgauagagaccuuaaugcuauuagcacuaauagcuguacuaacuggaggaguaacccuauuuuucuugucaggaaaaggauugggaaagaccucgauuggacuucuuugcgucauggcuaguagugcacuacuuuggauggcuucuguagaaccccacuggauagcugccucuauaauucuugaauuuuucuuaauggugcuauuaauaccggaaccagauagacaacgaacaccacaggauaaucaauuagcauaugucgucauaggucuuuuauucaugauauuaacgguagcugcaaacgaaaugggauuacuagagacaacuaagaaagaucuagguaucggccacgucgcagucgagaaucaccaucaugcuaccaugcuagauguugaccucaggccagcgucugcauggacucuuuacgcaguugccaccacaguuauaacacccaugaugaggcacacaauugaaaauaccacagcaaacaucagcuugaccgcaaucgccaaucaagcagcgauauuaauggguuuagacaaaggauggccaauaucaaagauggauauuggcguuccucuacuagcuuuaggguguuauucacaaguaaacccacucaccuugaccgcagcaguacuaauguuaguugcacauuacgcaauaauaggacccgguuuacaagcuaaagcuacacgcgaagcucaaaagcggaccgcagcgggaauaaugaagaaucccacgguugauggaauugugaccaucgaccuugauccagucguuuacgacgcaaaguucgaaaaacaguuggggcaaauaaugcuccuuauucuguguacuagccaaauucugcuuaugaggacuacaugggcacuaugugaaucgauaacucuagcaacuggcccccuaacgacgcuuugggaggguucccccgggaaauuuuggaacacuacgaucgcgguaaguauggcaaacauuuuucguggcaguuaucuagccggugcuggacuagcauuuucguuaaugaaaucgcuagguggaggaagacgagggacaggagcccaaggagaaacguuaggugaaaaauggaaacgacaguuaaaucaacugucuaagucagaauuuaauaccuauaagaagucuggaauaauggaaguagacagaucugaggcuaaggaagguuuaaaaagaggagaaacaacuaaacaugccguaagucgagguacagccaaguuacgaugguucguggaaaggaaucuaguaaaaccggagggaaaaguaauagacuugggaugcggccgaggaggauggagcuauuauugugcaggacuaaagaaaguaacagaagucaagggguauaccaagggagguccuggacacgaagaaccuaucccaauggcuacauauggguggaaucuggugaaauuacacuccggaaaagauguauucuuuacuccaccggaaaaaugugauacuuuacuaugugauauaggagaaucuaguccaaacccaacgauagaggaaggaaggacgcugagagucuugaaaaugguugaacccuggcuuagagggaaccaguucuguauaaaaauauuaaaucccuauaugccuaguguaguugaaacucuagaacaaaugcaaagaaaacacggugguaugcuagugaggaacccguuaaguaggaauagcacccacgaaauguauugggucucuugcggcacaggaaacauuguaagugcuguuaauaugaccucuagaauguuacugaacagauuuacaauggcacaucgaaaaccuacauaugagcgcgacguggaucucggugcaggcacaagacauguagcaguagaaccagaggucgcuaaucucgacauaauuggccaaagaaucgaaaauaucaaaaaugaacacaaaaguacuuggcauuacgacgaggauaacccauauaaaacaugggcguaccacggcucauaugaaguaaaaccaagcggcucugcauccuccaugguaaacgggguaguuagguuguugaccaaaccaugggauguaauccccauggugacacaaaucgcuaugacagacacuacgccauucggccaacaaagggucuuuaaagaaaaagucgauacaaggacaccgcgugcuaaacgcggaacugcacaaauaauggaaguuacagcaaaaugguuaugggguuucuuaagccguacgaagaaaccacgaaucuguacaagagaagaauuuacaaggaaaguccguaguaaugccgccauaggugcagucuuuguagacgaaaaccaauggaacucagcgaaagaagccguugaagacgagagauucugggaucuaguacaucgggaacgagaguuacauaaacaggguaaaugcgccacauguguuuauaacaugaugggaaaacgugagaagaaacugggugaguuugggaaagcaaaaggcucaagagcaauaugguacauguggcucggggcaagauuucuugaauuugaggcccucggguucaugaaugaagaucacugguuuuccagagaaaacagcuuaucaggaguagagggagaagggcugcauaaacuuggauacauccuaagagauauaucuaagauccccggcggaaauauguaugccgacgauacagcugguugggacacuagaauaacggaggaugaucugcagaaugaggcgaagaucacugauauaauggaaccagaacaugcccucuuagcaacaaguaucuuuaaauuaacauaccagaacaaggucguucgaguacaacgacccgcuaagucaggcacaguaauggaugugauuucuagacgagaccagcgcggaucaggucagguagguaccuacggacucaauacauucacaaauauggaaguucagcuaaucagacaaauggaaucugaggguauauuuuccccaucagaauuagaaacuccuaaccuagccaagaaaguauuggacugguuagaaaaacauggcgcagaaagacucaaacgaauggcgauaaguggagacgacuguguugucaagccuauagaugaucgcuuugccacggcguuaacugcucucaacgacaugggaaaaguccggaaagacauuccccaaugggaaccaucuaaaggguggaaugauuggcaacaagucccuuuuuguagucaccauuuucaccagcuuauaaugaaagaugggcgggaaauuguugucccuuguaggaaccaggacgaauuaguaggccgggcccgaguuucccaaggagccggauggagccuaagggaaacugcuugcuuaggcaaaucauacgcacaaauguggcaacuaauguauuuccacaggagggaucuuagguuagccgccaacgcuauuugcagugcaguaccaguagauugggucccgacaucuagaacgacguggaguauucacgcacaucaucaauggaugacaaccgaagacaugcuuucgguguggaauagaguguggauagaagaaaaccccuggauggaagacaaaacucacguuaguucuugggaggaaguaccauaccuugggaagagggaagaccaauggugugguucuuuaauaggguuaacagcacgagcuacuugggccaccaacauacaaguugcuauaaaccagguacggagacuaauagguaaugagaauuaccuggauuauaugacuagcaugaaaagauucaaaaaugaaucugauccugaaggagcauugugguag

SEQ ID NO: 21973 - RNA, 9879 nt, Artificial Sequence
  derived and/or modified CDS sequence (opt6) from DENV-1__KP188540__SS-prME
ucaguuacaaugcuacuaaugcuucuaccaacagcacuagccuuucaucucacgacuagaggaggggaaccucacaugauagucuccaagcaagaaagaggaaaaucgcuguuguucaagacaucagcuggcgucaacauguguacuuuaauagccauggacuuaggagaauuaugugaagauacuaugacuuacaaguguccacguauaacagaagcagaaccugacgauguagauuguuggugcaacgcuacagacacaugggugacguauggaacauguagucaaaccggugaacaucgacgagaaaaaagaagugucgcucuagcaccacauguaggacuaggacuugaaacccgaacggaaacuuggaugucuucagaaggagcguggaaacaaauucaaagaguugaaaccugggcauuaagacaccccggguucacaguuauagcauuuuuucuugcucaugcaauugggacuucuauaacucaaaagggaaucauuuucauuuuacuaaugcuuguuacaccaucaauggcgaugagguguguugguaucggaaacagggacuuuguugaagguuuauccggcgcaacuuggguagauguaguacucgagcauggcagcugcguaacaacgauggccaaaaacaagccaacccuggacauugaacuacuuaaaacagaaguaacaaacccggcuguccuuagaaagcuuuguauugaagcaaagauuaguaauacuacaaccgauucuagaugucccacucaaggcgaggccaccuuaguggaggaacaagacgccaauuucguaugucgccgcacguuuguugaucgagguuggggaaacgguuguggauuauuuggaaaaggcagucuuuugacgugugcaaaauuuaaauguguaacaaaacuagaagguaaaauuguucaauaugagaaucuaaaauacagugucaucgugacuguucauacaggagaccaacaccaagugggaaacgagacaaccgaacacggaacuauugcaaccauaacaccgcaagcacccacuuccgagauacaauuaacggacuauggagcgcugacacuagacuguucuccgagaacaggauuagauuuuaacgagaugguuuuacuaacaaugaaagaaaaaucuuggcucgugcauaaacaaugguuccucgauuuaccauugccguggaccagcggggccucuacgucacaagaaaccuggaaucgucaggauuuauuaguaacuuucaagacugcucaugcaaaaaaacaggaagucguaguacuugguagucaagagggagccaugcauacugcucuaacaggcgcgacagaaauucaaacauccggcacaaccacaauuuuugccgggcaucuaaaauguagacuuaaaauggacaaacucacucuaaaaggaaugucauaugucauguguacgggaucguuuaaguuggaaaaggaaguagccgaaacucaacacggcacuguacuaguacaaguaaaauaugaagguacagacgcaccaugcaaaauaccguuuagcacacaagaugaaaaaggcgugacucaaaauggacgacuaauaacugcgaauccaauaguuacagauaaagaaaaaccaguaaauaucgaaaccgaaccacccuucggggaaaguuauauuguagucggagcaggggaaaaagcauugaaguuaagcugguucaaaagaggaagcucuaucgggaaaauguucgaggcgaccgcacgcggagcuagacggauggcuauccuuggagauacggcaugggauuucggaaguauaggcgggguauucacuucaguagggaaguugguacaccaaguuuuugguaccgcguacggaguauuguucagcggcguaucauggacaaugaaaauugguauaggaauuuuauuaacauggcucggauuaaacucacgcaguacaagucuauccaugacaugcauagcagugggcaugguaacuuuauauuuaggggucauggugcaagcggacaguggaugugugauuaacuggaagggacgggaauuaaaauguggcucaggaauauucgugacgaaugaaguucauaccuggacagagcaguauaaauuucaagcggauucacccaaacgauuaucugcggcaauaggcaaagcuugggaggaaggaguaugugguauuagaagugcaacacgauuagaaaauauaauguggaaacaaauaucaaaugaguuaaaccauauccuacuugaaaacgacaugaaauuuacaguuguuguaggcgaugcgaacggaauucucgcacaagggaaaaaaaugauaagaccgcaaccgauggaacauaaauauaguuggaaaucuugggguaaagcaaaaaucauaggggcggauauccagaacacaaccuucauaauagacggacccgauaccccagaaugcccagaugggcagagagcauggaacauaugggagguagaagauuauggauucggaguuuuuaccaccaacaucugguuaaaauugcgagauuccuacacccaaaugugugaucaucguuugaugucagcagcgauaaaagauucuaaagcgguacaugcagauaugggauauuggaucgaaagcgaaaagaaugaaacguggaaguuagcccgggcuuccuuuaucgaaguaaagacauguaccuggcccaagucacacacacuauggucaaacggugugcuagaaagugaaaugaucauaccaaagauauucggugggccaauaucacaacauaauuaccgaccgggauacuuuacacagacagcaggaccuuggcaucuuggaaagcuagaauuagauuucgaccucugugaaggaacuacuguaguaguagaugagcauugugguaaucguggacccucucuacgaacgaccacuguuacuggaaaaauuauccaugagugguguuguagaaguugcacucugccgccccucagauucagaggcgaagauggguguugguaugguauggagauaagaccuguuaaggagaaagaggaaaacuugguaagauccauggugagugcuggcaguggagaaguugauuccuuuagucuggguauguuguguguauccauaaugaucgaagagguaaugaggucccgauggucaaggaaaaugcucaugacgggaacccuagcaguuuuccuacuccuaaucaugggucaacuaacauggaaugaucuaauaaggcuaugcauaaugguaggagcgaacgcgagcgauaggauggguauggguaccacguaccuugcacucauggcuacauuuaaaaugcguccaauguuugcagucgguuuacuuuuucgccgucucacaagccgcgagguauugcucuugacaauaggauugucguuagucgcuagcguugaauuaccuaauucgcuagaagaauugggagauggacuugcaaugggaauaaugauguugaaguuacuuacagaauuccaaccucaucaacuauggacuacucuauuaaguuuaacauucgucaaaaccacucuaucuuuagauuaugcauggaaaacaacagcuaugguauugaguauuguuagccuauucccuuuauguuugagcacgacaucucaaaagacaaccuggcucccgguacuucuuggaucauucggaugcaaaccauuaacuauguuuuugauaacagagaacaaaauuuggggccgcaagaguuggccacuaaaugaagggauaauggccauuggcauaguaucgauacugcuaucaucauuauuaaaaaacgauguuccuuuagccggaccgcuaauagcaggcgguauguuaauugccugcuacguaauuucagguucuuccgccgaucuguccuuagaaaaagcagccgaagugagcugggagcaagaagcugagcauagcggagcaucacauaacauuuugguagagguucaggacgaugggacaaugaaaauaaaagacgaggaacgggaugauacauuaaccauacugcuuaaggcaacgcuguuggcaguuucgggaguauacccaaugagcauuccugcaacucucuucguuugguacuucuggcaaaaaaaaaaacaacgaucgggaguauuaugggacacaccuagcccaccggaaguugaacgugcaguucuagacgacgguauauauagaauauuacaacguggcuuacuaggacgaucucaaguaggcgucgggguuuuucaagacggaguuuuucacacgauguggcaugugacaagaggggcuguacuuauguaucaaggcaaaagacucgaaccuucaugggcaucagucaaaaaagauuugauaucauauggcggugguuggagauuucaagggucauggaauacaggugaagaaguucaagucaucgccguagaaccugggaagaacccgaagaauguucaaaccacaccggggacauuuaaaacaccugaaggggaagucggcgcgauagcucuagacuuuaaaccagguacuucuggcagccccaucgucaauagagaaggcaagaucgucggccuguacggcaacggugugguuacuacaagcggaacauacguaucagcaauagcccaagcuaaagcaucacaagaaggaccacucccugaaauugagaaugaaguauuuaagaagcggaaucuaacgaucauggaccuacacccagguucaggaaaaacacggcgauauuugccugcuauuguacgugaagccauaaaacggaaacuccgcacauuaauacuagccccuacaagggucgucgccagugaaauggcugaagcacuaaaagggaugccaauuagauaucagacgacagcaguuaaaagcgaacacacagguagagaaauaguggacuuaaugugccacgcgacuuuuacuaugcgucuuuuaaguccuguaaggguaccgaauuacaacaugauaauaauggacgaggcgcauuucacugaccccgcaaguauagcagcacgugguuacauuucaacuagaguugguaugggagaggcugcugcaaucuuuaugacugcuacaccccccggcaguguagaggcauucccucagucgaacgcagugauucaagacgaagaaagggauauuccagagagaucauggaauaguggauaugauuggauaacugauuucccaggcaaaacagucugguuuguacccucgauuaaaucgggaaacgauauagcuaacuguuuacgaaaaaacggaaaaagaguaauccaguuaaguagaaaaacuuucgauacagaauaccaaaagacaaaaaauaacgacugggauuaugugguaacgaccgacauaucugaaaugggagcuaacuuuagagcagaucgagucauagacccccgucgauguuuaaaaccaguaauacuaaaggauggcccagaaagaguuauucuagcggggccaaugccaguuacaguugcuagugcagcacagcgcaggggucgaauagguagaaaccaaaauaaagaaggagaucaauacguuuacaugggacagccgcuaaacaacgaugaagaucaugcacacuggacagaagcuaagaugcuucuagauaacauaaacacgccggaagggaucauuccugcucuuuucgaaccugaacgugaaaagucugcagcuauagauggcgaauaccgcuugcgcggggaagcaagaaaaacguucguagaauuaaugcgaaggggagaucuaccgguguggcucaguuauaaaguugcgucggaaggguuucaauacagugaccguaggugguguuuugacggagagagaaacaaccaaguauuggaggaaaauauggacguagaaaucuggaccaaggagggcgaacgaaaaaaacucagacccagauggcuugaugcacgcacguauucagacccauuagcuuuaagggaauuuaaggaauuugcagcuggaagacgaagcgugucuggugaccuaauuuuagaaauagggaaacuaccacagcaccuuacucuucgagcgcaaaaugcucuagauaaucucguaaugcuacauaauagcgaacaagguggcaaagccuauagacaugcaauggaggaguuaccggauacgauagaaacucuaaugcuucuggcgcuaauagcaguacuaaccggaggugcuacacuauuuuuuuugaguggaaaaggauuagguaaaaccucgauugguuuauuaugugucaccgcaucuuccgcauuacuguggauggccagcguagaaccccauuggauagcagcuagcaucauucuugaauuuuucuuaaugguacuguugauaccugagccagacagacaacguacuccacaagacaaccaacuugcauacgucguaauuggauuguuauucaugauucuaacuguagcagccaacgaaaugggacuccuagaaacuaccaagaaagaucuggggauaggauacguagcggcugaaaaccaccaacaugcaacuaugcuggacguagacuuacacccugcgucugccuggacacuuuacgcaguagcgacgacaguaauaacaccaaugaugcgacacacaauagagaauaccaccgcuaauauaucucuaaccgcaauugcuaaucaagcugccauuuuaaugggauuagauaaaggauggccaaucagcaaaauggacauaggaguaccacuccuagcucuuggcugcuacucgcaaguuaacccguuaaccuuaacugcagccguguuaaugcuaguugcacacuaugcuauuaucggaccgggacuacaagcgaaagcaacacgagaggcccaaaaacgaaccgcugcuggaaucaugaagaacccaacuguugaugguauaguggcaaucgaucuugauccgguagucuaugacgcuaaauucgagaaacaacugggucagauaauguuguuaauccugugcacaucccaaauccuucuuaugagaacuacuugggccuuaugcgagucaauaacuuuggcuacaggaccauugacaacuuugugggagggaucaccuggaaaguucuggaauaccaccauagcaguaucuauggcgaacauauucagagguaguuaccuagcuggcgcuggacuugcauuuucguuaaugaagucccuaggcgggggccgaagaggaaccggcgcgcaaggugaaacccuuggugagaaauggaaaagacaauugaaccaguuaucaaaaucagaguuuaacacguauaaacgcagugggauaauggaagucgaccgaagugaggccaaagaaggccuaaagagaggggagaccacuaaacaugccguaagucgcggaacugcaaaacuaaggugguucguagaacgaaaccuagucaagccugaaggcaaaguaauagauuuagguuguggacgugggggguggucguacuauugugcgggguugaaaaaggucaccgaaguaaaaggauacaccaaaggagggccaggucaugaggaaccaauuccaauggcaacuuauggguggaaucuaguuaaacuacauucaggcaaggauguguuuuucaugccgccugaaaaaugugauacauuacuuugcgacauaggugaauccucuccgaaucccacaauagaggaaggcaggacucuaagggugcuuaagaugguagagccguggcuaagaggcaaucaauucuguauuaaaaucuuaaacccuuacaugccaucgguaguugaaacacuagagcaaaugcaacguaaacauggcggaaugcuaguuaggaauccauuaucaagaaauucaacacacgagauguacugggucucgugcgggacggggaacauugugucggcggucaauaugaccagccgcauguuacucaaucguuuuaccauggcccauaggaaaccgacuuacgaaagagauguggaccuaggugccgggacgcgacaugucgcgguagaacccgaaguagcaaaccuagauauaauugggcaaaggaucgaaaauauaaaaaaugaacauaaaucgacguggcacuaugacgaagauaacccuuacaaaacuugggcuuaucaugggaguuaugaagucaaaccaucugggagcgccucaaguaugguaaacggcgugguacgguuacuaacgaagccgugggauguuauaccaaugguaacacaaaucgccaugacagauaccacccccuucggccaacaacgagucuuuaaggaaaaaguugacacucgaacuccacgugcuaagcgagguacuacacaaauuauggaaguaacagccaaaugguuauggggcuuccugucgagaaauaagaaacccaggauuuguacaagagaagaauuuacaagaaaggucagaucaaacgcagccauuggggcugucuucguagaugaaaaucaauggaauucggcaaaggaagcaguagaggaugaacgcuuuugggaccuaguacaucgagaaagggaauuacauaaacaaggaaaaugcgccaccugugucuacaacaugauggggaaacgagaaaaaaaacugggagaguucggaaaagcaaaagguaguagggcaauaugguauaugugguuaggggcaagauucuuggaguucgaagcgcugggauuuaugaacgaggaucacugguucucaagggaaaacucacuguccggcguugagggggaaggucuacauaaacuaggauacauccuuagagauauaagcaaaauaccaggcggaaauauguaugcggaugacacagcuggaugggacacuaggauaacggaagacgauuuacagaacgaagcaaagauaacugacauuauggaaccugaacacgcacucuuagcuacaucuauuuuuaaacuaacauaccaaaacaaaguagugagaguacagagaccagcaaaaaacggcacgguaauggacguaauaagcagaagagaucagcgggguaguggacaaguaggaacauaugggcuaaacacguucacaaauauggaggugcaauuaauaagacagauggaaucggagggcauuuuucugccuucagaacuagaaacaccuaacuuagccgaaagagcuuuagauuggcuagagaagcauggcgccgaacgacuaaaaagaauggcaaucucaggagaugauuguguagugaaaccuaucgacgauagauuugcaacagcacucacagcccuaaaugauaugggaaagguucggaaagacauuccgcaaugggagccuucaaaaggauggaaugauuggcaacaagugccuuuuugcucccaucacuuccaccaacuuauaaugaaagauggcagagaaauaguaguaccaugccguaaucaggaugagcugguaggacgggcucgcguaucacaaggagcuggauggucuuugagagaaacagcaugcuuagggaaaucguacgcacagauguggcaacugauguacuuucauagaagagauuuaagguuagccgcaaacgcuauauguucagcgguuccgguugauuggguaccagcaaguagaacaacauggucaauucaugcgcaucaucaguggaugacgacugaggauauguuaucgguauggaaucgagucuggauagaagagaacccauggauggaagacaagacacaugucuccucgugggaagaggugccauaucucggcaaaagggaggaccaauggugcggaagccuuauaggguuaacagcgagggcaacgugggcgacaaacauacagguagcgauaaaccagguucguagacuaauugggaaugaaaauuaucuugauuauaugacaucaaugaaacguuuuaaaaaugaauccgauccugagggagcuuuaugguaa

SEQ ID NO: 21974 - RNA, 9879 nt, Artificial Sequence
  derived and/or modified CDS sequence (opt6) from DENV-1__KP188541__SS-prME
agcguaacaaugcuucucaugcuuuugccgacugcauuagcuuuucacuuaacaacuagaggaggagaaccccauaugauagucuccaaacaagaaaggggaaaaucacugcuuuuuaaaaccagcgccgggguuaauaugugcacacuaauagcaauggaccuaggagaauuaugugaagacacaaugacauauaaaugccccagaauuacagaagcagaaccagaugacguggauuguugguguaaugcgacggauacguggguuacauauggaacuuguucccaaaccggagaacacagaagggagaaaagaaguguagcgcuagccccucacguaggccuaggauuagaaacgaggacagaaacguggaugucaagcgaaggagcauggaaacaaauucaacgggucgaaacaugggcguuaagacacccaggguuuaccguaauugcguucuuucuagcacaugcuaucggcacgagcauaacacaaaaagggauuauuuuuauccuucucaugcuagucacuccaucgauggcaaugcgcugcguuggcauuggaaacagagauuucguagagggguuaagcggugcuacaugggucgacguuguacuugaacauggaucgugcguuaccaccauggcuaaaaacaaaccaacucuggauauagaauuacuuaaaacagaagucacuaauccagcaguauuaaggaaauuaugcauagaggcaaaaauaagcaauacuacaacggacagccgguguccgacucaaggagaggcaacuuugguagaagaacaagaugcaaauuuugucugcagaagaaccuucgucgaucgaggauggggcaacgguuguggacuguuuggcaaagguucucuacuuacgugcgcaaaauucaaaugcgucacaaaguuagaaggcaaaauaguacaauaugagaaucuaaaauacaguguuaucgugacaguccauaccggggaccaacaccagguggggaaugaaacgacggagcacggaacuauugcuacaauaacaccacaagccccaacaagugaaauccaauugacagauuacggcgccuuaacauuagauuguucuccaagaaccggucuggauuucaacgaaaugguucuucugaccaugaaagagaaaucuuggcuuguccauaaacaaugguucuuagaucucccucucccguggacaaguggggcgaguacgucucaagaaaccuggaaccggcaggaucugcuaguaacauuuaagacugcacaugccaagaaacaagaagucgugguucuggguucacaagaaggugcaaugcauaccgcacuaaccggagcuaccgaaauacagaccaguggaaccaccaccauauucgccggucacuuaaaauguagauuaaaaauggacaaacuaacacuaaaaggaaugucauauguaaugugcacgggcagcuucaaauuagaaaaagaaguagcagaaacacaacacggaacgguauugguucaaguuaaauaugaaggaacugacgcaccuuguaaaauaccauuuucgacacaagaugaaaaaggagugacgcagaauggccgacuuauuacggcuaacccuauuguuacggauaaagaaaagcccguuaauaucgaaacagaaccgccauuuggggaaagcuacauuguugucggggcgggugagaaagcgcugaaguuaucaugguuuaagaggggauccagcauaggaaaaauguuugaagcaacagcuagaggggcacggaggauggcaauccuuggagacacagccugggacuuugggucuauaggagggguauuuacaagcgucgguaagcuaguacaucaggucuucggcaccgcguacgggguuuuauuuucaggaguuucuuggacgaugaagauaggaaucgguaucuuacugacauggcugggucuuaauagccgcucuacaucauuaaguaugacauguauagcuguagggauggugacuuuguaucucggaguuaugguacaagcugacucugguugcguaauaaauuggaagggacgcgaauuaaaauguggaucaggcauauucguuaccaaugaagugcacacauggacagaacaguacaaauuucaagccgauagcccaaagagguuaagcgcagcuaucggaaaagcaugggaggaagguguaugcggaauuagauccgcaacaagauuggaaaauauuauguggaaacaaauuuccaacgaacuaaaucauauucuacuugaaaacgauaugaaguuuacaguuguagucggagacgccaacggaauauuagcacagggcaagaaaaugauccgcccacaaccgauggaacauaaauauucuuggaaaagcuggggaaaagcaaaaauaauaggugcagacauucaaaacacaacuuucauaauugacgguccagacacgcccgaaugcccagacggccaacgagccuggaauauaugggaaguugaagauuauggauucggaguauucacaacaaacaucuggcuuaaauugagggauucauauacucaaaugugugaucacagguuaauguccgcugcaaucaaagacagcaaagccguacacgcugacauggguuauuggaucgaaucagagaaaaaugaaacauggaaauuagcacgugcaucauuuauugagguuaaaacuuguacuuggcccaaaagucacacacuauggucuaaugguguauuagaauccgagaugauuauuccaaaaauauucggaggaccgauuucucagcacaauuauagaccaggcuauuuuacacaaacagcugggccauggcaccuugguaaacuagaauuagauuuugacuuaugugaagguacgacuguagucguagaugaacacugcgguaaucgcgggccaucacuacggacgacaacuguaacgggaaaaaucauacaugaauggugcugccgaagcuguacgcuucccccauugcgauuccgaggggaagacggauguugguauggcauggaaauccggcccgucaaggaaaaagaagagaauuugguuagaagcauggucagcgcaggcucaggggaagucgauaguuuuagucuagguauacuauguguaagcaucaugaucgaagaaguuaugcggucaagauggagccggaaaauguuaaugacaggaacgcuagcggucuuuuuacuucuaauaaugggacaacugacuuggaaugacuuaauaagauuauguauaaugguaggcgcuaaugccagugacagaaugggaauggguacuacauaucuggcucuaauggcuaccuucaaaaugagaccuauguuugccgucggccuucucuuccgucguuugacuucuagagaagugcuguuauugacuaucggccuuagucucguggcuagcguugaacucccaaauucgcuagaagaguuaggagauggucuagcaaugggaauaaugaugcuaaaauuauuaaccgaauuucaaccccaccaacuuuggacgacucuauuaagucucacuuucgucaaaaccacgcucucauuagacuaugcauggaaaacuacggccaugguccugucaauuguaagccuuuucccucuauguuuaucaacuacgucccaaaagaccaccugguuaccaguacuccuaggaaguuuuggguguaaaccauuaacgauguucuuuauaacggaaaauaagauuuggggaagaaaaucuuggccauuaaaugagggaauuauggcaauagggauagugucuauacuauuauccuccuuguuaaagaaugacguaccguuggccggaccauugauagcaggagggauguuaauugcauguuauguuauaucuggcuccucagccgaucuuucguuagagaaagcagcagaggugucaugggaacaagaagcagaacauaguggugcuucccauaauauccuaguugaaguccaggacgaugguacuaugaagauaaaagacgaggaaagagaugacacuuuaacgaucuuacugaaggcaacacuacuagcuguaucugggguguacccaaugucuauaccagcgacguuguuuguuugguacuuuuggcagaagaagaaacaacguucagggguguugugggauacaccgucaccaccagaaguugaacgagcuguucuugaugaugguaucuacaggauuuugcaacguggauugcuuggucgcagucagguaggaguuggagucuuccaagauggaguguuucauacuauguggcacgugacuagaggugcaguacuuauguaucaaggaaagagacuagaaccaucuugggcuucuguaaagaaagaucuaauuucuuacggugguggcuggcgguuccaagggucuuggaacacaggagaggaaguacaagucauagcaguagaacccgggaaaaacccuaagaacguccaaacgacaccaggaacuuucaagacaccggaaggggagguaggagccauagcccuagacuuuaaaccagggaccucuggaagucccaucguuaauagagaaggcaagauaguuggauuauaugggaauggagucguaacaacaagugggacauaugucucagcuauagcccaagcgaaagcuagucaagaagguccucuuccugaaaucgagaaugaaguuuuuaagaaaagaaauuuaacaauaauggaccuucauccugggagugguaagacaagacgguacuugccagccauaguucgagaagcaauuaagcguaagcucagaacauuaauucucgcucccacacgaguaguggccuccgagauggccgaagcgcuuaaggguaugccuaucagguaccaaacuacagcuguaaagucagagcauacuggaagagaaauuguugauuugaugugccaugcaacauucacaaugcgccuucucucccccguuagaguuccaaacuacaacaugauaaucauggacgaagcccacuuuacugauccggccaguaucgcagcuaggggauacauauccacucggguggggaugggagaagcugcagcuauuuucaugacagccacuccucccggaucuguagaagcguuuccucaaucaaaugcaguaauucaagaugaagaaagagauauaccugagagaucauggaacucggguuacgauuggaucacugacuucccggguaaaacuguuugguucguaccgucaaucaaaucagguaacgauauagcaaauugccugaggaaaaaugguaaaagagugauucaauugucccgaaagaccuucgauacagaauaucagaaaacuaaaaauaaugauugggacuauguggucaccacugauauaucagagaugggagccaauuuucgagcagacagggucauagauccacgacgguguuuaaagcccguuauacuuaaagauggacccgaaagggucauacuugcaggaccuaugcccguaacuguggcgucagcagcacaacgucgugguaggaucggaagaaaucaaaacaaggaaggggaucaauacguuuauaugggucaaccguugaauaaugaugaagaucaugcucacuggacugaagcaaaaaugcuauuggauaauauaaacacaccagaggguauaauuccagcguuguucgaaccugagagggaaaaaucagcugcaaucgauggagaguaucggcucagaggagaagcaagaaagacguucgucgaauuaaugagacguggugacuuaccuguguggcucucuuauaaaguugcuagugaagguuuucaauauuccgauagaaggugguguuuugauggggaacgcaauaaccagguguuagaggaaaauauggaugucgaaaucuggacaaaagaaggagaaagaaagaaauuaagaccuagauggcuagaugcaagaacauauagcgauccccuagcucuacgagaguuuaaagaauuugcugcggguagacguucaguaucuggugauuugauucuggagauaggcaaauuaccgcaacacuuaacuuuaagagcucaaaacgcacuagauaaccuaguaauguuacauaauagcgaacaaggugguaaagcauaccggcacgcgguagaagaauuacccgacacgauugaaacauugauguuauuagcauugauagcagugcuaacagguggagugacuuuauucuuucucagugggaaaggcuuaggcaaaacgucaauaggucugcucuguguuacggccuccucagcccuacuauggauggccucuguagaaccacauuggauagccgcaagcauaaucuuagaguucuuccuuaugguguuguuaauaccggagccagauagacagcggacuccacaggauaaucaauuagcguauguugucauaggauuguuguuuaugaucuuaacaguggccgcaaacgaaaugggccucuuagaaacgacuaaaaaggauuuaggaauaggguacguagcugccgaaaaucaucaacaugcuaccaugcuagauguugaccuucaccccgccagugcuuggacccucuaugcaguagcaacaacggucauaacgccuaugaugagacauacaauagagaacacgaccgcaaauauaucccugacagcuauagcaaaccaagcagcaauacucaugggacuugauaaaggauggccaaucaguaagauggacauaggcgucccacuuuuagcacuuggcuguuacucgcaagucaauccuuuaacacuuaccgcugcaguauuaauguuaguugcacauuaugcuauuauuggcccugggcuccaagcgaaagcuaccagagaagcucagaaaagaaccgcugcuggaauaaugaaaaacccuaccguagacgguauuguagccauugacuuagacccaguaguuuacgaugcaaaguuugaaaaacaacucgggcaaauuaugcuguuaauuuuaugcaccucgcaaauucuauuaaugagaaccacuugggcucuaugugaaucaaucacacuagcgaccggcccauuaacaacgcucugggaaggcucaccaggaaaauucuggaauacuacgauugcugucucuauggcaaauauauuucgagguaguuacuuagcuggagcaggauuggcuuucagucugaugaaaucucucggaggaggacgacgagguacuggugcacaaggggaaacauuaggagaaaaguggaagcgccaauugaaccaacuaagcaaaucagaguucaacacauauaaaagaagcgguaucauggaaguagauaggagugaggcuaaagaaggguuaaagcgaggagaaacgaccaaacaugcggucucccgcgguaccgcaaaacuaagaugguucguagaacgaaauuuagugaagccggaagguaagguuauugacuuggguugcggccgcgggggauggagcuacuacugugcuggacuaaagaaagucacagagguuaaaggguacacuaaaggcggaccaggacacgaggaacccauaccgauggcaacauacgguuggaaccuaguuaaauuacauuccgguaaagacguauuuuucaugccacccgaaaagugugacacacucuugugugacauaggggaaucuuccccaaacccaacgauugaagaggggaggacauugagaguucucaaaaugguugaaccuugguuaagagggaaucaguuuuguauuaagauucucaacccuuacaugccaagcguuguagaaacacuugagcaaaugcagaggaagcacggagggaugcuaguacgaaauccacuaucccgcaauagcacacacgaaauguauuggguuaguuguggcacuggcaauauagucucagcggugaauaugacuuccaggauguuauuaaauagauuuacaauggcucauagaaaaccuaccuaugaaagagauguagacuuaggagccggaacaaggcauguagcuguagagccugagguagcuaauuuagauauaauuggccagagaaucgaaaauauuaagaaugaacauaaaagcacuuggcauuaugacgaagauaauccguacaagacuugggcauaccauggaagcuacgaaguuaagcccuccggcucagcuaguucaaugguaaaugguguggugcgauuauugaccaaaccgugggacguuauaccgauggucacgcaaauagcaaugacagacacaacaccuuucgggcaacaacgaguguuuaaagaaaaaguagacacccgaaccccgagagcgaaacgcggaacaacucaaauuauggaaguaacugcuaaauggcuauggggcuuccucaguagaaauaagaaaccccgaauaugcacaagggaagaauuuaccaggaagguaagguccaacgcugcuauaggggcggucuuuguagaugaaaaucaauggaacuccgcaaaagaggcaguggaagacgagagauuuugggacuugguucaucgugaaagagagcuucauaagcaggguaaaugugcaacauguguuuauaauaugauggguaaaagagaaaagaaauuaggagaauuuggaaaagccaaaggaagucgggcuaucugguacaugugguugggcgcaagguuuuuggaguucgaagcguuaggauuuaugaaugaagaccauugguuuucccgggaaaauucacuuuccggaguggaaggggaaggauugcauaaacugggauauauacuucgggacauuucaaaaaucccuggagguaacauguacgccgaugauacagcaggaugggauacuagaauaacagaagacgauuuacaaaaugaggcuaaaauaaccgauauaauggaaccagaacaugcuuuacuagcuacaucgauauucaaacuaacuuaucagaacaaagugguuaggguacagagaccagcgaaaaauggaacaguaauggacguaauuucacgcagagaucaaaggggcuccggccaagucggaacguacggucugaauacguuuacuaauauggaggugcaauuaaucagacaaauggaauccgagggaauauuuuuaccuagugaacuggaaacaccuaaucuggcugaacgugcguuagacugguuagaaaaacauggugccgaacggcuaaagcguauggcgauauccggagacgauugugugguuaaaccuaucgaugacagguuugcgacagcccucaccgcacuaaacgacauggguaagguucgcaaagauauuccacaaugggagccuaguaaggguuggaaugacuggcaacaggugccauuuugcucucaccacuuccaucaauuaauaaugaaggauggaagggaaaucgugguccccugcagaaaucaagaugaacucguugguagagcacgagucagucagggagcugguuggucguugagagaaacagcauguuuagggaaaagcuaugcucaaauguggcaacuaauguacuuucaucgccgggaucuacgguuagcggcaaaugcgaucuguucagcuguacccguggauugggucccggccucccgaacaaccuggaguauacaugcucaccaccaauggaugacaacagaagauaugcugaguguauggaauagaguuuggauagaggaaaauccguggauggaagauaaaacgcaugugucaucuugggaggaaguccccuaccuugguaaacgcgaggaccaaugguguggaucguuaauugguuugacagcaagagcaacaugggcgacuaauauucaaguagcaauuaaucaaguccgucgacuaaucggaaaugagaacuaucuugauuauaugacaaguaugaaacgguuuaagaacgaaucagacccugaaggagccuugugguaa

SEQ ID NO: 21975 - RNA, 9879 nt, Artificial Sequence
  derived and/or modified CDS sequence (opt6) from DENV-1__KP188543__SS-prME
uccguuaccauguuguugaugcuccuaccuacagcacuagcauuucaucuaacaacacgaggaggugaaccucauaugauaguuucaaaacaagaaagaggaaaaucuuuauuauuuaaaacuucagucggagucaauauguguaccuugauagcuauggaucuaggcgaguuaugugaagacaccaugacauauaaaugccccagaauaacagaaguugaaccagacgauguagauugcugguguaaugcaacagauacguggguuaccuacggcacauguucucaaacaggugaacauagaagagacaaaagaucagucgcauuagcaccgcacguuggacugggcuuggaaacgcgcacagaaacauggauguccagugaaggggcguggaaacaaauccaaaaaguagaaacaugggcuuugagacacccgggcuucacggugaucgcauuauuuuuagcccaugcaauaggaacauccauaacucaaaaagggaucauauucauauuauuaauguuaguaaccccuucaauggcaaugcgcugcguaggcauugggaauagggacuuuguggaaggccuuucuggagcaacuuggguugaugucguauuagagcauggauccuguguuaccacuauggccaaaaauaaaccaacgcuggauauugaguuguuaaaaacagaagucacuaacccagcaguccuaaggaaacuaugcauugaagcgaaaauaucaaacacaacuacagauaguagauguccaacccaaggggaggcaacuuugguggaagaacaagaugcaaacuuugugugucgucguacuuuuguagaucgaggcuggggaaacgggugcggacuauucgguaaagggucuuugcuuaccugcgccaaguuuaagugcguaaccaaauuggaaggaaagauuguacaauaugaaaauuuaaaguauagugugauuguaaccguacauacaggugaccaacaucaagucgguaaugagaccacugaacaugguacuauugccacuauaacaccucaagcuccuacuagcgaaauucagcuaaccgacuauggagcccuuacauuagauuguucuccgagaaccggauuagacuuuaacgaaaugguguuauuaacuaugaaagagaaaagcugguugguccauaaacagugguuccuggauuuaccuuuaccauggacgagcggagcaucgacuucgcaagagacuuggaacagacaagaucuuuuagucaccuucaagacugcccaugccaagaaacaagaagucguuguauuagggucgcaagaaggagcgaugcacacggcgcuuacgggagcaaccgaaauccaaacgucagguacaacaacuauauuugcagggcaccugaagugccgacuaaaaauggauaaauugacucuaaaaggaaugagcuacguaauguguacugggucuuuuaaacuugaaaaggaaguugccgagacccaacacgguacgguuuuaguucaagugaaauaugaaggaacagaugccccuuguaaaauaccauuuuugacacaagacgagaaaggagugacgcagaauggaagguuaauaacagcgaauccaauagucacagauaaggaaaaacccguuaacaucgaaacagaaccgcccuuuggagaaaguuacauuguaguaggagcuggugagaaagcacuaaaacucucaugguucaagaaaggcuccagcauaggaaagauguucgaagccacggccagaggugcacgcagaauggcaauacuaggggauacugcaugggauuuuggaucaauagguggauuguucacguccgugggcaaacuaauacaucaggucuucgggacggcauacgguguuuuauuuagcggaguaucguggaccaugaagaucgguauaggcauauuacucacuugguuaggacuaaauagucgaaguacaucucugaguaugacaugcauagcugucggaaugguaacacuauauuuaggaguuaugguacaagccgacucuggauguguuauaaacuggaaaggcagggaacuaaaaugugggucuggaaucuuuguaaccaaugaggugcacaccuggacagaacaguacaaauuucaggcagacuccccaaaaagauuaucagcggcaauaggcaaggcaugggaagaagguguaugugguauaagaagugcaacaagacuagagaacauaauguggaaacagauaucuaacgaacuaaauuauauacuucucgaaaaugacaugaaguuuacagucguagugggcgauguaaacgggauacuggcucaaggaaagaaaaugauaagaccucaaccuauggaacacaaauauaguuggaaaucauggggaaaagcaaaaaucauuggggcugacauucaaaauacaacauucauuaucgaugguccugacacacccgagugcccagacgaucaacgagcuuggaacauaugggaaguagaagacuauggauuuggaauuuuuacuacaaauaucuggcuaaaacucagagacucgcacacccaaaugugugaucaccgccugaugagugcagcaauuaaggauucaaaagcagugcacgcugauauggguuauuggauugaaagcgaaaagaaugaaacguggaaauuggcgagagcaucauucauagaaguuaaaacaugcauuuggcccaagucccauacccuuuggucaaauggaguguuggagagugaaaugguaauucccaaaauauauggcggcccuauaucacagcauaauuauagaccuggauauuuuacacaaaccgcagguccauggcacuuaggaaaauuggaacuagacuuugacuugugugaagggacaacuguaguaguugaugagcacuguggauauagaggaccuaguuugaggaccacaacaguaacugggaagauaauccaugaauggugcuguaggucaugcacuuugccuccguuacgauuuaggggugaagacggcuguugguacggaauggaaauccgacccguaaaggaaaaagaagagaacuuaguacgcucuauggucucggcaggcucaggcgagauggauaguuuuucccuagguauucuuugugugucgauuuugauugaagaaguuaugagaucacgauggagucguaaaaugcuaaugacggguacacuagcuguguuccuuuuacuuaucaugggacaguuaacauggaaugacuugauaagacuaugcauaaugguuggugcuaaugccucggauaggaugggaauggggacaaccuaccucgcgcucauggcuaccuucaagaugcggccaauguuugcaguaggacuauuauuuagaagacuaacauccagagaagucuuauuauuaacagugggucuuagcuuggucgcaucaguagaacuccccaacagucuagaagaauugggcgauggccuugcaaugggaauaaugauguuaaaguugcuaacagauuuucaaccccaucaacuauggacaacauuauuaucauuaaccuuuauuagaaccaguuugucgcuugacuacgccuggaaaacaauggcaauggcccuaucaauagucucgcucuuuccguuaugucuuucuacaacuucgcagaaaacaacuugguuaccaguucuacugggaucuuuuggauguaagccauuaacaauguucuuaauuaccgagaauaaaauuugggggagaaagaguuggccaauaaaugagggaaucauggcuguuggaauuguuaguauacucuuaucaucauuacuuaagaacgacguaccauuggccggacccuuaauugccgguggaaugcucauagcuuguuacguaaucuccgguucgagcgccgaucuaaguuuagaaaaagcagcugaagucucaugggaggaagaagcagaacacuccggaacgucgcauaauaucuuaguugaaguucaagacgacgggacgaugaaaauaaaggaugaagagagagaugauacacuaacaauccucuuaaaagcuaccuuacuugcugucucuggaguuuacccuaugucaauaccagccacauuguuuguuugguauuucuggcagaagaagaaacaacguaguggaguacugugggacacaccaaguccaccagaaguagaaagagccguuuuggaugacggaauauauagaauacuccaaaggggcuuauugggucgcucgcaaguaggggucggaguauuccaagauggcguauuucauacaauguggcaugucacacgaggagcaguccuaauguaucagggaaagagauuagagcccucuugggccagcgugaagaaagacuuaauaucguacggaggagguuggagauuucaaggcucuuggaauacaggugaagaaguacaaguaauugcugucgagcccggcaaaaauccuaaaaacguacaaacuacuccagggaccuuuaagacaccagaaggcgagguuggagccauagcgcuagauuucaaaccaggcacuucaggaucaccaauagucaacagggaaggaaagauuguugguuuguacgguaaugguguaguaacaacaagcgguacguauguaucugcgauugcucaagcaaaagcuacucaagaaggaccucucccugaaauagaggaugaaguauucaaaaagaggaauuuaacuaucauggauuuacauccagguagcgguaaaacaagacguuaucuuccggccauaguuagagaagcaauaaaaagaaaacucaggacguugauauuagcgccuacacgaguaguagcuucagaaauggcagaggccuuaaaaggcaugccuauaagauaccagacaacagcugucaagagcgagcauacagggcgagagauaguagaccuaaugugucaugcgacuuucacaaugagacuacugucaccuguaaggguacccaacuacaauaugauaauuauggacgaagcccauuuuacugacccagcgagcauugcggcgcgagguuauauaucaacaaggguggguaugggagaagccgcggccauauuuaugacagcaacaccaccuggcucaguagaagcguuuccgcaaucuaaugcagugauacaagacgaagagagggauauaccagagcgaucuuggaauagugguuaugauuggauuacugauuuuccaggcaaaacaguaugguucguucccuccaucaaaaguggaaaugauauagccaacugccuuaggaaaaaugguaaaagaguuauacaacuaaguagaaaaacuuucgacacagaauaucaaaagaccaaaaauaaugacugggauuauguugugacaacagauauuucagaaaugggugcaaauuucagagcagacagagucauugauccaagaagauguuuaaaaccagucauacuaaaagagggaccagaaagaguaauauuagcggguccgaugccaguuacuguggcaagcgccgcacagagaagagggagaauuggacgaaaccaaaacaaagaaggcgaccaauacaucuacaugggucaacccuuaaauaacgacgaagaucacgcgcauuggacugaggcuaagaugcuguuagauaauauuaauacaccugaagguauaauuccagccuuauuugagccagaaagagagaaaucagcugcaauugacggagaauaccgacuacggggagaagcuagaaagaccuucgucgagcuuaugcggaggggagaccucccgguauggcuaucguauaaaguagcaagugaggguuuucaguauuccgaccgaagguggugcuuugacggcgagcgaaauaaccaggucuuagaggaaaacauggaugucgagauauggacaaaggagggagaaagaaagaaauugagaccaagauggcuugaugcaaggacauauucugauccgcuugcguuacgggaauuuaaagaauuugcagcuggaagacguucuguaucaggagaccugauauuggagauagguaaacuaccucaacaccuaacgcucagggcacaaaacgcccuagauaaucuugucaugcuacauaauucugaacaagggggaaaagcguacagacacgcuauggaagaauuaccagacacgauagaaacguuaaugcuccucgcccuaauagcuguuuugacugguggaguaacccuguucuuucuaucuggaaaggguuuagguaagacuuccauaggucuauugugugugauggcgaguagugcucucuuauggauggcgucuguugaaccacauuggauagcagcuagcaucauucuggaguucuuuuugaugguucuauuaauaccagaaccggacaggcaacgaacgccacaggacaaccaauuggcuuauguuguaauagguuugcuguuuaugauucuuaccguagcugcgaacgaaaugggguuacuugaaacgacaaagaaagaucuuggaauagggcacguagcaguagaaaaccaccaucacgcaacuauguuagacguggauuugagacccgcgucagccuggacacuguacgccguugccacaaccguuauuaccccaaugaugcgacauacaauugaaaauacaacggcaaacauuagcuuaacugcuauagcuaaccaagcagcaauccuaaugggcuuggacaaagguuggccaauaucuaagauggacauugguguuccauuacuggcacuagguugcuauucccaaguaaauccucuuacauuaacagcugcuguccugaugcuuguggcucauuaugcaauuauaggaccuggcuuacaggcaaaagccacgcgagaagcacagaaaagaacagcggcuggaauuaugaaaaauccgaccguagacggaauaguuacaauugauuuagaccccguaguguacgaugcgaaauucgaaaaacaauuggggcaaauuauguuacuuauauuauguaccucucaaauccuacucaugagaacaaccugggcguuaugcgaaucuauaacucuugcaacugggccacucacaacgcucugggagggauccccagggaaauuuuggaacacaacuauagcaguaagcauggcaaacauauucagaggcucauaucuugcaggagcaggacucgcguuuucgcuuaugaaaaguuuaggcggaggacggagagguacuggggcucaaggggagacauugggcgaaaaguggaaaaggcaauuaaaccaauuguccaaaagugaguuuaauacauauaagaaauccggcauaauggaagucgacagaucugaggcaaaggaaggauuaaaacgaggugaaacaacaaaacaugcgguaucgagaggaacugccaaauugcguugguucguagaaaggaaucuggucaaaccagaaggaaaagugguggacuugggauguggaagagguggguggucauauuauugugcaggacuaaagaaaguuacugaaguaaaaggguacaccaaagguggaccaggacaugaagaaccuauuccuauggcaacguauggauggaaccuagugaaacuacauagugggaaagacguauucuuuacgccgccagagaagugcgauacccuuuuaugcgacauaggggagucuuccccuaauccgacaauagaagagggucgaacguugcgugugcuuaagaugguugagccguggcugcgaggcaaccaauucugcauaaagaucuugaacccguacaugccuagcguagucgaaacucuagaacaaaugcaacguaaacauggaggaauguuaguaaggaauccacuuagcaggaauagcacccaugaaauguacuggguaucuuguggaacagggaauauaguaagcgcagugaauaugacaucacguauguuacuaaauagauuuacgauggcgcaucgaaaaccuacguaugaaagggauguggauuugggcgcaggaacccgucacguugcaguugagccggaaguugcaaauuuggauaucauagggcaacguauagagaacaucaaaaaugaacacaaaucaaccuggcacuacgacgaggauaacccuuacaagacaugggcguaucacgguucuuaugaagucaaaccuagcgguuccgccaguucaauggugaauggagucguuagguuauugacuaaaccaugggauguaauacccaugguaacacagauagccaugacugauacuaccccuuuuggucaacaaagagucuuuaaagaaaaaguagacacacgaacaccaagagcaaaacguggaaccgcacaaaucauggaaguaaccgcuaaauggcugugggguuuccuuaguaggaacaaaaagcccagaauauguacaagagaggaguucaccagaaaaguuaggucuaaugcugcaauaggagcgguguucguugaugaaaaccaauggaacucggcuaaagaagcgguugaagaugaaagauuuugggacuuaguucacagggagagggaguugcauaaacaaggaaaaugugcuaccuguguauacaauaugaugggaaaacgugagaagaaauuaggugaauuuggcaaagcuaaaggauccagagcgauuugguauaugugguuaggggcgcgauuuuuagaauuugaggcguugggauucaugaaugaagaccauugguuuaguagggaaaacucacuuucagguguagaaggugaggguuuacauaaacuaggauauauccuacgugacauuagcaaaauaccaggagguaacauguacgccgaugacacugcugggugggauacucguaucacagaagaugauuuacaaaaugaagcaaaaauaacugauauuauggaaccagaacaugcguuauuagcuacaaguauuuucaaauuaacauaucaaaauaagguuguacguguccaaagaccagcaaaaucaggaacagucauggacguaauuagcagacgggaucaacgcggaaguggucagguugguacauacgggcugaauacauucacgaacauggaaguacaguuaauuagacagauggaaucagaaggaaucuuuaguccaagugaacuagaaacuccgaaucuugccaagaaaguucuggauuggcucgaaaaacacggagcggaacggcuaaaacggauggcaauaaguggggaugacugugugguaaaaccaauugacgacagauucgcuaccgcucucacugcauugaacgauauggggaaaguucgaaaagacauaccucagugggaacccucaaaaggguggaacgauuggcaacaaguuccauucuguucacaucauuuucaccagcuuauaaugaaggauggcagggagauagugguuccguguaggaaccaggaugaguugguaggcagagcacgaguaucacaaggagcagguuggucguuaagagaaacagcaugccuagguaaaucauacgcccaaauguggcaacuaauguacuuccaucggagggauuuacgucuagcggcgaaugcuauauguucugcgguaccuguagacuggguaccgacaucgagaacaacguggucaauccaugcacaucaccaauggaugacgacggaagauaugcuaucuguauggaaccgugucuggauugaagaaaaucccuggauggaaaauaaaacgcacguaucgaguugggaagaaguucccuauuuaggcaaaagggaagaccaauggugcggaucucuaauaggacuuacagccagagcaacaugggcaacuaacauucagguagcuaucaaucaagucaggagacuuauugguaaugaaaauuauuuggacuauaugaccucaaugaagcguuucaaaaaugagucagacccagaaggcgccuugugguga

SEQ ID NO: 21976 - RNA, 9879 nt, Artificial Sequence
  derived and/or modified CDS sequence (opt6) from DENV-1__KP188544__SS-prME
ucagugacaaugcuacuuaugcuuuuaccuacagcauuagcauuccacuuaacuacaaggggaggagaaccacauaugauagugaguaaacaagaaagaggaaaaaguuuauuauuuaaaacgagugugggaguaaauaugugcacucuuauagcaauggaccuaggcgaauuaugcgaagauacuaugaccuauaaauguccacguauuacugaggcagaaccagaugacgucgacugcugguguaaugcaacagacacuuggguuacauacgguacauguagucaaacaggugaacauagaagagauaaacgaucaguugcguuagcuccacacguaggucucggauuagaaacaaggacagaaacauggaugucaagugaaggcgcauggaaacaaauacaaaaaguggaaacuugggcauuacgucauccgggauuuacagucauugcacucuuucuagcacaugcuauagguacaucaauaacucaaaaaggaauaauauuuauccuucuaaugcuuguaacaccaagcauggcgaugagaugugucgguaucggaaaucgugauuucgucgaaggcuuaaguggagcaaccuggguggacguggucuuagaacaugggucuugugucacaacgauggcuaaaaauaaaccuacacucgauaucgaacuacuaaaaacagaagugacaaauccggcuguguugcgaaaacuuuguauugaggcaaaaaucucuaauacuacaacagauagcagauguccaacacaaggugaggcaacccugguagaagaacaagaugccaacuuuguuugcaggcgcacauuuguugacaggggauggggaaauggauguggucuauuuggaaaaggcucacuucuaacgugcgcgaaauuuaagugcguaacuaaguuagaaggaaagauuguccaauaugagaaucuuaaguauucuguuauaguaacaguacacaccggagaccaacaccaagucggcaaugaaacaacagaacauggaacuaucgcgacaauuacuccucaagccccuaccuccgagauacaacuaacugacuauggagcucuuacauuggacuguucuccgagaacgggucucgauuucaacgagaugguacuacuuacaaugaaagagaaaucgugguuaguccauaagcaaugguuuuuagauuuaccacuacccuggaccaguggcgccucaacaucgcaagagacauggaacagacaagaucuauugguaacuuucaaaacugcacaugcgaaaaagcaagaagugguaguacuaggaucucaagaaggggcaaugcauacagcgcuaacaggugcuacagaaauacaaacuucuggaacaacaacaauuuuugcgggacaccuuaaaugcaggcuaaaaauggauaaauuaacauuaaaagggaugucauauguaauguguacaggaucguucaaauuagagaaagaaguggccgaaacacaacacgguacuguucuaguccaaguaaaauacgagggaacagacgcacccugcaaaauaccguucuuaacgcaagaugaaaagggugugacacaaaauggucguuugauuacugcgaacccaauaguaacagauaaggaaaaaccaguaaacauagaaaccgaaccaccauuuggugaaaguuauauaguuguaggagcgggagaaaaagccuuaaaacugucaugguuuaaaaagggaagcucuauuggaaaaauguuugaagccacagcgcgaggugcucggcguauggcuauauuaggggauacagcaugggauuuugggucuauaggagggcuauuuacaucuguaggaaaacuaauacaucaaguauucgguacagcguauggcguacuauuuuccggugugagcuggaccaugaaaauaggaauugguauauugcuaacuuggcuggggcucaacagcaggucaacgucgcuuucaaugacuuguauugcggucgggaugguuacauuguaccuaggcgugaugguccaagcggauagcgguugcguaauaaacuggaaaggaagagaauuaaaaugugggucuggaauauuuguaaccaacgaaguacauacauggacagagcaauauaaauuucaagccgauaguccgaagcgucuaucugccgcaauagguaaggcaugggaagagggagucugugguauuagauccgcgaccagauuagaaaacauuauguggaaacaaaucucuaaugaguuaaauuauauauuacuugaaaaugauaugaaauuuaccguuguggucggagaugucaacgguauauuagcucaagggaagaaaaugauaagaccucaacccauggaacauaaauauucauggaaaucauggggaaaggcaaaaauaaucggugcggauauucaaaauacaacauucauaauagauggaccugauaccccagagugcccggaugaccagagagcauggaauaucugggaagucgaggauuauggauucggcaucuuuacgacuaacauaugguugaaguuaagggacagucacacgcaaaugugcgaucacagguuaaugucugcggcgauaaaggacucuaaagcgguucaugcagacauggguuauuggauagaaagcgagaaaaaugagacauggaaacuagcaagggcuucauuuauagaaguuaaaacguguauauggcccaaaucacacacgcuauggagcaaugguguacuugaaucagaaaugguuauaccuaaaauauauggggguccaauuucacaacauaauuaucggccaggguacuucacucaaacagcuggaccauggcaucucgguaaauuggaauuagacuucgaucuaugcgaaggaaccacagucgugguugacgaacauuguggguacagagguccuaguuugagaacaacaacugucacugggaaaauaauucacgaauggugcugucgaucuuguacguuaccaccauuaagauuccgaggagaagacggcugcugguaugguauggaaauucguccuguaaaagaaaaagaagaaaaccucgugagaucaauggucuccgcaggcuccggcgaaguagacagcuuuucacucgguauacucugcguauccauacuuauugaagaaguuaugcgaucucgcuggagcaggaaaaugcucaugacugguacgcuugcuguguucuuauuacuaauaaugggucaguuaacuuggaaugauuuaauacgccuuugcauuaugguaggugcuaaugcuucugauagaaugggcaugggaacuaccuacuuagcguuaauggcuacuuuuaaaaugcggccuauguuugcgguagguuuacuauucagaagacugaccugucgagaagugcuccucuugacaguugguuugagucuuguggcgucagucgaacuuccuaauagucuggaagaacuaggggacggacucgcaaugggaaucaugaugcuaaaacuucucacugauuuccaaccacaccagcucuggacaacacuucuuagccucacuuucauaagaacuucacuuucacuugauuaugcguggaagaccauggccauggcccucaguaucgucagccuauucccauugugccugucaacaacgagccagaaaacuaccugguuacccguguuacuagguucauuuggauguaaaccuuuaacaauguuuuuaauuacugaaaacaagauauggggacgaaaaucauggccuauaaacgaagggauuauggcaguaggcauaguaucgauucuucucucaucccuacugaagaacgauguuccauuagcuggcccuuuaauagccggaggcauguuaauagcaugcuacgucauuucaggaucuuccgcagacuuaucacucgaaaaagcugcggaagugaguugggaagaagaagccgagcauucggggacuagccauaacauuuuaguagaaguacaagacgacggaacaaugaagaucaaagaugaagaaagagacgauacgcuuacuauccuacuaaaagcuaccuuauuggcaguguccgguguauauccaaugucuauuccugccacuuuauuugugugguauuuuuggcagaagaagaaacagagaagcggaguacuaugggauacuccaaguccacccgagguagagcgagcaguacucgaugauggcauauaucggauucuacagagaggauuacuaggacgcagccaaguuggugucggcguauuucaggauggaguauuccacacuauguggcauguaaccagaggugcaguauuaaugcaucaaggcaaaaggcuggaaccuagcugggcuagcgugaagaaagaucuuaucucuuaugggggcggauggcgauuucaaggcaguuggaauacuggagaagaaguccaaguaauagcugucgaaccagguaaaaacccuaaaaauguucaaaccaccccaggaacauucaaaacuccagaaggugagguuggagcuauugcucuagauuuuaaacccgguacgucagggaguccuauuguaaauagggaagguaaaauaguaggguuauaugguaacggaguugucaccacaucgggcacauauguuucggcuauugcccaggcuaaagcaacacaggaagguccgcucccagaaauugaagacgaaguguucaagaaacgaaaccugacuaucauggauuugcaucccgguagcgguaaaacuagaagauaccuucccgcaauagucagggaagccauuaaaagaaaauuacgcacauugauacucgcgcccacuagaguuguugcuucagaaauggcugaggcacucaaagguaugccuaucagauaucaaaccacagcugucaaaagugaacauaccggaagagagauaguugacuuaaugugccaugcaacauucacuaugagacuacuuucgccgguacguguuccaaacuauaacaugauaaucauggacgaagcgcacuuuacagauccagcaucaauugcagcaagaggguauauuagcacacgaguaggaaugggggaagcggcagcuauauuuaugacugcaacaccuccaggcucugucgaagcauuuccucagaguaaugccgucauacaagacgaagaaagagacauccccgagaggaguuggaacucaggauacgauuggauuacagauuucccugguaaaacggucugguuuguaccgaguauaaagagcgggaacgauauagcaaacugcuuaaggaaaaaugguaaaagagucauacagcucagcagaaagacauuugacacugaauaucagaaaacgaagaacaacgauugggacuacgucguuaccacggauauaagcgaaaugggugcgaacuuccgggcagaccguguaauagauccgagacgaugcuuaaaacccguaauauuaaaagaagggcccgaaaggguaauauuagcagguccaaugccaguuacaguagcauccgcagcucaaaggcgcggccgcauuggcagaaaucaaaacaaagaaggagaucaguauauauauaugggucaaccccuaaauaaugaugaagaucacgcacauuggaccgaagcgaagaugcuacuugacaauauaaauacccccgaggguauaauuccugcguuauucgagcccgagagagagaaaagcgcagcaauagauggggaauauagacuaagaggggaagcucgaaaaacguuuguagaacuuaugagaaggggagaccuuccaguaugguuauccuacaaaguugcauccgaggguuuucaauauucggacaggagguggugcuuugauggggaacgaaauaaucaaguacuagaagaaaacauggacgucgagauauggacaaaagaaggagagaggaaaaagcucagacccagaugguuagaugcuagaacuuacuccgauccucuagcacugagagaauuuaaagaguuugccgcuggccgaagaucagucucaggagaccucauuuuagagauagggaaauuaccacaacaucuaacccuacgagcacaaaacgcacucgacaaucuaguaauguuacauaacagugaacaaggaggcaaggcuuaccgacaugcaauggaagaauuaccagacacaaucgagacauuaaugcuauuagcgcuuauugcaguguugacaggaggagucacacuauuuuucuuaucggguaaaggucuaggaaaaacuucuauaggacucuuauguguaauggcuagcagugcauuauuauggauggcgaguguggaaccacauuggauagcggccucgauuauacucgaguucuuucucaugguucuguuaauaccagaaccggauagacaaagaaccccucaagacaaccaauuggcuuacguuguuauaggacuuuuauuuaugaucuugacaguagccgcuaaugaaaugggcuuacuagaaacaacaaagaaagaccuugguauaggacauguagccguggaaaaccaucaccacgcaacgaugcuugacguagaucuaaggccagcauccgccuggacguuauaugcugucgccacgacuguuauaaccccaaugaugcggcacacaauagaaaauaccacagcaaacauaagucuuacagcuauugcuaaccaggcugccauauugaugggcuuagauaaaggauggccaauaucgaaaauggauauugguguaccuuugcuagcgcuuggaugcuauucacaaguaaacccccugacauuaacagcggcgguauuaaugcuaguagcacacuacgcaauaauagggccaggacuacaggcaaaggccacacgagaggcccagaaaaggaccgcagccgguauaaugaaaaacccaacgguggacggaauagugacuauugauuuggacccaguaguauaugacgcaaaauuugagaagcaguuaggacaaauuauguuacugaucuugugcacaagccaaauacuacuaaugcggaccaccugggcauuaugugaaaguauaacucuggcuaccgguccgcucacuacuuuaugggaaggaucaccaggaaaauuuuggaauaccacuauagcugucaguauggccaacauauucaggggaagcuaucuugccggugcuggcuuagcauucaguuuaaugaagucacuagggggcggccggcgugguacgggggcgcaaggggaaacacuaggagaaaaauggaaacgacaauuaaaccaguugaguaagucagaauuuaauacuuacaaaaagaguggaauaauggaaguagaccgaucagaagcaaaagaaggacuuaaaagaggggaaacaacaaaacacgcggucucgagagggacagcgaaauuaagaugguucguagaaaggaauuugguuaaaccagagggaaaagugauugaccugggcugcggcagaggggguuggucauauuauugcgccggguuaaagaaagucacggaaguaaaaggcuacacaaaaggcggaccaggacacgaggaaccuaucccaauggccacuuauggguggaauuuagucaaacuccacaguggaaaagauguauucuuuacuccgccggaaaaaugcgacacacuauuaugugacauuggagagaguuccccgaacccuacuauugaagaaggccguacccucaggguacuaaaaaugguggagcccuggcucagagggaaccaauuuuguauaaaaauacuaaacccauauaugccgucaguagucgaaacguuggaacaaaugcaaaggaagcauggugggauguuggucagaaacccuuuguccagaaauaguacacacgaaauguacuggguaucaugcgguaccgguaauauugugagcgcagucaauaugacaucgcggaugcuucuaaaucguuucacgauggcacacagaaaacccaccuaugaacgagauguggacuugggugcggguacccgacauguggcagucgaaccagaaguagccaacuuagauauuauaggucaacgaaucgaaaacaucaaaaaugagcauaaaagcacuuggcaucaugacgaggacaauccauacaaaacaugggcauaucaugggagcuacgaagugaaacccagugguagugccaguucaauggucaauggaguagugcgacuucuaacuaagccaugggaugucauuccaaugguuacacagauagcaaugacugauacuacuccguuuggccaacagcgagucuucaaagaaaaaguggauacaagaacuccucgagcaaaaagggggacagcccaaauaauggaaguaacggcgaaguggcucugggguuuccuaucuagaaauaagaaaccuagaauauguacacgagaagaguuuaccaggaagguuagaucuaacgccgcuauaggugcaguauuuguagaugaaaaucaguggaacucagcaaaagaagcugucgaagaugaaagauuuugggauuuagugcauagggaaagggaacuacauaaacaggguaagugugcaacaugcguauacaacaugauggguaaaagagagaagaaauugggggaguucggaaaagcuaaaggaucuagggcaauaugguacauguggcuaggagcgagguuuuuagaguuugaagcucuuggcuucaugaacgaagaucauugguucucacgagaaaacagucuuagcggaguagaaggagaaggcuugcacaaauugggguacauccuuagggacauaucuaaaauaccgggaggaaauauguacgcagacgacacagcugguugggauacuagaauaacagaggaugauuuacaaaaugaagcgaaaaucacugauauaauggaaccagaacaugcauuacucgcgacuucuauauuuaaacucacauaucaaaacaaagugguaaggguccaaagacccgccaaaucuggaacaguaauggauguaauuucucguagagaucaaagaggaucuggucaggucgggacauauggccucaacacuuucacgaacauggaaguacaauuaauucgacagauggaaucugagggaauauuuaguccguccgaauuagaaacgcccaacuuagccaagaaagugcuagacuggcuugaaaaacauggagcagaaagauuaaaacguauggcuaucucuggugacgauugcguaguaaaaccuauugaugauagguuugcaaccgcuuuaacggcucuuaaugauaugggaaagguacguaaagauauaccacaaugggaaccaagcaaagguuggaacgacuggcagcaaguucccuuuuguagccaucauuuucaucaauuaauuaugaaagaugggagggaaauaguaguaccuugccguaaucaggacgaauuaguagggcgugcuagaguuucacaaggagccggguggucauuacgagaaacugcaugccucggaaagucauacgcgcaaauguggcaacugauguauuuccaucggagagauuuaagauuagcggcaaaugcaauauguuccgcaguaccuguggacugggucccuacaucacggacaacguggaguauccacgcacaccaucaguggaugaccacagaagacaugcugagcgucuggaaucgaguguggauugaagaaaacccguggauggaggauaaaacucaugucaguucuugggaggaagugccauauuuaggcaaaagagaagaccaguggugcggaucccuaauaggguugacagcaagggcaacuugggcaacaaacauacagguggcuauaaaucaaguacgacgauuaauugguaacgaaaacuaccuugauuacaugacauccaugaagcgauuuaaaaacgaaucggacccagaaggagcauuaugguag

SEQ ID NO: 21977 - RNA, 9879 nt, Artificial Sequence
  derived and/or modified CDS sequence (opt6) from DENV-1__KP188547__SS-prME
ucaguuacaaugcugcuaauguuauuacccacagcacucgcuuuucaccuuacgacuagaggaggggaaccgcacaugauuguuucuaaacaagaaagaggaaaaucauuacuuuuuaaaacuucaguaggagugaauauguguacacuaaucgcuauggaccucggggaacuaugcgaagacacgaugacuuacaaaugcccaaggauaacagaagcagaacccgaugaugucgauuguugguguaacgcgacugacacgugggucacuuauggaacauguucgcaaacgggagaacaucgccgagauaaacggucgguggcuuuagcuccccauguuggucuaggucuagaaacaagaacagaaacuuggaugaguucagaaggugcauggaaacaaauccaaaaaguggaaacuugggcguuacggcacccagguuuuacuguuaucgcauuauuccuugcacaugcaauaggaacgagcauaacacaaaaaggaauuauuuucauuuuauuaaugcuugucaccccgagcauggcuaugagauguguggguaucggaaaucgagacuuuguugaaggccucucaggcgcaacuuggguagacgugguguuggaacauggaaguugcguaacuacgauggcgaaaaauaaaccuacacucgacauagaauuguuaaaaaccgaagugacaaaucccgcaauuuuacguaaauuaugcauugaagccaaaauaucaaauacuacaacugauagccgauguccaacacaaggugaagcgaccuuagucgaggaacaagaugcaaauuuugucuguaggcguacauucguugauagaggaugggggaacgggugcggauuguuugggaaaggaagucuacugacaugugcuaaauuuaaaugugugaccaaacuggaaggcaaaauaguacaauacgagaaucugaaauacucaguuauaguuacuguccauacaggcgaucaacaccaaguagggaacgaaacgacagaacacggaacaauugcuacaaucacuccgcaagcuccgacuucugagauacaauuaacagauuauggagcauuaacucuggauuguagcccaagaacaggcuuagacuucaaugaaaugguauuacuaacaaugaaagaaaaaucaugguuagugcauaaacaaugguuucuggauuuaccacuacccuggacgagcggugcaaguacuucucaggaaacauggaauaggcaggauuuauuagucacauucaaaacugcacaugccaagaaacaagaaguuguagugcuagguucucaggaaggagccaugcauacugcauuaacaggagcgacagagauacaaacaucagguacaaccacgauuuuugcaggacacuuaaaauguaggcucaagauggacaaauuaacguuaaaagguaugaguuaugucauguguacagggucauucaaauuagaaaaagaagucgcagagacgcaacaugguaccguacucguucaggucaaauacgaagguacugacgcuccuugcaaaauaccauucuugacucaggaugaaaaaggaguaacacaaaauggucgccuuauuacugcgaacccaauaguuacagacaaggaaaaaccugugaacauugagaccgaaccgccauuuggugagucauauauugugguaggcgcuggcgaaaaagcucuaaaacuaaguugguuuaagaaaggaagcuccauagguaaaauguuugaagcuacagcccguggagcucgucguauggcaauuuugggagacacagcuugggauuuugguuccauugguggcuuauuuacaagugucggaaaacugauucaucaaguuuuuggcacugcauacggaguacuauucuccggagugucauggacaaugaagauaggcauuggaauacuauuaacauggcuagguuugaauagcaggucgacaucgcuaucaaugacaugcauagcggugggcauggugacuuuauauuugggaguaauggugcaagcagauaguggaugcgucauuaauuggaaagguagggaacuaaagugcggaagcggaauauuugugacaaaugaaguacauacguggacugagcaguauaaauuucaggcagauagucccaaaagacugucagccgcaauugguaaagcaugggaagagggagucugcggcauucgaucugccacacgucuagaaaauauaauguggaagcagauuucuaaugaguugaauuauaucuuacuagagaacgacaugaaauuuacagugguuguuggugacguaaaugggauacuugcacaaggaaagaaaaugauuaaaccgcaaccuauggaacauaaauauucauggaaaaguugggguaaggccaaaauaauaggagcagacauccaaaacacuacauucauuaucgaugggccugauacgcccgagugccccgacgaucaaagggcauggaauauaugggaaguagaagauuauggauucggcauauuuacuacaaauaucuggcuaaaauuacgagauucgcacacacaaaugugugaucauagacuaaugagcgccgcgauaaaagauuccaaagcaguacaugcugauauggguuauuggauagaaagugagaaaaaugaaacuuggaaacuugcucgagccaguuucauugaaguaaagacaugcauauggcccaagucacauacuuuguggucgaacggagugcuugaaagugagauggugauuccuaaaauauacggaggcccaauaucacagcacaauuaucgccccggauauuuuacccaaacagcugguccauggcaucuaggaaaauuggaguuggauuuugauuuaugugaggggacaacgguaguaguugacgaacauuguggauaccgagguccgucacuacgcacaacuacgguaacagguaaaauaauacacgaaugguguuguagaucauguacacucccaccauuaagguuucguggugaagacggauguugguaugggauggaaauaagaccugucaaagaaaaagaagagaaucuuguucgcagcaugguuucugcaggaaguggagaagucgauucauuuucuuuggggaucuuaugugucucuauacucauugaagaagugaugagaagucgaugguccagaaaaauguuaaugacuggaacacuagccguuuucuuguuacuaauaauggggcaacuuacuuggaaugauuugauaagauuauguauaauggucggcgccaaugcgcuagacagaaugggaauggguacaaccuauuuagcuuuaauggcuacuuucaagaugagaccgauguucgcugugggauuacuguuccgaagacuaacaucucgagaaguucuauuguuaacaguuggcuuaagccuugucgccucaguugagcuuccgucgaguuuggaagaacuaggugacggucuugcuaugggaauuaugauguuaaaauuauuaacagacuuucaaccacaucaauuauggacaacacuuuuaucuuuaacauuuauaaggacgagccuuucguuagauuaugcauggaagacaauggcaauggcauuaucgauuguuucgcucuuuccguuaugucuuaguacgacaucucagaaaacuacuuggcucccgguguuguuaggaucuuuuggguguaaaccgcuuaccauguuucuaauaaccgagaauaagauaugggguaggaaaucuuggccgauuaaugagggaauuauggcaguugggauagugucaauauuguugaguagcuugcucaaaaaugacguuccgcuagcaggcccauugauagcaggagggaugcuaauagcauguuauguaauauccgguagcucugcagaccuuucacucgaaaaagcugccgaagucucaugggaggaagaagcagaacacagcggaacuucacauaauaucuuaguagagguccaagacgaugggaccaugaaaauuaaagacgaagaaagagacgacacacuaacgauccuacuaaaagcgaccuuauuagcagugagcggugucuacccaaugagcauaccggcaacguuguuuguuugguacuuuuggcaaaagaagaaacaacgaagcgguguuuugugggacaccccaucaccuccggaaguagagagagcggugcuagaugauggcauauaucggauccuacaaagaggauuacuaggccguucacaagucgggguaggugucuuccaagaugggguuuuucauacaauguggcaugucacgagaggggcaguacucauguaccaagguaagcgucuagaaccuuccugggcgucaguuaagaaagacuuaauaucauaugguggugguuggcgauuucagggaucuuggaacacaggcgaagagguccaagucauugcuguagaacccggcaaaaaccccaaaaacguacaaacaacaccaggcaccuuuaaaacgccagaaggugagguuggagccauugcgcuggacuucaaacccggaacuucgggaucgccaauaguaaacagagaaggaaaaauaguuggcuuguauggaaauggaguaguaacaacaagugguacguaugugagcgccauugcucaagcaaaagcaacacaagaagggacauugccugagauagaagaugaaguauuuaaaaagcgcaauuugacaaucauggacuuacauccagggucuggcaaaacacgaagauacuugccagcuauuguuagagaggcaauaaagcgaaaguuacgaacacuaauucuugcgcccacacgaguaguagccagcgaaauggcggaagcauuaaaagggaugcccauuagauaucaaacaaccgcaguuaaaucugagcauacugggagggaaauaguugaucuaaugugccaugcaacauucacuaugcguuugcuaucacccguaagaguaccuaauuacaacaugauaauaauggaugaagcccacuuuacagaucccgccucaauugcugcuagaggguauauaucaaccagagucggaaugggggaagcugcagccaucuuuaugaccgcuacuccacccggcucagucgaagcauuuccucagucaaaugcaguuauacaagaugaggaacgggauauaccugaaagaucauggaauaguggauaugauuggauaaccgacuuuccgggcaaaacagucugguuuguaccuucaauaaaauccggcaaugacauugcaaauugucuaaggaaaaauggcaaaagaguuauccaauuaaguagaaagaccuuugacacagaauaccagaaaacaaagaacaaugauugggacuacgucguaacaacugauaucuccgaaaugggagcuaacuuucgagcugacagggucauugauccuaggaggugucuaaaaccaguuauucucaaggaagguccugagagagugauauuagcuggaccuaugccaguaacaguagccucagcagcucaacgucgagguaggauaggucgcaaccagaacaaagaaggcgaccaauauauauacaugggccaaccacuaaacaaugacgaagaucaugcccauuggacagaagcgaaaaugcuacuggauaacaucaauacaccagaaggaauaauuccugcuuuguucgaaccugaaagagagaaaagcgcagcaauugauggagaguauagguugcgaggagaagcccgaaaaacauuuguagaauuaaugagaaggggagaucucccuguuugguugucauauaagguugcuuccgagggauuucaauacagcgauaggcgaugguguuuugauggggaaagaaacaaucaaguacuggaggagaacauggacguagaaauauggacaaaggaaggcgagcguaagaaauugcgaccccguugguuagaugcaagaacuuauucugacccccuugcccuccgcgaguucaaagaauuugcagccggucgacgguccgucuccggcgacuugauauuagaaauagguaagcuaccacaacaccuuacccuccgcgcucagaaugcacucgacaauuuaguuauguuacacaauucggagcagggagggaaggcuuauagacaugcaauggaagaacuaccugauacgaucgaaacacuaauguuauuagcguuaauugcaguauuaacuggaggaguaacccuauuuuucuugucuggcaagggacucgggaaaacuagcauaggucucuuaugcgugauggccucauccgcguugcuguggauggcuuccguggaaccucacuggauugcagccaguauaauuuuagaguucuuccuaauggucuuauuaaucccagaacccgauaggcaaagaacaccucaggauaaucagcuagcguaugugguaauuggacugcuauuuaugauacuaacuguagcugcaaacgaaaugggucugcuugagacaaccaagaaagacuuagggauaggucauguagcuguugaaaaucaucaucacgcgacgauguuagauguggaucuaaggccagcgucagcguggacacucuaugcaguggccacuacugucauuacucccaugaugaggcauacaauagaaaauacgacugcaaacauuaguuugaccgcuauagcgaaucaggcagcuauccuaaugggacucgacaaaggauggccuauaagcaaaauggacauaggaguaccuuuauuagcccuuggcuguuauagccaaguaaauccucugaccuuaacugcagcaguccuaauguuaguugcucacuaugccauaaucgguccggguuuacaagcaaaggcaacaagagaagcucaaaagcgaaccgcggcaggaauaaugaaaaaccccaccgucgauggcauaguaacaauugacuuagauccuguaguguaugaugcuaaauuugagaaacaacuugggcaaauaaugcuuuuaauacuguguacgagucaaauucuacuaaugcggacaacuugggcacugugcgaaucaauaacuuuggcuacggggccccuaacgacccuuugggagggaucaccaggaaaauuuuggaacaccacaauagcgguaaguauggcuaauauauuccguggaucuuaucuagcuggagcaggccuagcauuuagucuuaugaagucacuaggaggagguagaagagggaccggagcacagggagaaacacugggggaaaaauggaaacgucaacuaaaccaauuaaguaaaucugaauuuaauacauacaagaaaagugguauaauggagguagauagaucagaagcuaaggaaggauuaaaaagaggagaaacaacuaaacaugccguaagccguggaacugcgaaacuccguugguuugucgagcgcaauuuaguaaaaccagaaggaaaaguuauagacuuaggauguggaagaggcggcuggaguuacuauugcgcuggacuaaagaaagucacagaaguaaaaggauacacgaaaggagggccuggacaugaagaaccaauuccgauggcaacguaugguuggaaucugguaaaacuucacaguggaaaagacguauuuuucacuccaccugagaaaugugacacuuuauuaugcgacauaggagaaucuagucccaacccuacaaucgaggaagguaggacgcuaagaguauuaaaaaugguugaacccuggcugagagggaaccaauuuuguauaaaaauccuaaauccguacaugccuagugucgucgagacucucgaacaaaugcaacggaaacauggcggaaugcuaguacguaauccuuuaucacgaaacucgacgcaugagauguauuggguuucuugcggcacugguaauauagugucagcgguaaauaugacaaguagaauguuguugaauagauuuacuauggcacaccguaagcccacuuaugaaagggacguugauuuaggagcugggaccaggcacguagcuguugaaccagagguagcgaaccucgacauaauuggacagcggaucgaaaauauuaaaaaugaacauaagaguacauggcauuaugaugaagacaaucccuauaagacaugggccuaucacgggucauacgaggugaaacccagcggaagugcuagcucuaugguaaauggaguaguacgucuguuaaccaaacccugggacguaauaccaaugguuacucaaauugcuaugaccgauacaacaccauucgggcaacagcgaguuuuuaaagaaaaagucgauacaaggaccccacgcgccaaacgaggaacugcacaaauaauggagguaacagcaaaauggcuuuggggguuucuaagcagaaacaagaaaccacguauauguacacgugaagaguucacaaggaaagugagaaguaaugccgccauaggugccguuuuugucgacgaaaaucaauggaacucugcuaaggaagcgguggaagacgaaagguucugggaucuuguacaucgagaaagagaguuacauaaacagggaaaaugugccacaugcguauauaauaugaugggcaagcgugaaaagaaacuuggugaguucggcaaagcgaagggaucacgggcaauuugguauauguggcuaggagcucgauuccuagaguucgaagcacuuggguuuaugaaugaggaccauugguucaguagagaaaauaguuuaaguggagucgaaggagagggacuucacaaacuaggguacauuuuacgugacaucuccaaaauaccaggggguaacauguaugcagacgauacugcuggaugggauacuagaauaacagaagaugacuuacagaaugaagccaaaaucacagacauaauggagccagaacacgccuuauuagcuaccaguauauuuaagcucacauaccaaaacaaaguggugcgcguccaacgaccggcgaaaucagguaccguaauggacguaauuucacgaagagaucaaagaggaaguggacaagucggaaccuacggacuaaacaccuuuacuaauauggaaguacaauuaauucgacaaauggagagcgaagguauauuuucaccauccgaacuagaaacgccaaauuuagcgaagaaaguucuagauugguuagaaaagcacggcgcugaaagauugaagagaauggcaauaucgggugacgacugugucguaaaaccuauagaugaccgauuugcgacagccuugacagcguuaaaugauaugggaaagguuaggaaagauauuccucagugggaaccuucgaaaggauggaacgacuggcagcagguaccauuuuguucccaucacuuccaucaauuaaucaugaaagacgggagagaaauagugguaccaugccguaaccaagaugaacuugucggaagggcaagaguaucacaaggagcagguuggagcuuaagggaaaccgccuguuuggguaaaucauaugcacaaauguggcaacuaauguacuuccaucgucgagaucucagacuagcagcgaaugcuaucugcucagccguacccguagacugggucccuacauccagaacuaccuggagcauucacgcgcaucaccaguggaugacgacugaagauauguugaguguguggaaccguguauggauugaggaaaauccuuggauggaagacaaaacacauguauccucgugggaagaaguuccauaccuugggaaaagagaagaucaauggugcggcucacuuauaggguugacggcaagagcuaccugggcaacuaauauccaaguagccauaaaccaaguuagaagauuaaucgguaacgaaaauuauuuagauuauaugaccucgaugaaacgguucaagaaugaaucugauccagaaggagcucucugguga

SEQ ID NO: 21978 - RNA, 9879 nt, Artificial Sequence
  derived and/or modified CDS sequence (opt6) from DENV-1__KP723473__SS-prME
uccguaacaaugcuucuaauguuguugccgacugcacuugcauuccaucugacgacacgagguggagaaccucauaugauaguaaguaaacaagaaaggggcaaaucauuauuauuuaaaacgagcgcggggguaaacauguguaccuuaauagccauggacuuaggugaacugugcgaagauacaaugacuuauaaauguccgagaauuaccgaagcugaacccgaugauguugauugcugguguaacgcuacugauacuugggugacuuacggaaccugcucacaaacaggugaacacagacgagacaaaaggaguguagcauuagccccgcaugugggauuaggucuggaaacaagaacagaaacuuggaugucuagcgaaggugccuggcgacagauacaaaaaguugagacaugggcacugcggcacccaggguuuacaguaauagcacuauuucuagcgcaugcgauugguaccagcauuacucagaaagggauuauuuucauacuuuuaaugcuaguuacgccuaguauggccaugagauguguagguaucggcaauagagauuucguggaaggacuuucuggcgcgacauggguagacgucgugcuagagcauggaucaugcguaacgacuauggcuaaaaauaaacccaccuuggauauagaguuacuuaaaacagaaguuacgaacccagcaguacuucgaaaauuaugcauagaagcaaaaauaaguaauaccacaacggacagucguugcccaacccaaggugaagcuacauuaguugaagaacaagaugcaaauuucguaugccggcguacauuuguagauaggggguggggcaaugguuguggauuauucggaaaagguucauugcucacuugugcaaaauuuaaaugcguaacaaaauuagaagggaaaaucguucaguaugagaaucugaaauacuccgugaucguuacuguacauacgggugaccaacaccagguuggaaacgagacaacagagcacggaacaauagcaaccaucacuccacaagcaccaacaagugaaauucaacuaaccgauuacggggcauugacacuagacugcucuccccgaaccggcuuggacuuuaaugaaaugguacuucugacuaugaaagagaaaaguuggcuaguccauaaacaaugguuucuugaucuaccgcugccauggacgucaggcgcaaguacaagccaagaaaccuggaaccgccaggaucugcuuguaacuuuuaaaacagcucaugcuaagaaacaggaaguugucguacuuggcagccaggagggugcaaugcauacagcacuuacaggagcgacagagauccaaaccuccggcacgacuacgauauucgcuggucacuugaaaugcaggcuaaaaauggauaaacucacacucaaagguguuucauauguuaugugcacagguuccuuuaaauuagaaaaagaaguggcagaaacacagcauggcacgguuuuaguacaagugaaauacgaagggacugacgcucccugcaaaauaccgauuaguacccaagaugagaaaggcgugacccaaaaugggagacucauaacagcaaauccaauuguaaccgauaaagagaaaccuguuaacauagaaacagagcccccuuucggcgaauccuacauuguaauuggagcuggcgaaaaagcauuaaaacuaucaugguuuaagaaaggaucuucaauagguaaaauguuugaggcgacugcuagaggagcacgucgcauggcuauuuuaggcgacaccgcuugggauuucggaucaaucggaggcgucuuuacaagcguaggcaagcuagugcaucagguuuuuggaacggcauacggaguucuguucagcggagucucauggacaaugaaaaucgguauugggauauuguuaaccugguugggucugaauagucgaaguacuucauuauccaugacaugcauugcaguaggaaugguaacuuuauaucugggcgucauggugcaggcugacagugggugcguaaucaauuggaaaggccgagaauugaaaugcgguucgggaauauuuguaaccaaugaaguucauacuuggacagaacaauacaaauuccaggcagauucaccaaagcgucuaagugcagcaauagguaaagcaugggaggaaggugugugugguauccgcucagcuacuaggcuagaaaauauaauguggaaacaaauuucgaaugaauuaaaccauauuuuauuagaaaacgauaugaaauucacagugguagucggggaugcuaaugguauuuuaacccaagguaagaaaaugauacgaccucaaccaauggagcacaaauauucuuggaaaagcuggggaaaagccaaaauaauuggcgccgacacucaaaacacgacguuuauuauagaugguccagauacuccagagugcccagacgaucaaagagccuggaacauaugggaaguggaggacuauggauucggagucuuuaccacaaacauuuggcuaaaacuaagagauucauauacucagaugugcgaucauagauuaauguccgccgcaauaaaagauagcaaagcuguucaugcggauauggguuacuggauagaaagugagaaaaaugagacguggaaacuagcaagagcaucauuuauagaaguaaagacuugcauuuggccgcgcagucauacgcuauggagcaaugggguacuugagucagaaaugauuauaccuaaaauuuauggcgguccaaucucucaacauaauuaccgucccggauacuucacucaaacggccgguccuuggcaccuaggaaaauuagaauuagauuuuaauuuaugcgaagguacaacgguaguuguagaugaacauugcgguaaccgugggccaagccuuaggacuacaacuguaacaggaaagauaauacacgaguggugcugcagaagcugcacacuaccuccauuaagauuccgaggggaagaugggugcugguaugguauggaaauucgaccaguaaaagaaaaagaagagaaccuugucagaagcauggucagugccggaucaggagaaguugauucauucucauugggguugcucugcguaagcauaaugauagaagaggugaugcgaucuagauggaguagaaaaauguuaaugacugguacuuuggcuguauucuuccuacuaauuaugggucaacucacauggaaugauuuaauaagacuuuguaucauggugggagcaaauguuagcgacagaaugggaauggguacgacuuaccuggcgcuaauggcaacguuuaaaaugagaccaauguuugcaguaggauuacucuuuagacgacuuacuagccgagagguauuauuauuaacgauaggcuugucacugguggccucuguugaauuaccuaauucuuuagaagaacuaggcgacggauuagccaugggaauaaugauguuaaaauuguuaacugauuuccagucacaccaacuauggacgacacuacuaucauuaacuuucaucaaaacgacacugucuuuagacuaugcuuggaaaaccauggcaaugguucuaucgauaguuucacuauucccucuuugccugucgacuacuucccagaaaacgaccuggcuuccuguauuauuaggaaguuucggcugcaaaccucuaacgauguuccucaucacagaaaacaaaaucuggggacgaaaguccuggccucuaaaugagggaaucauggcaguaggaauuguaaguauucugcuaagcuccuuacucaagaacgacgucccuuuggcuggcccauuaauagcaggagguaugcuaauagcauguuacguaauuucggguucaucugcugaucuuaguuuggagagggcagccgaaguaaguugggaagaggaagcugagcauucgggcgcaucgcacaauauauugguagaaguccaggacgaugguaccaugaaaaucaaagaugaggaacgcgaugauacauugaccauucuuuuaaaagcaacgcuccuugccgucucgggcguauauccuaugucaauaccggccacauuguucguaugguauuucuggcagaagaagaaacagcgaucugguguacuaugggauacaccaagucccccagaggucgaaagagcgguguuagaugaugguauauacaggauuuuacaaagaggauuguugggccguagccaagucggcguaggaguauuccaggacgguguauuccauacaauguggcacgugacaagaggcgcuguuuugauguaucaagggaagagacuggaaccaucuugggcuucgguaaagaaagauuuaauaucauaugggggaggguggagauuccaagguucauggaauacgggugaagagguucaggucaucgcagucgaaccggguaaaaauccaaagaacgugcagacaacgccggggacauuuaaaacgccugagggugaaguaggagcaauagcauuagacuuuaaacccggaacaucaggaagucccaucgugaaucgagaagguaaaaucgugggucuauaugguaacggcguaguaacuacgucaggaacauacgucucagccaucgcgcaagcaaaggccucucaagaaggcccuuuaccagagauugaagaugaaguauuuaagaaaaggaaccuaacgauaauggaccugcauccagggagcggcaagacuagacguuacuuacccgcaauagugagagaagcaauaaagaggaaauuacgaacgcuuauuuuggccccaaccagaguagucgcuucagagauggcggaggcucuaaaaggaaugccuauaagauaucaaacaacagcugucaaaagcgaacauacagggaaagagauaguugauuugaugugucacgcaacauucaccaugagacuauuaaguccggugagggugcccaauuacaacaugauaauaauggacgaagcacauuucacagacccggcuucgaucgcugcgagaggcuacauaagcacgcgcguugggaugggugaggccgcagccaucuuuaugacagcaacgcccccugguagcguggaagcauuuccacaaagcaacgcgguuauccaagacgaagaacgagauauaccggaacgaucguggaacucagguuaugauuggaucacugacuucccggguaaaacaguaugguuugucccaagcauaaaaagugguaaugauauagcaaauugucuaagaaagaacggaaaacgagugauccaguuaagcaggaaaacguucgauaccgaauaucagaaaaccaaaaauaaugauugggauuauguaguaacuacggauaucucagaaaugggagcgaauuuccgcgcagaucguguaauagauccacgcagauguuuaaaaccaguaauccugaaagacgggccagagcgcguaauucuagcaggacccaugcccguuacagcagcaucagccgcacagcgcagggguagaauagggagaaaucaaaacaaagaaggugaucaauacaucuacaugggccagcccuugaauaacgaugaggaccacgcgcacuggacggaggcuaaaauguugcuugauaacaucaauacuccagaaggcauaauaccagcauuguuugaaccagaaagagaaaagagugccgcaauagauggcgaauaucgauugagaggggaagcacgaaagacauuugucgaacugaugcgacgaggagaucuaccaguaugguuauccuauaagguagcaagugagggauuccaauauagugauaggcgauggugcuuugacggagagagaaauaaucaaguuuuggaagagaauauggacgucgaaauuuggacaaaggaaggugaacgaaagaaaugugauagucgauggcucgaugcgagaacguauagcgaccccuuggcucuacgcgaguuuaaagaauuugcagccggucgacgcucgguaucaggagaccuuauauuagaaauagggaaauuaccacaacaucugacauuaagagcucaaaacgcauuggacaaucuaguaaugcuccauaauucagagcaagguggaaaggcuuaucgccaugcaauggaggagcugccagacacaauagaaacauugauguuacuagccuuaauugcaguacuaacagggggaguaacacucuuuuuccuaucugguaaaggauuagggaaaacuucuauaggccuauuaugugugauggccucaucuguauuacuauggauggcaucuguagaaccacauuggauugcugcgaguauuauccuagaauuuuucuuaauggucuugcuaauaccagagcccgauagacaaagaacgccacaagauaaccaauuggcuuauguuguaauugguuuauuauuuaugauacugacagucgcagcuaacgagaugggacucuuagaaacuacuaaaaaggaucuuggaauugggcauguaguggcagaaaaucaccaccacgcaacaauguuggauauagaccuccauccggccagugccuggacuuuauacgcaguugcgacaacuauaauaacgccgaugaugaggcauaccauagaaaauacgacggcuaauauuaguuuaacugccauagcaaaccaagcagcuauauugaugggacuagacaaaggcuggccuaucaguaaaauggauauuggaguaccacuuuuagcucuuggcugcuacagccagguaaauccauuaacacugacugccgcaguauuaauguuaguagcacauuacgcuauuauugggccuggauugcaagcuaaagcaacucgugaggcacaaaaacguacugcggcugguauaaugaaaaacccaacggucgauggcaucguggcuauagacuuggaccccguuguauaugaugcaaaguuugagaaacaacugggacaaauaauguuacucauucuauguacgucacaaaucuuauuaaugagaacaaccugggcacuuugcgaaagcauaacauuagcaacaggaccauuaacaacuuugugggaaggaucuccugguaaguucuggaacacuacuauagcuguuuccauggccaauauuuuuagggggagcuauuuagcuggagcgggauuagcuuuuagucuaaugaaaagccucgggggcggacgacguggaaccggggcgcagggugagacacuaggggagaaauggaagaggcaauugaaccagcuuucaaagucagaguuuaauacguauaaaagaaguggaauuauggagguugaccggagcgaagcgaaagagggauugaaaagaggagaaacaacaaaacaugcgguaucuagagggacggcgaaacugcgcugguuugucgagcgaaacuugguuaaaccagaaggaaagguaaucgaccuaggauguggcagaggagguuggaguuauuauugugccgggcucaagaaaguaacugaaguaaaaggcuacacgaaaggaggaccaggccacgaggagccuauaccuauggcaacauacggcuggaacauagugaaauuacauaguggacgggauguguucuucacaccaccagaaaagugugauacauuauuaugugacauaggugaaucaucgccgaaccccacuaucgaagaaggaagaacucuaagaguucugaagaugguugaaccauggcuacgugguauucaauuuuguauuaagauauuaaacccauacaugccaucugucguagagacguuggaacaaaugcagcgaaaacauggggguaugcuuguucgaaauccuuugucgaggaacaguacacaugagauguauuggguaaguugcgguacugggaauauuguaucagcaguuaauaugacuucuaggaugcuccucaacagauucacaauggcgcaucgaaaaccaacauacgaacgggauguagaccugggcgcgggaacaagacauguagcuguagaaccagagauugcuaauuuagauauaauugggcaaagaaucgaaaacauuaaaaaugagcauaagucaacuuggcauuaugaugaggacaacccauacaagacaugggcuuaccauggauccuaugaagucaaaccgucgggaacagcaaguucaaugguaaauggagugguacgacucuugacaaaaccaugggacguaauuccuauggugacccaaauugcgaugacggauacaacgccauuuggccagcaaagaguuuucaaagagaaaguagacacaagaacucccagaccaaaaagagggacugcacaaauuauggaagucacugcgaaauggcuauggggauuuuugagcaggaauaagaaaccuagaauaugcacacgagaggaguucacgagaaaaguuagaagcaaugcagccauaggugcgguauuugucgaugaaaaucaguggaacagcgcgaaagaagcaguggaagacgaaagauucugggacuugguacauagagaaagagaacuacauaaacagggaaaaugugcgacuuguguauauaauaugaugggcaaacgugagaagaaauuaggagaauuuggcaaagcuaaaggaucaagagcuauaugguacaugugguuaggugcuagauuccuugaguucgaagcauuaggauucaugaacgaagaccacugguuuuccagagaaaauucacucucuggaguugaaggggagggauugcacaaacuaggcuacauucuacgagauauaucuaagauaccuggaggaaacauguaugcggaugauacagcaggaugggauacucgaauuacugaagaugaccuacaaaacgaggcgaagauaacugauauuauggagccagagcacgcccuuuuagcgacaucgauuuuuaagcugacguaccaaaauaagguugugcggguccagagaccagcaaagucugguacagucauggaugucaucaguagaagagaccagaggggaagcggacagguagguaccuacgggcugaacacuuuuacaaauauggaagugcaacuaauaagacaaauggagucugaaggaauauuuucacccuccgaacuagaaaauuccaaucuagcugaacgaguuuuagauugguuggagaagcauggcguagaaagauugaaacgcauggcaauaaguggugacgauugcguaguaaaaccgaccgacgaccgauucgcuacagcccuaacugcauuaaaugacauggguaagguacgaaaggauauuccacaaugggaaccgucaaagggauggaaugauuggcagcagguacccuuuuguucacaucauuuccaccaacuaaucaugaaggauggacgggagaucguagugccaugucggaaucaggaugaauuaguaggcagagccagaguaucgcaaggcgcuggauggucacuacgugaaacugccuguuuggggaaaaguuacgcgcaaauguggcaauuaauguacuuccaucguagagauuugcgacuagcagcuaacgccauaugcucagcuguacccguuaacugggugccuacaucucgaacaacuuggucaauacaugcucaucaucaauggaugacaaccgaagauaugcuauccgucuggaauagaguuuggauagaggagaacccguggauggaggauaaaacacaugucucaaguugggaagauguaccauaucuaggaaaacgugaagaccagugguguggcucgcuaauagguuugacggcuagggcuacuugggcuacgaauauacaggucgcuauaaaucaagugcguagacuaauagguaacgagaauuauuuggacuauaugacaagcaugaaacguuucaaaaacgaauccgauccagagggcgcguuaugguaa

SEQ ID NO: 21979 - RNA, 9879 nt, Artificial Sequence
  derived and/or modified CDS sequence (opt6) from DENV-1__KT187564__SS-prME
ucaguaacaaugcuacugauguugaugccaaccgcauuggcauuucauuuaaccacuaggggcggagaaccacacaugauggucaguaaacaagaaaggggaaaaaguuuauuauuuaaaaccagcgcggguguuaauaugugcacacucauagcgauggacuuaggugaacuaugcgaagauacuaugaccuauaaaugcccacgaaucacagaagcagaaccggaugacguagauuguugguguaaugcaacagacacuugggugacauauggcacgugcucccaaaccggcgaacauaggagggacaaaaggagcguagcauuagcaccccauguaggucuagguuuggaaacaagaacagagacuuggaugagcucagaaggggcauggaaacaaauacagagagucgaaacaugggcgcuacgacauccagguuuuacaguuauugcacuauuccuagcacacgcaauaggaaccucaauaacucaaaaagguauuauauuuauccuucuuauguugguuacgcccagcauggcaaugcgauguguaggaauaggcucacgagauuucgucgagggauugagcggagcaacguggguugaugugguguuggaacauggcaguugcgugaccacaauggcaaaagacaaaccaacuuuggacauagagcuguuaaaaacagaaguaacuaauccagcuguacuaagaaaauuauguaucgaggcgaaaauaagcaauacaacgacagacucacguuguccgacccaaggagaagcaacguuaguggaggagcaggaugcuaacuucguuugcaggcgaacauuuguagauagaggaugggggaaugguugcggucuuuuugguaaaggaucauuaauuacuugugcuaaguuuaaaugcguuacgaaacuggagggaaagaucgugcaguaugaaaauuugaaauauucgguuauaguaacaguacauacaggugaucaacaucaaguggguaaugaaucuacggagcaugguacgaccgcaacgauuacaccccaagcaccaaccaccgagauucaauugacggauuauggagcucuaacacuugacuguucuccgaggacaggucucgacuuuaacgaaaugguacuuuuaacaaugaagggaaagaguugguugguacacaaacaaugguuuuuagauuuaccacugccauggacgaguggugcgucaacgucucaagaaacauggaaccgucaagauuuguuaguuacguucaaaacagcgcaugccaagaaacaagaaguaguuguacuggguagucaagaaggugcaaugcauacggcauuaacaggugcaacagagauucagacaagugguacuaccaccauauuugcugggcaucuaaaaugucgcuuaaaaauggacaaacuuacgcugaaagggaugucauaugucaugugcacgggcaguuuuaaacuagagaaggagguggcagaaacccagcaugguacaguucuagugcaaauaaaguacgaagguaccgaugcgccguguaaaauaccauuuuccacacaagaugaaaaaggggucacgcaaaacggaagacuuaucaccgcuaauccuaucgucacugauaaagaaaagccuguaaacaucgaggcagagccuccauuuggagaaucguauaucguaauaggugccggagagaaagcgcugaaacucucgugguucaaaaagggaucuucgauaggaaagauguuugaagcuacagcaaggggugcccguagaauggcuauacuaggagauacugcaugggauuucgguagcauaggggguguauuuacaaguguugguaaauugguccaucaaauauucgguacugcauauggcgugcuauucucugguguaucuuggacgaugaaaaucggaauagguguguuauuaacgugguuaggacuaaauucacgaucaacgagucuuucaaugacguguaucgcugugggccuaguaacgcuuuacuuagggguuauggugcaagcugacucugggugcgugauaaauuggaaaggucgugaauuaaaauguggcucaggaauauucgugacaaacgaagugcacacauggacagaacaauauaaauuucaggcggauucgccgaagagauuaucggcugcaaucgggaaagcaugggaagagggugugugcgguauacguucugccacccgccucgaaaauauaauguggaagcagauuuccaacgaacuaaaucauauacucuuagagaaugauaugaaauuuaccgucgugguaggagacguagcgggaauauuggcccaaggcaagaaaaugauccgcccacaaccgauggaauacaaauauagcuggaaaagcugggguaaggcaaaaauuauaggggcagacgugcaaaauacuacauucauaauugauggcccgaacacuccggagugcccagaugaccaacgagcuuggaacauuugggaggucgaagauuacgguuuuggaauauuuaccacaaauauaugguuaaagcuacgcgacaguuauacccaagugugugaucaucgacuaaugagugcugcaauaaaagauuccaaagcaguucaugcagauauggguuacuggauagaaagugagaaaaacgaaacuuggaaacuugccagggcauccuucauagaagugaaaacuugcauauggccgaaaagccauacccuuugguccaacggcguacuagaaagugaaaugauuauuccuaaaaucuauggagguccuauuagucaacauaauuacaggccaggcuauuucacucaaacagcggguccauggcaucugggaaaauuggagcuagacuuugauuuaugugaagguacgacggugguagucgaugaacauuguggaaacagagguccgucauuacggacgacaaccguaacagggaagaucauacaugaaugguguugcaggagcuguacgcugccaccauuaagauuccggggagaagacgguuguugguaugggauggagauaaggccgguuaaagaaaaggaggaaaaccuagugaaaaguaugguuagcgcuggaaguggagaaguagauucauuuucauuaggauuauuaugcaucucgaucaugaucgaggaaguuaugcgaucgagauggucgagaaaaaugcuaaugauaggaacgcuugccguuuucuuuuuacuaauuaugggacaguuaaccuggaacgaucuuauacgauuauguaucauggugggugcuaacgcaagugauaggauggguaugggcacgacuuaucuagcacuaauggcuacauuuaaaaugaggcccauguucgcaguaggccuucuauuucgucgccucacaucacgagaaguucuauuguugacaauagggcuuagccugguagcaucggcagaauuaccaaauagucuagaggaauuaggcgacggcuuagcgauggguauaaugauacuaaaauuauugacagacuuucagagucaccaauuaugggccacucuauuaagccuaaccuuuauuaaaacuaccuuuaguuuacacuacgcuuggaagacuauggcuaugguccuuucaaucgugucauuguuuccgcuauguuuaucuaccacgucucaaaagacaacuuggcucccaguacucuuaggaagccuaggauguaaaccacuuaccauguuuuuaauugcagagaacaagauaugggggagaaaaucuuggccacugaacgaggggaucauggcugucggaaucguaaguauacuuuuaagcaguuuacuuaaaaaugauguuccacuagccggacccuuaauugcgggaggaaugcugauagcuugcuauguaaucucugguucauccgccgaucuuucucuagaaaaagccgcugaaguuaguugggaagaagaggcagaacacaguggagcuagucacaacaucuuaguagagguacaagaugacggaaccaugaagauaaaagacgaagaaagagaugacacauuaaccauacugcuuaaggcuacguuacuugcggugagcggggucuuucccuuaucaauaccggcgacguuauucguaugguacuuuuggcagaagaagaaacagagaucaggaguauugugggacacuccuagcccuccagagguugaacgagccgucuuagacgauggaauuuauagaauuaugcaaagaggacuauugggaagaucucaaguaggagucggagucuuucaagaaaauguauuucauacaauguggcacguuacgagaggagcgguauuaauguaccaaggaaaaaggcuggaaccuucaugggccucaguaaagaaagauuuaauaaguuacggcggaggauggcgcuuacaggguucauggaauaccggugaggaaguacaggucaucgcuguagagccaggcaaaaaucccaaaaacguucagacagcgccagggacauuuaaaacaccugaaggagaaguuggagcaauagccuuagauuucaaaccuggaacaagcggaaguccgaucguuaaccgcgaagguaagaucguuggacuauacgggaauggcguugucacgacaagcggaacauauguaucagcuauugcucaagcuaaggcuucgcaagaaggcccauugccagaaaucgaggacgagguauuccggaaaagaaaucuaacuauaauggauuuacacccagguucugggaagacaagaagauaccugccagcuauagugcgagaggcuaucaaaaggaaacugcgaacauuaauacuagcuccaacaagaguaguagcaucugagauggccgaagcacuaaaaggaaugccaauacgauaucagaccaccgccgugaaaagugaacauacagguaaagaaauaguggauuuaaugugccaugcaaccuucacgaugcgacugcuuaguccugugcguguaccgaauuacaauaugauaauuauggaugaagcacauuucacagacccgagcucuauagcugcgcgugguuacauuaguacaagaguaggaaugggagaagccgcggccauauucaugacagcuacuccaccaggaaguguagaggcuuuuccacagucaaacgccguaauucaagacgaagaacgcgacauuccugaaaggagcuggaacucaggcuacgaauggauuacugauuuuccugggaaaaccguaugguucguuccuucaauuaaaucagguaacgauauagcaaauugcuugcgaaagaauggaaaaagagucauacaacuaucccgcaaaacauucgauaccgaauaucagaaaacuaaaaacaacgauugggauuacguugucacgacagauauaucagaaaugggagcuaacuuucgugcugacagaguaauagauccuaggagauguuuaaaaccagucauuuuaaaagauggaccugaacgagucauacuugcugguccuaugccuguaacaguugccuccgcugcacaacgucgcggccguauugguagaaaucauaauaaagagggugaccaauacaucuacaugggucaaccucucaacaacgaugaggaccaugcacauuggacagaagcaaaaaugcuuuuagauaauauaaacacuccugaaggaauuauacccgcauuauucgaacccgaaagggaaaagagugcagcaauugauggagaauauaggcuaaggggcgaagcaagaaagaccuuuguugagcugaugagaagaggggauuuaccaguuuggcucaguuauaaaguggcuagcgaaggauuccaguauucugaccgccgcugguguuucgacggagagcgaaacaaucaaguucuagaggaaaacauggacguagagauuuggacaaaagaaggggaaagaaagaaacuacguccccguugguuggaugcgagaacuuauagcgacccacuugcguuacgcgaguuuaaagaauuugcagcuggaagacgcucgguuucgggggaccuaauacuagaaauaggaaaauuaccacaacaccucacacaacgagcccaaaaugcguuggauaaccucgugauguuacauaauucagaacaaggaggacgggcguaucgucacgccauggaggagcucccagauacaauugaaacacuaauguuauuagcucucauagcgguuuuaacagguggaguuacucuauucuuucuuagcggacgaggguuagguaaaaccagcaucggcuuacuguguguaauggcgucuucuguuuuacuuuggauggccaguguagaaccacauuggauugcagccagcauuauacuugaguucuuuuuaaugguauuacuuauuccggaaccugaccgucaaaggacaccccaagacaaucaacuugcauacguagugaucggauuacuauucaugauacucacaguggcugcuaaugagauggguuuacuagaaacgacuaagaaagaucuaggcaucggacacguugcuguugagaaccaccaucaugcagcaaugcuagauguagacuuacauccagcuagcgcauggacauuauaugcuguugcaaccacaauaauaacgccuaugaugcgccacacaauugaaaauacaacggcgaacauuucgcucacagcuauagcaaaucaagccgcaaucuuaaugggccuugacaaagguuggccuauuucaaaaauggauaucgguguuccccuguuggcacugggauguuauucgcaaguuaauccuuuaacauuaaccgcggcgguauuaauguuaguugcucacuacgcaauaaucggaccgggacuacaagccaaagcgacgagagaagcacagaaacguacggcugcagggauuaugaaaaaucccaccgucgaugguauaguugcgauagaucucgauccgguaguauacgaugcaaaauuugaaaagcaacugggacaaauaaugcuacucauacuaugcacaucccagauucuucuaaugagaaccacaugggcauugugugaaagcaucacacuagcuacggguccacuaacaacgcuaugggaagggagccccggaaaguuuuggaacacaacuauagccguuucaauggccaauauuuucagaggguccuauuuggcuggagcaggcuuagcauuuucccuaaugaaaucauuggguggagggcgaagaggaaccggagcucaaggugaaacucucggugaaaaauggaaaaggaggcugaaccaacuaucuaagagcgaguucaauacauauaaacgaucagguauaauggaaguugacagauccgaagcuaaggaggguuuaaagcgaggugagacuacaaaacaugcuguaagcagaggaaccgcuaaguuaagaugguucguugaaaggaaucugguaaaaccggaaggcaaaguaauagaucuuggaugcggaaggggaggauggagcuacuacugugcuggucuuaagaaaguaacagaagucaaaggguauacgaaaggaggaccgggacaugaagaaccaauucccauggcuacuuauggcuggaauuuaguaaaacugcacucaggaaaagauguauuuuucaucccacccgagaaaugcgauacccuccuaugcgacauuggagaaaguaguccaaacccuacaauagaagaaggcagaacucuucgaguuuugaaaauggucgaaccauggcuaagaggcaaccaauuuuguauuaagauuuuaaauccguacaugccaucgguaguagaaacacuggaacaaaugcagaggaaacaugggggaaugcuuguuagaaaccccuuaaguagaaauucgacgcaugagauguauuggguaucuugcgguacgggcaauauaguaagugccgugaacaugacgaguaggaugcuuuugaacagguuuaccauggcgcacaggaaaccuacauaugaaagagauguagaccuaggugcagguacuagacacguagccguugaaccagaaguggcaaacuuagacauaauaggucaacgcauagaaaauauaaaacacgagcauaaaaguacguggcacuacgaugaagauaauccauacaaaaccugggcuuaccauggaucguaugaagucaaaccaucagguucagcaucuaguaugguaaacggcguuguaaaguugcucacuaaacccugggauguuauuccuaugguuacccaaaucgccaugacagacacaacgccauuuggucagcaaaggguuuuuaaggaaaaaguagauacacgcacaccaaaagcgaaacgaggaacagcucaaauuauggagguaacagcaagauggcuauggggauucuuaucaaggaacaagaaaccaagaauauguacuagagaagaauuuacaaggaaaguccguucaaacgcagcaauuggcgcgguauuuauagaugaaaaccaauggaacucagcuaaagaagcuguugaggacgaaagauuuugggaucugguucaucgagaaagggaacuucacaaacaagguaaaugcgcuacuuguguauauaauaugauggguaaacgagagaagaaacuuggugaguuuggaaaagccaaagguagucgagcaauuugguacaugugguuaggugcgcgguuuuuggaauuugaagcucugggauucaugaaugaggaucacugguuuuccagagaaaauucauuaucggggguagaaggugagggauuacauaagcuagguuauauauugagagauauuucuaaaauaccugggggaaacauguacgccgacgauacagcgggaugggauacuagaauaacggaagacgauuuacagaaugaagccaaaauaacagauauaauggaaccggaacaugccuuacuagcaaaagcuauuuuuaaacuaacguaucaaaauaagguaguaagaguucaaagaccagccaaaaauggaaccgucauggaugucauaagcagaagagaucaaagaggaagcggccaaguaggaacuuacggccuuaauacguuuacuaacauggaggcacaacuaauaagacagauggaaagugagggaauauucagcccaagugaacuagagacaccuaacuuagccgaacggguccuagauuggcucgggaaauauggagucgaaagauuaaaacgaauggcgauuaguggggaugauugcguagucaaaccaauugaugaccgcuucgcgacagcucuaacagcauuaaacgacauggguaaaguucguaaagauauuccacaaugggagccuagcaagggauggaaugacuggcaacaagucccauuuuguucacaccacuuucaucaauuaauaaugaaggacggaagagaaaucguuguuccgugcaggaaccaagaugagcuaguugggcgagcccggguuucucaaggagcuggauggucucuaagagaaacggcauguuuagggaaaaguuacgcccaaauguggcagcucauguauuuucaucgucgagaccuccgccuagccgcuaaugcuauauguagcgcaguuccggucgacuggguaccgacuucgcggacaacauggaguauccacgcccaccaccaauggaugacgacagaagauaugcucucuguguggaaucgaguauggauagaggaaaacccauggauggaagacaagacucacauuaguaacugggaagacgugccuuacuuaggaaaacgagaagaccaguggugcggaucauugauaggucuuaccgcaagagccacuugggcaacaaacauucaaguugcgauaaaucaagugagacgucuaauugggaaugaaaauuacuuagauuacaugacaucaaugaagcgguuuaaaaaugaaucggacccagagggagccuugugguaa

SEQ ID NO: 21980 - RNA, 9879 nt, Artificial Sequence
  derived and/or modified CDS sequence (opt6) from DENV-1__KT187560__SS-prME
ucaguuacgauguuacuaaugcuacuaccaacggcauuagcuuuucaucucacuacgaggggaggcgaaccucacaugauuguaaguaaacaagaacgaggaaaaucuuugcucuuuaaaacaagcgcgggcguaaacauguguacuuuaauugcuauggaucucggagaauuaugcgaagacacaaugacguauaaaugcccuagaauuacugaagccgaaccugacgauguggauuguugguguaacgcaacagauacuuggguaacuuacggaacuuguucucaaacaggagaacauagacgugauaagcgaagugucgccuuggcaccucauguaggucuuggccuagaaacacguacagaaacauggaugaguucagaaggggcauggcgacaaauacaaaaaguugaaacuugggcauuaagacacccugguuucacaguuaucgccuuauuucuagcgcaugcgauagggacuucaaucacucaaaaaggaaucauauucauacuuuugauguuggugacaccuucaauggcuaugcgauguguagguauagguaacagagacuucgucgaagguuuaucaggagcuacaugggucgauguuguauuagaacacggaucauguguuacuaccauggccaaaaacaaaccuacuuuggauaucgaauuauuaaaaacugaagucaccaacccggcaguccuccgaaaacuguguauagaagcuaaaauaaguaacaccacgacagacagcagauguccuacgcaaggagaagcuacauuaguagaagaacaagaugccaauuuuguuuguagacguacauucguagaccgggguuggggaaacggauguggacuuuuuggcaaagguucauuauugacaugugcgaaauuuaaaugcgugacaaaacucgaaggcaaaaucguucaauacgaaaacuuaaaauauucaguaauagucacagugcauaccggagaucagcaucaaguaggcaaugaaacgacagaacauggcacaauagcuacgauaacaccacaagcaccaacuucggaaauucaauuaacggauuacggcgcuuuaacacuugauugcucaccuaggacuggucuagauuuuaacgaaaugguccuuuuaaccaugaaagagaaaaguugguuaguucacaaacagugguucuuagaucuaccgcuaccuuggacuucaggggcaucaacaagucaggagacguggaaucgucaagaccuccucguaacauuuaaaaccgcgcacgccaagaaacaagaaguagucguucugggaucacaagaaggagcgaugcauacugcacugacaggagcaaccgagauucaaaccaguggaacaacaacaauauucgcaggacauuugaaaugcagguugaaaauggacaaauuaacacugaaagguguuucguauguuauguguacuggaaguuucaaacucgaaaaagagguagcugaaacacaacauggaacaguccucguccaaguaaaauaugaaggaaccgacgccccguguaaaauuccaauaucgacucaagacgaaaaagggguaacacaaaauggucgccugauaacugcaaacccaaucguuaccgacaaagaaaaaccugugaacauagaaaccgaaccaccguucggggagagcuacauaguuaucggcgccggugaaaaagcacuuaagcuaucuugguucaagaaaggaagcucaaucggaaagauguuugaggccacagcuaggggugcucgacguauggcaauucuuggagauacagcaugggauuuugggucuauaggcgguguuuuuacaaguguaggcaagcugguucaccaaguauuuggcacugcauauggaguacucuuuagcggcgugaguuggaccaugaagauuggaauaggaauuuuguugacauggcucggucuuaauucuagaucuacaucacuaucaaugaccuguauagcgguaggaaugguuacauuguauuuaggagugaugguccaagcagauuccggaugcguaauaaacuggaagggaagagagcuaaaaugcgguaguggaauauucguuacgaacgaaguucacacauggacugagcaauauaaauuccaagcagauucaccaaagcgauuaagugcagcaaucggaaaagcaugggaggagggaguuugugguauacgaucagcaacucgacuagaaaauauuauguggaaacagaucucuaaugagcuuaaucauauccuauuagaaaacgacaugaaguucacugucguugucggugaugccaacggaauacuaacucaagguaaaaagaugauaaggccccaaccuauggaacauaaauauagcuggaagucauggggcaaggcuaagauaauaggggcggauacgcaaaauacuacauuuaucauugaugguccugauacacccgagugcccugaugaucaacgagcauggaauauuugggaaguagaagauuacgguuucgggguuuucacuacaaacauaugguuaaaacugcgcgacaguuauacacaaaugugugaucaccgauuaaugagcgcugcuauaaaagauucgaaggcuguacaugcagacaugggauacuggauugagucagagaaaaaugaaaccuggaaacucgcuagagcuaguuucauugaaguuaaaacguguauauggcccaggucgcauacguuguggucaaacggaguuuuggagucggaaaugauuauacccaaaauauauggaggaccuauaagucagcauaacuauagaccaggauauuuuacacaaacagcaggacccuggcaccuggguaaguuggaauuggacuuuaacuuaugcgaggguacuaccgucguagucgaugaacauugugguaacagaggcccuagucuaaggacaacuacagucacaggaaagauaauacacgagugguguuguagaagcugcacauugcccccguugagauuucgaggggaggacggauguugguauggaauggaaauaagaccaguaaaggaaaaagaagaaaaccuaguacgcuccauggucagugcuggaaguggggaagucgauuccuucucguuaggauuacucuguguaucaaucaugauugaagaggugaugagaaguagauggucuagaaagauguuaaugaccgggacacuagcaguauuuuuccuuuugauuaugggucaacuuacauggaaugaucugauucguuuguguaucauggucggagcuaauguaucagaucgaaugggcauggggaccacauaucuagcgcuuauggcaacuuucaaaaugagaccaauguucgcaguaggacuuuuguuucgaagacucacguccagagaggucuuacuguuaacuauaggacuaucauugguugcuaguguagaauugcccaauucuuuagaagaacuuggugauggucuugcuauggguauaaugauguuaaaguuauuaacugauuuccaaucacaccaacucuggacaacacuacuuucgcuuaccuucauaaagacuacucuaucucuugauuaugcuuggaaaacuauggcaaugguuuuaucuauaguaaguuuauucccuuugugccuauccaccacaagucagaaaacuaccugguuaccuguacuauugggaaguuugggguguaagcccuuaacuauguuuuuaauaaccgagaacaaaauuugggguagaaaaaguuggccauuaaacgaaggaauaauggcuguagggauuguauccauucuucucucaagccuccucaaaaaugauguuccauuagcugguccccucaucgcuggcgguauguugaucgcuugcuaugucaucucaggaaguucugcggauuuaagccuagaaagggcggccgaaguauccugggaagaagaggcugaacacagcggugcgagucauaacauccuuguugagguacaagaugaugguacaaugaaaauaaaagacgaagaacgugaugauacauugacuauucuucugaaagcaacccuucuggcgguaucagguguuuauccuaugucuauuccagcaacgcuauuuguaugguacuuuuggcagaagaagaaacagcgcucaggaguuuuaugggauacaccaucgccaccugaggucgaacgugccguuuuagacgaugggauuuaccgcauacuucagaggggccugcucggacgcagucagguagggguuggaguauuccaggauggugucuuccauacaauguggcaugucacgaggggugcaguacuaauguaucagggaaaaagguuggaaccauccugggcaagcgucaagaaagaucuuauaucauacggagguggcuggagauuucagggaucauggaauacuggagaagagguacaaguaauagccguugaaccugggaagaaccccaaaaauguccaaacgacacccggaaccuucaaaacccccgaaggagagguaggugcaauagcucuggacuuuaaaccagguacuucgggaagccccauagucaaucgggaagguaaaauuguaggguuauauggaaaugggguagucacuacaagcgggaccuacguaucggcaauagcacaagcaaaagccagucaggagggcccauuaccagaaauagaagacgaaguauuuaagaaacgaaauuugacgaucauggauuuacauccggguagcgguaaaacacguagguaccuaccagcuauugucagggaggcaaucaaacgaaaauuaagaacacucaucuuagcucccaccagagucguagcuagcgaaauggccgaggcacuuaaaggaaugccuauacgauaucaaacgacagcagugaaaucagaacauacugguaaggagauuguggauuuaaugugucacgccacuuuuacuaugcgccuacuaucaccaguaagaguacccaacuauaauaugauaauaauggacgaggcgcauuuuacagaccccgcaucaauagccgcucgaggauauauuucuacgcggguuggaaugggagaggcagcagcgauauucaugacagccacaccaccaggcuccgucgaggcuuuuccacaaucaaacgcagugauacaggaugaagaacgcgacauuccggagcgaaguuggaacaguggauacgauuggauuacugauuuccccggaaaaaccguaugguucgugcccucaauaaagucuggcaaugauauugcaaacugccuuagaaagaacgguaaacgaguuauccaacuaucuagaaaaacuuuugauacagaauaccagaaaaccaaaaacaaugacugggauuacgucguuacaacugauaucuccgaaaugggugcgaauuuucgagcugaucgaguaauagauccuagaagaugucucaaaccuguuauccuuaaagauggaccugaacgugugaucuuagcaggaccuaugccaguaacagcagcuucagccgcacaaagaagagggagaauaggucggaaccaaaacaaggaaggagaucaauauaucuacaugggccagccccucaacaacgaugaagaccaugcccauuggacggaagcaaaaauguuacucgauaauauaaacacgccagaagguauuauaccugcgcucuuugaaccugaacgagagaaaagcgcagcgauugacggagaauaucguuuacguggugaagcgaggaaaacuuuuguugaauuaaugagaagaggggauuuacccguaugguuaagcuauaaagucgcaucugaaggcuuucaauacagcgaucgcagauggugcuucgacggugaacguaauaaucaaguacuugaagaaaacauggauguagagaucuggacuaaggaaggggaaagaaagaaacuaagaccucgauggcuagaugcaaggacauacagcgacccacuggcacuuagagaguuuaaagaguucgcugcgggacguaggucgguaagcggcgauuuaauauuagagauaggaaagcuaccacaacacuugacacuacgugcgcagaaugcgcuugacaaccugguuauguuacauaauagugaacagggugguaaagcguacagacacgcuauggaagaauuaccagacacaauugaaaccuuaaugcuucuagccuuaaucgccguguuaacaggagggguuacgcuauucuuucugucagggaagggacuagguaagacaucaaucgguuuacucugcguuauggcaaguucuguucuucuuuggauggcuucaguagaaccacacuggauugcugcuucuaucauucucgaauuuuucuugaugguuuuauuaauaccagaaccagacagacaaagaacuccucaagauaaucaacucgcauauguuguuauaggucuucucuucaugauuuuaacagucgcagcaaaugaaaugggacuauuggaaacaaccaagaaggacuuggguauaggucaugucguagccgaaaaucaccaccaugcaacuaugcuugauauugaucugcacccggccucagccuggacguuauaugcuguagcaaccaccauuauaacaccuaugaugcgacacacaauagaaaacacaacagcaaauaucucacuuacugcaauagcaaaccaagccgcgauacuuauggggcuagacaaaggcuggccaauaaguaaaauggauauuggaguaccauuacuggcauuaggcuguuacucacaagugaacccuuugacguuaacugcagcaguccuaaugcuaguagcacacuaugcgauaaucggcccaggacuucaagcaaaagcuacaagagaggcucaaaaacgaaccgcugccgggauuaugaagaacccuacuguggaugguauaguagcaauagacuuagauccaguuguuuacgaugcuaaauucgaaaagcagcuaggucagauaaugcuacuuauacuuugcaccagccaaauacuacuaaugagaacaacgugggcacuaugugagucgauuacgcucgccacuggaccuuuaacaacccuuugggaagguagcccuggcaaguuuuggaacacaaccauugcgguuagcauggccaacaucuuccguggauccuaccuggcuggcgcgggguuagcauuuucgcugaugaaaucacuggguggcggaagacgcggaacgggggcacaaggugaaacuuuaggagaaaaguggaagaggcaacucaaucaauugucaaaaagugaauuuaacaccuacaagcgaucugguauuauggaagucgacagaucagaggcaaaggaaggucucaaacgcggagaaacaacaaaacaugcgguuuccaggggaacggcaaaauuaagaugguucgucgaaaggaauuuggucaaaccagaaggcaagguaauugacuuggguugcgguagaggcggcuggucauauuacugugcuggcuugaagaaggugacugaagugaaaggcuauaccaaagggggaccgggucaugaggaaccuaucccaauggcaacuuaugguuggaauaucguuaaauugcacuccgggagagacguauucuuuacgccuccagagaaaugugauaccuuguugugugacauuggugagucaaguccaaauccuacaauagaagaagggaggacauugagaguacuuaaaaugguugaacccuggcuaaggggaaaucaauuuugcauuaaaauacuuaacccuuacaugccaagugugguggaaacauuggagcaaaugcaacgaaaacacggaggaauguuaguaaggaacccacuuucaagaaauuccacacacgaaauguacuggguguccugcggaacugggaacaucguaagcgcaguuaacaugaccaguagaauguuguuaaacagauuuacuauggcucacagaaaacccacuuaugaacgagacguagacuuaggagcuggaacaagacaugucgcuguggaacccgaaauagcuaauuuagacauaauaggucaaagaauugaaaacaucaaaaaugaacauaaaucaaccuggcauuaugaugaagauaacccauacaaaacaugggcauaucacggaagcuaugaaguaaagcccagcgggucugccaguucaaugguuaacggcguaguccgcuuacucacaaaaccuugggauguuauaccuaugguaacucaaauugcgaugacagauaccacgccuuuuggccaacagagaguuuuuaaggaaaaaguagacacgaggacaccucgaccaaagagaggaacugcacaaauuauggaaguuaccgcgaaauggcugugggguuuucuuuccagaaacaagaagccuagaauuuguacgagggaagaguuuacaagaaaagugagaaguaaugcagcaaucggagcgguauuuguggacgaaaaucaguggaacagugcaaaggaagcgguggaggacgagcguuucugggacuuaguucauagagaacgggaguuacacaaacaagguaagugugcaaccugcguuuacaacaugauggguaaaagggagaagaaacuuggggaauuuggcaaagcaaaagguaguagggcgauaugguacaugugguugggagcgcgguuccuggaguucgaggcguugggcuuuaugaaugaagaccacugguuuucucgcgaaaacucguuaucagguguagaaggagaaggauuacacaaguuaggcuauauacugcgcgauauuaguaagauuccaggcgguaauauguacgcagacgacaccgcaggcugggacacacggauaacagaagacgauuugcagaaugaggcgaaaauuacggauaucauggagccggagcaugcuuuauuagcaaccucaauuuuuaaauuaacauaucaaaauaagguaguacgaguacaaagaccagcuaaaucuggaacugucauggaugugauaagucgacgcgaucaaaggggcucagggcaaguuggcacuuauggacuaaauaccuuuacaaauauggaaguucaguuaauuaggcaaauggaaucggaggggauauuuuccccaucagaguuagaaaauaguaaccuagcggagagaguacuugacuggcucgagaaacauggugucgaaaggcuaaaaagaauggcaaucucaggagaugauugcguaguuaaaccaacagacgauagguuugcaacagcauugacagcauuaaaugauaugggaaagguccgaaaagacauaccccagugggagccauccaaagguuggaaugauuggcaacaaguuccauuuuguucucaccacuuucaucaguuaauaaugaaggacgggcgggaaaucguagugcccugcagaaaucaagacgaacuggugggacgagcuagaguuagccaaggugcaggauggagccuacgagaaacggcaugucuggggaagucauaugcacagauguggcaauuaauguauuuucauagaagagauuuacgucuagcagcgaaugcgauaugcucggcaguaccgguaaauuggguccccacuucuagaacuacauggaguauucacgcucaccaucaauggaugaccacagaagauaugcugaguguuuggaaccgcguuuggauagaagaaaauccguggauggaggauaagacacaugugucaaguugggaagauguccccuacuuaggaaaaagagaggaucaauggugcggcucucucaucggucuuacagcaagggcaacaugggcgaccaauauacaaguagcgauaaaucagguacguagauugauagguaaugaaaacuaucuagauuacaugacgaguaugaagagauuuaagaaugagagugauccugaaggagcacuaugguga

SEQ ID NO: 21981 - RNA, 9879 nt, Artificial Sequence
  derived and/or modified CDS sequence (opt6) from DENV-1__KT187561__SS-prME
ucaguuacuauguuauuaauguuacugccaacugcacuagcauuucaucuuacaacucgaggaggugaaccacauaugauagugucaaaacaagaaagagggaaauccuugcuauuuaaaacgucagcuggcgugaauaugugcacucuuauagcuauggaucuaggggaacucugugaagacaccaugacuuacaaaugcccacgaaucacggaagcagaaccagaugauguugacuguugguguaaugcaaccgacacauggguuaccuaugguacauguagucaaacuggggaacaccgucgagacaaaagaucuguagcacuagcgccacauguuggguugggacucgagacucggacugaaacauggaugaguagugagggugcguggcgucaaauacaaaaaguggaaacuugggcgcuucgacacccugguuuuacugucauugcguucuuuuuagcgcacgccauuggaacaaguauuacacaaaaaggaauaauauuuauauuacuuauguuaguuacaccaucuauggcgaugcgcugcguugguauagguaacagagacuuuguagaggguuuaaguggcgcuacauggguugacguuguuuuagaacaugguucaugugugacaacuauggccaaaaauaaaccuacguuagauauugaauuacuuaaaacagaaguuacaaacccggcgguuuuaagaaaauuauguauagaggcaaaaaucucaaauacgacaacagacucccgcugcccuacacaaggcgaggccacuuuaguagaagaacaagaugcuaauuuuguaugcagacguaccuuuguagacagaggauggggaaauggguguggucuauuugguaaagguucccuccugaccugcgcaaaauuuaaaugcguaacaaaacuagaggguaaaaucguccaauacgagaaccucaaauacucggucaucguaacugugcauaccggcgaucaacaucaaguuggaaaugaaacuacagagcaugguacgauagcaaccauaacgccacaagcuccuacuucagagauacaacuuaccgauuauggggcccucacucuagacugcucaccacgcaccggucuugacuuuaaugaaaugguucuccucacuaugaaagaaaaaucauggcucguacacaaacaaugguuccuagaucuaccucuaccguggaccaguggcgccagcacaucucaagaaacguggaaucgacaggauuuacucguaacuuuuaaaacugcucacgcgaagaaacaagaaguaguuguucugggaagccaggaaggggcaaugcauacggcguuaacaggcgcuacggaaauacaaacaagugggacaaccacgauuuucgcuggacaccuaaaauguagauuaaaaauggacaaguuaacauuaaaaggagucaguuacguaauguguacaggcagcuuuaaauuagaaaaagaaguugccgaaacccaacacggaacaguccugguccaaguaaaauacgaggguacugacgcaccaugcaaaauaccgauaagcacacaggacgaaaaaggcgucacccaaaauggucgcuugauuacugcaaacccgauaguaacagauaaagaaaaacccguaaauauagagacggaaccucccuuuggagaaaguuauauagucauaggagccggugaaaaagcacucaaacucucuugguucaagaaaggcucaagcaucggaaaaauguuugaagcgacugcaagaggagcuaggcguauggccauacuuggugacacggccugggauuuugguucaauaggugggguauucacaaguguagguaaauuaguucaucaaguguuuggcacugcauacggaguucuauuuaguggaguaagcuggacuaugaaaauuggcaucggcauucuuuuaacaugguuaggauugaauagccggucuacuucucuauccaugacaugcauugcaguagguaugguaaccuuauauuuaggugugaugguucaagcugauucagguugcgugauaaauuggaaagggagagaacuaaaaugcggaucuggaauauucguaacaaaugaaguacauaccuggacagagcaguacaaguuucaggccgauucccccaagagguugucugccgccauaggaaaagccugggaggaaggugucugugguauaagaucugccacuagacuugagaacauaauguggaagcagauuucuaacgagcuuaaucacauccuauuagaaaaugacaugaaguucacaguuguugugggugacgccaacgguauacuuacacaagguaaaaagaugauacguccucaaccuauggaacacaaguauucauggaaaagcugggggaaagcaaaaauaauaggggcagacacccaaaauacuacguucauuauagacgggccugauacaccagaaugucccgacgaccaacgggcuuggaauauaugggaagucgaggauuacggcuucggagucuuuacaacgaauauauggcuaaaacuaagagacucuuauacucaaaugugcgaucaucgacuuaugucagcagcuauaaaagauucuaaagcuguucacgcugauaugggauauuggauagaaagugagaagaacgaaaccuggaagcuagcacgugccaguuuuauagaaguaaaaacaugcauauggccucgaucacacacuuuauggucgaacggaguauuagaaucugaaaugauaauccccaaaauauauggaggaccgauaucucaacauaauuaccgacccggguacuuuacucaaacugcuggcccauggcacuuggggaaauuggaacuagauuuuaaucuaugugagggaaccacgguuguaguggaugaacacugcggaaauagaggccccucuuuaagaacgacuaccguuacgggaaaaauaauccaugagugguguuguagaucguguacucuucccccuuuaagguuucguggggaggauggguguugguacggaauggaaauaagaccuguaaaagaaaaagaagaaaaucugguacguaguaugguuucugcuggaagcggcgaaguggacucauucucacuaggucucuugugugucucaauaaugauagaagaaguaaugcguucuagauggucacguaaaauguuaaugacggguacccuagcuguauucuuucuccuaauaaugggucaacucacauggaacgaccuuauaagguuaugcauaaugguaggagccaaugugagcgaccggaugggcauggggaccacauaccuagcacuaauggcuacuuucaagaugagaccaauguucgcgguaggauuacucuucagaagacuaacaucuagagaaguacuucuauuaaccauuggucuaucgcuaguugcuaguguggaauuaccuaauucauuggaagaacuaggagauggcuuagccaugggaauaaugauguuaaaacuacugacagauuuccaaagccaucaguuauggaccacauuacugucucuaacauuuauaaagaccacacucagcuuagauuaugcauggaaaacgauggcuaugguucuaucaauugucagcuuauuuccccuuuguuuaagcaccacaucgcagaaaaccacauggcucccuguauugcuuggaucauuugguuguaaaccguuaacaauguuuuuaauaacugagaauaaaauauggggaagaaagaguuggccacuuaaugaaggaauuauggcagucggaauaguuucaauacuccuuucgucuuuacucaagaacgacguuccauuagcuggcccauuaauagcaggagguaugcuaauagcuugcuacgucaucucaggaucuucagcugaccuaucauuagaaagggccgcugaagugagcugggaagaggaggccgaacacaguggagcuucacauaauauccuaguagagguucaagacgacggaaccaugaaaauaaaggaugaagaacgggaugacacucuuacaauuuuacuuaaagcaacccuuuuagcaguaagcgguguauauccaaugucaauaccggcaacccuauucguuugguauuucuggcagaaaaagaaacaaaggaguggcguucuaugggacacuccaaguccuccagaaguggaacgagcaguccuagacgacgggauuuacagaauacuccaacguggauuauuagguagaucucaaguuggaguaggaguguuccaagauggcguuuuccauaccauguggcauguaacuagaggcgccguuuuaauguaccaaggaaaaagauuagaaccuucuugggcaucugucaagaaagaucugauuucguacggagguggguggagguuccaggguucauggaacacaggagaagagguccaaguaauugcgguggaaccggggaagaaucccaaaaacguccaaacaacgccgggaacauuuaagacacccgagggagaaguaggugcaauugcguuggauuucaagccagguacgucggguucaccaauaguaaaucgugaagguaaaaucgugggacuauacggcaacggagugguaacaacgagcggcacuuacguaucagcuauagcacaagcaaaagcaagucaggaagguccacuuccugaaauagaggaugaaguauucaagaaaagaaacuuaacaauaauggauuuacauccaggcucuggaaaaacaagaagauacuuaccagcuauugugagagaagcuaucaaacgcaaguuaagaacuuuaauauuggcaccgacacggguaguagcuagugaaauggcugaagcguugaaaggcaugcccauacguuaucagacgacagcuguuaaauccgaacauacaggaaaggaaaucguagaccuaaugugucaugcgacauuuacaaugcgauugcuaucucccguccgaguuccuaacuacaauaugauaauuauggaugaggcacacuuuacagauccggcuagcauugcugcuagaggauauauuucgacuagaguggggaugggugaagcugcugcgaucuuuaugaccgcuaccccgcccgggaguguagaagcauucccgcagaguaacgcaguaauacaggaugaagaaagagauauuccggaaagaucauggaauagcgguuacgauuggauaacugauuuuccgggcaaaaccguaugguuugucccuagcauuaaauccggaaacgauauugcuaauuguuugcggaaaaacggaaaacgagucauacaacuaucaagaaaaacauuugauacagaguaucagaaaacgaaaaacaaugauugggacuacgucguaacaacagacauaucggaaaugggggcaaacuuccgagcugaccgaguaaucgauccuaggagauguuuaaaaccaguuauauugaaagacgggccagaacggguaauacuggcgggacccaugcccguuacagcagcaucagccgcacaaagacgcgggagaauaggcagaaaucaaaacaaagagggcgaccaguacaucuacaugggacaaccucugaauaaugacgaggaccacgcacacuggacugaggcuaagauguuacucgauaauaucaacacaccggaaggcauuauaccugcacuauuugaaccggaacgugaaaaauccgccgcaaucgacggagaauauagauuaaggggugaagcucgcaaaacauuuguagaauuaaugcggagaggagauuuaccaguaugguugucauacaaaguggcuucugaaggauuucaguauucagaucgccgaugguguuucgauggugaaagaaacaaucaaguauuagaagaaaauauggacguagagaucuggacgaaagaaggcgaaaggaagaaacuccguccuagaugguuggacgcaagaacauauagcgacccuuuggcacucagggaguuuaaagaguuugcagccgguagaagaucgguaucuggggauuugauuuuagaaauuggaaaacucccgcaacacuuaacauuacgagcacagaaugcauuagauaaccuaguuaugcuacauaacuccgaacaagguggaaaggcguauaggcacgccauggaggaguugccagauacgauagagacguugaugcugcuugcguugauugccguccuuaccgggggcguaacucuuuucuuucuuagcgguaaaggucuuggaaaaacaaguaucggguuguuaugugugauggcaucauccgucuuacuauggauggcuucuguugagccacacuggauugcggcuucaauaaucuuagaguucuuucucaugguucugcuaauaccagaaccggaucggcaaaggacaccgcaagauaaucaauuagcauacguuguuauuggucuguuguuucuuaucuuaacaguugcggccaaugaaauggguuuauuagaaacgacgaagaaagaucugggaauaggucauguuguggcggagaaucaccaucaugcgaccaugcucgacauagaccuacauccugcuagugcauggacacuauaugccguggcuacuacaauuauaacgccuaugaugcgacauacaauagagaacacuacagcaaacauuagucucacagcuaucgcuaaucaggcagcuauuuuaaugggacuggacaaaggauggccaaucucuaaaauggauauagguguuccccuguuagcccuugguugcuauagucaaguaaauccauuaacccuaacggcagccguauuaaugcugguugcucauuaugcuauaauuggcccuggucuacaggccaaagcaacaagagaagcacaaaaacgaaccgccgcaggaauuaugaaaaacccaaccguugauggaaucguugccauagacuuagaccccguuguauacgaugcaaaguuugaaaaacagcucggacaaauaaugcuguugauucuguguacaagucaaauauuauuaaugcgaacaacgugggcucuuugugagucgauaacauuagccacagguccacuaacgacucucugggaagggucuccugggaaauucuggaacacgaccaucgcaguaaguauggcgaacauauuucgugggucguaucuugcuggugcaggacuugcauuuagucuaaugaaaagucuuggaggugguagacgaggaacuggagcccagggcgaaaccuugggagaaaaauggaaacgacaguuaaaccaacuuagcaaauccgaguuuaauacuuacaagagauccgguauaauggaaguagaucgaucugaggccaaagaaggucuaaaacgaggagaaacgacaaaacaugcagugagcagaggaacagcaaaacucagaugguucgucgaacgaaauuuaguaaaaccugaggggaaaguaauagaccuaggaugcggacgaggagggugguccuacuacugugcaggccucaagaaaguuacugaaguaaaaggguauacuaagggcggaccuggccacgaagaaccaauaccaauggcuacauauggcuggaauaucguuaaauuacacagcggacgugauguauuuuucacuccuccagaaaaaugcgauacgcuacuaugugacauaggugagagcucuccgaacccaacuauagaagaagggcgaacgcuucgaguuuuaaaaaugguagaacccuggcuacgaggaaaccaauuuuguaucaaaauacugaauccuuauaugccgucaguaguggagacuuuagaacaaaugcagcgaaaacauggugggauguuaguaagaaauccacuaaguagaaauaguacccacgaaauguauuggguaaguugcggaacggguaauauaguuucggcuguaaacaugacaucccguauguugcuuaacagauuuacaauggcgcauaggaaaccgaccuaugaaagagauguagaucugggugcaggaacaagacauguggcuguagagccagagauagccaaccuagauauaauagggcaaagaauugaaaacaucaaaaaugaacacaagucuacguggcauuaugaugaggacaauccguauaaaaccugggcuuaucacgguagcuacgagguaaaaccaucagggucagccagcaguauggucaauggaguaguucgucuauuaacaaaaccaugggaugucauucccaugguaacacagauagcaaugacagauacaacgccuuucggucaacaacgcguauuuaaagaaaaaguagauacacguacuccaagaccgaaaagagggacagcacagauaauggagguaacugcuaaaugguuauggggguuccuaucccgcaacaaaaagccacgcauauguacaagagaagaguucacacgcaaaguaaggucaaacgccgcuauaggcgcaguauuuguagacgaaaaccaauggaacucagcaaaagaggcgguugaagaugagagauuuugggauuuaguccauagggaaagggaacuucauaaacaaggaaaaugcgcaacauguguuuacaacaugauggguaaacgcgagaagaaauugggagaauuuggaaaagcaaagggaaguagagcaauaugguacauguggcuuggcgcaagguucuuagaauuugaagcucuggguuuuaugaaugaggaucauugguucucuagagaaaauucacugagugggguagaaggugaaggauuacauaaacuaggauauauacuucgcgauauuucuaaaaucccaggaggaaauauguacgccgacgauaccgcaggaugggacacacgcaucaccgaagaugauuuacaaaacgaggcuaaaauuacggacauaauggaaccagagcaugccuuacuagcaacuuccaucuucaaguuaacauaccaaaauaaaguugucagaguacagagaccugcaaagagcggaacagucauggacgucauaucucgucgggaucaaagaggcagcggucaaguuggaacuuauggacugaauaccuucacaaacauggaaguacaauugauuagacagauggaguccgagggaauauucucuccuucagaacuagaaaauaguaaucuagcagaacgcgucuuggauuggcuagagaaacacggagucgagagacucaaacgcauggcgaucucuggagacgacugcguagugaaacccacagaugaucgguuugcgacagcacuuacagcauuaaaugacaugggaaaaguccgaaaagauaucccacaaugggaaccaaguaaaggauggaaugacuggcaacaaguaccauucuguucgcaucauuuccaucaacuaauaaugaaggacgggagggaaauagugguuccaugccgaaaccaagaugaacuuguaggacgagccagaguuagccaaggggccggauggucuuugagagaaacagcaugcuuaggcaaauccuacgcucaaauguggcaacugauguauuuccaccgaagggaccucagauuagcagcaaaugcuauuugcagcgccguaccuguaaacuggguccccacaagcaggacgacguggucaauacaugcucaucaucaauggaugacuacggaagacaugcuauccguauggaauagaguauggauagaagagaauccauggauggaagauaaaacccaugugucuucuugggaagacgugccguauuugggaaagagagaggaucagugguguggaagucuaauuggacuaacugcucgagcaaccugggccaccaauauacaaguggcaauaaaccagguuagacgacuaauuggaaacgaaaauuaccucgauuauaugacaucaaugaaacgauucaagaacgagucagauccugagggagcccuaugguaa

SEQ ID NO: 21982 - RNA, 9879 nt, Artificial Sequence
  derived and/or modified CDS sequence (opt6) from DENV-1__KT187562__SS-prME
ucuguaacuauguuauuaaugcuauuaccaaccgcuuuagcauuucaucuaacuacucgaggaggugaaccacauaugauuguaucgaaacaagagagggggaaaucauuacuuuucaaaacuucugcugggguuaauauguguacauuaauagcaauggauuuaggugagcuuugugaggacacuaugacauauaaaugcccgaggauaaccgaagcagaaccagaugauguugauuguuggugcaacgcaaccgauacaugggucacauacgguacuugcucucaaaccggcgaacaccgaagggauaaacgaucaguugcuuuagcaccgcauguaggacuagguuuggaaacccgaacagaaacauggaugucuuccgagggagccuggcgucaaauccaaaaaguagagacaugggcacuucgucaccccgguuuuacagugauagcacuuuuccuagcacaugcgauaggaaccucgauaacacagaagggaauaauauucauauugcuaauguuaguaacaccgagcauggcaaugagaugugucggaauugguaaucgugacuucguggaaggccugagcggggcaacauggguagauguaguccuagagcacggaucgugcguaacaacaauggccaagaauaagccaacacuagacauagagcuccugaaaacagaagucaccaauccggccgugcuaaggaaacuaugcauugaagcuaagaucuccaauacaacuacagauagcagaugucccacacaaggagaggcgacguuagucgaggaacaagaugcaaacuuugugugccguaggacuuuuguagaucgagguuggggcaacggauguggacuuuuugggaaaggcucucugcuuacuugugcgaaauuuaaauguguuacgaagcuagaagggaagaucguccaauaugagaauuuaaaauacucuguuauugugacaguucacacgggagaucaacaucaaguaggcaaugaaacuacagaacaugggacaauagcgacaauuacuccucaagcuccaacuucagagauacaauuaacagauuauggugcacugacucuugacuguucgcccagaacaggcuuagauuucaaugaaauggucuugcuaacaaugaaagaaaaaucauggcuuguacacaaacagugguuucuagauuugccacucccguggacaaguggggcuuccacaucacaagaaacuuggaaucgacaagaccuacucgucacguucaagaccgcacacgccaagaaacaagaaguaguuguuuugggaagccaagaaggugcuaugcacaccgcauuaacaggagcaacugaaauacaaacgaguggcaccacaacaauuuucgcaggccacuugaagugcagauuaaagauggauaaacuuacguuaaaagguguuucauauguuauguguacugguucauuuaaacuagaaaaagaaguagcagaaacacaacaugguacaguuuuaguacagguuaaauacgaagggacugaugcuccuugcaagauuccaaucucaacgcaagacgaaaaaggggucacgcaaaacggcagacugaucacugccaauccaauuguuaccgauaaagaaaagccuguuaauaucgaaaccgaaccuccauuuggagaaagcuacauuguaaucggagccggcgaaaagacauuaaaacucucuugguucaagaaaggaaguaguauagguaagauguuugaagccacagcaagaggagcuagacgaauggcaaucuugggagauacagcaugggacuucggaucgaucgguggaguauucacaaguguagggaagcuaguacaucaagucuucggaaccgcuuaugguguacuuuuuagcggcguaucguggacuaugaaaauaggcauuggcauacuauuaacguggcuaggauuaaacucacgaucgacuagcuugaguaugacuuguauugcagucggaaugguaacuuuauacuuaggagucaugguccaggcggacaguggaugcguaauaaauuggaaaggacgagaacuaaaaugcggaucaggaauuuuuguaaccaacgaaguucauacguggaccgagcaauauaaauuccaagcagacucgccgaaacgguugucugcugcgauaggcaaggcaugggaagaaggggucugugguauacgaucagcuacacgacucgaaaacaucauguggaagcagauaucaaaugaacuaaaucacaucuuguuagagaacgauaugaaguucaccgucguggugggcgaugcaaacgguauacuuacacaaggaaagaaaaugauaaggccccaacccauggaacauaaauacuccuggaaauccuggggcaaagcuaaaaucauaggagcagauacacaaaauacgacauuuauaauagaugggccagacacuccagaauguccagacgaucaaagggcauggaacauuugggaagucgaagacuaugguuucggaguuuuuacaacaaacauuuggcuaaaauuaagagauaguuauacucagaugugugaccaccgacucaugucagcugcuauuaaagacucaaaagcgguacaugcagacaugggauauuggauagaaagugaaaagaaugaaacuuggaaacuugcacgagcgucuuucaucgaaguaaaaacguguaucuggccccgcagccacacguuauggaguaaugguguuuuagaaucggagaugaucauaccgaaaauauauggcggucccauaagucaacauaauuauagaccaggauauuucacccaaacagcugguccauggcauuugggaaaauuagagcuggacuuuaauuugugcgaagguacaacuguggucguagaugaacacugcggaaauagaggaccaucauuaagaacaacuacaguuacaggcaagaucauacaugagugguguugucgcucauguacucucccaccgcugagauuucgaggagaggauggcugcugguauggcauggagauuaggccaguaaaggaaaaggaggaaaacuuggucagaaguaugguaucagcuggaaguggagaaguggauagcuucagccuuggucuacucugcguuucaauuaugauugaggaaguaaugcgcucaagauggaguagaaagauguuaaugacagggacacuagcagucuucuuucuauuaaucaugggacaauuaaccuggaaugauuugauaagauuaugcauuaugguaggcgcgaaugucagcgauagaauggggaugggaacaacauaucucgcacuuauggcaacuuuuaaaaugagaccuauguucgcugugggacuuuuguuuagaagauugacgaguagggagguauuauugcuaacuauaggacuaucguuaguggccucuguugaauuaccgaauagucuagaagaauuaggagacggacuugcaaugggaauaaugauguuaaaacuauuaacugauuuccaaagccaccaacuuuggaccacauuacuauccuuaacuuuuauuaaaaccacacuaagucuagauuaugcuuggaagacuauggccaugguacuaucuauaguuucccucuuuccuuuaugucuuagcacaacaucucagaaaaccacuugguugcccguauuacuugggucuuuuggcuguaaaccacuaacaauguuccuaauaacggaaaauaaaauuuggggcagaaagucauggcccuuaaaugagggaauaauggccgugggaauagucagcauauuacuuucuucguuacuuaaaaacgauguuccguuagcugguccacugauagcaggagggaugcuaauugcauguuacguaauaucuggaucaagugcugauuugucauuagaacgcgccgcugaaguauccugggaagaagaggccgaacauucaggggcuucacacaacauucugguagaaguacaagaugacggaaccaugaaaauaaaagaugaggaaagggaugauacguuaacaauucuuuuaaaagcuacacuccucgcagugagcggcguauacccaaugucuauuccggcuacucucuucgugugguauuucuggcagaagaagaaacagaggagcgggguccuuugggacacuccaucuccaccugaaguggagagagccgugcucgaugacggcaucuacagaauacugcagagaggauuacuuggucgaucgcaaguaggagugggcguuuuccaagaugguguauuucacacuauguggcacguaaccagaggggcaguguugauguaccaaggaaaacgcuuagaaccuuccugggcgucugucaagaaagaucucauaucuuauggagguggauggagauuccaagguucguggaauacuggugaggaaguacaaguuaucgcuguugaaccagggaagaacccaaagaauguacaaaccacaccaggcacuuuuaagacaccagagggagaagucggcgcaauagcauuggacuucaaaccaggaacaucuggaucgccaauugugaauagagaaggcaagauuguaggcuuauaugguaacggcguaguuacuacaagugguacuuacgucagugcaaucgcacaggcuaaagcaucacaggaagguccucugccggagauagaagaugaaguguuuaaaaagagaaaccuaacuauaauggaucuccauccagguucuggaaaaaccaggagauaucuuccagcuauaguaagagaagcuauaaaaagaaaacuacguacacuuaucuuagcaccuacaagagucguugcaucagaaauggcagaagcguuaaagggcaugcccauaagauaucaaacgacagcuguaaaaucagaacacaccgguaaagaaauuguagaucuaaugugccaugcgacauuuacgaugagacuuuuaagcccaguacgaguuccaaacuacaauaugauuaucauggacgaagcccauuucaccgaccccgcaagcauagcggcgagaggcuacaucucuacacgcgucgggaugggugaagcggcagcuauuuuuaugacugcaacuccgccaggcucuguagaggcauucccacaauccaaugccguaauacaagacgaagagagagacaucccggaacgaagcuggaauagcggguaugauuggauaaccgauuuuccaggaaaaacgguuugguucguaccuuccauaaaauccgggaacgacauagcuaacugucuuaggaaaaauggaaaacggguuauucagcuuagucggaagacguuugacacugaauaccagaaaacgaaaaacaaugauugggauuacgucguaacgaccgauauuucagaaaugggagcgaacuuuagagccgaccgagugauagauccuagaaggugucuaaaaccaguuauucuaaaggauggaccugaaaggguaauacuagcgggaccgaugccgguuacugcagcaagugcagcgcaaagacgcggacgcaucggucgcaaccagaauaaggaaggcgaccaauauauauacaugggccaaccuuugaauaacgacgaagaucacgcgcauuggacugaagcgaagauguuguuagauaauauuaacacaccugaaggaauaauaccugcguuguucgaaccagagcgagagaaaagugcagcaauagacggugaauacagacugcgaggggaagcacgaaaaaccuucgucgagcuuaugcggagaggggaucuaccagugugguuaucguauaaaguagccagugaaggguuucaguacuccgauagaagaugguguuucgacggcgaacgaaauaaccagguucuagaagaaaauauggacguagaaaucuggacaaaggaaggagaaagaaagaaacuaaggcccagauggcuagacgccaggacauacagugauccucuugcauuacgagaauuuaaagaauuugcagcagguagaaggaguguaucaggagaccugauucuugaaauuggaaaauuaccacaacaccugacacuacgugcucagaacgcauuggacaaccucguuauguugcauaauucagaacagggagguaaagcauauagacaugcuauggaagaauuacccgauacaauugagacuuugauguuacuagcgcugauugcaguauuaacagguggagucacuuuauucuuucucagcgguaagggacuuggaaaaacuucaauagggcucuuaugcguaauggccucguccguacuccuguggauggcaagcguagaaccgcauuggauugcagcauccauuauucuagaguucuuucuuaugguuuuauugauacccgaaccagaucgucaaagaaccccgcaggauaaccaauuagcauacguaguuauugguuuguuguucaugauacuaacaguagcugcaaacgaaaugggacuauuggaaacaacaaagaaagacuuaggaauaggccaugugguugcugaaaaucaccaccaugcuacaaugcuagauauagacuugcaucccgcaucagccuggacccuauacgcuguugcuacgacuauaauaacuccgaugaugcgccacacaaucgagaauaccacagccaacauuagccuaacggccaucgcuaaucaagccgcgauauuaauggguuuagauaaaggguggcccauuucgaaaauggauaucggcgucccgcugcucgcuuugggaugcuauagucaagugaauccacuaacguuaacugcagcuguccuuauguuaguagcacauuaugccauuauaggaccggguuuacaagcaaaggccacaagggaggcccaaaagcgaacugcagcaggcauuaugaaaaacccaacuguggacggcauaguugcaauagauuuggacccggucguauacgacgcuaaauucgaaaaacaacuaggccagauaaugcuacugauacuuugcacaucucaaauauuacuuaugagaacgaccugggcauuaugugaaucaauaacgcuagcuacagggccuuuaacaacccuaugggaaggaagcccggggaaauuuuggaauacaaccauagcgguaucgauggccaacauauucagaggcucauaccucgcuggagcuggauuagccuucagucuaaugaagucccucggcggaggacgaagagguacuggagcacaaggagaaacauugggagagaaauggaaaagacaacuuaaucaguuaucaaaaucagaguucaauacuuauaagcgaucuggaauaauggaagucgaucgaucagaagccaaagaagguuuaaaaagaggggaaacaacaaagcaugcuguuaguagagguacagcaaaacuucgaugguuuguugaaagaaauuuagugaaaccggaagggaaggucauagauuugggauguggaagaggaggguggucauacuauugugcuggccugaagaaaguuaccgaagugaaaggauauacaaaagguggaccaggacacgaggaaccuaucccaauggccacauacgguuggaacauaguaaaguuacauucgggcagggauguauucuuuacaccgccagaaaaaugcgauacguuauugugcgauauaggcgaaucaagccccaauccuacuauagaagagggucgaacacuacgggucuuaaaaaugguugaacccuggcugagaggcaaccaauucugcauuaaaauacugaauccuuauaugccaaguguagucgaaacuuuagaacagaugcaacgcaaacacggagggauguuaguacggaaccccuuguccagaaacaguacgcaugaaauguacugggugucgugugggacuggaaauauaguaucugcaguaaauaugaccucgaggaugcuacucaacagauuuacaauggcucaccggaaacccacguaugagagagacguugaccuuggggcugggacaagacauguagcuguagagccagaaaucgccaaucucgauauaaucggucaaagaauagaaaauauaaagaaugaacauaaaaguacauggcauuaugaugaagauaauccauauaagacaugggcguaucacggaagcuacgaagucaagccguccggauccgcaucuucgaugguaaauggagugguccgauuauugacuaaaccuugggauguaaucccuauggucacacagaucgcaaugacggacaccaccccuuuuggucaacaaagaguuuuuaaggaaaaaguagauacucgcacaccuagacccaagagaggcaccgcucaaauaauggaaguaacugcaaaauggcuaugggguuucuugucacgaaacaagaaaccuagaaucuguacucgagaagaguuuacuaggaaaguacgcaguaaugcugcuaucggugcgguauucguugaugaaaaccaauggaacucagccaaagaggccguagaagacgagcgauuuugggaucuagugcacagggaaagagagcuccauaaacagggaaaaugcgcgaccugcguauacaauaugaugggaaaaagagaaaagaaauuaggggaauuugggaaggcaaaaggaucgcgagcuaucugguauauguggcuaggcgcaagguuuuuagaguuugaggccuuaggauucaugaacgaagaucacugguucucaagggaaaauucucuguccggugucgaaggugaaggccuccacaaacuuggguacauuuuaagagauauuagcaagauccccggcggaaacauguacgcagaugauacagccggcugggauacgaggauuacugaggacgaucuacaaaaugaagcuaagauaaccgauaucauggaaccugaacaugcauuauuagcuacaucgauauuuaaacuaacuuaccaaaauaaggugguuagaguacaaaggccagcaaagagugggacagucauggauguaauaagucgaagagaccaaagagguucgggacaaguagguaccuauggccucaacacauucacuaacauggaaguacaguugauacgccagauggaaagcgaaggaauauuuucaccaucugaacuagagaauaguaaucuugcagaacgaguccuagauuggcucgaaaagcacggugucgaaagacucaaaagaauggcaauuucgggugacgauugcguggugaaaccuacagacgauagauucgccacagcuuugacugcgcuuaacgauaugggcaaaguacgcaaagacauaccucagugggaaccaucgaaaggauggaaugauuggcaacaagucccguuuugcagucaucauuuucaucaacuaauuaugaaggaugguagggaaauaguuguaccuugucguaaucaggacgaauuaguugggagagcacguguaucucaaggcgcaggguggagccuccgugaaacagcuugucucggaaaaucuuaugcucagauguggcaacuaauguacuuucauagacgugacuuacgauuagcagcaaacgcuauaugcagugccguaccugugaauuggguuccaaccucuagaacgacuuggucaauucaugcacaccaccaguggaugacaacagaagauauguugucaguauggaaucgaguuuggauugaagaaaaucccuggauggaggauaagacgcacguaucgagcugggaagauguuccguauuuggguaagagagaggaucagugguguggcucuuuaauaggguuaacagcacgagcgacuugggccacaaacauucaaguugcaauaaaccaagucagaagacugauaggcaacgagaacuaccuggauuauaugacaaguaugaaaagauucaaaaaugaaagcgauccagaaggagcucuaugguag

SEQ ID NO: 21983 - RNA, 9879 nt, Artificial Sequence
  derived and/or modified CDS sequence (opt6) from DENV-1__JQ045628__SS-prME
agugugacuaugcucuugaugcugaugcccacggcccuggcguuccacuuaacaacaaggggaggagaaccacacaugauaguauccaagcaagaaaggggaaagaguuuacuuuuuaaaacaucugcugguguuaacauguguacacuuauugcgauggaucuaggugaacuuugugaggauacaaugacauacaaguguccgcggauuacagaaacggaaccugacgauguugauuguuggugcaacgcuacagauacguggguaacguaugguacaugcucgcaaacgggagaacaccgacgagauaaaagaaguguagcacuagcaccccaugucggucuagguuuagagacgcguacggaaacguggaugucaagugagggagcuuggaaacagauucaacggguagagacaugggccuuaaggcacccggguuucacugucauagccuucuuucuagcucacgccauuggaacaagcauaacacaaaagggaauaauuuuuauacuuuuaauguuaguaaccccgucaauggcuaugcgguguguggggaucgggucccgagacuucguugaaggucugaguggggcaacuuggguagacguaguauuggagcacgguaguuguguuaccacaauggcaaaggacaaaccuaccuuggacauagaguuauuaaaaacggaagucacaaauccugcgauauuacgcaaacuuuguauagaggcaaagauuucgaauacuacgacagauaguagguguccuacacaaggcgaagcuacccuaguagaagaacaagacgccaacuucguguguaggcguacguucguagacagagggugggggaacggauguggauuguuugggaaaggaucacuuaucacaugcgcaaaauuuaaaugcgucaccaaguuagaagguaaaauaguacaauacgaaaauuuaaaauauucuguaauuguaacaguucauacaggugaccaacaccagguugguaaugaguccacggaacacgggaccacagcaacaauuacgccacaagcaccaaccacagaaauacagcugaccgauuauggagcccuaacucuagauuguaguccucgaacuggucucgauuucaaugagauggucuugcuaacuaugaaggagaaaagcugguuaguucauaagcagugguuuuuagacuuaccacuuccuuggacaucaggagccucaacaagucaggaaaccuggaaucgucaagauuugcuaguuacuuuuaaaacggcacacgcgaagaaacaggaaguaguaguucucggaucacaagaaggcgcgaugcacacagcacucacaggagcuacagagauucaaacuucggguacuacuaccauauuugcaggacauuugaaaugcaggcugaaaauggauaaauuaacacugaagggaaugaguuauguaauguguacaggcucauucaaacuggaaaaagaagucgcggaaacucaacauggaaccguccuaguucaaauuaaauaugagggcacugaugcuccuugcaaaauuccauucagcacucaggaugaaaaaggcguuacccaaaacggaagacucauaacggcaaauccaauuguaacagauaaggaaaagcccgugaacauagaggcugaaccaccauuuggagagucauauauaguaauaggagcaggcgaaaaagcacuuaagcucuccugguuuaaaaagggaagcagcauuggaaaaauguucgaggcgaccgcaagaggggcgcgaaggauggcaauauuaggagauacagcuugggauuucgggucaauuggaggggucuuuacgucgguagguaaauuaguccaucaaaucuucgggacugcauauggcguauuauucucaggaguaagcuggacaaugaaaauagggauaggugucuuauuaacuuggcuaggacuaaauucaagaucaacuucucuaaguaugaccuguaucgcagucgggcuaguuacacuauacuuggggguuaugguacaagcagauaguggaugugugaucaacuggaaaggcagagaauuaaaaugcggaucagggauauucgugaccaaugaaguacauacuuggacagagcaauacaaguuucaggccgauaguccaaaacgucugucagcagcuauaggcaaagcgugggaggaagguguaugugggaucagguccgcaacacgacuagagaauauuauguggaaacagauaucuaacgaacugaaucacaucuuacuagagaaugacaugaaguucacaguaguuguuggcgauguagcuggaauuuuagcacaagguaagaaaaugauuagaccccagccgauggaauauaaauacaguuggaaauccuggggcaaagcuaaaauaauaggcgcagacguccaaaauacuacauucauuauugacggaccaaauacuccugaauguccugaugaucaacgcgcauggaacauuugggaaguagaagauuauggcuuugguauuuuuaccacgaacauaugguuaaaacuuagagauuccuacacucaggucugcgaccaucgacuuaugagugccgcgauaaaagauaguaaagcuguacaugcggacaugggcuauuggauugaaagugagaagaacgaaacauggaaacuggcucgagcaaguuucauugaagucaagacauguaucuggccgaaaucccacacguuauggucaaauggaguguuagagucugaaaugaucauuccgaaaauuuacggcggaccgauaagccagcauaauuauagaccgggauauuuuacacaaacugcagguccauggcaccuuggaaaauuagagcuggauuucgaucuaugcgaggggacuacgguaguuguugacgaacauugcggaaauagaggcccuaguuuacgaacuacuacuguaacagguaaaauuauacaugagugguguugcaggucuuguacucugcccccacuaagguucagaggggaagacggguguugguacggaauggaaauacgaccuguuaaggaaaaggaggaaaacuuagucaaaagcaugguuuccgccgguucuggagaaguagacuccuucucauuagggcuucucugcauaaguauaaugauagaagaaguaaugaggucuagauggucaaggaaaauguuaaugaccggaacacucgccguauucuuauuauuaaucaugggacaauuaacguggaaugaucuaaucagauuauguaucaugguaggcgcuaaugccagugacaggaugggaauggguacaacauaucucgcgcuaauggcaacauuuaaaaugagaccgauguuugcuguuggacuucuuuucagaaggcuaacaucuagggaaguauugcuacuaacgauagguuugagucuaguggcuucaguagaauuaccuaauaguuuagaagaauuaggagauggcuuagcaaugggaauaaugauacuuaaacuauugacagauuuccagucacaccaacuaugggcaacucuccuuucccuaacguucauuaaaacaacauuuuccuuacauuacgcuuggaaaacuauggcuaugguuuuaucaauuguaagucuauuuccguuaugccuaagcacgacuucacaaaagacuaccugguuaccaguucuauugggaucacuugguuguaaaccauuaacgauguuccuaauagcggaaaauaaaauauggggucgacgaucuuggcccuuaaaugaaggaauaauggcaguuggaauaguaagcauccuacuguccagccugcucaaaaaugacguuccacuggcagguccccuaauugcgggagguaugcuuaucgcaugcuauguuauaaguggaagcucagcugaucugucgcuagaaaaagcggcggagguuuccugggaagaggaagcagaacauucgggagcaucucauaauauacugguugaagugcaagacgacggaaccaugaaaauuaaagaugaagaaagagacgauacauuaacuauauuguuaaaagcaacuuuacuugcaguuagcggaguuuauccauuaaguauaccagcaacauuauucgugugguauuucuggcagaaaaagaaacagaggucuggaguuuugugggacacuccgagcccaccagaaguugagcgugcuguccuagaugauggaauauaucgaauaaugcagcgugguuuauuaggccgaucacaagucggcgugggaguuuuccaggaaaacguauuccacacaauguggcacguuaccaggggugcugucuuaauguaucaaggaaaacgccuugaaccaucaugggcuagcgucaagaaagaccuaaucucuuacgggggagguuggagauuacaagguaguuggaauaccggggaagaaguacaaguaauagccguggaaccugggaaaaacccuaaaaauguucaaacuacuccuggaacauucaagaccuuagaaggggaggugggugcaauugcuuuagauuuuaaaccuggcacuucagguucaccuauugugaaucgagaagguaagauagugggacucuauggaaauggcguugugacaaccucagggacauacgugagugcuauagcgcaggcaaaagcaagccaagaagggccguugccagaaauugaggaugaaguauuucguaaaagaaaucugacuaucauggaucuucacccaggcaguggcaaaacgaggagguaucuuccagcaaucguuagagaggcaauaaagcggaaauuacgaacguuaauucuagcuccaacacgugugguggccucagaaauggcagaagcucuaaagggaaugccaauaagguaccagacaaccgcggucaaaagcgaacauaccggaaaggagauuguagacuuaaugugucacgcgacauuuacaaugcgucuucucagcccuguuagagugcccaauuauaauaugauaauuauggaugaagcccacuuuacugacccaucuucuauugcagcaagaggauauaucucaacacgugugggcaugggugaagcagccgcuauuuuuaugacagcaacucccccaggauccguugaggcauucccgcaaaguaacgcagucauacaagacgaggaaagagauaucccagaacgaucauggaauaguggguaugaauggauaacagauuuuccaggaaagacuguuugguucgugccgucgauaaaaucggggaaugauauugcaaacugucuucggaaaaacggaaagagagucauccaguuaucaagaaaaaccuuugauacagaguaucagaaaaccaaaaacaaugacugggauuauguaguuacuaccgacauaucggaaaugggagcuaauuucagagccgauagaguaauagauccucgaagaugucucaagccaguaauuuuaaaagaugguccggaaaggguuauacuagcagggcccaugccuguaacaguugccucugcagcacaaaggaggggacgcauaggaagaaaucacaacaaggaaggagaccaauauaucuacaugggacaaccccuaaacaaugaugaagaucacgcucacuggacagaagcgaaaauguugcuagauaauauaaacacacccgaaggcauuauaccggcgcucuuugaaccggagcgagaaaaaucugcugcaauagauggagaauauagauugaggggagaggcuagaaaaacauuuguagaauuaaugcgcagaggagaucuuccaguaugguugaguuacaaaguagcaagcgaagguuuucaguacagugaucguagaugguguuuugauggggaaagaaauaaucaaguucuggaagaaaauauggauguagaaauauggacaaaggaaggagaacgcaaaaaguuacgcccaagauggcuggaugcaagaacauauuccgacccacuagcuuugcgggaguucaaagaguuugccgcuggacgccguucaguuaguggagaucucauucuagaaaucgggaaacuaccucagcaccuaacacagagagcucaaaaugcguuagauaacuugguuaugcuucauaauucagagcaagguggccgugcuuaucgccacgcuauggaagaacuaccggauacaauagagacacuuaugcucuuagcacuuauugcaguauuaaccgggggaguaacucucuucuuucuaucggguagaggucugggaaaaaccagcauuggguuauuauguguaaucgcaucuucggucuuacuguggauggccagcguagaaccccacuggauugccgcuucaauuaucuuagaauuuuuccucauggugcucuuaauaccagagccagaucgacaacgcacaccgcaggauaaccaauuagcguaugucguaaucggcuuauuauuuaugauauuaacaguugcugcaaaugaaaugggcuuacuagaaacaacgaagaaagaucuugguauaggucauguugcagugggaaaucaucaucaugccgcaaugcuagacguugaccuucaccccgcgucugcguggacucuuuacgcaguugcuacaaccauaauaacacccaugaugcgucacacgauugaaaauacaacggcaaauauaucauugacagcaaucgcgaaucaagccgcaauauugaugggguuggacaagggguggccgauuaguaagauggauaucggagucccuuugcucgccuuagggugcuauucgcaaguuaauccgcuaacauuaaccgccgcaguacuaaugcuaguagcacacuaugcuaucauugggccaggacuacaagccaaagcaacccgugaagcacaaaaacgaaccgccgcuggcaucaugaagaacccaacaguugauggaauugucgcgaucgacuuagacccagugguuuacgacgcaaaauuugagaaacaacuaggacaaauaauguuauuaauauuguguacgucucaaauacuacuuaugagaacaaccugggcucuuugcgaaucgauaacucuugcaacagguccauugacuacccuaugggagggcagcccagggaaauuuuggaauacgacuauagcuguaaguauggcuaauauauuucguggaucauauuuagcaggagccggucuggcauuuuccuuaaugaaaucacuaggugggggccggcguggaaccggggcacaaggagagacacuuggagaaaaauggaagcgacaacuaaaccaguugaguaagagcgaauuuaauacauauaaaagauccggcauaauggagguugacaggucugaagccaaggaagggcuuaaacgaggcgaaaccacaaagcaugcaguaagucgugguacagcaaagcuaaggugguucguugaaaggaaccuaguuaaacccgaaggaaaaguaauagaccuuggauguggucgaggagguuggaguuacuauugcgcaggacuaaagaaagugaccgagguaaagggauauacaaaagguggacccggacacgaagaaccaauaccuauggccaccuacggauggaaccuuguuaaauuacacucuggcaaggauguguucuuuauuccacccgaaaaaugcgacacccuuuuaugugauauaggagaaucaucaccaaaccccaccauagaggaaggacgaacauuacgaguguugaaaaugguagaacccuggcugagaggaaaucaauuuugcauaaaaauuuugaauccuuacaugccaagcgucguugaaacacuagagcagaugcagagaaaacauggagguauguugguuagaaauccacuaucgcgaaacucuacacacgagauguacugggucaguuguggcacaggaaauauuguaagugcaguaaauaugacaucaagaaugcuguuaaauagguuuaccauggcucacaggaagccaacguaugaaagggacguggauuuaggcgcaggcacgcgccauguagcuguagaaccggagguagcuaauuuagauauuaucgggcaaagaauugagaauauaaaacacgaacauaaaagcacauggcacuaugacgaggauaacccauacaaaacgugggcauaccacggaucuuaugaaguaaaaccuaguggcuccgcuagcagcauggugaauggcguuguuaaguuauuaaccaagccaugggacguuauaccaaugguuacucagauugcaaugaccgauacgaccccauuuggucaacaacguguuuuuaaagaaaagguugacacucgaacaccuaaggcuaagcgagguacagcacaaauuauggaggucacugcaaaaugguuauggggauuccuaucacguaacaaaaagccaaggauuuguacaagagaagaguucacuaggaaaguacgcaguaaugcugcuauuggagcaguauucguugaugaaaaucaauggaacucagcuaaggaagcaguagaggacgaaagauucugggaccugguacacagagaacgagagcuccauaaacagggaaaaugugccacauguguguauaacaugaugggaaaaagggagaagaaacuuggagaauuugggaaagcaaaagguagcagagcaauuugguacauguggcugggugcacgauuccuagaauuugaagcacuggguuuuaugaaugaagaucauugguucaguagagaaaauucccuuuccggcgucgaaggagaggggcuucauaaauugggguacauucuacgcgauauaucaaaaauaccgggagguaacauguacgcagaugauacagccgggugggauacuaggauaacggaagaugaccuacaaaaugaagccaggaucacagacauaauggagccagaacaugcauuguuagcuaaaucaauuuuuaaauugacauaccaaaauaaggugguccguguucaaagaccagccaaaaauggaaccguuauggauguaaucucccguagggaucaaagaggaucaggacaagucggcacauacggcuuaaacacauuuaccaacauggaagcgcaauuaauccgacaaauggaaucugaaggcauauucucgccuucagaacuggaaacacccaaccuugcagaacgaguguuagacugguuagaaaaauaugguguugaacgguuaaaaaggauggccauaucaggugacgacuguguuguuaagccuaucgacgaucguuuugcaaccgcucuuacagcuuuaaaugauauggggaagguacguaaagacauaccacagugggaaccaucgaaaggauggaacgacuggcaacaaguaccguuuugcucccaucauuuccaucaauugauaaugaaagauggacgugaaaucgucguuccuugcagaaaccaagaugagcucguaggccgugcaagggucucucaaggagcaggauggucacuucgagaaacugcaugccucgggaaaagcuacgcacaaauguggcaguuaauguauuuccaucgccgggaucuaaggcucgcagcgaaugcaauaugcuccgcaguuccuguagauuggaucccaacaucacgcaccacauggaguauacacgcgcaucaucaauggaugacaaccgaagacaugcugucgguauggaauaggguuuggauugaagagaauccauggauggaggauaagacacauauaucgucuuggggcgauguuccuuauuugggaaaaagagaggaccaguggugcgggucauuaaucgguuuaacugcaagagcaacuugggcgacaaauauucaagucgccauuaaucaaguacggcgacuaaucgguaaugaaaauuaucuugauuauaugacuucuaugaaacgauucaaaaaugaaucugaucccgaaggagcgcuaugguaa

SEQ ID NO: 21984 - RNA, 9879 nt, Artificial Sequence
  derived and/or modified CDS sequence (opt6) from DENV-1__JQ045629__SS-prME
ucuguaaccauguuacuaaugcugaugccgacugcauuagccuuccacuuaacuaccaggggaggugaaccgcauaugaugguuucaaaacaagaacgcggcaaaagucuacucuucaaaacgucagcaggaguaaauaugugcacauuaauugcuauggaucucggugaacuuugcgaagacacaaugacuuacaaaugcccgcggaucaccgaaacggagccagacgauguugauugcugguguaaugcuaccgacacauggguaacauacgggaccugcagccagacgggugaacaccgacgagacaaacgaucggucgcacuagcaccacaugugggacuaggacuugagacacgaacagaaaccuggaugucgagcgaaggugcguggaaacaaauccagagagucgaaacgugggcacuccgucauccuggguuuacaguaaucgccuuauuuuuagcgcacgccauaggaacaaguauuacacaaaaaggaauaauuuuuauacuguuaaugcuaguaacaccaaguauggccaugagauguguggguauuggcucuagagauuuuguugagggacuaagcggagccacgugggucgauguggugcucgaacaugguucuugugucacaacuauggcgaaagauaaaccaacucuggauauagaauuauuaaagaccgaggucacuaauccggcagucuuacguaaacugugcaucgaagcaaagauuagcaacacuacaacggauaguaggugcccaacacaaggagaagcaacuuuaguagaggagcaagacgcuaauuucguguguagaaggacauuuguagaucgggguuggggcaaugguugcggacuuuucgguaaagggagucuuauaacaugugcgaaauucaaauguguaacaaaauuggaagguaaaauuguacaauaugagaaccuaaaauauuccguaaucguuacggugcacacuggagaucaacaucagguaggcaaugaaucaacagagcaugggacgacagcuacgauaacaccccaagccccaacuacggaaauacaguuaacggacuauggcgcccuaacguuagauugcaguccuaggaccgggcuugauuuuaaugagaugguacuucucacaaugaaggaaaagaguuggcugguucacaaacagugguuccuagaucuaccccuaccuuggacaucuggggcaucaacaagucaggaaaccuggaauagacaggaucuacucgugaccuucaagacugcacacgcgaagaagcaagaagugguuguccucggcagucaggaaggagcaaugcacacggcccuaacaggagcaacggaaauacagacaucaggaaccacuacaauuuuugcaggacacuuaaaguguagacuuaaaauggauaaguuaacacuuaaagguauguccuacguaaugugcacgggaucuuucaagcuagaaaaggaguuagcggaaacucaacaugguacaguucucguucaaauaaaauaugaagggaccgacgcuccaugcaaaauuccuuuuaguacccaagaugaaaaaggugucacccaaaacggaagguuaaucacugccaauccuaucgucacagauaaagagaaacccgugaauaucgaagcagaaccuccuuucggcgagaguuauauaguuauuggagcuggugaaaaagcacuaaaacuaagcugguuuaagaaagguucaucaauugggaagauguucgaggcaacugcaagaggugcgaggcguauggcuauacuuggggacaccgcuugggauuucggaucaaucggcggaguauuuacuucggucgggaagcucguacaccagaucuuuggcacggcauacgguguacuauuuaguggugucucauggaccaugaaaaucgguauaggaguccuauugacgugguuggguuuaaacucaaggaguacaagucuuucgaugacaugcauugcuguggggcuaguaacuuuguaucuuggaguaaugguccaagccgauagcggauguguaaucaacuggaaggguagagaacuaaaauguggcuccgguauuuucguaacuaaugagguucauacuuggacggaacaauacaaauuucaggcagauucgccuaaaagguuaucagcagcgauagggaaggcuugggaagaaggaguaugugggauaaggucugcuacuagguuagaaaauauuauguggaaacaaauuucaaaugaguuaaaucauauccucuuggaaaacgauaugaaguuuacugucguugugggcgauguugcagguauauuagcgcagggaaagaaaaugauacgcccacaaccaauggaguacaaauauucauggaaaaguuggggaaaagccaagauaauaggcgcggauguacaaaauacgacguucauuauagauggaccaaauaccccagaauguccagacgaccaaagagcuuggaauauaugggaaguugaggacuauggguuugggaucuuuacaacuaauauuugguuaaaacugcgagauucacauacccaaguaugugaucauagacugaugucugcagccauaaaagacaguaaagcgguucaugcggacaugggauauuggauagagucugagaaaaacgaaacauggaaacuugcaagagcgucuuuuauugaaguuaaaaccuguauuuggcccaaaucacauacccuuuggucuaacggaguacuagaaucagaaaugauaauaccaaaaaucuacggcgguccgauuucccaacacaauuaucguccgggauauuuuacucagacagcuggacccuggcaucuaggcaaacuugaacuugauuucgaccucugugaaggaaccacuguuguagucgacgaacauuguggcaauagggguccuucauuacgaacaacuaccgugacagguaaaaucauucacgaaugguguugucggaguuguacauuaccaccacucagguuucgaggggaggacgggugcugguacggcauggaaauuaggccaguuaaagagaaggaagaaaaccucgugaaaucaauggucagugcuggauccggcgagguugauucuuucucgcucggucucuuauguauaaguauaaugauugaggaaguaaugagaagcagauggucucgaaaaauguuaaugacuggcacguuagcgguauucuuucuauuaauuaugggacaauuaaccuggaaugaccugauacgucuuugcauaaugguaggggcgaaugcuucugauagaaugggcauggggacaacuuacuuagcucucauggcaacauuuaaaaugcgcccaauguuugcgguaggccuacuauucagacgucuuacuuccagggaaguucuucuuuuaacuauaggauuaagucuaguagccaguguugaacugccuaauucacuagaggaauuaggagacggacuagcgaugggcauaaugauauugaaauuacucacugacuuccaaucgcaucagcugugggcaacuuuacucagucuaaccuuuauaaaaacaacauucucauuacauuacgcuuggaaaacaauggcaaugguacucagcaucguaagucuauucccacucugccucaguacaacuucucagaaaacgaccuggcucccaguccucuugggaucauuaggauguaagccauuaacgauguuucuaauagcggaaaacaaaauuugggggcggagaucauggccauuaaaugaaggaauaauggcggucggcauagucucaauauuacuuucaagucuucuuaagaaugauguuccuuuagcaggcccauuaaucgcugggggaaugcuaauugcaugcuauguaauuucagggucaagcgcggaccugucccucgaaaaggcagcagaaguuucaugggaagaggaagcggagcauucaggagcaucacauaacauucuuguugaagugcaagaugauggaacgaugaagauaaaagaugaggagagagaugauacacucacaauccuacuaaaagccacauuauuggcuguaucuggaguauauccgcucaguauacccgcuacgcuguuuguaugguauuuuuggcagaagaagaaacagagaagcggcguauuaugggacacgcccucucccccagaaguugaaagagcgguauuagaugauggcaucuauagaaucaugcagagagggcuacucggaaggucacagguaggaguaggagucuuucaagaaaacguuuuucacacuauguggcaugugaccagaggagcaguucucauguaucagggaaaacgauuagagcccagcugggcuuccguaaagaaagauuuaauaucuuacggaggcggauggcgacuucaagguaguuggaauacuggagaagaaguucagguuauagcagucgaaccugguaaaaacccuaaaaacguucaaacggcgccaggaaccuuuaagacaccagagggcgaaguaggggcuauugcucuagacuuuaaaccuggaacaagcgguucccccauuguuaaccgagagggcaaaauagugggauuguacggaaacggaguaguuacuacaucagggacauaugugagcgcuauagcacaagcuaaagcaagccaagaaggaccgcucccagaaauugaagacgaaguauucagaaaacgaaaccuuacuaucauggauuugcacccugggucggggaaaacccgucgcuaccuuccggcgauuguaagggaagcuauaaagcggaaacuacgaacacucauccuugcaccaacacguguuguugcguccgaaauggcagaagcgcucaaagggaugccaauuagauaucaaacuacagcaguaaaaagcgaacauacggguaaagaaauuguagauuuaaugugucacgcgaccuuuacgaugaggcuacuaucgccugugagaguaccuaauuauaauaugauaauaauggacgaagcacauuuuaccgauccaucaucuauagcugcgcgaggauauauuucaacccgaguuggcaugggcgaggccgccgcaauauucaugacggcaacuccaccugguagcguggaagcguucccucaauccaaugccguaauucaagaugaagaacgugauauaccggaaagaaguuggaauagcgguuacgaauggaucaccgacuucccuggaaaaacaguaugguucgugccuucuauaaaaucgggaaaugacauugcaaacugucuaaggaaaaacgggaaaagagugauucaacuuucaagaaaaacguuugauacagaauaccagaagacuaaaaauaaugacugggauuauguagucacaaccgacauaucagaaaugggcgccaacuuuagagcugacagagucaucgauccaagacgaugccuaaaaccuguaauccuuaaggaugggccggagagaguaauccuagcgggucccaugccaguuaccguagcaucggccgcacaaaggcgggggcgaauaggacgaaaucacaacaaggaaggcgaccaauacauuuacaugggacaaccauugaacaacgaugaagaucaugcgcauuggacggaagcgaaaaugcugcuagauaacauuaauacuccggaaggcauaaucccagcgcucuuugaacccgaacgagaaaagagugcagcuauagauggagaauacagacuaagaggggaggcucgaaaaacuuuuguugaauuaaugagacguggagaccuaccgguguggcugagcuacaaagucgcuagcgaagguuuccaauauuccgacagaagauggugcuuugacggagagcguaauaaccagguguuagaagagaauauggauguagaaauauggacuaaagaaggagaaaggaagaaacuaagacccaggugguuggaugcgagaaccuacagcgauccacuggcccuaagagaauuuaaagaauuugcggcuggacgcagaaguguaaguggcgauuuaauuuuagagauaggcaaacugccacaacauuuaacucaaagggcacagaaugccuuggacaacuuaguuaugcuccauaauucagaacagggaggucgggcauaccgacaugcaauggaggaguugcccgauaccauugaaacccucaugcuuuuggcucuaauugcgguucugacaggugguguuacucuauuuuucuuauccggaagaggauuaggaaaaacaucgauuggacuauuaugcguuauggcaucaucaguucuacuauggauggcaaguguagaaccucauuggauagcugcauccaucauacucgaguuuuucuugaugguucuuuugauaccagaaccagacagacagagaacuccacaggacaaccaauuagcuuauguaguaauaggucuacuauuuaugauucuaaccguugcagcaaaugaaauggggcuauuagaaacuacaaagaaggaucuuggaauaggacacguugcugucgaaaaccaucaccaugcagcuaugcucgauguagaccuacacccagcuucggccuggacuuuauaugccguugcgacaacuauaauuacucccaugaugcgccauacaauagaaaauacaaccgcuaauauaucgcucacagcuauagcaaaccaagcggccaucuuaaugggauuagauaaaggcuggccaaucaguaaaauggacauaggagucccguuauuagcuuuggguuguuauucacaggucaacccccucacauugacggcagcaguauuaauguuggucgcgcauuaugcuauaaucggcccaggccuucaagcuaaggcgacccgagaagcucaaaaacgaaccgcagccggaaucaugaaaaauccuacgguagacggcaucguagccaucgaucucgauccugugguauaugaugccaaguucgaaaagcaacuaggucagauaaugcuacuaauacuguguacaucacaaauacuacuaaugagaacuacaugggcucuaugcgaaucgaucacgcuggcgacugggccucuaacaacucuuugggagggaagcccaggcaaauuuuggaacacuacgauagcagugucaauggcaaauauuuucaggggaucauaucuagccggugcuggauuagcauucucucuaaugaaaagccuaggcggaggccgcagaggaacaggagcacaaggugaaacauuaggagagaaguggaaaagacaacuaaaucaacuaucaaaaagugaauuuaacaccuauaaacggucaggaauaauggaaguugaucgaagcgaagccaaagaaggccuaaaaagaggcgaaaccacaaaacaugcuguaagucguggaacagcuaaauuaagaugguuuguagaacgaaacuuaguaaaaccugaggguaagguuaucgaucuaggauguggccgugguggcuggaguuacuauugcgcagguuugaagaagguaacagaagucaaggguuauaccaaaggagguccgggacaugaagaacccauaccuauggcuacauacggauggaaucucguaaaacuccauaguggcaaagaugucuucuuuauacccccugaaaaaugugacacauuacucugugacauuggagaaaguucacccaacccaacaauagaagaagguagaacccuaagagugcuuaagaugguagagccauggcuuaggggaaaccaauuuugcauaaaaauacuaaacccauauaugccuucggugguugaaacccuagaacaaaugcaacguaaacacggagguaugcuaguaagaaacccucuaaguaggaacucgacucacgaaauguauuggguaucaugugguacgggaaacauaguuucggcaguaaauaugacaagccgcaugcuucucaauagauuuacgauggcucacagaaaacccacauaugaacgagacguugacuugggcgcgggaacaaggcacguagcagucgagccagaaguugcuaaccucgauauaauuggucaaagaauagaaaauaucaaacaugagcacaagucaacguggcauuacgacgaagauaaucccuacaaaacuugggcuuaccacgguucuuaugaagucaagccuucagggucagcuucaucuaugguaaaugguguagugaaauuauuaacgaaacccugggacgucaucccuaugguaacccaaaucgccaugacggauacaacacccuucggucaacaaaggguauuuaaggaaaaagucgacaccagaacgccaaaagcuaagcgaggaaccgcacaaauaauggaggucacugcaaagugguuguggggguuuuuaucaagaaauaagaagccgcgaauaugcaccagagaagaauuuacccgaaaaguacgaucaaaugcagcaauuggugcgguauuuguugacgagaaucaguggaacagcgccaaggaagcaguugaagacgaacgauuuugggauuuaguacauagagagcgggaauuacauaagcagggaaaaugcgcaaccugcguauauaauaugauggggaaacgggagaagaaauuaggugaauuugguaaagccaaaggaucaagagcaauaugguauauguggcugggcgcucgguuuuuggaauuugaagcucuagguuucaugaaugaagaucacugguuuucucgagaaaacagcuuaucgggcgucgaaggagaaggucuccacaaauuaggauacauacuaagagauaucaguaaaaucccagguggcaauauguacgcagacgauacagccgguugggauacccgaauaacugaagacgaccuccagaacgaagcacggauaacugacauaauggagccagaacacgccuuauuagcaaaaucaauuuucaaguuaacauaucaaaauaagguuguucgaguucaaagaccugcuaaaaacggaacuguuauggauguaauaucacguagagaucaaagagggucaggacaggugggcacuuaugggcuaaauacauucaccaauauggaagcucaguuaauacggcagauggaaucagaaggaauauucucuccgagugaauuagaaacgcccaauuuagcagagcgaguucuggauuggcuugaaaaguaugguguugaaagauugaaacggauggcgauaaguggagaugacugcguagugaaaccaauugaugaccguuuugcgaccgcacugacugcuuugaaugauaugggaaaaguuagaaaagauaucccacaaugggagccuuccaagggauggaaugacuggcaacaaguuccuuuuuguagucaccauuuucaucaauuaauaaugaaagacggaagagagaucguuguaccuugccgcaaucaagaugaauugguaggaagggccagagugagucaaggugccggguggucucuucgugaaaccgcuugcuuaggaaaaucuuacgcacaaauguggcaacuaauguauuuucauagaagagaucugcgcuuagcagcuaaugcaauuuguagugccguuccgguagacuggauacccacaagucgaacuaccuggucaauccaugcucaccaccaauggaugacaacagaggauaugcugagcguauggaauaggguuuggaucgaagaaaauccuuggauggaagauaaaacgcauauaaguucauggggagacguaccuuaucucggaaagagagaagaccaauggugcggaaguuuaauaggacucaccgcgcgagcuacaugggcgacaaacauccaaguugcuaucaaucaggucagaagauugauagguaaugaaaauuacuuggauuauaugacaaguaugaaaagauuuaagaaugaaagcgauccagaaggcgcguuaugguag

SEQ ID NO: 21985 - RNA, 9879 nt, Artificial Sequence
  derived and/or modified CDS sequence (opt6) from DENV-1__JQ045630__SS-prME
ucugucacaauguugcuaaugcucaugccaacagcgcuugcuuuucacuugacuacucggggaggagaaccacacaugaucgucucuaaacaagaaagagggaaauccuuauuauuuaaaacuagcgcagggguaaauauguguacuuugauagcuauggaccuaggugaauuaugugaagauacuaugacuuauaaauguccuagaauaacggagacugaaccugacgauguugacugcuggugcaaugcuacugauacuuggguuacauacgguacgugcagucaaacuggagaacaccggagagauaaaagaaguguugcauuggcgccccauguuggguuaggccuagaaacacgaacggaaacuuggaugucaucugaaggcgcguggaaacaaauccaacgcguugaaaccugggcccucagacacccaggauuuacuguuauagcucuauuccuugcgcaugcaaucggaacuucaauaacucaaaaaggaaucauauuuauauuauuaauguuaguaaccccuuccauggcaaugagauguguuggcauuggaucucgagacuuuguagaaggacucucuggagccacuugggucgauguaguuuuggagcauggaucaugugucacuacaauggcaaaagauaaacccacauuagauauagaauuauuaaaaacugaagugaccaacccagcgauacuacgaaaacuauguauugaagcuaaaauuagcaacaccacaacggacagcagauguccuacacaaggcgaggcaacauugguugaagaacaagaugcaaacuucgugugcagaagaacguucgucgauagaggcuggggaaauggaugcgguuuguuuggcaaaggcucacuuauaaccugcgcgaaauuuaaauguguuacgaaacucgaaggaaaaauuguacaguacgagaaucugaaauacagcgugaucguuacagugcacaccggagaccaacaucaagucggaaacgaaucaacggaacaugggacuacagcaacaauaaccccacaagcuccaacgacugaaauacaauugacagacuauggugcuuuaacgcuugacuguucaccgagaacuggauuagauuucaacgaaaugguguuacuaacaaugaaagagaaaagcugguuaguacauaaacagugguucuuagaccugccauuaccauggacuagcggagcauccacuucgcaggaaacuuggaaccgacaagaucuacuuguaacauucaaaacagcgcacgcuaagaaacaagaaguaguugugcuggguucucaagagggcgcuaugcauaccgcauuaacgggugcaacagaaauccaaaccucagggacgacgaccaucuuugccggucaucugaaaugccgacuaaaaauggauaaacuaacuuuaaaagguaugucuuauguaaugugcacaggcucguuuaaacuugaaaaagaaguagcagaaacgcaacaugggacggucuugguacagauaaaauaugaagggacagacgccccuuguaagauucccuuuucgacacaagacgagaaagguguaacacagaaugggagacuaaucacggccaaucccauaguuacugacaaagaaaagccuguaaauauugaagccgaaccuccguuuggcgaaaguuacauuguaauuggugcuggugaaaaggcacucaaauuaucaugguucaaaaagggaaguucuauugguaaaauguucgaggcaacugcgagaggcgcccguagaauggcaauucuuggggacacagcuugggacuucgguucgauagguggcguguuuacaucaguuggaaaguuaguacaucagauuuucgggacugcuuauggaguuuuauucucaggggucuccuggacgaugaaaaucgguauagguguacuauuaacauggcuuggccuaaauucccggaguacuucuuuaucaaugacauguauugcgguaggguuaguaacccuuuacuuaggaguaauggugcaagcagacucgggauguguuauaaauuggaagggccgagaacucaaaugugggucgggaauauucguuacuaaugaagugcacacuuggaccgaacaauacaaauuccaagccgauucuccgaaacgacucagcgcagcuauaggaaaagccugggaggaaggagucuguggaauacguagcgcaacccgcuuagaaaauauaauguggaaacagauauccaaugaacuaaaucacauauuacuagaaaaugacaugaaauuuaccguugugguuggagaugucgccggcauccuugcucaaggcaagaaaaugauacgaccacagccaauggaauauaaauauucuuggaaaucauggggaaaagcuaaaaucauuggugcggauguucaaaauacaacuuuuaucauagacgggccaaacacaccggaauguccugacgaccagcgagcauggaacauuugggaaguggaagauuaugguuuugggauauucaccacaaacauuugguuaaaacugagagauucuuauacccaagucugugaccauagacuuaugucagcugcuauuaaagacagcaaagcuguccaugccgauauggguuauuggaucgaauccgagaaaaaugaaacuuggaaauuagcaagagcaucauuuauagaagugaaaacuugcauauggccuaaaucccacacccuuuggaguaacggugugcuugaaucagaaaugauaauucccaagauuuacgguggucccaucucacaacauaacuaucgucccggauacuuuacucagacugcgggaccuuggcaucugggaaaauuagaauuagauuuugaucugugugaaggaaccacaguaguaguugaugaacauugcggaaaccgggggccgagucugcgaacgaccacaguuacagggaaaauuauccaugaaugguguuguagaaguuguacgcugccaccacuuagauuuagaggcgaagaugguugcugguacggaauggaaauccggccaguuaaagagaaagaagagaaucucguaaaaucaaugguaucagcaggguccggagaagucgauaguuuuucgcuggguuuguuguguauaucgauaaugauagaagaaguaaugcgaucacggugguccaggaaaaugcuuaugacaggaacacuagcugucuuucuauugcuuauuaugggccaacuaacuuggaaugaccuaauaagacugugcauaauggucggggcaaaugcgucugauagaaugggaaugggaacgaccuauuuagcccuaauggcaacauucaagaugcgucccauguuugcuguaggauuauuguuuagaagacuuacgagccgagagguacugcuguuaacuaucggacuaagucucguugcaucaguugagcucccuaauucguuagaagaacugggagacggcuuggcgaugggaauaaugauccucaaacuacuuacugauuuucaaagccaccagcuaugggcgacauuguuaucuuugacuuucauuaagacgaccuuuagucugcauuaugcauggaaaacuauggcaaugguauugagcaucgugucacuauuccccuuaugucuaucgaccacgagucagaaaacaacauggcuaccaguacucuuagggaguuugggcuguaaaccacuaacaauguuuuugauagcggagaacaaaauauggggacgcagauccuggcccuuaaacgaaggaauaauggcuguuggaauagucucaauacuauugucgucucuuuugaagaacgaugucccgcuagcgggcccucuaaucgccggagguauguuaaucgcaugcuauguuauuucagguaguuccgcagaccuuagcuuagaaaaagccgcggaagugaguugggaagaagaagcagagcauagcggcgcuagucacaauauucugguagaggugcaagaugauggaacuaugaaaaucaaagacgaagaacgcgacgauacguuaacuauuuuauuaaaggcaacuuuacuagcagugucagggguauauccccuaagcauuccagcuacauuauucguaugguacuuuuggcagaagaagaaacagagaucagggguauugugggauacacccucaccaccggaaguagagagagcuguacucgaugauggaauuuauagaauaaugcaaagaggccuguugggcagaucucaggucggugugggaguauuucaggaaaauguauuccacacuauguggcacguaacaaggggagcgguacugauguaccaaggaaaaagacuugaaccuuccugggccagcgucaagaaagauuuaauaucuuauggggguggauggagacuacaggggagcuggaacacaggugaggagguccaaguaaucgcagucgagccaggaaagaaucccaaaaauguacaaaccacacccgguacuuucaagaccccugaaggugagguaggugcgauagcccuagauuucaaaccgggaacgucaggcuccccuauuguaaaucgcgaagggaaaauaguaggucuuuacgguaaugguguugugacaacuagcggaaccuauguuucggcaauagcacaagccaaggcuucacaggaaggaccucucccagaaauagaagaugaaguauuuaggaagagaaaucuuacaauaauggaucuucauccaggaucggggaaaacaagacgcuauuuaccagcuaucguucgagaggcuaucaaacgaaaauuaaggacgcuuauacuagcccccaccagaguuguagcgucagaaauggcugaagcacuaaaaggaaugcccauccgauaccagacuacagcaguuaaaucagaacauaccggaaaagaaaucguagaucugaugugucaugccacuuucaccaugagauugcuaucgccaguaagaguaccaaauuacaauaugauaauaauggaugaggcucauuuuacugauccuucuaguauagcggcacguggguacaucucaacaagaguugguaugggcgaagcugcugcaauauuuaugacagcaacgccaccggguagcguugaggcuuuuccacaaucuaacgcggugauucaagaugaagaaagagauauaccugaaaggaguuggaacucagguuaugaauggauaacugacuucccaggaaagacagucugguuuguuccaucaauaaaaaguggcaaugauauugcgaauugcuugaggaaaaacggaaaacggguaauacaacugucaagaaaaacauuugauacagaauaucagaagaccaaaaacaaugacugggacuauguaguuacuacagacauuagugagaugggugcaaauuuccgagcugaccgaguaaucgaucccagacgaugccuaaaaccugucauucuaaaagauggcccagaacgcguaauucucgcgggaccuaugccuguaacaguagccagugcagcccagagaagaggacgaauugggaggaaccauaauaaggagggugaccaauacaucuauaugggacaaccucugaauaacgaugaagaccaugcgcacuggacagaggcgaaaaugcucuuagauaacauaaauacaccagaagguauuauaccugcauuguucgaaccggaacgggaaaagagcgcagccauugauggagaguauaggcuuaggggagaagccaggaaaacguucguugaacuaaugcgucgaggugaucuccccgugugguuaucguacaaaguagcaucagaaggauuucaauauucugaucgucguuggugcuucgacggagaacgaaacaaccagguacuagaagagaacauggacguagaaauauggacaaaggaaggagaaaggaagaaacuacguccuaggugguuggacgcgagaaccuauucagacccauuagcacuacgagaauuuaaggaauuugcugcuggacguagaagcguuaguggugaccucauuuuggaaauugggaagcucccacagcaucucacacaacgggcucagaacgcacuugauaaccucguaauguuacauaauucagagcaaggagggagagcauaucgacaugcaauggaggaguuaccggauacaauagaaacauuaaugcuauuagccuuaauagcugugcuuacaggagguguaacccuauuuuucuuaucuggccguggcuuaggaaagacaucaaucggccuuuuaugcguaauagcaaguuccguauuguuguggauggcuucagucgaaccacacuggaucgcggccucuauaauacuggaguucuuucuaaugguucucuugauaccagaaccugaccggcaacgaacaccccaggauaaccaauuagcauacguaguaaucggacucuuauucaugauauuaacaguagccgcgaaugaaaugggacuguuagaaacaaccaaaaaggaucucgguaucgggcacgucgcggucgguaaccaccaucaugcggcgauguuggaugucgaccuacaucccgcgucugcauggacuuuguaugcaguagcaaccacuaucauaaccccaaugaugcgccauacgauagagaauacuacugccaauaucagucuaacagcuaucgcuaaccaggcugcuauacuuaugggacuugauaaaggguggccaauaucuaagauggacaucgggguaccauuacucgcucuggguuguuacucccaggucaauccucuaacgcuaacagcagcgguauuaauguuaguagcgcacuaugcgaucauuggcccggguuuacaagcaaaagccacccgugaagcccagaaaagaacagcugcggguaucaugaaaaaucccacaguagacggaauaguugcaauagaucucgaucccguagucuaugaugcuaaauuugaaaaacaacucggacaaauaauguugcugauacucuguacgucucaaauacuacucaugcgcacaacaugggcccuaugcgaaaguauaacccuugcuaccgggccccuaacuacccuaugggaaggcuccccuggaaaauuuuggaauacaacaauagcagucagcauggcuaacauuuuucgagguuccuauuuagcaggagcggggcucgcauuuucgcuuaugaaaucguuaggagggggucggagagggacuggugcacaaggugaaacuuuaggagagaaguggaaacgucagcuuaaucaauuaaguaagagugaguuuaauacauauaaacguucaggaauuauggaaguagaccgcucagaggcuaaagaggggcucaaaaggggugaaacgacuaaacacgcuguaucacgugguacagcaaaguuacgcugguuuguggaaagaaauuuagucaaacccgaaggaaaaguaauagauuugggaugcggcagaggaggcuggagcuacuauugcgcaggacucaagaaaguaacagaggugaaaggguacacgaaaggggguccaggucaugaagaaccaauuccaauggccacuuauggguggaaucuuguuaaacuucacucgggaaaagaugucuucuuuaucccuccagagaagugcgauacacuacucugcgacauaggugaaucaucaccuaacccaacgauugaagaagggcgcacacuucgaguacuaaagaugguugaaccauggcucagggguaaccaauucuguauaaaaauccuaaauccauauaugccuucuguagucgaaacuuuagaacaaaugcaaaggaaacacggggguaugcuuguccggaacccauuaucgagaaacucuacgcaugagauguauuggguuaguuguggaacagguaauauaguaucugcagucaauaugacuucccgaaugcuauuaaaucgauuuacuauggcacaccgcaaaccaacauaugagagagacguagaccucggagcaggaacacgucauguagcagucgagccagaaguggcaaaucuagacauuauagggcagcguaucgaaaauaucaaacaugagcauaaaucaacguggcacuaugaugaagauaacccguauaagacuugggcauaucauggaagcuaugaaguaaagccgucggguucagcaagcucuaugguaaauggaguaguaaagcuauuaacuaagccaugggaugugauacccauggucacgcaaaucgcaaugaccgauacaaccccuuucgggcaacaaagaguuuucaaagaaaaagucgacacaagaaccccaaaggcaaaaagagggacagcgcaaauaauggaagugacggcaaaauggcuauggggauuucuuucaagaaauaagaaaccgagaauauguacaagagaagaguuuacgagaaagguucgaucaaacgcagcgauaggugcaguauucguugaugagaaucaauggaacucagcgaaagaagccguggaggaugaaagauuuugggaccuaguacauagagaacgagagcuacauaaacaaggaaaaugugcgacauguguauauaauaugaugggcaaaagggagaagaaauuaggagaguucggaaaggcuaaaggcaguagagcaauuugguacaugugguuaggagcaagauuuuuagaauuugaggcacucgguuuuaugaaugaagaucacugguucucacgugaaaacaguuuaucaggugucgagggagaggguuugcauaagcuaggcuacauauuacgagauauaaguaagauaccgggagggaauauguacgcagaugauacagcaggaugggauacaagaauaacagaagaugauuuacagaacgaagcacguauaacugauaucauggaaccugaacaugcauuacuugcaaaauccauauucaaauugacguaucagaauaaaguaguuagaguucagagacccgccaaaaauggcaccguaauggaugugauaucgcgaagagaccagcgugggucaggucaaguugggacauacggauuaaacacguucacaaacauggaagcucaacucaucagacagauggaaagugaaggaauauuuucaccuucggaacuggagacaccaaaucuggcagaaagggucuuagauuggcuagaaaaauauggcguagaaagacuaaaaagaauggcuauaucaggagaugauugcguuguuaaaccgauagaugaucgauuugcaacugcauuaacggcauuaaacgauauggguaaaguucguaaggauauaccacaaugggaaccaucaaaagguuggaacgacuggcaacagguuccauuuuguucccaucacuuccaccaguugaucaugaaggauggaagggaaauagucguaccuugccgcaaccaagacgaauuggucggccgagcaagaguuucacaaggagcgggauggagcuuaagagaaacagccugccugggaaaaucauaugcacaaauguggcaauugauguacuuucacagacgagaucugagacuugcagcgaacgcaauauguagugcuguaccaguugauuggaucccaacuucacgaacgacauggucaauucaugcucaucaccaauggaugacgacagaagauaugcugagcgucuggaaucgaguuuggauugaagaaaacccauggauggaagacaaaacacacauaucaucuuggggagauguuccguaucuuggaaaacgagaagaucaguggugcggcaguuugauagguuuaacggcaagagcaacaugggcuacaaacauacaaguugcaauuaaucagguuagacgccuaaucgggaacgagaacuacuuagacuauaugacuagcaugaagcgcuuuaaaaacgagagugaucccgaaggggcuuuaugguaa

SEQ ID NO: 21986 - RNA, 9879 nt, Artificial Sequence
  derived and/or modified CDS sequence (opt6) from DENV-1__JQ045632__SS-prME
ucugugacuaugcuccuaaugcucaugccaacugcacuagcauuucauuuaacuacacguggcggggaaccgcauaugauaguuuccaaacaagaaaggggcaaaucucuauuauuuaaaacaucagcggggguaaauauguguacucuaauugcaauggaucuaggggaauuaugugaagacacgaugacguacaaauguccucgcauaacagaaaccgaaccagaugacgucgauugcugguguaaugcuacagacacguggguaacguacggcacaugcucgcagacgggagagcauagacgagauaaacguucugucgcucuagcaccucauguaggcuuaggacuagaaaccaggacagaaacauggaugaguagcgaaggcgcguggaaacaaauucagcgaguagagacaugggcauuacgccacccgggguuuacuguuauagcucucuucuuagcucaugccauaggaacuagcauaacacaaaaaggaauaauuuucauccugcuuauguuagucacaccuucaauggcaaugcggugcgucggcauugguagcagggauuuuguagaaggccuaucaggggcuacuuggguugaugugguauuagaacacggaucauguguuacaacuauggcaaaagacaaacccacacuugauauagagcuauugaaaaccgaagugacuaauccugccguuuuaagaaaauuauguaucgaagcaaaaaucucaaauacaacgacugauucucgaugucccacacagggugaagccacccuaguagaagaacaagacgccaacuucguaugucgaagaacuuucgucgauagaggauggggaaacgguugugguuuauuugguaaaggaucacuaauaacgugugcgaaauucaaaugcguuacaaaauuagaagggaaaauaguccaauaugagaacuuaaaauauagcgucauaguaacuguacacaccggagaucagcaccaaguagguaaugagucgacagaacacgguacgacagcgacaauaacuccacaagcaccuacuacagaaauucaacucacugauuacggcgcauuaacauuagauuguuccccgaggacuggucuggauuucaacgaaaugguacuacuaacaaugaaagagaaaaguuggcuuguucacaagcaaugguuucuugaucuuccucuaccauggacuucgggggccaguacaucgcaagaaacguggaauaggcaagaccuacucguuacauuuaaaaccgcucaugccaagaaacaggaaguaguagugcuuggaagucaagaaggugcaaugcauaccgcuuuaaccggagcaacggaaauucaaacuucagguacgacaacuauauucgcggggcaucuaaaauguagauuaaaaauggauaaguuaacacuaaaaggaaugagcuacguaauguguaccggaucauuuaaacuagaaaaagaguuggcugaaacacaacaugguaccguauuaguccaaauuaaauaugaggggaccgacgcaccguguaaaauaccauuccuaacacaagaugaaaaaggcgucacucaaaacggaagacucaucaccgcuaauccuauugucacugauaaagagaagccuguaaauaucgaagcagaaccaccauucggagaaucauacaucguaauuggcgccggcgaaaaggcacuaaaguuaucuugguucaaaaagggcaguucuauaggcaaaauguucgaggcaacugcucgaggugcaaggaggauggcgauccuuggugauacugccugggauuucggaucaauuggaggggucuuuaccucaauagguaaacuugugcaucaaauuuuugguacugcauauggaguacucuuuagcggcguaucauggacaaugaaaauagguauagggguacuccugacauggcuuggacucaauagccggucuaccucucucaguaugacauguauugcagucggacugguuacucuauacuuaggaguuaugguucaggccgauucaggcugcguuauuaacuggaaagguagagaauugaaaugcggaucuggaauauucguuacgaacgagguccacacuuggacugaacaauacaaauuccaggcagauucuccaaaacgacugagcgccgcaauuggaaaagcaugggaagaagggguuugugggauacgaucugcuaccagauuagaaaauauuauguggaaacaaauauccaaugaauuaaaccauauccuccuagaaaacgauaugaaauucacagucguuguuggagauguggcugguauacuugcgcaagggaagaaaaugaucagaccacaaccaauggaacauaaauauucuuggaaaucguggggaaaggcaaaaauaauuggcgcagauguucaaaauaccacauucauaauagauggcccaaauacgcccgaaugucccgaugaucaacgagcuuggaauauaugggaaguagaggauuacggauucggaauuuucacuaccaacaucugguuaaaauugagagacucguacacccaaguaugugaccauagacugaugucagcugcaaucaaagacucgaaagcaguacaugcggacaugggauauuggauagaaucggagaagaacgaaacguggaaauuagcucgcgcgagcuucauagaggucaagaccugcauuuggccaaaaagccacaccuuguggagcaacggugugcuagaauccgaaaugaucauuccgaaaauuuauggagguccuauuagccagcauaauuaucgcccagguuauuucacucaaaccgcaggaccuuggcaucuagguaaauuggaacucgacuucgaucugugugaagguaccaccguaguuguugacgaacacuguggaaauagaggaccaucauuacgaacaacaacaguuacugguaaaauuauucacgagugguguuguagaucuugcacauugccgccccugcgguuccgaggcgaagacggcuguugguaugguauggaaauuaggcccguuaaagagaaggaagaaaauuugguaaaaagcauggugucagcaggaucaggugaaguagauagcuuuaguuuggggcuauuaugcauuaguaucaugaucgaggaaguuaugcgcuccagauggaguagaaagaugcuuaugacggggaccuuggcggucuucuuuuuacuaaucaugggacaauuaaccuggaacgaucuaauacgucuauguaucauggucggggccaaugcauccgaccgaaugggaaugggaacaacuuauuuggcgcugauggcuacauucaaaaugagaccuauguuugcaguuggucuauuauuuagacgcuuaaccagucgugaaguuuuguuguuaacgaucggauugucacuuguagccucgguugaacuaccuaauucucucgaagaacuuggcgauggguuagccaugggaauuaugauucuaaaacuauuaacagauuuucaaucccaucaauuaugggccacccucuuaucacuaacauuuauuaaaacaacguuuaguuuacauuaugcuuggaaaacuauggcgaugguccuaagcaucguuucucucuucccgcucugccucuccacaacaagucagaaaacaacauggcugccagucuuguuaggaagccuuggauguaagccacuuacgauguucuuaauagcagaaaacaaaauaugggggcgcagaagcuggccucuaaacgaaggaaucauggcaguagggauuguaucgauauuacucagcucucuccuuaagaaugauguaccauuggcgggaccuuuaauagcgggagguauguuaauugcuuguuauguaauaaguggaucaagcgcagacuuaucauuggaaaaagcugcagagguaaguugggaagaggaagcagaacacagcggcgcgucccacaauauauugguagaaguacaagaugauggaacaaugaaaauuaaagaugaggaaagagacgacacucuuacgauucugcuaaaagccacguugcuggcuguaucgggggucuacccauuguccauaccagcgacauuauucguaugguauuucuggcaaaagaagaaacaacggucgggaguguugugggauaccccuucuccgccagagguagaaagagcaguucuugaugauggcauauacagaaucaugcaacgaggauugcuagggcggagucagguuggagucggaguauuccaagagaaugucuuccacacuauguggcacguaacccgaggcgcaguacuuauguaccaaggaaagagacucgaaccuucaugggcaagugugaagaaagauuuaauaucauauggugggggauggagguuacaagggucguggaauacgggagaggaaguacagguuauagccguagaaccgggcaaaaaucccaaaaauguucaaacugcuccagggacguucaagacaccagagggagaagucggagcgauagcauuagacuucaaacccgguacuucagguucccccauaguuaauagggaagggaaaauuguaggacuauauggaaacggaguaguuaccacuagcgguacguacguaagcgcuauugcacaggcgaaggcaagccaggaggguccacucccagaaauugaagaugaggucuucaggaaacguaaccuuacaauuauggaccuacauccuggaagcggcaaaacgagaagauacuugccagcgauagugagagaagccauaaaacguaaacuacgcacacuaaucuuggcaccaacacggguuguggcgagcgagauggccgaagcacucaagggaaugccaauaagauaccaaacgacagccguaaaaucugaacauacugguaaagaaauaguggauuugaugugucacgcgacuuuuacaaugagauuguuaagccccguacguguaccaaacuauaauaugauuauuauggaugaagcacauuucacggacccuaguucgauagcugcucguggguauauuucuacuagaguaggaaugggugaggccgcugcgauauuuaugaccgcuacaccgccagggucgguagaagccuucccacaauccaaugcaguaauacaggacgaggaaagagauauaccugagagaagcuggaacucaggauaugaauggauaacugauuuuccggguaaaacagugugguuuguaccgaguauaaaaucaggaaaugauauagcuaacugcuugaagaaaaauggaaaacgagucauacaguuaucaagaaaaacguucgauaccgaauaccagaaaacgaaaaacaaugacugggauuaugucguaacaacugacaucucugaaaugggugcaaacuucagagcagauagggugauagauccaaggaggugccuuaagccaguaauacuuaaagaugguccugagcguguaaucuuagccgguccgaugccggugaccguggcuagcgcagcgcaacggagaggaaggaucgggagaaaccacaauaaagagggagaucaauauauauacaugggucaaccacuuaacaaugaugaagaucaugcucacuggacagaggcaaaaauguuauuggacaacauaaauacuccugaagguauaauuccagcuuuguucgaacccgaaagggaaaaaucugcagcuaucgauggagaguaccgacuuagaggcgaagcgagaaaaacauuuguugaacucaugagacgaggagaucucccgguguggcuaagcuauaagguggcuucggaaggcuuucaguauucugauagacgguggugcuucgauggugagaggaauaaucaaguacuagaagagaacauggacguggaaauuuggacuaaagaaggugagaggaagaaacuacgaccacgguggcuagaugcaagaaccuauagcgauccgcuagcguuaagagaauuuaaagaguucgcugcagguagacguaguguaagcggugaucuuauucuagaaauuggaaagcugccacaacauuugacacaaagagcacaaaaugcucuagauaaucucguaauguugcacaauagugaacaaggugggagagcauauagacaugcgauggaagaguuaccugauacgauagagacauuaauauuacucgcauuaauugcaguauugaccgguggcguaacuuuguucuuucuaaguggaaggggcuuaggaaagacaucuauugguuuauuauguguaauggccaguuccguauuguuauggauggcaagcguugaaccccacuggauagcggcaucaauuauucuugaguucuuuuuaaugguccuccuaauuccagaaccagaccgccaaaggacuccacaggauaaccaauuggccuacguaguaauaggguuacuauucaugauucucacuguagcugcgaaugaaaugggauuacuugaaacaacuaagaaagaccuaggaaucggacauguagcgguagaaaaucaucaccacgcagcaauguuagauguagaucuucauccugccagcgcauggacauuauaugcaguagcgacaacaauaaucacacccaugaugagacauacaauagaaaacacaacugccaauauuagccugacugcaaucgcuaaucaagcggccauuuuaauggguuuagauaagggauggccaauaaguaagauggacauaggcguaccucugcuagcucuuggauguuacucacaggucaacccacucacacuuacagcagcgguacugauguugguagcacacuaugccaucauaggcccuggccuccaagccaaagcaacuagagaagcucagaaaagaacagcagcgggaauaaugaaaaauccaacaguagacggcauaguagcaauugaccuagacccgguaguauaugacgccaaguuugaaaaacaauuaggacaaauuaugcuacuaaucuuauguacgucucaaauucucuuaaugagaaccacuugggcauuaugugaaucaauaacacucgccaccggaccucuaacaacucuaugggaaggauccccugguaaauuuuggaauacaaccauagcaguuucgauggcaaacauauuuagagguuccuaccuagccggagcaggacuugcauuuucauuaaugaagucguuaggaggugguaggagagguacgggagcucaaggggaaacuuuaggugaaaaauggaagagacaacuuaaucagcucagcaaaagcgaguucaauacauacaagcgaagcggaauaauggaaguagacagaucagaagcuaaagaaggccuuaagagaggcgagacuaccaaacaugccguguccagaggaacagccaagcucaggugguuuguagaaagaaauuugguaaagccagaggggaaaguuauugaccuuggcugcgguagaggggguugguccuauuauugugcuggccucaagaaaguaacugaagugaaaggauauacuaagggaggucccggucaugaagaaccaauucccauggcaaccuauggcuggaauuuaguaaagcuccauucaggaaaagacguguuuuucauuccaccggaaaaaugugacacauuguugugcgauauaggcgaaagcaguccuaauccuacaauagaagaaggaagaacacuuaggguguugaagauggucgagccaugguuacguggaaaucaguuuuguauaaaaguauuaaauccauauaugccuucagugguugaaacauuagaacagaugcagagaaaacacgggggaauguugguuagaaacccacuaucucgaaauucuacgcaugaaauguacugggugaguugcggcacagggaauaucgugagugcagugaauaugacaaguaggauguuguuaaauagauuuacaauggcacaucgaaaaccuaccuacgaacgcgauguugauuuaggagcaggaaccagacacgucgcuguagaaccagagguugcgaauuuagauauaauuggccaaagaaucgagaauaucaaacaugagcacaaauccacuuggcauuaugaugaggacaauccauauaaaacaugggccuaucaugguaguuaugaaguaaagccaaguggaucggccagcucuaugguaaacgguguagugaagcuacuuacaaagccaugggaugucaucccaauggugacucagaucgcuaugacggauacaacuccauucggccagcaaagaguauucaaagaaaagguagauacgcggacgccgaaggcgaaaagaggcacagcccaaauuauggaaguaacagccaaauggcuguggggguuuuuaucucgaaauaagaaaccacguauuuguacuagagaagaguuuacaaggaaagugcguucgaaugcagcuauaggugccguguuuguugacgagaaucaauggaacuccgcgaaggaagcaguagaggacgaacgguucugggaccucguccaccgggagagggaauugcacaaacaaggcaaaugugcuacuuguguauauaacaugaugggaaaaagagagaagaaacuaggugaguucgguaaagcgaagggcucacgugcaauaugguacaugugguugggagcuagauuuuuagaauuugaggcuuugggauucaugaaugaagaucauugguuuagucgagaaaauucccugucagguguagaaggugaggggcuucauaaguuggguuauauauugcgagacauuaguaaaauaccagggggaaauauguacgcagaugacacugcaggaugggacacacguauuaccgaagacgaucugcaaaacgaagcacgaauaaccgacauuauggaaccugaacaugcccuauuagccaaauccauauucaaacuuacuuaucaaaauaaaguaguaagagugcagcguccagcuaaaaaugguaccgugauggauguaaucucaagaagagaucaaaggggaaguggccaagugggcacuuauggccuaaauacguuuaccaacauggaagcacaauuaaucagacaaauggaaucugaagguauauuuucuccaagcgaacucgagacacccaaccuagcugaacgaguuuuagauuggcuugaaaaauacggaguagagagauugaaacggauggcgauuaguggcgaugacugugugguaaagcccauugaugaucgauuugcuacugcauuaacagcauuaaaugacauggguaaagugagaaaagacauaccccaaugggaaccuagcaaaggcuggaaugauuggcagcaaguccccuuuuguucacaucauuuucaucaauuaauaaugaaggauggccgagaaauagucgucccauguagaaaccaggacgagcuggucggccgagcgaggguaucacaaggugcuggauggucauuacgggagaccgcaugucuaggaaaaucauaugcacaaauguggcaauuaauguauuuucaucguagggauuuacgucuugcugcaaaugcgauauguucugccgucccgguagauuggauaccaacaagcagaacgacauggagcauucacgcgcaucaccaauggaugacaacagaagauaugcucagcguauggaaucgagucuggauagaggaaaauccguggauggaagauaaaacacauauuucuucauggggagauguuccauauuuaggaaaacgggaagaucaguggugcgguuccuuaaucggcuuaacagcucgagccaccugggcuacgaauauccaaguagcaauuaaccaagugcggaggcuaaucgguaacgaaaauuaucucgacuauaugacaagcaugaaaagauucaaaaaugagagugacccggagggugcuuuaugguaa

SEQ ID NO: 21987 - RNA, 9879 nt, Artificial Sequence
  derived and/or modified CDS sequence (opt6) from DENV-1__JQ045633__SS-prME
ucuguuacuauguugcuaaugcuaaugcccaccgcucuugcauuucaccuuacaacgagagguggugaaccacauaugauugucucaaaacaagaacgaggaaaaucacuguuguucaaaacaagugcugguguaaauauguguaccuuaauagcuauggauuuaggagaauugugcgaagacacuaugacuuacaaaugcccgaggauuacugaaacggagcccgacgauguagauuguugguguaaugcuacugauacauggguuacauauggaaccugcagccaaacaggcgaacaccggagagacaaacgaucgguggcacuagcgccucauguagggcuaggguuggagacaagaaccgaaacauggaugaguagcgaaggugccuggaaacaaauacaaagaguagaaacaugggcacuucgccaucccggcuucaccguaauugcauuguuccuugcucaugccauaggaacaucgauaacgcaaaaagguauuaucuuuaucuugcuuauguuaguuaccccaagcauggccaugagaugcguagguauaggaagucgagauuucguugaaggauuauccggggcuaccuggguggaugucguucuugaacacggaagcugcguaacaacaauggcaaaagauaaacccacauuggauauagaacuauuaaaaacagaagucacgaauccagcgguacuuaggaaauuauguaucgaagccaaaauaaguaauacuacuacugauucacgaugucccacacaaggugaagcuacuuuaguagaagaacaagaugcgaauuuuguguguagacgaacuuuuguagaucgugguuggggaaaugguuguggacuuuucggcaaagggucauugauuacgugcgcaaaauuuaaaugcguaacaaaacuagaaggcaaaauuguucaauaugaaaauuugaaauauagcguaaucguaacaguacauacaggugaucaacaccaagucgguaaugaaaguacugagcauggaacuacggcuacaauaacgccacaagcaccaacaacugaaauccaauuagcagacuauggcgcacucacauuagauuguucaccgagaaccggacuggacuuuaacgaaaugguccuguuaacuaugaaggaaaagucauggcuaguacacaaacaaugguuucuagaucugccauuaccauggacaagcggagcaucaacgucgcaagagacauggaauagacaggaucuccuagucacauucaaaacggcucaugccaagaaacaagaggucguaguccugggcucacaagaaggagccaugcacacggcacuuacuggugcgacagagauacaaaccuccgguacaacaacaauauuugcaggccacuuaaaaugucgacuaaaaauggauaaacuuacauugaaagguauguccuauguuaugugcacaggcagcuuuaaacuugaaaaagagcucgcagaaacacaacaugguacuguucuagugcaaaucaaauacgaaggaacagacgcuccuugcaaaaucccauuuucaacgcaggaugaaaagggggucacacaaaauggccgcuugaucacggcgaauccaauaguaacagacaaagagaaaccggucaacauagaggcagaaccaccguuuggggaaagcuacauaguaauaggugcuggggaaaaggcuuuaaaguuaucaugguucaagaaagggucuuccauuggaaagauguuugaagcaacggcccgaggagcacgaaggauggccaucuuaggggacacagcaugggauuuugguucgauaggaggcguauuuacaagugugggaaaguugguacaccagauauuuggugccgcauacgggguguuauuuagugguguaucuuggaccaugaaaauugguauaggagucuuacuaacuugguuaggauuaaauucaagaucaacaagucuuucuaugaccuguauugcuguagguuuaguuacacucuacuuaggcgucaugguucaggccgauucggguuguguaauaaauuggaaagguagagaacucaaaugcggcagcggaauauucgucacaaacgaaguacauacauggaccgaacaauauaaauuucaagcagacagcccuaaacgacugagugccgcuauaggaaaagcaugggaagaaggugugugugguauaagaagcgcgacucggcuagaaaauauuauguggaaacaaauaucaaacgaacuaaaucauauccuccuugaaaacgacaugaaauucacagucguaguaggggauguugcaggaauccucgcucaagggaaaaagaugauuaggccgcaaccgauggaauacaaauacucauggaaaucuuggggaaaagcgaagauaaucggggcagauguacaaaauacgaccuucauuauagacggucaaaacacaccagagugcccggaugaucaaagggccuggaauauaugggaaguugaagacuauggauucggcauauuuacuacaaauaucuggcuuaaacuaagggacucguauacacaggucugugaccauagauuaaugucugcagcaauaaaagacagcaaggcaguccacgccgacaugggauacuggauagagucugagaaaaaugagacuuggaaguuagcuagagcaucauuuauagaagucaaaacauguaucuggcccaaaucacauacacuuuggucuaauggcgucuuggaaucugagaugauuauaccaaagauauacggugggccaauuucacaacauaauuacagaccaggauauuuuacccagacggcgggucccuggcacuuaggaaaguuagaacuggacuuugaccucugugagggaaccacuguuguaguagaugaacauugugguaaucgugguccgucgcuuagaacaacaacgguaaccggcaaaaucauacaugagugguguugucggucaugcacccucccaccacuucgauuucgaggagaagauggauguugguacggcauggaaauaaggccgguaaaggaaaaagaggagaaccugguaaagucuaugguauccgcagguagcggggaaguugauaguuucucauuaggacuguuaugcauuagcaucaugauagaggaaguuaugaggucucgauggucaagaaagaugcucaugacuggaacuuuggcaguuuucuuacuuuugaucaugggccaacucaccuggaacgauuuaauuaggcucugcauaaugguaggagcaaacgcgagugauagaaugggcauggggacgacguauuuagcauuaauggcaaccuucaaaaugagaccuauguuugccguuggauuauuauucagacgauuaaccucaagagaaguacuguuacuaacaauuggauuaagccuaguggcaagcguagaacugccaaauagccuagaggaacugggggauggguuagcgauggguauuaugauucuuaaacuucuaaccgauuuccaaucccaucaauuaugggcaacccuccuuucacuaacauucauaaaaaccacuuucaguuugcauuaugcuuggaagacaauggccaugguacuaaguauugugagcuuauuuccucuuuguuugucaacuacaagucagaaaaccacgugguuacccguacuauugggaucauuaggaugcaagccuuuaacgauguucuugauagcugaaaauaaaauaugggguagacgaucauggccucugaacgagggcauuauggcuguuggaauagugaguauauuauuaucuucguuacugaagaaugaugucccgcuugcggguccucuuauagcaggaggcauguuaauagcauguuauguuauauccgguucauccgccgaucuaucacucgagaaggcugcagaggucaguugggaggaagaagccgaacauucaggggcgagucauaauauucuaguagaaguccaagaugauggaacuaugaagauuaaggaugaagaacgggaugauacacuaacuaucuuacugaaagcaacauuacuagcuguaagcggcguuuauccgcucaguaucccugcgacucuauuuguaugguauuuuuggcagaagaagaaacaaagguccgguguucuaugggauacacccucacccccugaagucgagcgugcaguguuagaugacgggaucuaucggauuaugcaaaggggccuauuaggacguucgcagguagguguuggggucuuucaagaaaauguuuuucacaccauguggcacgucacaagaggggcaguguuaauguaucagggcaaacgauuagaaccaucaugggcaucggucaagaaagauuuaauaucguacggaggaggauggagauugcaaggcucauggaacacaggagaagagguacaaguaauagcaguugaaccugguaaaaaucccaaaaauguccaaacugcaccuggaacauucaagaccccugaaggugaagugggagcuauagcacuagauuuuaagccuggcacuuccggaucgccaaucguaaauagagaagggaaaauaguuggacuguauggaaaugguguuguuacgacuucgggcacauauguaucagcaauagcacaagcaaaagugucacaagaagggccacuaccugaaauugaggaugaaguuuuccgcaagcguaaucugacgauuauggacuuacauccaggcucaggcaaaacuagacgcuauuuaccagcgauagugagagaggccauaaaacgaaaauugcggacacuaaucuuagcaccaacgagaguaguagcaagugaaauggccgaagcccuuaaagguaugccaauaagauaccaaacaaccgcagucaagagcgaacauacaggaaaagagauaguggauuugaugugucaugcuacuuucacgaugagacuacuuucucccguuaggguaccuaacuauaauaugauaauuauggacgaagcacacuucacagacccaaguagcaucgcagcgcgugguuauauuuccacuaggguuggaaugggcgaagcagcugcuaucuucaugaccgccacgccaccgggaucaguagaagcguuuccucaaucaaacgcggugauacaagacgaagagagagacaucccugaaaggagcuggaacagcgguuaugaauggauuacagauuuuccugguaaaacggugugguuugugccaucaauaaaauccgguaaugauauagcaaacugccuacgcaaaaaugguaagagagugauucaauuaagccgaaagacuuuugauacagaauaucagaaaacuaaaaacaaugauugggauuacgucguuacuacggauauuucggaaaugggugcaaacuucagagcugaucgcguuauagauccaagacgaugccugaagccaguuauucuuaaagacgggccugagcguguaauuuuggcgggaccuaugccugucacaguagcaagcgccgcacaaagacgaggaagaauaggaagaaaucacaauaaagaaggugaucaguacauauauaugggacaaccccuuaacaacgaugaagaucacgcacauuggacagaagcaaaaaugcuacuggauaacauaaauaccccagaaggaauaauaccagccuuguuugaaccggaaagagaaaaaucggcugcaauugauggagaauauagacuuagaggugaagcacgaaaaacuuucguagagcuuaugaggcguggcgaccuuccuguaugguuauccuauaagguagcuuccgaaggauuucaguauagugacaggagauggugcuucgauggugaaagaaauaaucaaguacuugaggaaaauauggauguagaaaucuggacuaaagagggagaacguaaaaagcuccguccacgaugguuagacgcccguacguacagcgauccguuagcauuacgugaauuuaaggaauuugcagcuggacguagaucuguuaguggcgaccuaauuuuagaaauugguaaacucccacagcauuugacacaaagagcacagaaugccuuggauaacuugguuaugcuacauaauucagaacaaggggguagagccuaucgccacgcuauggaagaacucccagauacgauagaaacuuuaaugcuucuagcacucauagccguacuaacaggagggguuacauuauucuuuuuaucaggcagaggccuuggcaaaacaucaauaggauuguuaugcguuauggcuuccaguguccugcuauggauggcuagcguagaaccacauuggauagcagcuuccaucaucuuagaauuuuucuuaaugguacuuuugauuccugagccugauagacagcgcacaccucaggauaaucaacuugcuuauguaguuauaggccuacuuuuuaugaucuuaacaguagcagcaaaugaaaugggucuucuagaaaccacuaagaaagaccuagguauaggccacguagcaguagaaaaucaccaucacgcagccauguuagauguagauuugcauccugcaagcgcauggaccuuauacgcaguggcuacaacaaucauuaccccuaugaugagacauaccauagaaaauacaacggccaacauaucauuaacugcaauugcaaaucaagccgcaauauugaugggauuggauaaaggguggccuauaucgaaaauggauauaggagugccacuacuagcgcuuggaugcuauagucaagugaauccacuuacacucaccgcagccguuuuaauguuaguugcacauuaugcuaucauaggcccuggucuacaagccaaggccaccagagaggcgcagaaaaggacggcagcaggcauaaugaaaaacccaaccguagauggaaucguugcaauugacuuggauccaguaguuuacgacgcaaaauuugaaaaacaauuaggucaaauuaugcuucucauccuuugcacaagucagauccuacuaaugcguacgacuugggcgcucugugaaucgauaacauuagcaacaggaccauugacgacguugugggaaggcucaccagggaaauuuuggaauacuaccauagccguauccauggcuaacauauuucgaggaaguuaccuagcaggagcaggauuagcguuuucuuuaaugaaaagucuagguggaggucggcguggaacuggcgcacagggagaaaccuuaggagaaaaauggaaaaggcaauuaaaucaacuaucuaaaagugaauuuaacacuuauaagagaagcggcauaauggaaguagaccggucagaggcaaaagaaggcuuaaaacgaggggagaccacgaaauaugcggucucgcguggaacagcuaaacuccgaugguucgucgaacgaaauuuaguuaaacccgagggaaaagugauugaucucgggugcgggcgcggugguuggucauacuacugcgcuggccuuaagaaagucacggaagugaaagguuauacaaaaggaggaccgggucaugaggaaccaauaccaauggccacauacggguggaaucuuguuaaauuacauagugguaaagauguguucuuuguacccccugagaaaugugauacauuauuaugugauauaggagaaaguagcccuaaccccacaaucgaggagggaagaacauuacgaguucuaaaaaugguugagccguggcuacgaggaaaccaguuuugcauaaagauacuaaaucccuauaugcccagcgugguagaaacucuagaacagaugcaacgcaaacauggaggaauguuaguaagaaauccgcuaagcagaaauucaacacaugaaauguauuggguaaguugcgggacuggcaauauaguaucggccgucaacaugacuucaagaauguuacuuaaucgauucacuauggcccaucgaaaaccuacauaugaaagagauguugacuuaggagccgggacuagacacguugcgguagagccagaaguagcaaaucuagacauuauaggacagagaauagaaaacauuaagcacgaacacaagagcacuuggcacuaugacgaagauaacccuuacaagacuugggcuuaucacgguucuuaugagguaaaaccgucagggucagcaucgaguauggugaacggggucguaaaauugcugacaaagccgugggacguuaucccaaugguuacacaaauugcaaugacugacacaacgccauucggacagcaaagaguauucaaagaaaaaguggacacaagaaccccuaaggcaaaaaggggaacagcucagauaauggaaguuacggcuaaauggcugugggguuucuuaagucgaaacaagaaaccacggauauguaccagggaggaguucacacgaaaaguucgaucuaaugccgccauuggagcaguuuuuguagacgaaaaccaauggaacucugcaaaagaggcaguagaagacgaaagauucugggacuuaguccacagggaaagagaacuucauaaacaagguaaaugcgcaacauguguuuauaacaugaugggaaaacgggagaagaaacuuggagaauuugguaaagcaaaagguucaagggcuauuugguauauguggcuaggggcgagauuucuagaauuugaagcucugggguuuaugaacgaagaucauugguuuaguagagaaaauucacuuaguggaguugaaggagaagguuuacauaaacuaggcuauauacuaagagacauuuccaaaauucccgguggcaacauguacgcugaugacaccgcaggaugggauacccgaauaacugaggacgacuuacaaaaugaggcacggauaacagacauaauggaaccagaacaugcgcuacuugcgaaaucgauauuuaaacucacauaucaaaacaaggugguacgcguacagcggccagccaaaaacgguacggugauggaugucauaagucgacgagaucagagagguagcggacaagucggaacauauggauuaaacacguuuacaaauauggaggcgcaacuuaucaggcagauggaaagugaggggauauuuucacccuccgaacuugaaacaccgaauuuggccgaaagaguacuagacugguuagaaaaguauggaguagaaagacuaaaacgaauggcgauaaguggggaugauugcguaguuaagccgauugacgauagguucgcaacagcuuugacggcucuaaaugacauggguaaaguuaggaaagauauaccacagugggagccaucgaagggauggaaugauuggcaacagguucccuucuguucacaucauuuucaucaacuuaucaugaaagauggucgagaaauaguagugccuugccguaaccaagaugagcuuguuggacgagcucgaguaucccaaggugcgggcuggucguuaagagaaacagcaugcuuaggaaaaaguuacgcacaaauguggcaguugauguacuuucauagacgagacuuacguuuagcggcuaacgcaauauguuccgcggugccggucgauuggauucccacuagccgaacaacguggagcauucacgcccaucaucaauggaugacaacugaagauaugcuuucaguuuggaaucgaguuuggauagaagagaaucccuggauggaagacaaaacucauauaucaaguuggggugauguaccauaucuaggcaaacgggaagaucaguggugugggagcuuaauuggucuuacagcccgugcgacgugggcgaccaauauacaggucgcaaucaaccaagugaggcgucuuauugggaacgaaaacuaucuagacuauaugacuagcaugaaacgauuuaaaaacgaaagcgauccagaaggagcauuaugguga

SEQ ID NO: 21988 - RNA, 9879 nt, Artificial Sequence
  derived and/or modified CDS sequence (opt6) from DENV-1__JQ045634__SS-prME
ucagugacaaugcuucuuauguuaaugccaacggccuuggcauuccauuuaacaacaagagguggagaaccgcauaugauugucaguaaacaagaaagaggaaaaucuuuauuauucaaaacuuccgcuggagucaacauguguacucuaauagcaauggauuugggugaacuuugcgaagauacaaugaccuacaaaugcccuagaaucaccgaaacggaaccagaugaugucgauuguuggugcaacgcuacagauaccugggucacauaugguaccugcucucaaacaggagaacaucgcagagacaaacgaucuguagcauuggccccacacgucggauuaggucuugaaacuagaacggaaacauggaugucgucagaaggugcauggaaacaaauucaacgcgucgaaacaugggccuuaagacauccagguuucacaguuaucgcucuuuuucucgcccaugccauagggacaagcauuacacaaaaaggaauaauuuuuauccuacuaaugcuuguuacaccaucuauggcuaugcgaugcguugggauugggucacgggauuuuguggagggacucagcggggcaacgugggucgacguaguacuugaacacggaucauguguaacaacaauggcaaaagacaaaccaacucuagauaucgaacucuugaaaacagaaguuacaaauccagcaguucuuagaaaacuuugcauugaagcaaaaauaucuaauacaacgacagauucucgcuguccaacucaaggagaggcgacguugguagaagaacaagaugcaaauuuuguaugucguaggacguuuguagacagaggguggggaaacggauguggacuauuuggaaaagguucauuaauuacaugcgcaaaauucaaguguguaacaaaacuugaagggaagaucguacaauacgaaaaccucaaauauaguguaauuguuacaguccacacuggagaucaacaucaaguagggaaugaaucuacagaacauggaacaacagcuacaauuaccccacaagcgccuacgacggaaauacaacuugcggauuauggagcuuugacgcuugauuguucaccuagaacuggauuagauuucaacgagaugguacuguuaacaaugaaagagaaaagcugguuggugcauaaacaaugguuucuagaucugcccuuaccauggaccaguggggcuaguaccucacaggaaacauggaacagacaagacuuauuaguaacuuucaagacugcucaugcaaagaaacaggaaguggugguauuaggaucccaagaaggugcuaugcacacagcacuaacuggggcaaccgagauacagacgagcgguacaaccacaauuuucgcaggacauuuaaaaugucgauugaaaauggauaaacuaacacucaaagguaugaguuauguuaugugcaccgggucauucaaguuagagaaagaauuggccgagacgcaacacggaaccguucuugugcaaauuaaauacgagggcacugaugcaccuuguaagauaccguuuucaacucaagaugaaaaagggguuacccaaaaugggagauuaauuacagcaaauccgauuguaacagauaaagaaaaaccagugaauauagaagcugaaccaccauucggagaaaguuacauuguaauaggugcgggugaaaaagcccuuaaacuaucaugguucaagaaagguucgagcaucggaaaaauguucgaagcuacugccagaggcgcuagaagaauggccauucuuggggacacggcgugggacuuuggaucuaucggaggagucuucacuuccgugggcaaauuagugcaucaaauuuuuggugcugccuacggugugcuguucaguggcguaucuuggacuaugaaaauagggauaggcgucuuauuaacaugguugggacuaaauucuaggucgacaucucuaucuaugacuuguaucgcugucggucuagugacauuguaccuugguguaaugguacaagccgauucgggcugugucauaaacuggaaaggccgagaacuuaaauguggcucagggauauucguaacgaaugaagugcauacauggacagaacaauauaaauuucaagccgacagucccaaaagguuaucugcggcuauaggaaaagcgugggaagaagguguauguggcauccgaucagccacaagacuagagaauauuauguggaaacaaauauccaacgaauugaaccauauuuuacuugaaaacgauaugaaguuuacagugguuguaggcgauguggcugguauauuggcccaaggcaagaaaaugauucguccacaaccaauggaauauaaauacaguuggaaaagcuggggaaaagccaaaauaaucggagcagauguccaaaauacaaccuuuauaauugauggacagaauacaccagaguguccugaugaucagcgugcauggaacauaugggaggucgaggacuauggauucggaaucuuuacgacgaauauaugguuaaaauugcgagauagcuacacucagguaugugaccaucgccuaaugucagcagcaauaaaagacaguaaagcaguccacgcagauaugggauauuggauagagucugagaagaaugagaccuggaaguuagcucgggcaucauucauugagguaaaaacauguauauggccaaagucacauaccuuauggucaaacgguguccucgaaagugaaaugauaauucccaaaauauauggaggaccaaucagccaacauaacuauagaccaggauauuucacacagacagcaggcccauggcacuuaggaaaacuugaacuagacuuugauuugugugagggcacgacgguaguaguagacgaacauugcggaaauagaggaccaucacuacgaacgacgacuguuacggguaaaaucauccacgaauggugcugcagaucauguacauuaccaccacuaagauucagaggggaagauggaugcugguauggaauggagauuagacccguaaaagagaaagaagagaauuuagucaaaagcaugguaucggcaggaagcggagagguagauaguuucagucugggccuacucugcauaaguauaaugauugaagaggucaugcggucaagguggagucguaaaauguuaaugaccgguacuuuagcuguguuuuugcuauuaauuaugggccaacuaacauggaaugaccugauccgauugugcaucaugguaggagcaaaugcaagcgacaggaugggaauggggacaacuuaucuagcgcuaauggcgaccuuuaagaugagaccaauguuugcaguaggauugcuuuuucggcggcugaccuccagagaaguauuacuacugacuauagggcugagucuaguagcaucggucgaauuaccaaauucacuagaggaauuaggagauggguuggcaaugggcauaaugauuuuaaaacuucuuaccgauuuucaaagccaucaacucugggcuacacugcuuaguuuaacuuuuauaaagacuacguucagcuuacauuaugccuggaaaacaauggcgauggugcuuagcauaguuagucuauuuccacuaugucugucuacuacaucccagaaaacgacguggcucccaguauuauuaggaucccuuggaugcaaaccucuuacuauguuccugauagcugaaaauaaaauauggggccgacgauccuggccgcuuaaugagggaauuauggcaguuggaauagugaguauacuacuuagcucucuacuuaaaaaugauguuccacuagccggaccauugaucgcuggaggaauguugaucgcguguuacgugauuaguggauccagugcagaucucucgcucgagaaagcugcugaaguaucaugggaggaagaggcagaacacaguggugcuucucauaauauccucguagaaguacaggaugaugguacaaugaaaauaaaagacgaagaaagggacgauacauugacuauauugcuaaaagccacauuauuagcagugagugguguauacccgcuguccaucccggcaacccuuuuuguuugguauuuuuggcagaagaagaaacaaagaagugguguucuuugggauacuccuuccccgccagaaguagaaagagccguucuagaugauggaauauaucgaauaaugcaaagaggacuauuggggcggagucaaguuggaguagguguauuccaggaaaacguuuuucauacaauguggcaugucacgagaggagccguucugauguaucagggaaaacggcuggaaccaucaugggcaucagucaagaaagacuuaauaucauacgguggggguuggagauuacagggaucauggaacacgggagaagaaguucagguaauugcaguugaaccagguaaaaaucccaagaauguucagaccgcaccaggcacuuuuaaaaccccugaaggcgaagucggcgcaaucgcccuagauuuuaaaccugguacgucgggcaguccaauagugaauagggaagggaagauaguggguuuguauggcaauggggucguuacaacgucggggacguaugugucagcgauugcucaggcuaaaguaucacaagagggaccauugccggaaauagaagaugagguuuuuagaaaaagaaacuugaccaucauggacuugcauccaggauccggaaaaacuagaagauauuuaccugcaauaguacgugaggcgauaaaaagaaaauugagaacccugauccuggcuccaacuagaguaguggcgucagaaauggcggaagccuugaaagggaugccaauucguuaccaaacgacagcagucaaaagugaacacacagguaaagaaauaguugacuuaaugugucaugcuacauuuacaaugagauuguuaaguccuguccgcgucccaaauuacaacaugauaauaauggacgaggcccacuucacugauccaagcucaauugcggcucgcggcuauauuagcacacgaguagguaugggugaagcagcagcuauuuuuaugacugcgacaccaccagguagcguggaagcauuuccgcagaguaacgcgguaauucaggacgaggaacgggauauaccggaaagaucuuggaauaguggguaugaauggauaacagauuuuccaggaaaaacuguuugguucguuccgucuauaaaaagcgguaacgauauagcaaauugcuuacguaagaacgguaaaaggguaauacaauuauccagaaaaacauuugacacggaauaucaaaagacgaaaaacaaugauugggauuauguaguaacgacagauauuagugaaaugggugccaauuucagagcggaccgggucaucgauccgcgaaggugcuuaaaaccugugauccuuaaagauggcccagaacgcgucauacuugcgggcccaaugcccguaacgguagcaagugcugcgcaacgcagagggcguaucggucgaaaucauaauaaagagggugaucaauauauuuacaugggacaaccacuuaacaaugacgaggaucaugcucauuggaccgaggcuaaaauguuauuggacaauauaaacacgccagaaggcauaauaccagcacuauuugagccugaacgugagaaaucagccgcuauugacggagaguaccgauuaagaggggaggcaagaaagaccuucguggaacuaaugagacgcggcgauuuaccaguauggcucaguuauaaaguagccucagaaggguuccaauacucugauagaagaugguguuucgauggcgaaaggaauaaucaggugcuagaagagaacauggauguagaaauuuggaccaaagagggagagagaaagaaacuaagaccgagaugguuagaugcaagaacguacucugauccacuagcacuccgggaauuuaaagaauuugcggccgggagaaggagcguaucgggagacuugauauuggagauugggaaacuaccgcagcauuugacucaacgcgcccaaaacgcauuagauaacuuaguaaugcuacauaacucagagcaaggcggacgagcuuaucgucaugcuauggaagaacuaccagauacuauagaaacacuuauguuauuagcacuuauugcaguauuaacaggaggugugacacuauucuuucuaagugguagaggguuagguaaaacgucuauaggucuacuuugugucauggcuaguaguguauuauuauggauggcaucuguggagccgcauuggauagcagcuagcaucauuuuagaauuuuuccuaauggucuuguugauacccgagccugauaggcagcgaacaccgcaagacaaucagcuggcauauguaguaaucggucucuuauuuaugaucuuaaccguggcagcaaacgaaaugggauuacuagagaccacgaaaaaggauuuggggauugggcaugucgcaguugaaaaccaucaccaugccgcaaugcuggauguagauuugcauccagcgucagcauggacauuauaugcgguggcgacuacaauuauaacgccaaugaugaggcauaccauagagaauacuacggcaaauaucagccugacagcaaucgcaaaucaagcagcgauauugaugggcuuggauaaagguuggccaauaaguaaaauggauauugguguuccacuacucgcuuuggguugcuauagccaagucaacccgcuaacguuaaccgccgcgguccuuauguuaguggcccacuaugccauaauagggccuggacuacaggcuaaagccacuagggaagcccagaaaagaacagcggccgggaucaugaaaaauccaacgguugaugggaucguagcaauagaucuagauccugugguauaugaugcaaaauuugaaaaacaacucggucaaauuaugcuuuugauauugugcacuucacagauauugcuaaugcgcacuacaugggcacuaugugaguccaucacacuugcuacagggccauuaacaaccuugugggaaggaucaccuggaaaguuuuggaauacaacaauagcaguaaguauggcgaauauauuuagggguuccuacuuagcuggugcuggccuagcguucuccuuaaugaaaucgcuagguggaggaaggcgugguacgggagcacaaggagagacauuaggagagaaauggaagagacaacuaaaucaauuguccaaguccgaauuuaauacuuauaaacgcagugggauaauggagguagacaggucggaagccaaggaggguuuaaaacgaggcgaaacaacaaaauaugcuguuagucgggguacagcaaaacuuagaugguuuguagagcgaaauuuaguaaagccagaagguaaagugauagacuuaggauguggacggggaggaugggcuuauuauugugccggccucaagaaagugacggaaguuaaaggauauacgaagggaggcccagggcacgaagaaccgauaccaauggccaccuauggauggaaucuuguaaaguuacauagcggaaaagacgucuucuuugucccgccggaaaaaugcgauacacucuuaugugacaucggagagaguucaccaaacccaacaauagaagaaggaaggacuuuaagaguccuuaaaaugguagaaccuugguuacgagguaaucaauucuguauuaaaauucuaaauccauauaugccuucuguaguugagacacucgaacaaaugcaaagaaaacaugguggaaugcuaguaagaaauccauuaucacgaaauucgacgcaugagauguacugggucuccuguggcacugggaacaucgugagcgccgucaauaugaccagcagaaugcuacucaauagguuuacaauggcacauagaaagccaacuuaugaaagagauguugacuuaggcgcuggaacacgacacguugcagucgaaccagagguagcgaauuuggauauuaucggacaaagaauugaaaauauuaagcaugaacauaaaucuaccuggcauuaugaugaagacaauccauauaaaacgugggcauaucaugguucguacgagguuaaaccgucgggaucggccucauccauggugaacgguguaguaaaauuacugacuaaaccaugggaugugauccccaugguuacacaaauagccaugaccgacacaacaccauuuggacaacaacgaguuuucaaggaaaaagucgacacccgaacucccaaagcaaaacgagguaccgcgcagauaauggagguaaccgcaaaauggcuauggggauuccucucacgcaacaagaaaccacgaauuuguacucgagaggaguucacaagaaaaguucguucaaaugcggcgauaggugcuguuuuugucgaugagaaucaauggaauagcgcaaaggaagcuguggaagacgagagauucugggaccucguucaucgagaaagggaauuacacaaacaaggaaaaugcgcuacaugcguuuacaauaugauggggaaaagagaaaagaaacuaggggaguuuggcaaagcaaaaggaagucgcgcaauaugguauaugugguuaggugcgcgauucuuggaguuugaagcccuuggauuuaugaacgaagaccacugguucagccgagaaaauaguuuaucaggcguugaaggugaagggcuucauaaacugggguauauauuaagagauauaucgaagauaccaggaggaaacauguacgccgacgacacagcagguugggauacaagaauaaccgaagaugacuuacaaaacgaagcaagaauaacagauauaauggagccagagcaugccuuauuagcaaaaucuaucuucaaacuaacauaccaaaacaagguugucagaguacaaagaccagccaaaaacggaacggucauggauguuauaagcaggagagaccagcgaggcucuggucaaguagguacuuacggauuaaauaccuuuacaaacauggaggcacaauuaauuaggcaaauggaaucugaagguauauuuucaccuagugaacuagaaacaccaaaucuggcagagagaguauuggauugguuggaaaaguauggaguagagagauugaaacgaauggcaauaaguggugacgauuguguuguuaaaccuauugacgaccguuuugcuacggcacucacugcccuaaaugauaugggaaagguuagaaaagauaucccacaaugggaaccaucuaaagguuggaacgacuggcaacaagugccauuuugcucucaccauuuccaucagcugaucaugaaagaugggagagaaauagucgugccauguagaaaucaagaugaacuuguaggcagagcacgugucucacaaggcgcaggauggucacuuagagaaaccgcaugucuagguaaaagcuaugcgcagauguggcagcuaauguauuuccacagacgcgaccucagauuggcggcaaacgcuauuuguagugcugucccaguugacuggauaccaacaucuaggacaacuuggucaauacaugcucaucaucaauggaugacuacugaggauaugcuaucagucuggaauaggguguggauagaggaaaauccauggauggaggauaaaacacacauuucgaguuggggugacgugccuuacuugggcaaacgagaagaucaauggugugggucauuaaucgguuuaacugcccgagcaacuugggcgaccaauauacaaguagccauuaaccaaguucguagacuaaucggaaacgaaaauuaccucgauuauaugacgucaaugaaaagauuuaagaaugaaagcgaucccgaaggugcacucugguaa

SEQ ID NO: 21989 - RNA, 9879 nt, Artificial Sequence
  derived and/or modified CDS sequence (opt6) from DENV-1__JQ045636__SS-prME
ucgguaacaauguuauuaaugcuaaugcccacugcauuagcauuucauuuaacaacucgcgggggugaaccccauaugauaguuagcaaacaggaaagaggcaaaucacuauuguuuaagacaagugcaggagugaauauguguacauugauagcuauggaccugggagaauuuugcgaagacacaaugacuuacaaaugccccagaauuacggaggcagaaccagacgacguggacuguuggugcaacgccacugauaccuggguuacauaugguacgugcagucaaacaggcgaacauagaagagauaaacguuccgucgcuuuagcuccacacguaggacugggacuggagacaaggacggaaacauggaugagcagugaaggggcguggaaacaaauacaacguguugaaacuugggcgcuaagacauccgggguucacugugauagcauuguucuuggcccacgccauugggacaaguauuacucaaaaaggaauaauauuuauacuucuuauguuagugacgccauccauggcuaugaggugcguaggaauagguagcagagauuuugucgagggccugagcggugcaacauggguugacgucguucuggagcauggcucaugcgugacaacuauggccaaggauaaaccgacguuggauauagaacuucuaaaaacugaggugacaaauccagcugucuuacggaaacuuugcauugaggcgaaaauuagcaacacaacaacugacagcagauguccgacacagggagaggcuacccucgucgaagaacaggaugccaauuucgugugcaggagaacguucguugauagaggaugggggaacggcugcggacuuuuuggaaagggcagccucauaacaugcgcaaaguuuaaauguguuacaaaauuagaagguaaaaucguacaauacgaaaaucugaaauauuccgugauaguuaccgugcauaccggagaucaacaucaaguggguaacgaaucuacagagcaugguacgauagcaacaauaacaccacaggcaccaucaacagaaauucaguuaacagauuacggggcauuaacacuggauugcuccccgcgcacgggauuagauuucaaugaaaugguuuuguuaacaaugaaggaaaaaucauggcucguacacaaacagugguuuuuagauuuaccccuacccuggacaaguggugcuucaacuagucaggagaccuggaaucgacaagaucuacuaguuacguucaaaacugcacaugcgaagaagcaagaaguuguagugcucggaucacaagaaggugcaaugcacacagcucucacaggagcgacggaaauucaaacuucaggcacaacaacaauuuuugcaggccaucugaaauguaggcuaaaaauggauaaguuaacacuaaaagguaugagcuacgucaugugcacagggaguuuuaaguuagaaaaggaagucgcagaaacacaacacgguacaguucuaguccaaauaaaauacgagggaacagaugcaccgugcaaaauuccuuuuucgacccaagaugagaaaggagcgacucaaaauggcagauuaauaacggcgaacccgaucguaacagauaaggaaaaaccagugaauauugaagccgagccaccauucggagaaagcuacauuguaauaggugcuggggaaaaagcguuaaaacugaguugguuuaagaaaggcuccucuauaggaaaaauguuugaggcaacagcgcgcggagcucguagaauggcaauccugggugauaccgcgugggacuuuggaagcaucggaggagucuuuacuucaguuggaaaacuuguacaucaaaucuucggaacagcauaugggguacuuuuuucugguguaaguuggacgaugaaaauagguaucggaguacuacucaccugguuggguuuaaacucucgcucaacaagccuuagcaugacuugcauagcaguaggacuggucacccuauaucuaggaguuaugguucaagcugacaguggcugcguuauaaacuggaaaggcagagaauuaaaaugcgggucagguaucuuuguuacaaaugaaguacacacuuggacugaacaguauaaauuucaggcagauaguccuaagcgauuaagcgcagcuaucgguaaagccugggaagaaggcguauguggcauaagaucagcaacaagacuagaaaauauaauguggaaacaaaucagcaaugaacuuaaccauauauuauuagaaaaugauaugaaauuaacaguuguuguaggagauguugcuggaauauuagcacagggcaaaaagaugauaagaccacagccaauggaguacaaguauucauggaagucguggggaaaagcaaaaauaauaggagcugauguacaaaauacaacuuucauaauagauggucccaauacaccagaauguccagaugaccagagagcauggaacauaugggaagucgaagacuauggguucgguauuuucacaacaaauauauggcuaaaacuaagagauucauauacccaaguuugcgaucauagacuaaugagcgcugcaauuaaagacucaaaagcaguucacgcagacauggguuacuggaucgaaagcgaaaaaaaugagaccuggaaacuagcacgugccaguuuuauugagguaaaaacauguaucuggccuaaaucucacacauuauggaguaaugggguacuagaaagugaaaugauaauaccgaagaucuauggugguccgaucucgcagcacaauuaucgaccgggauauuuuacgcaaacggcggguccuuggcaucucggcaaguuagaauuagauuuugaucuuugcgaaggaacaacagucguaguugacgagcauuguggaaacagaggaccuucguuaagaacaaccacagugacgggaaaaaucauacacgaaugguguugcaggucuuguacguugcccccauugagauuuaaaggcgaagauggauguugguauggaauggagauaagaccugugaaagaaaaggaagagaauuuaguaaaaucaaugguuagugccggauccggcgaaguugacucguucagcuuaggauuacucuguauuucaaucaugauagaagaaguaaugagaucaagauggucaagaaaaaugcuaaugacuggcacccucgcaguuuuuuuuuuauuaauaauggggcaacuaaccuggaaugaucuaauaagauuguguauaauggugggagcugaugcgucggauagaaugggaaugggcacaaccuaccucgcccugauggcaacauucaaaaugcgcccaauguuugcgguagguuuauuguucagaagguugacaagcagagaggucuuguuacuuacgauuggcuuaaguuuaguagcuagcguagaauuaccuaacagcuuggaagaacugggagauggguuagcuauggggauaaugauacuaaaauuacuaacugacuuucaaucccaucagcuaugggcuacacuacucaguuugacauuuauaaggaccaccuuuucauuacacuaugcauggaagaccauggcaaugguauuaucgauaguuucauuguucccauugugcuuaagcaccacaucgcaaaagacaacgugguuaccaguccugcuaggaagucucggcuguaaaccauuaacaauguuucuuauugcugaaaauaaaaucugggggcgaaagucuuggccacuuaaugaggguauaauggcagucgggaucgugucuauacugcuaaguucuuuacugaagaaugaugucccgcuagcuggucccuuaauagcaggcggaaugcucauagcauguuauguaauuaguggaucuucugcagauuuaagucuagagaaagcagccguagugagcugggaagaggaagcugagcauucaggugcaucgcauaacauauugguagaagugcaagaugauggaacaaugaagauaaaagacgaagaaagagaugacacacuaaccauucuccucaaagcuacacuacuagccguaaguggaguguauccguuaaguaucccugcaacccuauuuguaugguauuucuggcagaagaaaaagcaacgcucaggcguccuuugggacacaccaucaccaccggaaguugagagagccguauuagacgaugguauuuauagaauaaugcaacggggguugcuuggacgaagucaaguaggugucgguguuuuucaagaaaauguauuucacacgauguggcacguaacaagaggagcaguacucauguaccaaggaaaaagacuagagccuucgugggcaucuguaaaaaaagaucuaauuucuuaugguggagguuggaggcuucaagguucuuggaauacgggagaagaagugcagguaaucgccguugagcccggaaaaaauccuaagaauguucaaacagcgccuggaaccuucaaaaccagugaaggagaaguuggagcaaucgcauuggauuuuaaacccggaacgagcggcucaccuauaguaaaucgagaaggaaaaauaguaggccucuauggaaaugguguaguaaccacuuccggaacauauguaagcgccauagcacaagcgaaagcuagucaggaagggcccuuaccagaaaucgaggacgagguauuucguaaacguaaccucacaauaauggauuuacacccaggaagcgggaaaacacgacgauaccuaccugcaauagugcgcgaagcuaucaaacguaaguugagaacauuaauauuggcuccgaccagaguuguugcaagcgaaauggcagaagcuuugaaagguaugccuauaagauaucaaacaacagcaguuaaaucggaacacacgggaaaggaaauaguagaucuaaugugccacgcaacuuuuacuaugcgauuauuaagucccguacggguuccgaauuauaacaugauuauaauggaugaagcgcauuucaccgacccaaguuccaucgcugcuagaggguauaucuccacacguguuggaaugggugaggcagcugcaaucuucaugacagcuacaccaccggguucaguggaagccuuuccacaaagcaaugcuguaauacaggaugaagaacgcgacauucccgaacgcucuuggaauuccgguuacgaauggauaacagauuuuccgggaaaaacggugugguucguucccucaauaaagucuggaaaugacauagcaaauugcuuacguaagaacggaaaaaggguaauacagcuauccagaaaaacuuucgacacggaauaucagaagacaaaaaacaaugauugggauuacgucgugacaacagauauaucugagaugggugcuaauuuuagggcagaucguguuaucgacccucgacgcugcuugaaaccgguaauucuaaaagauggaccggagcgagugauuuuagcuggaccaaugccaguaaccguggcaucggcggcgcaacgaagaggacgaauagggaggaaccauaauaaagaaggggaccaguacauauauaugggacaaccacuuaacaacgacgaggaucaugcgcauuggacggaagccaagaugcuucuggauaacauaaauacuccggaaggaauuauuccggcacuauucgauccagagagggaaaaaagugcugcaaucgauggcgaauauagauugagaggugaagcgcgcaagacauuuguugaauuaaugaggaggggagauuuaccuguuuggcucagcuacaaaguagcaucagaagguuuucaguacagcgauaggagauggugcuuugacggugagagaaauaaucaggucuuagaggaaaacauggacguugaaauauggaccaaagaaggagagcggaaaaaguugagaccaagauggcuugaugcaagaacauauuccgacccucuagcuuuaagggaauucaaagaauuugcggcugggcggagaagugugucaggagaucucauucuggagauuggcaagcuaccgcaacaucuuacacagagggcgcaaaacgcucuugauaaucuugucaugcuccauaacucagagcaaggcggacgagcauaccgacaugccauggaagaauuaccggauacaauagaaacgcuuauguuacuggcuuuaauagcuguauuaacaggaggaguuacccuauuuuuccuaucagggcggggucuuggaaaaacuaguauaggucuacuauguguaauggcaagcucaguucuacuguggauggcuagcguagaaccccacuggaucgcagccucaaucauauuagaauuuuucuuaaugguacuacuaaucccagaaccugaucgacaaaggaccccgcaagauaaucaacuagcauauguaguaauaggauuauuauuuaugauuuuaacaguggcagcaaaugaaauggguuugcuggaaacgacuaaaaaagaucugggcauaggccacguggccguagagaaccaccaccaugcagcaaugcuagacguagaucuucaucccgcaucagccuggacacuauaugccgucgcgacaacuaucaucacgccuaugaugagacauaccauagagaacaccacagccaacauaagucuaacagcgauugcuaaccaggccgcaauucuuauggguuuagacaaaggauggccuauuucuaaaauggauaucgggguaccccuacuggcgcugggcuguuacucacaaguuaauccauuaacacucacggccgcggucuuaauguuggucgcucauuaugcuauaauaggacccgguuugcaagcuaaggcaacucgcgaagcucaaaagagaacugcagcagggauaaugaaaaacccuacugucgacgguaucguggcaauugacuuagaucccguagucuacgacgcaaaauuugaaaaacaacuagggcaaauaauguuacuuauuuuauguacaagucaaauacuauuaaugcgaaccacaugggcuuuaugugaaaguaucacucuagcuacagguccacucaccacucugugggagggcucuccagguaaguucuggaacacaacuauagcaguuucuauggccaauauuuucagaggcaguuaucuagcuggggcugggcuggcguuuagcuuaaugaaaucauugggaggagggcgaagagggacuggcgcacaaggcgaaacauuaggggaaaaauggaaacgucagcuuaaucaacuuaguaaaucggaauuuaacacauacaaacgaucgggaauaauggaaguagauagaucggaagcuaaagagggguuaaaaagaggugagacaacaaagcacgccguaucaagaggaacugcuaaauuacgaugguuuguagagcgaaauuugguaaaaccggaagggaagguuauagaccuaggcuguggaagaggaggauggaguuacuacugcgcagggcuaaaaaaaguaacugagguaaaaggguacaccaaagguggaccaggacaugaggagccgauaccuauggcaacguaugguuggaacuuaguaaaacuacacucaggaaaagaugucuucuuuauaccuccagagaaaugcgacacgcuguuaugcgauauuggagaaucuucgccuaauccuacaaucgaagaagggcgaacucuuagaguucuuaaaaugguggaaccaugguuacguggcaaccaauuuugcauuaaaaucuugaauccguacaugccuagcgucguugaaacacuagaacagaugcaaagaaaacauggagggaugcugguacgcaauccuuuaucaagaaacuccacucaugagauguauuggguaaguugugguacagguaacaucgucucagcaguuaauaugacgaguaggauguuacucaaucgcuuuacgauggcgcaccgaaagccuacuuaugaaagagauguagaccuuggagcgggaacucggcauguagcgguugaaccugaaguagcuaaucuagauaucauaggucaaaggauugagaauauuaaacacgaacauaagucaacguggcacuaugaugaagacaacccuuauaagacuugggcuuaccacgguaguuacgaagugaaacccucuggguccgcgaguuccauggugaacggaguuguuaaauuauugacgaaaccaugggacgugauuccuaugguuacucaaaucgcaaugacagauacaacaccauuuggacaacaacgaguuuuuaaagagaaaguggacacgcgaaccccaaaagccaaaagaggaacugcacaaauaauggagguaacagccaaguggcuguggggauuucuaaguagaaauaaaaaaccucggauauguacaagagaagaauuuacaagaaaaguuaggagcaacgccgcgauaggcgcaguauuuguugacgaaaaucaauggaacucugcuaaggaagccgucgaagacgaacguuucugggaucuuguacaucgugaacgggaacugcauaaacaggggaaaugugccacguguguuuacaacaugauggggaaaagagaaaaaaaauugggagaguuuggcaaggccaagggaaguagagcgauaugguauaugugguuaggagcgcguuuucuugaauuugaggcgcuugguuuuaugaacgaagaccacugguucucuagagaaaacuccuuaucuggaguagaaggagaagguuugcacaaguuagguuauauacuccgggacauaucaaaaauaccgggagggaacauguaugcugacgauacugcggguugggauacgcgaauaaccgaagacgauuuacaaaaugaggcgaagauaacagauauuauggagccugaacacgcgcuacuagccaaaucaaucuucaaauugacauaccaaaauaaagucgugagaguucaaagaccagcaaaaaauggaacaguaauggacguaaucaguaggagagaucaaagggguagcggucaaguaggaacauaugggcuaaauacauuuaccaauauggaagcgcaacuaauacgacaaauggaaucagaaggaauauucucaccaagugaguuagagacuccaaacuuagcaggaagaguacuugauugguuggaaaagcauggagucgaaagacugaaacgaauggcaaucucgggugaugauugcguggucaagccuauagacgaccgauucgcuacagcacuaacggcauuaaaugauauggguaaaguuaggaaggacauaccacaaugggaacccucaaaagguuggaacgauuggcagcaagucccuuucuguucacaucauuuucaccaauuaauaaugaaagauggaagagaaauaguagucccaugcagaaaccaagacgaacuuguaggaagggcacgcgucagccagggagcaggauggucucuacgggaaacagcgugucuaggaaagucuuaugcccaaauguggcaauugauguacuuccaucggcgagauuuaagacuagcugccaacgccauuuguagugcagucccgguagacuggguaccaacgucacgcacuaccuggagcauacaugcccaucaucaguggaugacaacugaggauaugcugucaguauggaaccgaguauggauugaagagaacccuuggauggaagauaaaacccauauaucuagcuggggggauguuccauaccuugggaaaagggaagaccagugguguggaagcuuaauuggucuaaccgcaagagccacaugggcuaccaauauccagguugcaauaaaucaagucaggagacuacugggaaaugagaacuaccucgauuauaugacaucaaugaagcgauucaaaaaugagagcgauccagaaggugcauuaugguag

SEQ ID NO: 21990 - RNA, 9879 nt, Artificial Sequence
  derived and/or modified CDS sequence (opt6) from DENV-1__JQ045635__SS-prME
ucgguuacuaugcuauuaaugcugaugccaacugcgcucgcauuccauuuaacaacuagaggaggggaaccgcauaugauuguaucgaaacaagaaagaggaaaaucacuauuguucaaaacaucagcugguguuaauaugugcacguuaauugcaauggaucuuggggaauuuugugaagauacuaugaccuacaaaugcccuagaauaacagaagcagaaccggaugauguugauugcugguguaaugcaacagauacgugggucacauauggaacauguagucaaacgggggaacaucguagggacaaacgaaguguagcucuugcaccacaugugggauugggccucgaaacaagaacagaaacuuggaugaguagcgaaggcgcauggaaacaaauacaaaggguugaaaccugggcacuccgucauccagguuuuacuguuauagcgcuauuccucgcucaugcaauaggaacgucgauaacacaaaaaggaauaauauuuauacuacugauguuaguaacaccaucaauggcgaugcgauguguaggcaucgggaguagagauuuuguagaaggguuaucuggagcgacuuggguagauguaguauuagaacacgggaguuguguaacuacgauggcgaaagacaaaccaacuuuagauauugaauuacuuaaaacagaaguaacgaacccagcaguauuaagaaaauuaugcauugaagcaaaaauaaguaacacaacuacagauagucguuguccuacacaaggggaagcuacuuuagucgaagaacaggaugcaaauuuugucugucgacgaacuuucgucgaccgcggauggggaaacggaugcggucucuucggaaaagguucauuaauuacaugugcaaaauuuaaaugcgugacuaaacuagaagguaaaauuguacaauaugaaaaccuaaaauacucuguaauuguaaccguucacacgggcgaccaacaccaagucgggaaugaaagcacugaacacggaacaaucgccacuauaacgccucaagcgccgucaacagaaauacaacugacagacuauggcgcauuaacucuggacugcaguccgaggacaggcuuagacuuuaaugaaauggugcuauuaaccaugaaagagaaaaguuggcuuguucauaaacaaugguuucuggaucuuccuuugccuuggaccucgggggccaguacaagucaagagaccuggaacagacaggaccucuuagugaccuucaaaacagcacaugccaagaaacaagagguaguuguucuaggcucccaggaaggcgccaugcacacugcucucacaggcgccacagaaauccaaacguccggaacuacaacaauuuuugcaggacaccugaaauguagauuaaaaauggacaaacuuacccuaaaagguauguccuauguuaugugcacgggcaguuuuaaacuagaaaaagaagucgcugaaacccaacacggaacuguauuaguccagauaaaauaugaaggaacugacgcaccuugcaaaauaccuuuuagcacacaagaugagaaaggagcuacccaaaauggacguuuaauaacugccaaucccauaguaacagauaaagaaaagccugucaacaucgaagcagaaccaccauucggugaaucuuauaucguuauaggggccggugaaaaagcauuaaaacuuaguugguuuaagaaagguaguucuauuggaaaaauguucgaagcaaccgcgcguggcgccagacggauggcaauacuuggcgauaccgcaugggacuucgguagcauuggcggaguuuuuacgucuguaggaaaacuuguucaucagauauuuggaacagcguacgggguacuuuuuagugggguaucguggacaaugaaaaucgguauuggcguacuauuaacguggcucggucuaaauucacggagcaccuccuuaaguaugacguguauagcuguaggauuaguuacauuauaucuuggugugaugguacaagcugacucuggauguguuauaaauuggaaaggaagggagcuuaaauguggcagugguaucuuugugacaaaugaaguacauaccuggacagaacaauacaaauuucaagccgauucgccgaaaagacuuagcgcggcuauagggaaagccugggaagagggaguaugcgggauacgaucugcgaccagguuagaaaacauuauguggaaacaaauaucuaacgaguugaaucacaucuuauuagaaaacgauaugaaauugacugucguggucggcgauguagcuggaauuuuggcucaagguaagaagaugauuagaccucaaccaauggaauacaaauauagcuggaaaucuuggggcaaagcaaaaaucauaggugcagauguacagaacacuacguuuauuauagacggaccgaauacucccgaauguccagacgaucagcgugccuggaacauaugggaaguagaagauuauggauuuggaaucuucaccacgaacauaugguuaaaacugagggauuccuauacccaagugugcgaccaucguuugaugucggcggcaauaaaagauaguaaggccguacacgccgauaugggauauuggaucgagucagagaaaaaugaaacauggaaguuggcuagagcuaguuuuauagaggugaagaccuguaucuggcccaagucccauacgcuguggucaaacgggguacucgaaucagagaugauuauuccuaagauauaugguggccccauaagucaacauaauuauaggccugguuacuuuacacaaacagccggaccauggcauuuaggcaaauuagaguuagauuucgauuuaugcgagggaacaacaguaguggucgacgagcacugcggaaauagaggaccgagucugcgaacaacuacagucacaggaaaaauaauccaugaguggugcugucguaguugcacucugccaccccuucgauuuaaaggggaggauggauguugguacggaauggaaauaaggccuguuaaggaaaaagaagaaaaucuggucaaguccaugguuucagcuggcaguggugaaguugacuccuucucuuuagggcuucuguguauuuccauaaugauugaagagguaaugcgaucucgguggagccggaaaauguuaaugacgggcaccuuagccguauucuuucuauugauaauggggcaauuaacuuggaaugaccucauaagacucuguauuaugguuggagccgacgcaucagacagaauggggaugggcacuacuuauuuggcccucauggcaacguuuaaaaugcgaccgauguuugcaguuggauuauuauucaggcgacuuacaucucgugaagucuuacuucucacuauuggacuuagccugguugccagcguugaauugccuaacucacuagaggaacugggagauggcuuggcuaugggaauaaugauuuuaaaacuucuaacagacuuucaaagccaccaauuaugggcuacacuucuuucauugacauuuaucaggacgacauuuagcuugcauuaugcauggaagacaauggccaugguccugucaauuguuucacuauuuccauuaugccucucuaccacaucgcaaaagacgacauggcugccuguacuacucggaagucuagguugcaaaccuuugacgauguuuuugaucgcagaaaacaaaauaugggguagaaaaucauggccauuaaacgaaggaauaauggcagucggaaucguaucaauccuauuaaguagucuacuuaagaaugaugugccccuagccgggccacuuauugcuggggguaugcuaauugcguguuauguaauaagcggguccuccgcugauuuaucgcuugagaaggcggcaguaguaucaugggaagaggaggcagaacauaguggugcaucacauaauauauuagucgaaguacaggaugacgguacuaugaaaauuaaggaugaagagagagacgauacauugacaauuuuacuuaaagccacauuacucgcgguauccggaguauauccucuuagcauaccggcaacacuuuucgucugguacuucuggcagaagaaaaagcagagaagcggaguguuaugggauacaccaucgcccccagagguugaaagagcuguuuuagaugaugguauuuaucggauaaugcagaggggauuauuagguaggagucaaguaggaguuggaguuuuucaagagaauguauuccacacaauguggcacguaacaagaggagccguccucauguaucaggggaaacgacucgaaccaagcugggcaagcgucaagaaagacuuaauuagcuauggcgguggcuggcgacugcaaggcaguuggaacacaggugaagaaguacaaguuauugccguugaaccagguaaaaaucccaaaaaugugcaaacagcuccuggaacauucaaaacaagugagggagaaguuggagcgauagccuuagauuucaagccaggcacaucugguuccccuaucguaaaccgagaaggaaaaauaguaggccuuuacggaaauggcguaguaacaacaucuggcacuuauguaucugccaucgcacaggccaaagcaucacaagaaggacccuugccagaaaucgaagaugaaguauuuagaaaaaggaauuuaacaauaauggauuuacaccccggcuccggaaaaacaaggcgguaccugcccgcuauagugagagaagcgauuaaacggaagcugaggacccuuauacuagcaccaaccaggguaguugcuucagaaauggcagaagcguuaaaaggcaugccaauuagguaucagacaacagcagucaaaagcgaacauacaggaaaagaaaucguagauuugaugugucacgcuacuuucacaaugcgacugcugaguccaguaaggguuccaaauuauaacaugauuauaauggacgaggcacauuucacagacccaucaaguauagcggcaagaggauauauuagcacgcguguaggaaugggggaggcagcagccauuuuuaugacugccacuccgccaggaaguguugaggcuuucccacaaucgaaugcaguuauacaggaugaggaacgggauaucccagagagaagcuggaacucggguuacgaauggauaacagauuuuccagguaagaccguaugguucguaccuucgauaaagucaggaaaugauauugcaaauugcuuacgcaaaaauggaaagcgcgugauccagcuaucgcgaaagacauuugauacagaguaccaaaagacuaaaaacaaugauugggacuacguagugacuacagauauuucagagaugggagcaaauuucagagcugauagagugauagauccuagaagauguuuaaaaccugugauucugaaggacggccccgaaaggguuauucucgcuggcccgaugccuguaacuguggcuucagcugcucagagacgggggcgaaucggaaggaaccauaacaaagaaggagaucaauauauauacauggggcaaccauugaacaaugaugaagaucacgcccauuggacugaagcuaaaaugcuacucgacaacauaaauacaccggagggcauaauucccgcacuauucgauccagaacgagagaaaagcgcggccauagauggcgaguacagauuaaggggugaagcgagaaaaacuuuugucgagcucaugcgacguggcgauuuaccaguuugguuauccuacaaaguugcaagcgaagguuuucaauacucagacaggcgauggugcuuugauggagaaagaaacaaucaaguauuagaagaaaacauggacguggagauauggacuaaagagggagagcguaagaaacuuagaccgcguuggcuagaugcccgcacguauucugauccguuggcccuaagagaauuuaaagaguucgcagcaggaagaaggucaguaucuggugaucuuauucuugaaauagggaaacuaccacaacauuugacccaacgagcacagaaugcuuuagauaauuuggucaugcuacauaauucagaacaaggaggcagagcauauagacacgccauggaggaacugccggacacgaucgagacacuuauguuacuugcuuuaauagccguuuugacgggcgggguaacucuuuucuuuuuguccggcagaggccuaggaaaaacaucaauugguuuacuauguguaauggccucgagcgugcuuuuauggauggcaaguguugaaccucauuggauagcugcaaguaucauauuagaguuuuucuuaaugguucuuuuaauuccagaaccagaucgucaacgaacgccacaagauaaucaauuagcauauguaguaaucggcuuauuauuuaugauuuuaaccgucgccgcgaaugagaugggacuuuuagaaacgaccaagaaagauuugggaauuggucauguagcaguagaaaaccaccaucacgcggcgauguuagacguggaucuacauccagcauccgcauggacucuauaugcugucgcaacgacaauaaucacuccaaugaugagacacacaauagagaauacaacugccaauauuucucuuaccgcuauugcuaaucaagcagcuauucuaauggguuuagauaagggguggccaauaucaaaaauggacauuggcgucccccuacuagcacuaggauguuacucccagguuaauccauuaacacuuacagcagcgguucugaugcuugucgcucacuaugcgaucauaggcccaggcuuacaggcuaaggcuacccgagaagcccagaaaaggacagcagcagggauaaugaaaaaucccacuguagauggaauaguugcgauugaucuugaucccguaguauaugaugcgaaauucgaaaaacaacucggccagauaaugcuucuuauucuguguacgagucaaauuuuauugaugcgaacaacaugggccuuaugcgaaucaauaacccuugcaaccggaccacucaccaccuuaugggaaggauccccagguaaguucuggaauacaacuaucgcuguuagcauggcuaacauauucagggggaguuaccucgcaggagccgguuuagcuuucucauuaaugaaaucacuagggggugggagaagaggcacuggagcgcaaggagaaacacucggagaaaaauggaaaagacaacucaaucaauuguccaaaucggaguucaacacguauaaaaggagcggaauaauggaaguugaucggucagaagcuaaggaaggucuaaaaagaggagaaacaacaaaacacgcgguaucacgugggacagcuaaauuaagaugguucguagaaagaaauuuaguuaaaccugagggcaaaguaauagauuuagguugcggacguggagguugggcauauuauugugcaggacuuaagaaaguuacagaagucaagggauacacaaaaggagguccuggccacgaggaacccauaccgauggcuaccuauggguggaaucuagucaaacugcauucugggaaagacguuuucuuuauuccuccagaaaaaugcgauacacuucuaugugauaucggggagucaaguccgaauccuacuaucgaggagggacgcacuuuaagaguccuaaaaaugguagagccauggcuuagagggaaucaauuuuguaucaaaaucuuaaacccauacaugccgucaguagucgaaacacuugagcaaaugcagcgaaagcacggugguaugcuagucagaaauccuuuaaguagaaauucaacgcaugaaauguacuggguaaguugcgguacgggcaacauagucucugcgguaaacaugacuucgcgcaugcuacugaaucgauuuacaauggcacaccguaaaccuaccuacgagagagauguagauuuaggggccgguacgcgacauguagcaguggaaccugaaguagcaaaccuagauauaaucggccaacgaauugaaaacaucaaacacgaacacaagagcacuuggcauuaugaugaggauaaucccuacaaaacaugggcauaccacggauccuaugaaguaaagccaaguggaucagcuaguucaauggucaacggaguuguaaaauuguuaacuaagccaugggauguaauaccuauggucacacagauagcaaugaccgacacaaccccguuugggcagcaacggguuuucaaagaaaaaguggacacgagaacaccaaaggcuaagagagggacugcacaaauuauggaaguaacugcuaaaugguuauggggcuuucuuuccagaaauaagaaaccaaggauauguacuagagaggaguuuacaagaaaaguacgcucgaaugcagccaucggagcuguuuuugucgaugaaaaucaauggaacagugcuaaagaagcgguugaggaugagcguuucugggaucuaguacauagggagagagaacuacauaaacaaggaaagugugcaacaugcguuuauaauaugaugggaaaaagagagaagaaacuuggugaauuuggaaaagcaaaaggcagucgagcaauaugguacaugugguuaggcgcacgauuucuggaguucgaagcauugggauucaugaacgaggaucauugguuuucaagagaaaacucguuaagcgguguagagggcgagggguuacacaaauugggcuauauccugagagauauaucuaaaauuccgggagggaauauguacgcggacgauacagcagggugggauacuagaauaaccgaagacgacuuacaaaaugaagcaaaaauaaccgauauuauggaacccgaacacgcacuguuagcgaagaguauauucaaacuaacuuaccaaaauaaagugguuagaguacaacgucccgccaaaaauggaacgguaauggauguaauaucgagaagagaccaaagggggaguggacagguagguacauauggucuaaauacauuuacaaacauggaagcucaacugauuagacaaauggaauccgaggggauauuuucacccagugaacuagagacgccgaacuuggccggcaggguuuuagauugguuagaaaaacauggagucgaaagacuaaaaagaauggcgauaaguggugaugauuguguuguaaaaccgauugaugaucgauuugcuacugcacuuaccgcauugaaugauaugggcaaaguaagaaaagacauaccacaaugggagccaaguaaaggguggaacgauuggcaacaaguaccuuuuugcucacaccauuuucaccaguuaaucaugaaagauggucgugaaauuguaguaccuugucgcaaucaagacgaacugguaggaagggcaagagucagucagggagcaggguggagccuucgagaaaccgccugucuaggaaaaucauaugcucaaauguggcaauuaauguauuuucacagaagagaccucagacuagcagcuaaugcaaucuguuccgcaguacccguagacuggguuccuacgucaagaaccacuuggagcauacacgcucaccaucaauggaugaccacugaagauaugcuaucaguuuggaaccgagucuggaucgaagaaaacccuuggauggaggauaaaacucauaucucgaguuggggugauguucccuaccuuggaaaacgagaagaccaauggugcggaaguuugaucgggcucacggcucgugccacaugggcuacgaauauacaggucgccauuaaccagguaagaaggcucuuaggaaacgaaaacuaucuagauuauaugacuucgaugaaacgauuuaaaaaugaaucagacccagaaggagcucuuugguag

SEQ ID NO: 21991 - RNA, 9879 nt, Artificial Sequence
  derived and/or modified CDS sequence (opt6) from DENV-1__JQ045637__SS-prME
ucaguaacaauguuacugauguuaaugccaacggcacuagcuuuucaucuaacgacgagggguggggaaccacauaugauagucagcaaacaagaacgaggaaaaagccuauuauuuaaaaccagcgccggugugaauaugugcacuuugauagcuauggacuugggagaauuaugcgaagacacuaugacguacaaaugcccgagaauaacagaaacugaaccggaugaugucgauugcuggugcaaugcaacagauacguggguaacauauggaacuuguucacaaacuggagaacacagacgugauaaacggaguguagcguuggcaccacauguuggucucggauuagaaacucgaacagagacguggaugagcucagagggagcguggaaacaaauacaaagaguagaaacuugggcacuaagacauccagguuuuacaguaauugcgcucuuucuagcucacgcuauagguacgagcauuacucagaaaggaauaauauuuauucugcuuauguuaguaacaccuucuauggcuaugagguguguagguauuggcaguagagacuucguagaaggacuuucaggagcuacauggguagauguggugcuagaacauggaucauguguaacaacuauggcaaaagacaaaccgacuuuagauaucgaacuuuuaaaaacggaagugacaaauccagcaguuuuacguaaauuguguauagaagcaaaaauaagcaauacaacuacugauucccgauguccaacucaaggagaagccacguuaguagaagaacaggaugcaaauuuuguaugucggagaacauuuguagaucgaggaugggggaacggauguggauuauucgggaaaggaucgcuaauuacgugugcaaaauucaaauguguuacaaaacuagaaggcaaaauuguucaauacgaaaaucugaaauacucuguaauaguaacuguacauacaggcgaucagcaucaggucggaaaugagaguacagagcauggcacaaccgcgaccauaaccccucaagcaccuacaacagaaauucaguuaaccgacuauggcgccuugacauuagacuguagcccaagaacaggacuugauuucaaugagauggucuuacuaacaaugaaagagaaaagcuggcuaguccacaaacaaugguuccuugaucugccgcucccuuggacuucuggagcaucuacaucccaagagacuuggaaccgucaagauuuauuaguaacauuuaaaacugcacaugccaagaaacaagaagucguggucuuaggaagucaggagggugcgaugcauacagcccuuacuggagcaacagaaauccaaaugagcggaacaacuacgauuuuugcuggacacuuaaaaugcagauuaaaaauggacaaacuuacuuuaaaaggaaugagcuauguaauguguacugguucguuuaaauuagaaaaagaaguggcagaaacccaacacgguacuguacuuguacaaaucaaauaugaaggaacggaugcuccaugcaaaaucccauuuaguacgcaagacgaaaaggguguuacucaaaauggaagacuaauuacagcuaacccuauagugacggauaaagagaaaccagugaauauagaagcugaaccacccuuuggagagaguuauauaguaauuggggccggggaaaaagcacugaaacuaucgugguuuaagaaaggaagcucaauagguaaaauguuugaggcaacagcgagaggugcgagaagaauggcaauauuaggugacacagcaugggauuucggcucgauaggcgggguauuuaccaguguaggaaaacucguucaccaaauauuuggcacugcguauggcguacucuucucugggguuagcuggaccaugaaaauugguauaggaguauuacugaccuggcuaggauuaaauagcagaaguacaaguuugucaaugacaugcauagcgguuggccuaguuacauuauaucugggcguaaugguacaagcggacaguggcugugucauuaacuggaaagggcgugaacuaaaaugcggcucagguauuuuugugacgaaugaaguucauaccuggacggagcaguacaaauuccaagcagauuccccuaagcgauuaucggcugcaauugggaaggcuugggaagaaggaguaugcgggauaaggucugcaacuagguuagaaaauauaauguggaaacaaauaucgaaugaauuaaaucauauucuacuagaaaacgauaugaaguucacagugguggucggagacguagcaggcaucuuggcccaaggaaagaagaugaucagaccacaaccaauggaauauaaauauucauggaaaucaugggguaaagcgaaaauaauaggugcagacguucaaaauacuacguucauaaucgauggaccaaauacaccugaguguccagaugaucaacgagcuuggaacaucugggagguggaggauuaugguuucggaauuuuuacuacgaacauauggcuaaaguuaagagacucauacacccaaguaugugaucauagacuuaugagcgcagcaauuaaggauuccaaagcgguacaugcugacaugggcuauuggaucgaaagugagaaaaaugaaacuuggaaacuagcaagagccucauuuauagagguaaaaacauguauauggccgaaaucucauacacucuggucaaaugggguacuggaaucugaaaugauuauucccaaaauauauggcggaccaauaagucaacacaauuauagaccagguuauuucacgcaaacagcugguccguggcaccuagguaaauuagaacuugauuuugacuugugcgaaggaacaacuguuguagucgaugaacauugcgguucucggggccccagcuugaggacaacaacuguaacugguaaaaucauacaugaaugguguugucgaucuuguacacuaccuccacuaagguuuagaggggaagaugguugcugguacggaauggagauuaggccaguuaaagaaaaagaggaaaauuugguuaaaucuaugguaagcgcuggaagcggagaaguggauucacucagcuuaggcuugcuauguauaucuauaaugauugaggaagucaugcgcucaagauggucaagaaaaauguugaugacuggcacccuagcuguauucuuucuacuaaucauggggcagcuuaccuggaacgaucuaauaagguuauguauuaugguuggggcuaaugcgucugaucgaauggguauggguacuacauaucucgcauugauggcugcauucaaaaugcgucccauguucgcuguaggcuugcuuuuuaggagacugacgucccgugaagugcuccuuuuaaccauuggacugagccuaguggcuuccguugaauugccuaacucauuagaggagcuaggugauggauuagcaaugggaauuaugauucugaagcucuuaacggauuuucagagccaccaacuuugggcaacauuacucaguuuaacauuuauaaaaacuacauuuucacugcauuaugccuggaagacgauggcaaugguacucagcauugugucuuuauuuccccucugccuaaguacgacaagucagaaaaccacuuggcuaccaguguugcucggaucuuuagguugcaaaccccuaacaauguuuuugaucgcagagaacaaaauauggggaagaagaaguuggccauuaaaugaaggaauuauggcgguaggaauuguuaguauacuuuuaucaaguuuacuaaagaacgacgugccgcucgcgggaccucuuauagcgggcgguauguugauugccuguuacgugauuuccggaaguagcgcagaucuaucucuugaaaaggcggcugagguuucuugggaagaggaagcggaacacucuggggcuucacauaauaucuuaguggaaguucaagaugauggaacuaugaaaaucaaagaugaggagagggacgacacccugacuauucuauuaaaagcaacauugcuagcaguuaguggaguuuacccccucucaaucccagcuacacuauuuguuugguauuucuggcaaaagaagaaacagaggagcgguguacuaugggauacuccaagcccuccagaaguagaaagagcaguacuagaugauggaauauaucggauaaugcagagaggccuacugggucguucacagguggguguagguguauuccaagaaaaugucuuccacacaauguggcaugucacgcgcggggcagugcuaauguaccaaggaaagagacuagaaccaaguugggcaucuguaaagaaagauuugauaucauauggaggaggauggaggcuacaagguaguuggaacacaggcgaagaaguucaaguuaucgccguggaaccggggaagaaucccaaaaacguucaaacagcaccagguacguucaagacaccggaaggugaaguuggggcuauugcuuuggacuuuaaaccugguacgucuggaucacccauagugaauagggaaggaaaaaucguaggucuuuacggaaaugggguugugacaaccucagggacauacgucagugcaauagcgcaggcgaaggcuucgcaagaagggccacugccugaaauagaggaugaaguauuucguaaaagaaaucuuacaauaauggaccuucauccaggaaguggaaaaacacgccgauauuugccagcgauagucagggaggcuauuaaacguaaacucaggacauugauucuugccccaacuagaguuguagcaagugaaauggcagaagccuuaaaaggaaugcccauuagauaucaaacgacagccguaaaaagugagcauacuggaaaggaaauaguagaucuaaugugccaugcgacauucacuaugagauugcuaucaccagucagagugcccaacuacaacaugauaaucauggaugaggcacauuuuacagauccuagcucuaucgcagcacgaggauauauaaguacucgaguagguaugggugaagcagccgcgaucuuuaugacagcuacucccccaggaucuguagaggcguuuccucaaucaaaugcaguuauucaggaugaagaaagagauauuccggaacgcaguuggaacucugguuacgaauggauaacugauuucccaggaaaaacgguaugguucguuccaagcauaaagucaggcaaugacauugcuaauugccuucgcaaaaauggaaaaagaguuauacaacuaagucgaaaaacuuuugauacugaguaccagaaaacuaaaaauaaugauugggacuacgugguaaccacggauaucagugaaaugggcgcaaauuuucgcgcugauagaguuauagauccccguagaugcuuaaaaccaguaauuuuaaaggacgggccagaacgaguaauccuggcaggaccaaugcccgucacuguagcaucagccgcucaaagacgcgggagaauuggaaggaaucauaauaaggagggcgaccaauauauuuacaugggacaaccuuuaaauaacgacgaagaucaugcucauuggaccgaagcaaaaaugcuacuggauaauauaaauaccccggaaggaauuaucccugcauuauuugaacccgaacgagaaaaaucggcugcuauagauggagaauaccgucuuagaggcgaagcaagaaagacauuuguagaauuaaugagaagaggggaucuuccaguauggcuuucauauaaaguagcuucggagggguuccaauauucagauaggagaugguguuucgauggagaacgcaacaaucaaguacuggaagaaaacauggauguagaaauauggacaaaagaaggagaacguaagaaacuacgaccaagguggcuagacgcgaggacguauucagauccucuagcauuaagagaguucaaagaauuugcugccgguaggcguucggucucaggggaucuaauucuagaaauugggaaacugccacaacaucuaacacaaagggcucagaaugcauuggacaacuuagugaugcuacacaauucggaacaaggcggcagagcuuauaggcacgcgauagaggaacugccagacacaauagaaaccuugauguuguuagcacuaauagccguguuaacaggagguguuacacuuuucuuucuuuccggucgaggucuuggcaaaacuucuauuggccugcuauguguaauggcauccucagucuuacuauggauggcaagcguugaaccucacuggaucgcagcuuccauaauccucgaguucuuucuaaugguucuauuaauuccugagccugaucggcaaagaacaccacaggacaaccaacuagccuaugugguuauuggacuccuuuuuaugauccucaccguagcugcuaacgaaaugggauuauuggagaccaccaaaaaggaccuuggaauaggucauguugccguugagaaccaucaucaugcugcuaugcuugacguggaucuccaccccgcgagugcguggacauuauacgcgguagccacaacgaucauaacgccaaugaugcgucauacuaucgaaaauaccacagcaaauauuucucucacugcaauagcaaaucaagcggccauuuuaaugggucuugauaaaggauggccgauuucuaaaauggacauuggaguaccacuacuagcccuaggcuguuauucacaagugaauccauuaacguuaacugcugcuguauuaaugcugguugcccauuaugcuauuaucggacccggacuacaagcuaaagcuacgagagaagcgcagaaaaggaccgcagcagguauaaugaaaaacccaacuguugacggaauuguagcaauagauuuagauccaguaguuuaugaugcaaaauucgaaaaacaguugggccaaauaaugcuauugauuuugugcacaucccagauucuauugaugagaacuacaugggcucuuugugagaguaucacuuuagcgacgggaccacuaacaacgcucugggaaggcucacccggaaaguucuggaauacuacaauagcuguaucuauggcuaauauuuuucgagguuccuaucuugcuggagcuggacuugccuucucguuaaugaaaucauugggagguggaagaagagguacuggugcccagggcgaaacucuuggcgaaaaauggaaacggcaacuaaaucaauugagcaagagcgaguuuaacacauacaagagaagcggcauuauggagguugacagaucggaagcuaaagaggggcuaaaaagaggagaaacaacuaagcaugccguuucaagggguacggcaaagcucagaugguucguugaaagaaaccuugucaaaccugaaggcaaaguuaucgaucuagggugcggcagagggggauggucuuauuacugugcuggacugaagaaaguuacugaggugaagggguacacuaaaggaggaccaggucaugaggaaccaauaccuauggcaacauacggauggaaucuaguuaaauuacauuccgggaaagacgucuucuuuauaccgcccgaaaaaugugauacacuauuaugugauauuggcgaaaguucgccaaacccaaccaucgaagaaggccguacuuuaagaguacuaaaaaugguugagccaugguuaagagggaaucaauuuuguauaaaaauacuuaacccauauaugccaucuguaguggaaacuuuggaacagaugcaaaggaaacacggagguaugcugguaagaaacccucuaucaagaaauagcacgcacgaaauguacugggucaguugcggaacugguaauaucguaagcgcagugaauaugacgagucguauguuauuaaauagauucaccauggcacauagaaaaccaaccuaugaaagagauguagaucuuggggccgguacgcgacauguagcagucgaacccgaaguagcuaacuuggauauaauaggccaaagaaucgaaaauauaaaacacgaacauaaaagcaccuggcauuaugaugaggauaacccuuauaagaccugggccuaucacggaucuuacgagguaaaaccauccgguucagcuucuucaaugguaaauggaguagucaaacugcucacaaaaccgugggaugugauaccuaugguaacccaaauugccaugacggauacaacccccuuuggucagcaacgaguuuucaaagagaagguugauacacggacaccgaaggcuaaacgagggacagcacaaauuauggaggugacggcuaaauggcuuuggggauuccugucaagaaauaagaaaccuagaauaugcacgagagaagaguucacucgcaaggugcgaucaaacgcggcaaucggagcgguguucguugaugagaaccaauggaacucagcaaaagaagcaguagaagaugaaagguuuugggauuuaguucacagagaaagagaacuacauaaacaaggaaaaugcgcaacauguguguacaauaugaugggaaaaagggagaagaaauuaggggaauuuggaaaagcaaagggaagucgugcuaucugguacauguggcucggggcacgauucuuagaguuugaggcuuugggauuuaugaacgaggaccauugguuuagcagagaaaauagcuuaagcggaguagagggcgaagguuugcauaaguuaggauauauauuacgcgauauauccaagauucccggugggaauauguaugcagacgauacagcaggaugggacacaagaauaacggaagaugaccuccaaaaugaagccagaauaacugauauuauggaaccagaacaugcccuauuggcgcguucuauauucaaacugacauaucaaaauaagguuguuagaguacagagacccgccaaaaacggaaccguaauggauguuauaucgcguagggaccagagaggaagcggccaagugggaacauauggacuaaauacauuuaccaauauggaagcccaauuaauaagacaaauggaaucugaaggcauauuuaguccauccgaauuagaaacucccaacuuggcagaacgaguucuagacugguuggaaaaauauggaguagaaagauuaaagaggauggccauuaguggugaugacugcguuguuaaacccaucgacgauagauucgcuacugcuuuaacagcguuaaacgauauggguaaaguaagaaaggauauaccccaaugggagccgucuaaagguuggaacgauuggcaacaagucccuuuuugcucucaucacuuccaucaauuaauaaugaaagaugguagagaaauaguaguuccuugcaggaaucaggacgaacugguaggacgugcgaggguaagccaaggagcgggguggucauuaagggaaaccgcaugcuuagguaaaaguuaugcacaaauguggcaacuuauguauuuucauagacgcgaucuacgucuagccgcaaaugcaauauguuccgcggugccugucgauuggauuccgacaucuaggacuacauggucaauacaugcccaucaucaauggaugacaacugaggauaugcuuucuguauggaaccgaguguggauugaagaaaacccuuggauggaagacaaaacucauaucucaucauggggugauguaccguacuuagggaagcgcgaagaucaauggugcgguucauuaauaggauuaacggcucgagccacuugggcaacuaacauucaaguagcgauaaaccaaguuagaagauuaauuggcaacgaaaauuauuuagauuauaugacgagcaugaaaagauuuaaaaacgaaucggauccggaaggagcacuaugguaa

SEQ ID NO: 21992 - RNA, 9879 nt, Artificial Sequence
  derived and/or modified CDS sequence (opt6) from DENV-1__JQ045638__SS-prME
aguguuacuauguuguugaugcugaugcccacagccuuagcauuucaucugacaacaagggguggggaaccucauaugauuguuuccaaacaagaaagaggaaaaagccuucuauucaaaacaagcgcagggguaaacauguguacucucaucgcaauggacuuaggcgaauugugugaagacacaaugacuuacaaauguccaagaaucacagaaacagaaccagacgauguugauugcugguguaaugcgacugacaccugggucacuuacgggacuuguagucaaacuggggaacacaggcgugauaaacgcaguguagcccuggcuccccacguagguuuagguuuagaaacaagaacagaaacuuggaugucgucggaaggugcauggaaacaaauacaaaggguggaaacgugggcauuaagacacccuggauucacagucauugcacuauuucuggcacacgcaauagggacaaguauuacacaaaaaggaauuauuuucauacuacuaaugcucgucacgcccucuauggcuaugaggugugucggaauaggcuccagagauuuugucgaaggacuauccggugcaacauggguagauguaguacucgaacaugguucuugcguaaccacuauggcuaaagauaaacccacacuagauauugaacuccugaaaacagaaguuacaaauccugcaguauugcguaaauugugcauagaagcuaaaauuucaaauacgacaacagacucaagaugucccacccaaggcgaagcaacucuuguagaagaacaggaugcuaauuuuguuuguagaagaacguuuguggaucgaggauggggcaauggcugcggacucuuugggaaggguucucuuauuacuugugcaaaauuuaaaugcgugacaaaauuagaaggaaaaauaguacaguaugaaaaucuaaaauacucugugauuguuacaguccauacgggcgaucagcaccaaguaggcaaugaaaguacggaacauggaaccacagcgacaauaacaccgcaagcccccacaacagaaauucagcuaacugauuacggagcuuuaacgcuagauuguuccccaagaacgggauuagacuucaacgagaugguucuacuaacuaugaaagaaaagagcuggcuuguccacaaacaaugguucuuagacuuacccuuacccuggacuucaggggcgaguacaagccaagagacuuggaauagacaagacuuauuaguaacguuuaagacggcccacgcuaaaaagcaagaagucguaguucugggaucgcaagaaggugccaugcauacagcauugacuggcgcuacggagauacaaaugucgggaaccacuacaauauucgccggucauuuaaaauguaggcuaaaaauggauaaauuaacacugaaaggaaugaguuauguuauguguacaggaaguuuuaaauuagaaaaagaagucgcagagacucagcacggcacuguacucguucagauaaaauaugagggcacagacgcuccuuguaaaaucccuuucagcacgcaagaugaaaagggaguaacacaaaacggaagauugauaacagcuaauccaauugucacagacaaagaaaaaccaguaaauauagaagcugaaccaccauuuggugagucuuacaucgugaucggggcuggagaaaaggccuuaaaacugucuugguuuaagaaagguucaaguauuggcaaaauguuugaagccacagcaagaggagccagacguauggcuauauuaggagacacagcaugggauuucggaaguauagguggggucuuuacgucgguagguaaacucguacaucaaauauuuggaacagcauauggaguacuauuuagugggguaaguuggacuaugaaaauuggcauuggcguacuauuaaccuggcucggacuuaacucaagaaguacaucccugaguaugacguguauagccgucggguugguuacccuauaucuuggagugaugguacaagccgauucggggugcguuaucaauuggaaaggaagggagcuuaaguguggcucuggaauauuugucacuaacgaagugcacacauggacagagcaauauaaguuucaagcagauucaccuaaaagauuaagugcugccauuggcaaggcuugggaagaaggcguuugcggaauacguucugcaacacgucuugagaacaucauguggaaacagaucucgaacgaauugaaucauauacuucuagaaaacgacaugaaguucaccguagucgucggcgauguugcuggaauuuuggcacaaggcaagaaaaugaucaggccacaaccgauggaauauaaauauucauggaaaucuuggggcaaagcaaagaucauaggagcugacguacaaaauacaaccuucauaauugauggaccgaacacaccagaaugccccgaugaucaacgagcguggaacaucugggaaguagaagauuauggauuugguauuuucacaacaaauauaugguugaaacuccgagauaguuauacgcagguaugcgaucaccgacugaugagcgcggcaauuaaggauaguaaggcugugcaugcggauaugggauauuggauagaaagcgagaaaaaugaaacguggaaauuggcacgcgcuaguuucauagaaguuaaaacuuguauauggccaaaaagucacacauuauggaguaauggaguccucgaaucugagaugaucauccccaaaauauauggcggaccaauaucccaacauaauuaucgcccaggcuacuuuacucaaacagcuggacccuggcaucuuggcaaacuugaauuagauuucgaucucugugaagguaccacagucguaguggacgaacacugugggagcagaggaccuuccuuaagaaccacuacugucacugguaaaauuauccacgaaugguguuguaggagcuguacccuaccgccacuacguuuuagaggcgaagaugguugcugguauggaauggaaauacgacccgucaaagaaaaagaagagaaccucguuaaaucgaugguuucagcggguagcggugaagucgauuccuugucuuuaggucugcuaugcauuucgauuaugauagaagaaguuaugcgaagccgcuggucaaggaagaugcuaaugacagguacauuagcaguauucuuucuauuaauuaugggccagcuaacauggaacgaccuaauucgacuguguauaaugguaggugcgaacgcaucggauagaaugggcaugggcacaacauaucuagcauuaauggccgcauuuaagaugaggccgauguuugcaguaggacuauuguuuaggcgucugacuagcagagaaguccugcugcuaacgaucggucucagcuuaguugccaguguggaauuaccuaacucgcuagaagaguuaggagacggacucgcuaugggaaucaugauacuaaaacuauugacagauuuucaaagccaucaacugugggcaacauuauuaucccugacauucauuaagacaacauuuucccugcacuaugcuuggaagacgauggcgaugguauugaguauuguuucuuuauucccguugugucuuaguacuacgagccagaagacuaccuggcuuccuguccuacuaggaagccuggguuguaaaccucuuaccauguuccuaauugcugagaauaaaauuugggguaggcgaaguuggcccuuaaacgaagguauaauggcugugggaauuguaucaaucuuacuaaguucauugcucaaaaaugacgucccacuagcagguccauugauagcaggagggauguugauagcuuguuacguaauuaguggaaguagugccgaucugucguuagaaaaagcagcugagguaucuugggaagaagaagcagaacauuccggugcuucucacaauauccucguagagguucaagacgaugggacaaugaagauuaaggacgaagagagagacgauacguuaacuauacuacuaaaagcuacauuacuagccgucucagggguauacccucucucgauaccggcuacuuuauucguuugguauuucuggcagaagaagaaacagaggucuggaguauugugggacacuccaucuccuccagagguagaacgggcuguguuggaugaugggauauauagaauaaugcagcgaggucuacuaggcaggagucagguaggcgugggugucuuucaggaaaauguauuucauaccauguggcacguuacuagaggagcaguuuugauguaucagggaaaaaggcuagaaccaucaugggccagugucaagaaagaucucauaucauauggaggaggguggcgacugcaagguucguggaauaccggggaagaaguacaaguaaucgcaguggaaccgggcaaaaauccaaagaauguccaaacagcaccgggaacauucaaaacgccugaaggagaagugggcgccaucgcauuagauuucaaaccuggaacaucaggaagcccuauaguaaacagagaggggaagauaguugggcuguacggcaacggcguggucacaacgucugguacuuauguaagcgcaauugcacaagcaaaagcaagucaagaaggaccacuaccugaaauugaagaugaaguguuuaggaaacgcaacuugacuauaauggaccuacaucccggcaguggaaaaaccagaagauaucuuccggcaauaguacgagaagcgaucaaacgcaaauugagaacacucauacuugcuccuacucgagucguggcauccgaaauggcugaagccuugaaaggaaugccgauaagguaccagaccacagcaguuaaaucagagcacacugguaaggaaaucgucgacuuaaugugccacgcuaccuuuacaaugaggcuguuaucuccuguuagggugccuaacuauaauaugauaauuauggaugaggcccauuuuaccgauccguccucaaucgcggcacgagguuauauaagcaccagaguaggaaugggagaagcggcagcaauuuuuaugaccgcgacaccgccggguucaguugaggcuuuuccacaaucuaacgcaguaauccaggaugaagaaagagacauaccagaacggaguuggaauagcggauacgaauggaucacugauuuucccgggaaaacggugugguucguaccgagcaucaaaagcggaaaugauauagcgaacugccuacguaaaaacgguaaacggguaauccaauuaucuagaaaaacguucgacacagaauaucagaaaacuaaaaacaaugauugggacuauguagugacuacugacauaucugaaaugggugccaacuucagagcagaucgugucauagauccaagaagaugucugaagccgguaauacucaaagacgguccugaaagaguaauucuagccggccccaugcccgugacuguagcaucugcugcacaaagacgaggccguauugguagaaaccauaauaaagaaggagaccaauauauauauaugggacaaccacucaauaacgacgaagaucacgcgcauuggacagaagcaaagauguugcucgacaauaucaauacgccagaaggaauaauacccgccuuguuugaaccggagagggagaaauccgcugccauagacggggaauaccgauugaggggugaggccaggaaaacuuucguugaacucaugagaagaggagaccuaccaguauggcuauccuauaaggucgcaucggaggguuuucaauacuccgaccgaagauggugcuucgauggugaacgaaacaaccaaguccuagaggaaaauauggacguagaaauauggacaaaggaaggagaaaggaagaaguuaagaccgcgcuggcuagacgcccguacguauagcgauccacuagcucugcgagaguucaaagaauuugcggcagggagacgaagcgucaguggagauuuaauacucgaaauaggaaaacuuccacaacauuuaacacaaagggcgcaaaacgcgcuugacaauuugguaauguuacauaauagugaacaaggugggcgggcguaucggcaugcaauugaagaacuuccggauacgauagaaacauuaaugcuuuuagcccuuauagcagugcucacugggggaguuacacuauuuuucuuaucagggagaggucuuggaaaaacaagcauuggauuguuauguguaauggcuuccaguguauuacuguggauggccucgguggagccacauuggauugcagccucaauaauccuugaguucuuucuaaugguacuacuuauaccugaaccagaucgacaacgcacuccacaagauaaucaacucgcuuacguaguaauaggauugcuauuuaugauauuaacaguugcugcaaaugaaauggguuuacuagaaaccaccaagaaagauuugggcauugggcaugucgcuguagaaaaccaccaucacgcagcaaugcuagauguggaucuacacccugcgucagcauggacacucuaugcugucgcgacaacuauaauuaccccaaugaugagacacacgauagaaaauacaacagcaaauaucaguuuaacugcuaucgccaaccaagcagcgauuuugaugggguuagacaaaggcuggcccauuucaaaaauggauauagggguaccgcuacuggcucuuggaugcuauagccaaguaaaccccuuaacgcuaacagccgcuguacuaaugcuaguagcacauuaugcgauaauaggaccuggcuuacaagcaaaggcgacaagagaagcucagaaacggacagcagcgggcauuaugaagaauccaacggucgacgguauaguggcaauagacuuagauccaguaguauacgaugcaaaauuugagaagcaauugggucaaauaauguuguuaauauuaugcacaucucaaauccuacuaaugcgcacuacuugggcacuaugcgagaguauaacccuagcaacaggcccauuaacuacccugugggaaggcagcccuggaaaguuuuggaauacuacgauugcgguaagcauggcaaauaucuuuaggggguccuaucuagcuggggcagguuuagcauucaguuugaugaaaucucuaggaggagguagaaggggcaccggagcgcaaggugagacacuaggggaaaaguggaaaaggcaacuuaaccaauuaucuaaaagugaguucaacacauauaaacgguccggaauuauggaaguugacagaucugaagcaaaagaagggcucaaaagaggcgaaacuacuaagcaugcaguaucacgcgguacagcaaagcucagaugguucguugaaagaaauuuagucaaaccagaggguaagguaauugacuugggguguggaagagggggaugggcauauuauugugcaggccuaaagaaaguuacugagguaaaagguuauacaaaaggugguccaggacaugaagaaccuauuccaauggcuacauauggauggaauuuggugaaguugcacagcgguaaagacguauuuuucauucccccagaaaaaugcgauacacuauugugcgacauuggagagaguaguccaaaucccaccauugaagaagggagaacguuaagaguauuaaaaaugguagaacccuggcuaagaggaaaccaauuuugcauuaaaauauuaaauccauauaugccuucagugguugagacauuagaacaaaugcaaaggaaacacgguggcaugcuagugagaaauccucucagccguaacucuacacaugaaauguauuggguuucuugugguacaggaaacauuguaagcgcaguaaacaugacaucacgaaugcucuugaacagauucaccauggcucacagaaaaccaacauaugaacgagacguugauuuaggagccgguacccgucauguagcgguugaaccugaagucgcuaaucuugauaucauaggccaaaggauagaaaauauuaaacacgaacacaaaaguaccuggcauuaugaugaagauaauccauauaaaaccugggcauaccaugguagcuacgaaguaaaacccucugguucagccagcuccaugguuaacggaguaguuaaacucuugacgaaaccaugggacguaauacccaugguuacacagauagccaugacugacaccacacccuuuggucagcaacguguauuuaaagagaagguagauacuaggacuccaaaagccaaacgcgguacugcacaaauuauggaagugacagcgaaauggcuguggggcuucuugaguagaaauaagaaaccuaggauaugcacgagagaagaauuuacucgcaagguaagaagcaaugccgcaauuggagcgguauucgucgacgaaaaucaauggaauagugcaaaagaagcugucgaggaugaaagauucugggaucugguccaccgugaacgagaacuacauaaacaaggaaaaugugcaacaugugucuauaacaugaugggcaagagagagaagaaacuaggugaguucgguaaagcaaaaggcaguagggccauaugguacauguggcuaggcgcaagauuccuggaguucgaagcacuaggcuuuaugaaugaagaucacugguucuccagggagaauagccuaaguggggucgaaggugagggacuacauaaauuaggauacauuuuaagagauauuagcaaaauuccaggcgguaauauguaugcugaugacacggcuggaugggacacuagaauaaccgaagaugaucuacaaaacgaagcgcggaucacugauauaauggaacccgaacaugcccuauuggcacgaucaauauuuaaacuaacguaucaaaauaaaguaguuagaguccaaagaccagcgaaaaauggaaccguaauggaugucaucagucgcagagaccaacgagggagcggacagguuggaacauauggauuaaacacauucacaaauauggaagcucaauuaauacgucagauggaaucagaaggcauauuuucccccucagaguuggaaacaccgaacuuagccgagagaguauuagauugguuagagaaauauggcguugaaagacucaaaagaauggcuauaucgggagacgacuguguagucaaacccauagaugauagauuugccaccgcacuaacagcucuaaacgauauggggaaaguccgaaaagauauuccacaaugggaacccucuaaaggauggaacgauuggcagcaaguacccuuuuguucacaucacuuccaccaacuuauaaugaaagacgguagggaaauagucguuccuugucgaaaccaagacgaauuagugggccgagcaagagugucccaaggagcggguuggagucuaagagaaacugccugucuaggaaaaucauaugcacaaauguggcaacuuauguacuuccauagacgcgauuuaagauuagcagccaaugcgauuugcucagcaguuccaguagauuggauaccgacaaguagaacaacauggucuauacaugcgcaccaccaauggaugacaacggaagauauguuaagugucuggaaucggguauggaucgaagaaaauccuuggauggaagauaaaacccauauuucaucauggggugacguuccauaucuaggcaaaagggaagaccaauggugugggucccuaauuggacuaaccgcaagagccacaugggcuacaaacauacaaguagccaucaaccaaguucgcagguugauuggaaaugaaaauuauuuagauuauaugacaucuaugaaacgauuuaaaaaugagagugacccggagggugcccuaugguga

SEQ ID NO: 21993 - RNA, 9879 nt, Artificial Sequence
  derived and/or modified CDS sequence (opt6) from DENV-1__JQ045639__SS-prME
agcguaacuauguuucuaauguuaaugcccacugcgcuugcuuuccaccuaacuacgagagguggggaaccucacaugauagucaguaaacaagaacgugggaaaagccuacuauuuaaaacgagugccgggguaaacaugugcacuuuaauugcgauggaucucggugaacuaugugaagacacuaugacguauaaaugcccucgcauaacugaaacagaaccagacgauguugauuguugguguaaugccacugauacauggguaacauaugggaccugcucccaaacgggggaacaucgcagagauaaacggagcguagcgcuugcuccacauguggggcuuggucucgaaaccagaacagaaacauggaugaguucagaaggagcauggaaacaaauacaacguguagaaacaugggcgcuuagacauccagguuuuacgguaauugccuuauuccuggcccacgccauagggacuagcauaacgcaaaaaggaauaauauucaucuugcuuaugcuaguuacgccaucaauggcaaugcgcugcguagguauugggucccgagauuucguggaagguuuaucuggagccacauggguagauguggugcucgaacacggaaguugcguaacuacaauggcaaaagauaaaccaacucuagacauagaacuacucaaaacugaaguuacgaauccagcuguacuaagaaaauuaugcaucgaggcaaaaaucagcaacacgaccacagacucaagauguccaacccaaggugaagcgacauuaguggaggaacaagaugcgaauuucguuuguagacgaacauuuguagaucgggguugggggaauggaugcggacuauuugggaaggguaguuuaauuacaugcgcaaaauucaaguguguaaccaaacuagaagggaaaauuguacaguaugaaaaccuuaaauauucgguaauagucacuguacacacgggugaucaacaccaaguggggaacgaaucuacagagcauggcacaacugcaacgauuacuccgcaagcgccgacuacggaaauacaguuaacagacuacggggcauuaacacucgacuguucgccgagaaccggucuugauuucaacgaaauggugcucuuaacaaugaaggaaaagaguuggcucguucauaagcaaugguuccucgaucuaccacuaccauggaccuccggagccaguacaagucaggaaacauggaaccgacaagaucugcuuguuacauucaaaacagcccacgcaaagaagcaggaggugguuguuuugggaucucaagaaggagcaaugcacaccgcuuuaacuggcgcaacugaaauacagacaaguggcacaacuacuauauuugcuggacaccugaagugcagacuaaaaauggacaaacuaacauuaaaggggaugaguuauguaauguguacagguucguucaaauuagagaaagaguuagcagagacgcaacaugguaccgugcuuguucagauaaaguaugagggaacagaugcaccuugcaaaauacccuucaguacucaagaugagaagggaguaacacaaaaugggagauuaauuacugcuaacccaauagugaccgacaaagaaaaaccaguaaauaucgaggcugaacccccauuuggagaaucauacauagucauaggugcuggcgaaaaagcacugaaacucucuugguuuaagaaaggauccagcauuggcaaaauguuugaagccaccgcaagaggagcgcgaagaauggcaauacuaggugauacagcaugggacuucggaaguauagguggugucuuuacaagugugggaaagcuaguacaucaaauauuugguaccgcauacgguguucuauucucaggcguuuccuggacuaugaaaauuggcauaggaguacugcucacauggcuaggauugaacucacgaaguacgagucuuucaaugacguguaucgccgucggauuaguaacacuguaucuaggaguuaugguccaagcugauucaggauguguuauuaauuggaaaggaagagaacuuaaaugcgggaguggaauuuucguaacuaacgaaguacauacguggacggaacaauacaaguuucaagcagauucaccaaaaaggcugucggcugcuauuggcaaagcaugggaagaggguguguguggaauuagaagcgcuacacgcuuagaaaacauuauguggaaacaaauuagcaaugaguuaaaccacauuuuauuagaaaaugacaugaaauuuacugucgucguaggggauguggcuggcaucuuagcacaaggcaagaaaaugauccguccacaacccauggaauauaaauauaguuggaaauccuggggcaaagcgaagauaauuggagccgacguucagaacacaacguucauaauugaugggccaaauacucccgagugcccugacgaccaaagagcguggaacauaugggaaguugaagacuauggcuucgggauauuuacaacaaacauaugguugaaacuacgagauucauacacucagguuugcgaccaucgucuuaugucggcagcgauaaaggacaguaaagcaguucacgcagacaugggauauuggaucgaaucugagaaaaaugagacguggaaguuagcacgagcaaguuucaucgaagugaaaacuuguaucuggccaaagucacauacuuuauggaguaauggcguucuggagucagaaaugauuauuccaaaaauuuacgggggcccgauuucucaacauaauuaucgaccaggauacuuuacgcaaacagcagggccauggcacuuaggaaaacuugaauuggacuucgacuugugcgaagggacuacagucguuguugacgaacacuguggaaauagaggcccuagcuuaaggacuacaacaguuaccggaaaaaucauacaugaauggugcugucguaguugcacacuaccaccucucagauucagaggagaggacggaugcugguacggaauggaaauccgacccguaaaagagaaagaagaaaaccucgugaaaucgaugguauccgcagguucgggagaaguggauaguuucucacugggcuuguuauguauaucgauaaugaucgaagagguaaugcguagcagauggucaaggaaaaugcucaugacaggaacgcuggcaguauuuuuccuauuaauaauggggcaacuuacuuggaacgauuuaauucgacuaugcaucaugguaggugcgaacgcaucugacagaaugggaauggguacgacuuacuuggcccuuauggcaacguuuaagaugagaccaauguuugcgguaggcuugcucuuuagacgguuaacauccagagaaguguuauuacugacgaucggauugagccuaguagcgucugucgaguuacccaacucgcucgaggaauuaggagauggucuggccaugggaauaaugauauugaaacuucugaccgacuuucaaagccaccaauugugggcaacauuacuaucacuuacuuuuauaaagacuacauucuccuuacauuacgcauggaagacuauggcaaugguacugucgauagucuccuuguucccguuaugucucucuacaacaagucagaaaacaaccuggcuaccgguacucuuagguagcuugggcuguaagccgcucacgauguuucugauugcggaaaacaaaaucuggggucgacgaucauggccacucaaugaaggaauuauggcggucggcauuguaucaauauuacuguccagccuacucaaaaacgaugucccacuagcaggaccauuaauugcaggaggaauguugaucgcaugcuacguuauaagcggguccagcgcggaccugucacuagaaaaagcagcagaaguaucaugggaagaagaagcggaacacuccggggcuucacauaauauauuaguagaagugcaagaugacgggacaaugaaaauuaaggacgaagagagagaugauacucuaacuauccuauugaaagcgacacuuuuagcggucucagggguauauccacucucuauucccgccacacuauuuguuuggcacuuuuggcaaaagaagaaacagagaucuggaguucucugggauaccccuucaccaccagaggucgaaagagcaguguuagaugacggaaucuaucguauaaugcaaaggggcuugcuaggucggagucaagucgguguagguguauuucaagaaaacgucuuccauacaauguggcauguaaccagaggugccguacuaauguaccagggaaaaagacuagaacccuccugggcuucaguuaagaaagauuuaauauccuauggaggaggguggagauuacaagguaguuggaacacuggagaagagguacagguuauugcaguagaaccgggcaaaaacccuaagaacguacaaacagcacccggaacuuucaaaacaccagaaggagaaguuggagcgauagcucuugauuuuaaaccaggaaccaguggaagccccauagucaauagagaaggaaaaaucguaggguuauacggaaacggcguagucacaacgagugggaccuauguaagugcaaucgcacaagcccgagcgucacaagaaggcccuuuaccugaaauagaggaugaaguauuucgaaaaagaaaucucacgaucauggaucuacauccuggauccgggaaaacaaggcgauaccuucccgcgauuguucgugaggccauaaaaagaaaauuaaggacacuaaucuuagcuccaacuagaguaguugcgucagagauggccgaagcucuaaaaggaaugccuauaagauaccaaacgaccgcuguuaagucagaacacacaggaaaagagauaguugaucucaugugccacgcaacguuuaccaugagacuuuugucgccaguaagaguaccaaauuauaacaugauaauuauggaugaagcucacuuuacagauccaucgucuauugcugcaagagguuacauuucaacucguguaggaaugggagaagcagcugcgaucuucaugacggcuacgcccccaggaagcguagaggcauuuccacagucaaaugcuguuauacaggaugaagaaagggacauacccgagcgcucauggaacucagguuacgaguggauuaccgauuuucccggcaagacgguuugguuuguaccaucgauuaaaagugguaacgacaucgcaaacugucucagaaagaacgggaaaagaguaauccagcucaguagaaaaaccuuugauacugaauaucagaaaacuaaaaauaacgauugggauuacguaguaacuacagauaucucagaaaugggugcuaacuuccgggcugaucguguaauagaccccagacguugucuuaagccagugauacucaaagauggcccugaaagaguuauuuuggcagguccuaugccaguaacagucgcaucggcugcacaaaggagaggaagaauuggacgaaaucauaacaaagaaggggaucaauacaucuacauggggcaaccucucaauaacgaugaagaccaugcacacuggacagaggcaaaaaugcucuuagacaauaucaauacucccgagggaauuauuccagcacuauucgagccagaaagagaaaaaucagcugcgaucgacggugaauauagguuaagaggagaggcacgaaaaacguuuguugagcuaaugcggagaggagauuuaccagucuggcugucuuauaaagucgcaucagaaggauuucaauacucggacagaagaugguguuuugauggggaacggaauaaccaaguccuagaagaaaauauggacguagagauuuggacgaaggaaggugaaaggaagaaacucagaccaaggugguuagacgcaagaacguacagugauccgcuugcauuacgugaauuuaaagaguuugcggcaggcagaaggucagugucaggagaucucauauuagaaauugguaaauuaccacaacauuuaacacaaagagcacaaaaugcccuagauaaucuuguuaugcuacauaauagcgaacagggaggcagggcauaccggcacgcaauggaagaguuaccggacacaauugaaacucuaaugcuacuugcucuaaucgcaguuuugacuggugggguaacgcuuuucuuccuuaguggcagaggauuggggaaaacaagcauugguuugcuuugcguuauggcuucgucugcacuccucuggauggcgaguguggaaccgcauuggauagccgcuaguauuauuuuggaguucuuuuuaauggugcucuuaauuccugaaccagaccgacaaagaacaccucaggacaaccaacuagcguauguuguuaucggauuacuguucaugauacuuaccguugcagcuaaugaaauggguuugcuagagaccacaaagaaagaucuaggaauaggucaugccgccguagagaaucaucaccaugcggcaauguuagauguagaccuucauccagcauccgcauggacacuguacgcaguagccacaacaauuaucacaccuaugaugagacacaccauagaaaauacaacggcaaacauaucccugacugcaauugcaaaucaggcggcaaucuuaauggguuuggacaaaggauggccgauaaguaagauggacauuggugugccgcuacuggcccuggggugcuacucccaaguaaacccacugacauuaacagcagcuguguuaauguuaguagcucauuaugcaauaauugggccggguuuacaagcaaaagcuacuagggaagcccagaagaggacagcagcagguauuaugaaaaacccaacaguagaugggauuguggcaaucgaucuugauccaguuguuuaugaugcaaaauucgaaaaacaauuaggacaaauaaugcuucuuauacuguguaccucccaaauacuuuuaaugagaacuacuugggcauuaugcgaaucaauaacacuugccaccgggccguuaacuacacugugggaaggaucacccggaaaguucuggaauacgaccauagcgguuagcauggcgaauaucuuuagaggaagcuaccuagccggugcugguuuggcguuuucauuaaugaaaucauuaggaggagguaggagggguaccggagcgcaaggugaaacuuuaggggagaaauggaaaagacaacuuaaucaauuauccaagucugaauuuaauacauauaaaagaucaggaauuauggagguugacagaucggaagccaaagaaggacuaaaacgaggcgaaacaacuaaacacgcuguaucaaggggaacugcuaaauuacguugguuuguugagagaaaccuaguaaaaccagaaggaaaaguaauagauuuaggauguggccgagguggauggucauauuauugcgccggauuaaagaaggucaccgaaguaaaaggcuauacuaaaggcgguccaggccaugaggagccgaucccaauggcaacauacggguggaauuugguaaaacuacauucaggcaaagauguauucuucauaccaccagaaaaaugcgauacuuuacuuugugacauuggagaaucaagcccaaacccgacaauugaggaagggcgcacgcuaaggguucuuaaaaugguagagccaugguuacguggaaaucaguucuguauuaaaaucuuaaacccuuauaugcccucugucguagaaacuuuagaacagaugcaaagaaagcacggagggaugcuaguacguaacccacucaguagaaacucuacacacgaaauguauugggucaguuguggaacugguaauauuguuucugccguuaacaugacuagccgcaugcuccugaauagguucacgauggcacauaggaaaccgacauaugaaagagauguagacuuaggggcgggaacacggcauguugcagucgaaccagaggucgcuaauuuggauauaaucggacaaagaauagagaacauuaagcaugaacacaaaucaaccuggcauuaugacgaggauaaucccuauaagacaugggcauaccacggaucuuacgaaguaaaaccaagcggaagcgcuucaucuauggucaauggaguuguaaaauuauuaacaaaacccugggacguaauacccaugguuacucaaaucgcuaugacagauacuacuccauucggucaacaacgaguauucaaggaaaaaguagacaccagaacuccaaaggcaaagcgugggacagcccaaauaauggaaguaacggcuaaauggcuaugggguuucuuaucaagaaacaaaaagccgcguaucuguacccgagaagaauuuacacgaaagguacgcucgaaugcagcaauaggcgcaguauuuguagacgagaaccaguggaacucagcaaaggaggcuguagaggacgaaagguucugggacuuaguacauagggaaagggaauuacauaagcaagguaggugcgcaacaugcguuuacaacaugaugggaaagcgggagaagaaauuaggagaauuugguaaagcaaaggguaguagagcaauaugguacauguggcuaggggcgcgcuuuuuagaguucgaagcauuaggauuuaugaacgaagaucauugguuuucgcgggaaaauagcuuaagcggcguugaaggugaaggauuacauaaacuaggcuacaucuuacgcgacauuucuaaaauaccaggcggaaauauguacgcugaugauacagcggggugggauacuagaauaacagaagacgauuuacaaaacgaagcaagaaucacugauauaauggaaccugaacaugccuugcuugccaaaaguauuuuuaaacugacuuaccaaaauaaggugguaagaguccagagaccagcuaaaaauggcacaguaauggacguaauaaguagaagagaccaacguggaucaggucaaguaggaacuuauggccuaaauacguuuacaaauauggaagcacaauuaauuaggcaaauggaauccgaaggaauuuuuaguccaagugaauuagaaacacccaaccuagcugagagaguacuugauugguuggaaaaguauggaguagaacgacuuaaacguauggccauaucgggagacgacuguguaguaaaaccaauagacgaucgauucgcaacugcuuugaccgcacuuaaugacauggggaaaguaagaaaagacauaccccaaugggaaccaaguaaaggauggaacgauuggcaacaaguuccguucugcagucaucacuuccaucaauuaauuaugaaggaugguagagaaauugugguaccgugccggaaucaagacgagcuaguggggcgagcucgcguuucacaaggagcaggauggucacuacgagagacugcaugcuuggguaaaucuuacgcacaaauguggcagcucauguauuuucaucgacgugacuuaagacuugcagcuaaugcgauuuguucagccgucccggucgacuggauaccaacaagccggacuacuuggaguauacaugcccaccaucaauggaugaccaccgaggauaugcucucgguuuggaaucgaguuuggauagaggagaauccguggauggaagauaaaacgcauauaucaaguugggaagauguaccauauuuagggaagcgcgaagaccaauggugcggaagccuaauagggcugacagccagagccacgugggcaaccaacauucaaguagcgauuaaucaagucagaaggcuuauuggcaaugaaaacuaucuagauuauaugacaucaaugaaacgauuuaaaaaugagucugauccggaaggagccuuaugguag

SEQ ID NO: 21994 - RNA, 9879 nt, Artificial Sequence
  derived and/or modified CDS sequence (opt6) from DENV-1__JQ045641__SS-prME
ucaguaacuauguuacuaaugcuuaugccuacagcgcuugcuuuucauuuaaccacccgugggggagaaccacauaugauaguaucuaaacaagaacgugguaaaucguuacuauuuaaaacauccgcaggaguaaacauguguacuuuaauugccauggaucuuggugaacucugcgaagauaccaugacuuauaaauguccucguauaacagaaacugaaccagaugauguagauugcugguguaacgccacugauacuuggguaaccuauggaacgugcucccaaacuggagaacacaggagagacaaacgaucaguggcacucgccccacauguagggcuaggauuagaaaccagaacagaaacauggauguccucagaaggggcuuggaaacaaauacaaagaguugaaacgugggcacuucgacauccaggauucacaguaauagcgcuauuccuagcacaugcaauagggacaaguaucacacaaaaaggaauaauuuuuauauuacuuaugcuaguuacaccaaguauggcuaugaggugcguaggaauuggaagcagggacuuuguagaaggacuuucaggugcuacuuggguagacguagucuuggaacacgggagcuguguaacaacuauggcaaaagauaaaccuacacuagacauugaacuacuaaaaacagaagucacaaacccugcaguauuaagaaaacucuguauagaagcgaaaauuagcaauacgacgacugacagucgauguccaacccaaggcgaagcuaccuuaguugaagaacaagaugcaaauuuugucugcaggcggacuuuuguagaucgugguuggggaaauggcuguggcuuauucggaaaagguucauugauuacuugcgcaaaauuuaaaugcguaacaaaauuagaagguaaaauaguucaauacgaaaauuuaaaauauucgguuaucguuacaguacacacaggcgaccaacaucaaguaggaaaugaaaguacugaacacggaacuacagcgacgauaacuccccaagcaccaacaacggaaauacaauuaacagauuauggugcauuaacacucgauugcaguccccgcacuggacuggauuucaacgagaugguacuccucacaaugaaggagaaaagcuggcucguacacaaacaaugguuuuuggauuuaccauuaccauggacaucaggagcaucuacaagucaagaaacauggaaucgccaagacuuguuagucaccuucaagacagcacaugccaagaaacaagagguaguagugcuggguagccaggagggagcuaugcacacugcacucaccggugcaacugaaauucaaacuuccggaacuaccacuaucuucgcgggucaccuaaaauguagauuaaaaauggacaaauuaacacucaaaggaaugagcuaugugauguguacugggagcuucaaauuggaaaaagaacuugcagaaacacaacaugguaccgucuuaguacagauaaaguaugaagggacugacgcuccgugcaaaaucccuuucucaacucaagaugaaaaagguguugcccaaaauggaagacuuauaacugcgaacccaauagucacggauaaagaaaaaccuguaaauaucgaagccgaacccccuuuuggcgaaaguuauauagucauaggggcaggcgaaaaagcgcucaaacuuagcugguucaagaaagguuccaguauagguaaaauguuugaagccacagcaagaggugcaaggagaauggcaauucucggagauacugcgugggacuucgguucuauaggagggguguucaccagcguuggcaaauuaguccaucaaauuuuugggacagcauacggaguguuauuuagcggcguaucauggacaaugaagauagggauaggggucuuauuaacgugguuaggauuaaacucuaggucuacaaguuuaaguaugacuugcaucgcgguaggacuuguuacgcuauaccugggaguuauggugcaagcagacagcggcugcgugaucaacuggaaaggcagagaacuaaaaugcggaagcggcaucuuuguuacgaacgaaguucauacauggaccgaacaauauaaauuccaagcugauagcccgaaaagacuaagugcagcgauaggaaaggcuugggaagagggaguaugugggauuaggucugccacuagguuagaaaacauaauguggaaacaaauuucgaacgaguuaaaucauauacuccuggaaaacgacaugaaauuuacuguggugguaggcgacgucgcagggauucuagcacagggcaagaaaaugauacgaccucagccgauggaguacaaauauucauggaaaagcuggggaaaagcuaaaauuauaggagcggauguccagaauacuacauucauaauagacgguccuaacacgccagaaugccccgaugaccagcgugcauggaacauaugggaaguugaagauuauggauuuggaauauuuacaacuaauauauggcucaaauuacgagacucuuauacacaaguaugcgaccaccgauuaaugagugccgcgaucaaagacagcaaggcaguucaugcagauaugggcuauuggauagaauccgaaaagaaugaaacauggaaacuugcaagagcgucuuucauugaaguaaaaacauguauuuggccgaagucucacacgcuguggaguaauggcguacuugaaagugaaaugaucauuccuaaaauauacggagguccaauaucucagcauaacuauaggcccggcuacuuuacucaaacugcaggucccuggcaccuaggaaaacuagaauuagauuuugaucucugugaagguacuacaguagugguugaugaacacuguggaaaccguggucccagcuugagaacuacaacugugacaggcaaaauaauacaugaguggugcuguagaagcuguacguugccaccacuuagauucagaggagaagacgggugcugguaugggauggaaauuaggccagugaaagaaaaagaagagaaccuaguaaaaucuaugguaucugccggaucgggcgaaguagauuccuuuagcuuaggccuccucuguaucucuauaaugauagaagagguaaugagaucaagauggucuagaaaaauguuaaugacaggcacacuagcugucuucuuccuguugauuaugggacaguuaacauggaacgaccuaauuaggcucugcauaaugguaggcgcgaaugcgagugacagaaugggaauggguacaacguauuuagcguuaauggccaccuucaaaaugcgacccauguuugcaguaggucuauuauucaggcgcuuaaccuccagagagguguuacuacuaacaaucggccuaucauuagucgcgaguguugaacuuccaaacagccucgaggaauugggagauggacuagcuauggggauuaugauccuaaaauuauuaacagauuuucagucacaccaauuaugggcaacacuguuaucauugacauuuauuaagacgacguugagccuacacuacgcauggaaaacaauggccaugguccugaguauaguaaguuuauucccuuuguguuuaucuaccaccagucagaaaacaacauggcuucccgugcuacuaggaagccuugguuguaagccuuuaacaauguuuuuaaucgcagaaaauaagauaugggggagaagaaguuggccucuuaaugaagguauaauggccguuggaauuguaucaauucuccugaguucucuauugaagaaugaugucccauuagccgguccauugauagcuggcggaaugcuaauagcuugcuaugucaucucagguaguucugcggaucuaucuuuagaaaaagcggcagaaguuaguugggaagaagaggcggaacacaguggugcaucucacaauauccuaguagaaguacaagaugacggaacuaugaaaaucaaagacgaggaaagagacgauacauuaacgauauugcuaaaagcuacacuucuagccguuucgggaguauacccgcuaucaauaccagcuaccuuauucgucugguauuuuuggcaaaagaagaaacaaagaucagguguguuaugggacacuccaucgccuccugaaguggagagagcgguauuggaugacgggaucuacaggauuaugcaaagaggauuacuuggacgaucacaaguuggagugggaguauuccaagaaaauguguuucacaccauguggcacguuacaagaggagcuguccuuauguaucagggaaaaaggcuagaaccauccugggccucagucaaaaaggaccuaauaucguauggaggggguuggcgauuacaagguucuuggaauaccggagaagagguucaagucauagccguggaaccaggcaaaaauccuaaaaacguccagacugcuccuggcaccuucaaaacccccgaaggcgaaguaggagccauugcauuagauuucaaaccuggaaccucuggaucacccauagucaaucgagaagggaagauuguaggacuuuacgggaauggcguggucacuacaucaggaacauacguuucagcuauagcacaggcuaaagcuagucaagagggaccucugcccgaaauugaagaugaagucuuucguaaacgaaaccuaaccaucauggauuuacauccaggcaguggaaaaacacguagauaccuaccagcaaucgugcgagaggcaauaaaacgaaaacuuagaacccugauacuggcaccaacgaggguuguagcaagugaaauggcagaagcacuaaaaggaaugccaauucgauaccaaacgaccgccguaaagucagaacacacggguaaggagaucguagaucuuaugugucacacaacuuuuacuaugcgguugcuuucacccguucgaguaccaaacuacaauaugauuauuauggaugaagcacacuucacugaucccaguucaauagcggcuagaggguauauaaguaccagaguggggaugggcgaagcggcagcaauauuuaugacggcgacacccccgggaucaguugaagcauuuccccaaucgaaugcuguaauacaagaugaagaaagagauaucccagagcguucauggaauagcggauacgaauggauuacagauuuuccaggaaaaacgguaugguuugucccaaguauaaaaucuggaaaugauauagcaaauugccuaagaaagaacgguaaaagagugauacagcugagcaggaaaacauucgauacagaguaucagaaaacgaagaacaaugacugggacuacguaguuaccacagacauuagugaaaugggagcaaacuuccgugcggauagggugaucgacccuaggcggugucugaaaccuguuauacugaaagaugggcccgaacgcguaaucuuagccgguccuaugccggucacggucgcaagugcggcacagagacgcggccguauaggcagaaaucauaauaaggaaggagaccaguauaucuacaugggucaaccccuuaacaaugaugaagaucacgcacacuggacagaagcaaaaaugcucuuggacaauaucaauacuccugaggguaucauaccagcgcuguuugagccagaacgcgagaaaagcgcugccaucgacggagaauaucgacuacgaggugaagcacggaagacauuuguagaauuaaugaggaggggagaucuaccuguauggcuaucauauaaagucgcgucugaaggauuccaauacagugauagacgcugguguuucgacggcgaaaggaacaaccaaguuuuagaagaaaacauggacguggaaauuuggacgaaagaaggggaacgcaagaaacuuagaccacguugguuggacgcacgaacuuacagugacccauuggcuuuaagagaguucaaagaguucgcugccggaagacgaucagugucgggggaccugauacuugagauaggaaaguuaccccaacaccuaacacagcgggcacaaaacgcacuggauaaccuuguaauguugcauaauagugagcaagguggaagggcauacagacacgcaauggaagaacuuccggauacaaucgaaacucuaaugcuucuagcuuugaucgcaguacugacgggaggagucacauuauucuuuuuaucaggacguggucuugguaaaacgaguauagguuuacucuguguaauggccaguucaguguuacuuuggauggcaaguguugaaccccacuggaucgccgcaucaauuauauuagaguucuuccuuaugguccuacuuauucccgaaccggaucggcaacgaacaccacaagauaaucaauuagcuuauguuguuauaggguugcuauucaugauacuuacaguagccgcaaaugaaaugggauuacuagaaacuacuaagaaagacuuaggaauagggcacguggcuguugaaaaucaccaucaugcagcuaugcucgauguugaucuucacccugcgagcgcguggacguuauacgcaguagcaacaacuauuauaacaccgaugaugagacacaccauagagaacacaacugccaauauaucacugacagcaauugcgaaucaggccgccauacucaugggacuugacaaaggcuggccaauuagcaaaauggauauagguguaccuuuauuggcacugggauguuauucacagguuaaucccuugacgcuaacggcagcagucuuaaugcuaguugcgcauuaugcaauaauuggcccaggacugcaggcgaaagccacuagagaggcgcagaaaagaacugcagcaggaaucaugaaaaauccgacaguugacggcaucguagcuauagaucucgauccagucguauacgaugcaaaguucgaaaaacaacuuggucaaaucauguuacuaauauuauguaccucucaaauauuacugaugcguacaaccugggcuuuaugcgaaaguauaacccuagcaaccggaccucuuacaacccuuugggaagguaguccaggaaaauuuuggaauacaacaaucgcggugucaauggccaacauuuuucggggaaguuaccuagccggagcaggccuagcauuuucccucaugaaaucacucggaggagggagacgaggaacaggcgcccaaggagaaacgcuaggagaaaaauggaagcgacaguuaaaucaauugagcaaaagcgaauuuaauacauauaaaagaagugggauaauggaaguagacagaagugaagcaaaagaaggacuuaagagaggcgagacaacuaagcacgcuguaucacgugggacagcaaaacugagaugguuugucgaaaggaaucuuguaaaaccugaagguaaagucauugaucuugguugcggaagaggaggguggagcuacuauugcgcaggucucaagaaaguaacagagguaaaaggauauacgaaagggggcccgggccacgaagaaccaauacccauggcgacguacggcuggaauuuagugaagcuacauucuggaaaagacguuuucuuuaucccuccggagaaaugugacacacuuuuaugcgacaucggcgaguccucgccgaacccaacuauugaagaaggaagaacguuaaggguguuaaaaaugguugaaccauggcuccgcgguaaccaauucuguauaaaaauucuaaacccuuauaugccauccguaguugaaacucuugaacaaaugcaaagaaaacauggugguauguugguccgaaacccacuaagucgaaacucaacgcacgaaauguauugggugagcuguggaacggguaauauagucucagcgguuaacaugacuagccgaauguuacucaaucgguuuacaauggcucauagaaagccgaccuaugagagagauguugaccuuggggcgggcacccgucaugucgccguagagccggaaguagcaaaucuugacauaauuggacagagaauagaaaacauaaagcaugaacacaaaaguaccuggcauuaugacgaagacaauccauacaaaacaugggcauaucaugguaguuaugaagugaaacccucuggcucagcaaguucuaugguaaauggaguaguaaaacuccugacgaagcccugggacguaauaccaauggucacacaaauagccaugacugauacuacaccauuuggucagcaacguguauuuaaagagaagguagacacgcguacaccgaaggcuaaaagaggaaccgcacaaauaauggagguaacugccaagugguuauggggcuuucuaucucgcaauaagaaacccagaauauguacaagagaggaguucacuagaaaaguuagguccaaugccgcuauuggcgcagucuucguagaugaaaaucaauggaauagugcgaaagaagcagucgaagaugaacgguuuugggauuugguacauagagaaagggaacugcacaaacaaggaaaaugcgcuaccuguguauauaacaugaugggaaaacgagagaagaaacuaggggaguuuggaaaagcaaaagggagucgugcgaucugguauaugugguuaggagcccgauuccuagaguucgaggcauugggguuuaugaacgaagaucacugguuuagcagggaaaacucacucuccgggguagaaggugaaggauuacacaaacuuggcuacauauuacgagauauaaguaaaauaccgggcgguaauauguaugcagaugauaccgcaggaugggacacuagaauuacagaagacgacuuacaaaacgaagcuagaauaacggauaucauggaaccagagcaugcacuucuugcuaaaucaauauucaaauuaaccuaccaaaauaaaguaguaagaguacaacgaccggcaaagaacggcacugugauggauguaauaucaagaagagaccaaaggggaaguggacaaguaggaacguacggauugaauacauuuaccaauauggaagcucaauuaaucagacaaauggaaucagaagguauuuuuagcccgucggaauuggaaacgccgaaucuggcggaacggguacuagauugguuagaaaaauacggaguagaaaggcucaaaaggauggcuauuucuggagacgauuguguaguuaaaccaauugaugaucgauucgcaacagcuuuaacggcauuaaacgacaugggaaaagucagaaaggauauaccucagugggagccaagcaaagguuggaacgauuggcaacaggucccauuuugcagccaccauuuccaucaacucauuaugaaagauggacgcgaaauagugguucccugccgcaaucaagacgaacucgugggcagagccagaguaucucagggagcagguuggucauuaagggaaacagcaugccuaggcaaaucuuaugcgcagauguggcaacuaauguauuuucacagaagagaucugcgauuggcagcgaaugcaauuugcagugcgguaccugucgauuggauaccaacaucucgcacgaccuggagcauccacgcucaccaccaauggaugacaacagaggauaugcugagugucuggaauaggguauggauugaagaaaauccguggauggaagauaaaacccauaucucuucguggggagacgucccguacuuagguaaaagagaagaccaaugguguggguccuugauugggcucacagcccgggccaccugggccacaaauauucagguagcuauuaaucaaguccgccguuugauagggaacgaaaacuauuuagacuacaugacaucgaugaagagauuuaagaacgaaagugaucccgaaggagcacuuugguaa

SEQ ID NO: 21995 - RNA, 9879 nt, Artificial Sequence
  derived and/or modified CDS sequence (opt6) from DENV-1__JQ045642__SS-prME
ucagucacgauguugcucauguugaugccgacugcuuuagcauuucauuuaacgacaagagguggcgaaccccauaugauagucagcaaacaagagcgaggcaaaucgcucuuauuuaaaaccucagcagggguaaacauguguacguugauagcaauggaccucggugaauuaugugaagacacaaugacguacaaaugccccagaauaacggagacggagccagacgauguugauuguugguguaaugcuacagacacgugggucacauaugggaccuguagccaaacgggcgaacaccgccgcgauaaaagaucugucgcauuagcgccucauguugggcugggucuagaaacccgcacagaaacguggaugucaucugaaggggcuuggaaacaaauacaacguguggaaacgugggcucuacggcauccgggauuuacaguaauagcacuauuucuagcacacgcgauagggacaaguauaacgcaaaaaggaauaaucuuuauacuucuaaugcugguuacaccgaguauggccaugcguuguguagggauaggaucacgggauuuugucgagggucugucaggagcaacauggguugacgugguacuggagcauggaucauguguaacuacaauggcaaaagauaaacccacauuagauauugaauuauuaaaaacagaagugacaaauccugccguccuccggaaacugugcauugaggcaaaaaucucaaacaccacaacggauaguagguguccaacacaaggcgaggcaacuuuaguggaagaacaagaugcaaauuuugugugucguagaacguuuguggacagaggcugggguaaugguuguggacucuucggcaaaggcagucuuauuacgugcgcaaaauuuaaaugugucacaaaauuagaaggaaaaauaguucagugcgagaacuuaaaauauuccgugauaguaacaguacacacuggugaccaacaucaaguagggaaugaaucaacagaacacgguaccaccgcaaccauuacuccucaagcuccaacuacggaaauacaacuaaccgacuacggcgcccuaacuuuagauugcucuccgcggacuggccuagauuucaaugagaugguuuuauuaacuaugaaagaaaaaucauggcuaguacacaaacaaugguuucuagaucuuccacuaccauggacaucaggcgcuucuacaucacaggaaacuuggaaccgacaggaucucuugguaacuuucaaaacagcacacgcuaagaaacaagaggucguaguacuaggcagucaagaaggagcaaugcacaccgcuuuaacgggcgcuacagaaauacaaacuuccgggacaacuacaauauuugcaggacaucucaaaugucgcuuaaaaauggauaaacuaaccuuaaaagguaugucauaugugaugugcaccgguucguucaaauuagagaaggagguggcagaaacacaacauggaacgguguuagugcaaaucaaauacgaaggaacggacgcaccauguaagauuccauucagcacgcaagaugaaaaaggggugacacaaaacgguagguugauuacagcaaauccgauuguaacggacaaggaaaaaccugucaacauagaggcggaaccaccauucggcgaaagcuacaucguuaucggagccggggaaaaagcauuaaaauuaagcugguuuaagaaaggaaguucuaucggaaaaauguuugaagcaaccgcaagaggugcucgaagaauggcuauacuuggcgauacugcaugggauuuuggcucuaucgguggugucuuuacaagcguggggaaacugguacaccagauauucggaacugccuacggagugcuuuuuaguggaguaucuuggacaaugaaaauaggaauaggaguauuguuaacuugguuggggcuuaacuccaggucuacuucacuuucgaugacauguauagcuguaggucuggugacuuuauaucuuggagugaugguacaagcggauucaggauguguuauaaauuggaaaggaagagaacuuaaaugcgggagcgguaucuucguaacuaaugaaguacauacuuggacugaacaauacaaauuucaggcugauagccccaaacggcuaucagcugcgauuggcaaagccugggaagaaggcguauguggcauacguagugcaacuagguuagaaaacauaauguggaaacagauuagcaacgaacucaaucauauucuacuugagaaugauaugaaauuuacuguggucguuggugaugucgcgggcauacuugcccaaggaaagaagaugauccggccgcaaccuauggaguacaaauauucauggaaaagcuggggaaaggccaaaauaauaggugcugacguccaaaacaccacauucauuauagacgguccaaauacgccagaguguccagaugaccaaagagccuggaacauaugggaaguugaagacuacgguuuugguauuuuuacuacuaauauuuggcugaagcuacgagacucuuacacacaaguuugcgaccaccguuuaaugagugcagcuaucaaagacucaaaggcagugcaugccgacaugggauacuggauagagagugaaaagaaugaaacuuggaaauuagcuagagccaguuuuauagaaguaaaaacuuguauauggccaaaaucacauacgcuaugguccaauggcguacuagaguccgagaugauaauacccaagauuuacgggggaccaauaagucaacacaauuaccgaccaggcuauuuuacucagacugcagggccauggcauuuagggaaauuagaauuagauuucgaccuuugugaaggcacgacaguaguuguugaugaacacuguggaaauagagggccaucuuuacgaaccacgaccgucacggguaaaaucauacaugaaugguguugcagguccuguacacucccaccucuaagguucagaggagaggaugguuguugguacggcauggaaauuagaccuguaaaagaaaaagaagaaaaucuuguuaagagcauggucucagccgggucuggggagguugacucuuucagucuaggauuauuauguauuuccaucaugauugaagaagugaugcgcucucgguggucgagaaaaauguuaaugacaggcacccuagccguauucuuucucuuaauuaugggucaacuuacguggaaugauuuaauaaggcuauguauuauggugggugcuaacgcaagugaccguauggguaugggaacaacauauuuggcacucauggcuacguuuaagaugaggcccauguucgcaguaggauuauuguuccgaagguugacaucucgagagguauuacuuuuaacaaucggauuaagccuaguagccaguguagaauuaccaaauagccuagaagaguuaggagauggcuuagcgaugggaaucaugauacuaaaacuucuuacagauuuucagucucaucaauuaugggcaacauuauuaagccuaacuuuuauaaaaacgacauucucacuacacuacgcguggaaaaccauggcgaugguauuaagcauagugagucuuuucccauuaugccugucgacaaccagccagaaaacuaccugguuaccaguccucuuaggaucccugggcugcaaacccuuaacaauguuucuaaucgccgaaaauaaaauaugggggagaagaucuuggccacuuaaugaagguauuauggcgguaggaauaguuucuauacuuuugaguucgcuccugaagaacgauguaccacuagcuggaccacuaaucgcaggaggaauguuaauugcauguuacguaauuucaggaaguucagcagauuuaucuuuagaaaaagcagcagaaguaagcugggaagaagaggcugagcauucaggcgcaagucacaauauuuuaguugaggugcaagaugauggaacaaugaaaauaaaagacgaagagagagaugacacgcuaaccauucuccuuaaagcaacguuauuagccgucucaggaguuuacccuuuaaguauaccggcgacauuauuugucugguacuucuggcagaaaaagaaacaaagaucaggaguuuugugggacacucccucaccacccgagguggggcgcgcagucuuagaugauggcaucuaccgaauaaugcaacgaggacuacuuggacguagucaaguaggugugggcguguuucaagaaaacguguuccacaccauguggcauguaacucguggggccguucuaauguaucaaggaaaacgcuuagaaccaucgugggccucagucaagaaagaccuuauuaguuacggaggugguuggagacuccagggaucauggaauaccggggaagaaguucaaguuauugcgguagaaccagggaaaaacccaaagaauguccagaccgcgccggggacuuucaaaacaccugaaggagaaguaggggcuauugcguuagauuuuaagcccggaacaucagguucuccaauaguaaacagagaagguaagauaguaggguuauacggcaauggaguaguuacaaccucuggcaccuacgucucagcaaucgcacaggcaaaagccagccaagaaggucccuuaccagaaauagaggacgaaguuuucagaaagagaaauuugacuauaauggacuugcacccagguucgggcaaaacaagaagauaucuacccgcaauaguaagggaagcgauuaaaagaaaacuaagaacucuuauccuagccccgacacggguaguugcaagcgaaauggcugaagcguuaaaaggaaugccaauuagguaucagacaacggcaguaaaaucggagcauacgggaaaagaaauaguggaucuaaugugccacgcuaccuucacuaugaggcugcucagcccggucagagugccuaacuauaauaugauuauuauggaugaagcucacuuuacugauccuucgucaaucgccgcacgaggauauauaucaacuagagugggaaugggggaagcugccgcgaucuuuaugacugcaacaccuccagguucgguugaggcauuuccucaauccaacgcgguaauacaggaugaagaacgggauauuccagaacgauccuggaacaguggcuaugaauggauaacugauuuuccaggaaaaacagugugguuuguuccaagcauaaaaucugguaaugauauugcaaacugccuccgaaagaauggaaaacguguaauccaauuguccaggaagacauuugacacggaauaccagaaaacuaagaauaaugauugggauuaugugguaacgacugauauuucagaaaugggugccaacuuucgagcugaucgcguaauugauccuagaagaugucucaagccuguaauauuaaaagaugguccugaaagaguuauacuugcaggaccaaugccaguaacuguagcuucugcggcacaacgaagagguagaauagguagaaaccacaauaaagaaggagaccaguacauauacaugggucagccgcuaaauaaugacgaggaucaugcacacuggacugaagcaaaaauguuacuagauaacauaaauacaccggaggggauaaucccggccuuauuugagcccgaacgagagaaaagugcagcuauagacggugaauaccgauugcgaggagaagcucgaaagacauuuguagaauuaaugagaagaggagaccucccaguuuggcuuucguauaaaguugcaagcgaaggguuucaauacagugaccgacgguggugcuuugauggcgagcguaacaaucaaguguuggaggaaaacauggaugucgaaauuuggacaaaggaaggagaaaggaagaaacucagaccacgauggcuugacgcgcguacguauagcgauccauuagcguuacgggaauuuaaggaguucgccgcagguagacggucaguaucuggcgaccucauauuagaaauuggaaaacuaccccaacaucuaacgcaaagagcacaaaaugcuuuagauaacuuaguaauguugcacaacagugaacagggagggagagcguacaggcaugcgauggaggaacugccagacacuauagaaacauugaugcuacuagcauuaaucgcgguauugaccgggggcgucaccuuauucuuccuaucaggacgugggcuaggcaagacgucaauaggauuacuguguguuauggccaguucgguguuacuguggauggcauccguggaaccccauuggaucgcagcaaguauaaucuuggaauuuuuccugaugguauuauuaauuccagaacccgauaggcaacggacaccucaggauaaucaauuggcauauguuguaaucggccugcuauuuaugauacuaacaguugccgcaaacgaaaugggacuauuggagacgacuaagaaagacuuaggaaucgggcauguagccguagaaaaccaucaccaugcugcuaugcuagacguagauuuacauccugcaucagccuggacacuguaugcuguggcaacuacuauuauuacacccaugaugagacauacaauagaaaacacuacagcaaauauaagucuuaccgccaucgcgaaccaagcagcuauacuaaugggauuagauaaaggguggccgauaaguaaaauggacauuggagucccucuacuugcauuaggcugcuauagucaaguaaauccgcuaacacuaacagccgcgguucuaauguugguagcucauuacgcgauaauaggaccaggcuuacaagcaaaggcuacgagagaagcacagaaaagaacagccgcaggaaucaugaaaaauccuacuguggauggaaucguagccauugaucuagauccuguugucuaugaugcuaaauucgagaaacaauuaggacagauaauguuacuaauucuuuguacaagucaaauauugcuaaugagaacgacaugggcuuuaugugaaagcaucacacuagcaacaggcccacuaacaacucuaugggagggcaguccaggaaaauucuggaauacaacaaucgcaguaagcauggcaaauauuuuucgaggaaguuaucuagcaggagcuggauuagccuuuagucuuaugaagucucuuggagggggacggagagguacaggcgcacagggagaaaccuugggggaaaaguggaaacgacaauugaaccaauugucaaaaucagaauuuaauacauauaaaagaagugguauuauggaaguagauagaucggaagcgaaagaaggauuaaaacgcggagaaacaaccaaacacgcggugagccgggggacugccaaauuacggugguuuguggaaagaaauuuggucaaaccugaaggcaaaguaauagauuuagguugcggucgagguggcuggucauauuacugcgcaggacuaaagaaggucacagaaguaaaaggauacacgaagggagguccaggacaugaagaacccaucccaauggcuacguacggcuggaaucuuguaaagcuccauucuggaaaagauguauucuuuauaccuccagagaaaugugauacauugcuaugugacauaggcgaaucuucuccuaauccaacaaucgaagaaggcaggacacuacgcgugcuaaagaugguagagccaugguuaagaggcaaccaauuuugcauaaaaauacuaaacccguacaugccgaguguagucgagacauuagagcagaugcaacgaaaacacggagguaugcucguucggaacccccuuagcaggaacucuacacacgagauguauugggugucgugcggcacuggaaauauagugucagcggucaauaugacaucccgcaugcucuuaaacagauuuacgauggcccauagaaagccaacauaugaaagagauguagauuuaggugcaggcacacgacacguagcaguugaaccagaaguugcgaaccuagacauaauaggacaacggauagaaaacauaaaacaugagcauaaaagcaccuggcauuaugaugaggacaauccauacaaaacuugggcguaucacggcucguacgagguuaagccaucagggagugcgaguucgaugguaaacggaguugugaaguugcucacaaaacccugggacguaauaccaaugguaacgcagauagccaugacggauacgacuccguuuggucaacaaaggguauuuaaagagaaagucgacacucgcacaccuaaagcaaaacggggcacugcacaaauaauggaagugacggcgaaauggcuaugggguuuucuaagcagaaacaagaaaccaaggauuuguacacgcgaagaguucacucgaaaaguacgaucaaacgcggcaauuggagcagucuuuguugaugaaaaccaauggaauagugcaaaggaagccguugaggaugaaagauuuugggauuugguacacagagaacgagaacuacauaagcaaggaaagugugcaacauguguuuacaacaugaugggaaaaagagagaagaaacuuggugaguuuggcaaagccaaaggcucaagggcuauaugguacaugugguuaggggcaagauuuuuagaauuugaggcucuaggauucaugaacgaagaccacugguuuucuagagagaacucgcuaucaggaguugaaggugaaggucugcacaaacuagguuacaucuuacgugauaucagcaaaauaccagguggaaacauguaugcggaugacacagcuggcugggauacucgaauaaccgaagaugauuuacagaaugaagcuagaaucacagacauaauggaaccugaacacgcacuauuggcaaaaagcauuuuuaaguuaacguaucaaaauaaagugguaaggguccagaggccugcgaaaaauggaacugugauggauguaauuagccgucgugaucaacgaggaucaggccaaguuggaacguauggacugaauacguucacgaacauggaagcacaguuaauacgucagauggaauccgaggguauauucagcccaucugaguuagaaacaccgaacuuagcugagagaguacuagauuggcuagaaaaauacgguguagaacggcuaaaacgaauggcgauuaguggagaugauuguguuguuaaaccuauagaugauagauuugccacugcacugacugcacuuaaugauaugggcaaaguuagaaaagauauaccacaaugggaaccaucaaaagguuggaacgacuggcaacaagugccguuuugcucacaucauuuccaucagcuaauaaugaaagaugguagagaaauagugguccccugucguaaccaagacgagcuuguggggcgggcucgaguaagucagggagccgguuggagccuacgugagacagcuuguuuaggaaagaguuaugcucagauguggcaacucauguacuuccacaggcgagauuuaagacuagccgccaacgcgauauguucugcuguaccaguagauuggauccccacuucucgaacuacauggucgauacacgcacaucaucaauggaugacaacagaggauauguugucagucuggaauagaguuuggauugaggaaaauccauggauggaggacaaaacucauaucucauccuggggagacguaccuuacuuggguaaaagagaagaccaauggugcggcucucuuauaggcuuaacagcuagagcaaccugggcaacaaacauccaaguagcaauuaaucaagugagaagauuaauaggaaaugaaaacuauuuagauuacaugacuucgaugaaacguuucaagaacgaauccgaucccgagggcgccuugugguaa

SEQ ID NO: 21996 - RNA, 9879 nt, Artificial Sequence
  derived and/or modified CDS sequence (opt6) from DENV-1__JQ045644__SS-prME
ucaguuacuaugcuuuuaaugcuaaugccuacggcauuagcauuucaucuuaccacgcgugggggugaaccgcauaugauuguaucaaaacaagaaaggggaaaaucucuauuguuuaaaacuucagcugguguaaauauguguacuuuaauagcaauggauuugggagaacuaugugaagauaccaugacuuacaaauguccgcgaauaacagaaacagaacccgacgacguagacuguuggugcaaugcaacggacacauggguaaccuauggaacuuguucucaaacaggggaacauagacgagauaaaagaucggucgcacucgcaccccacguaggauugggacuugaaaccaggacugaaaccuggaugucaucggaaggugcguggaaacaaauucaaaggguggaaacaugggcacuaaggcacccaggcuuuacaguaauugcccuauuucuugcccacgcgaucggaacaagcauuacccaaaaagguauaauauuuauccuauugaugcuaguaacgccgucaauggcaaugagaugcguugguauaggauccagagauuuuguugaggguuuaucaggugcuacguggguagauguuguuuuagaacauggcagcugcguaacuacuauggcaaaagacaaaccaacauuagauauugaacugcuuaaaacugaagucaccaaucccgcgguacuuagaaaauuauguaucgaagcaaaaaucagcaauaccacgacugacagucgauguccaacucaaggagaagcuacccuuguugaggaacaggacgcuaauuucguuugucgucgaacuuuuguagauagaggauggggaaauggauguggucuuuucgguaaagguucacuuauuacaugugcaaaauuuaaauguguuacaaaacuagaagguaaaaucgugcaauaugaaaauuuaaaauauuccgucauagugacaguacauacgggagaccagcaucaaguagguaaugaauccacagaacaugguacaacugcaacaauaacaccacaagcuccuaccacagagauucaacuuacagacuacggugcuuuaacauuggacugcaguccgagaacaggacuugauuuuaaugaaauggugcugcucacuaugaaagagaaaaguugguuaguccacaaacagugguucuuggauuuaccauuaccauggacauccggugcaagcacuucacaagaaacauggaauagacaggaucuacucguuacauucaaaaccgcucaugccaagaaacaagaaguagugguacuugggagucaagaaggcgcaaugcauacggcccucacuggggcgacagaaauccaaacgucaggcacuacaacgauuuucgcuggacauuuaaaauguagauugaaaauggauaaacuuacuuugaaaggaaugagcuacgugaugugcacgggaucguuuaaauuagaaaaagaaguagcagaaacgcaacaugguacgguacuggugcagauuaaguaugaaggaacugacgcgccuuguaagauucccuuuaguacccaggaugaaaaaggcguaacucaaaauggucgacucauaaccgcgaauccuauugucacagauaaagaaaaacccguaaacauugaagcugaaccacccuuuggggaaucauauauagugauaggagccggugaaaaggcccucaaacuaucaugguucaagaaagguucaaguauuggaaaaauguuugaagcuacagccagaggagcuagaagaauggccauuuuaggagacacagcaugggauuuuggaucuaucggagggguauucacaaguguuggaaaauuaguccaucaaauauuugguacggcauacgguguacuauuuucagguguaucguggacaaugaaaauuggcaucggagucuuguuaacguggcuuggauuaaauucuagaucaacauccuuaagcaugacuugcauugcagucggccuagugacacucuauuuagguguuauggugcaagcagauucggggugugucaucaacuggaagggucgagaacuaaaauguggguccggaaucuuuguuacuaacgaaguccacaccuggacggaacaauacaaauuucaagcggauucuccaaaacgacuuagcgcggcaaucggaaaggcuugggaagaagguguguguggcauaagaucagcaacaagauuagaaaauauaauguggaaacagauaucaaaugagcucaaucacauuuuguuagaaaaugacaugaaauucacugucguuguaggagaugucgccgguauacucgcucaagggaagaaaaugauaagaccgcaaccaauggaguacaaauauaguuggaaaucuuggggaaaagcgaaaaucauaggagcugacguucaaaacacgacauuuaucaucgacggcccgaacacaccagaauguccagacgaccagagagcuuggaauauuugggaagucgaagacuacggcuuugggauauucacuacaaacauuuggcuaaaguugagagacaguuauacacagguaugugaucaccgacugauguccgcugcaauaaaagacucaaaagcaguacacgccgacaugggauauuggauagagucagaaaagaaugaaacuuggaaauuggccagagcguccuuuauugaaguuaaaacuugcaucuggcccaaaagucauacauuaugguccaacggcguauuggaaucugaaaugauuauaccuaagauauaugguggaccaauuucucaacauaauuaucgaccaggcuauuucacacaaacggcaggaccauggcaucucgggaaauuagaauuagacuucgauuuaugugaagguacgacuguagugguugaugaacacuguggcaauagagguccaucuuugcgaacaaccacuguuacgggaaagauaauucaugaauggugcuguagaucguguacgcugccaccacucagguucagaggagaggacggcuguugguauggaauggaaauacgaccaguaaaagagaaagaggaaaaccugguaaaaucaaugguauccgcugggagcggagagguagacaguuuuucacucggacuacuuuguauaucaauuaugaucgaagagguaaugcgaaguagguggucacgaaaaaugcugaugacaggaacccucgcaguauucuuucuucuaauaauggggcaauuaacauggaacgaccucauacgacugugcauuauggucggggcuaaugcuucagauaggaugggaaugggaaccacuuaccucgcccuaauggcagcuuucaaaaugagaccaauguuugcaguuggauugcuuuucagacgacugacaucacgcgagguccugcuacuaacaauuggauuaagccuaguggccucgguugaacuaccuaacucacucgaagaacuuggagauggacuugcaaugggcauuaugauacugaaauuauuaacagacuuucaaagucaucaacucugggcgacucuguuaaguuuaacauuuauuaaaaccacauucagucuccacuaugcauggaaaacaauggcgaugguucuuucuauuguaucauuauucccacuauguuugucaacaacuucacaaaagacaacauggcuacccguauuauuaggaagccuugguugcaagccauugacuauguucuuaauagcagagaacaaaauuuggggacguagaucuuggccuuuaaaugaaggcauaauggccgugggaauaguaaguauucuacucagcuccuuacucaaaaaugauguaccuuuagccggaccacuaauagcugguggcaugcugaucgcauguuauguaauaagcggauccuccgcagauuugucucuggagaaagcggcugaagugucuugggaagaagaggccgaacacaguggugcaagccacaacauacuuguagaaguccaagaugaugggacgaugaaaauaaaagacgaagaacgagacgacacguuaacgauuuuacuaaaagcuacucucuuagcgguaucaggcguauacccccuaucaauuccagcuacauuauucguaugguauuuuuggcagaagaagaaacaaagaucaggggugcucugggauacuccuucaccaccugaaguggaaagagccguauuagaugacgguauauaucggaucaugcagaggggucuacuggggaggucacaaguaggaguuggcguauuccaagagaauguguuucauaccauguggcacguuacacgaggugcaguuuugauguaucaggguaaacgacuggaaccaucaugggcuagugucaagaaagaccuaauauccuacggaggcggauggcgucuacaaggaucauggaauacgggcgaagaaguccaagugauagcgguggaacccggcaaaaaucccaaaaauguacaaacggcaccuggaaccuuuaaaacgcccgaaggagaggugggugcuaucgcucuagacuucaagcccggaacgaguggaaguccaaucguuaacagggaagguaagauagucggacucuauggaaacgguguuguaacuacaucagguacauaugugucggcuauagcucaagcaaaggcgucacaagaagggccacucccugagauagaggaugagguauucaggaaacgcaaccugaccauuauggaucuucauccgggcuccgggaaaaccagacgauauuuaccugcuaucgucagagaggcuauuaaacgaaaacugcgaacuuuaauauuggccccaacuagaguaguggcgucagagauggcagaggcuuuaaaagguaugccaaucagauaucagacaacagcaguaaaaagcgaacauacuggaaaagaaauaguagacuuaaugugucacgcaaccuucacuaugcgacuguuaucaccugugcgagucccuaacuacaacaugauuauaauggacgaagcacacuuuacagauccaucaaguauagcugcccgagguuauauuucaacaaggguuggaaugggagaggcagcagcaauuuuuaugacagcuacaccacccggaaguguugaggccuucccucaaagcaaugcaguaauacaagacgaagaacgugauauaccugagaggagcuggaacucagguuaugaauggauaacugacuucccuggaaaaacaguuugguuuguacccaguauuaaauccggaaaugacauagcuaauugccuuaggaaaaauggaaaaagaguuauccaauuaucaaggaaaacguuugauacagaauaucagaaaacgaaaaauaaugacugggauuaugucgugacuacugacaucucggaaaugggugcaaauuucagagcagaucgugucaucgaucccagacgaugcuugaaaccugucauauugaaagauggaccugaacgcguaaucuuagcaggaccaaugccaguaacagucgcaucagcugcgcaacguaggggccguaucggccguaaucauaacaaagaaggagaucaauauauuuacaugggucaaccacuaaacaaugacgaagaccaugcucacuggacagaggccaaaauguuacuggacaauauuaauacuccagaagggauuauaccggcuuuguucgagccggaaagagagaaaucugcggccauagacggggaguaccgccuccggggagaggcuagaaaaacauuuguugagcuuaugcgcaggggagaccuuccagucugguugagcuauaagguugcuucagagggguuccaauauagugauagacggugguguuucgacggugaacgcaauaaccaaguauuagaagaaaauauggaugucgaaauauggaccaaggaaggagaaagaaagaaacuaagaccgcguuggcuagaugcuagaacuuacucugacccccuggcguuacgggaauuuaaagaguucgcagcaggaaggcguaguguaaguggagacuugauacuggagaucggaaaguuaccacaacaucuuacgcagagagcucaaaaugcacuugacaauuuaguaaugcuacauaauagugaacagggaggccgugcauaucgacacgcuauggaagaacucccagauacgauagaaacauuaauguuguuggcacucauagcgguccugacaggagggguuaccuuauucuuccuauccggucgaggcuuaggaaaaacaucaauagggcuacuuugugucauggcaagcuccguucuguuauggauggcuucgguggaaccucauuggaucgcugcuucaaucauauuggaguucuuucuuaugguucuauugauaccggaaccagacaggcagagaaccccucaagauaaccaauuagcguauguagucauagguuuacuauuuaugauauugacagucgcggcaaaugaaaugggccucuuggagacaaccaaaaaggaucuagggauuggacacguugcuguggagaaucaucaccaugcagcuaugcucgauguggacuuacauccugcgagcgcuuggacacuuuaugcuguugcgacaacaauaauuacaccuaugaugaggcauacuauagaaaauaccacagcuaauauuucauuaacugcgauugccaaucaagcggcuauacuuauggggcuugacaaaggauggccuauuagcaagauggauaucgggguaccucuucuggcgcuagguuguuauagccaaguaaacccacugacccuaacugccgcuguacuuaugcuaguugcacacuacgcgauuauugguccaggacuacaagcaaaagcaacacgcgaggcacagaaaagaacagcagcagguauuaugaaaaacccaacaguagauggcaucguggccaucgaccuugacccgguugucuaugacgcuaaauuugaaaaacaacuaggacagauaauguuauuaauacuauguacaagccagauauuacuaaugagaaccacaugggcauuaugcgagagcauaacguuagcgacagggccauuaacgacacucugggaagggaguccuggaaaauuuuggaacacaacuauugcugugaguauggcuaauauauuccguggaucauaucuggcuggggcgggacuagccuuuucucuuaugaaaucacuagguggcggaagacggggcacuggugcacaaggcgaaacuuuaggagaaaaguggaaaagacaauuaaaccaacuaucaaaaucagaauuuaauaccuauaaaagguccgggauaauggagguggauagaagcgaggcuaaagagggguugaaaaggggagaaaccacaaaacacgcgguaucacguggcacggcaaaguugcgaugguuuguugaacguaauuuagucaaaccagagggaaaaguaauugaucuaggaugugggcgcggagguuggucauacuauugcgcgggucuaaagaaagugacagagguaaaaggguacaccaaagggggaccaggucacgaagaaccaauuccuauggcaacuuauggauggaacuuagugaaacuucacagcggaaaagacguguucuuuauaccacccgaaaaaugugauacgcugcucugugacauuggagaaucuucacccaacccgacuauugaagaagguaggacacuacgaguguuaaaaaugguagaaccauggcugagggguaaucaauuuugcauaaagauacucaacccauacaugccuucagugguugaaacuuuggaacaaaugcagagaaaacacggaggcaugcuagugcggaauccguuaucccguaacucuacucaugaaauguacugggugagcugcgggacggggaacauuguaucagcaguaaauaugacuucccgaaugcuauuaaauagauucacaauggcacauaggaaaccuacuuaugaacgugacguugaucuuggggcgggcacccggcauguggcgguagaaccagaaguagcgaaucuagauauuauugggcagcgcaucgaaaauauaaaacacgaacauaaaucuacguggcauuaugacgaagacaaccccuauaagacaugggcuuaucacgggucauaugagguaaaaccuuccgguucugcaagcaguaugguuaauggagugguaaagcuccucaccaaaccaugggauguaauaccuaugguaacccaaaucgcuaugacugacacaacuccauuuggacaacaaagaguuuucaaggagaaaguagacacuagaacgccuaaagcuaaaaggggaacggcacaaaucauggaaguaaccgccaaaugguuauggggauuccucagucgaaacaagaaaccacgcauaugcacacgagaggaauuuacacgaaaaguaaggucuaacgcggcuaucggggcagucuuuguagaugaaaaccaauggaacucggcaaaagaagccguugaagaugaacguuucugggaucuaguacauagagagagagaacuacacaaacagggaaaaugcgcgacguguguguauaauaugaugggaaaaagagagaagaaacucggagaauuugggaaagcaaaagguucacgggccauaugguacaugugguugggcgcaagauuccuugaguucgaggcuuugggauuuaugaacgaggaucauugguucucgagagaaaauagccuuuccgggguagaaggagaaggauuacacaaguugggauacauucuuagagacaucucaaaaauuccgggcgguaacauguaugcagacgauacagcgggcugggacacuagaaucacagaagacgaucuucaaaaugaagcaaggaucaccgacauuauggaaccugaacacgcucuauuagcucguaguaucuuuaaacugacauaccaaaauaaaguuguucguguacaacgacccgcuaaaaacgguacuguaauggacguaauuaguagaagagaccaaagggguucaggucaaguagguacauauggacuuaacacuuuuacuaauauggaagcccaguuaauuagacagauggaaagcgagggaaucuucucuccuucugaguuagagacuccaaaccuugcggaacgaguuuuggauugguuggaaaaauauggagucgagcgguuaaaacgaauggcuaucuccggagaugacugcgucguuaagccaauugaugacagguucgcaacugccuuaacagcauuaaaugacaugggcaagguccgaaaagacauaccacaaugggaaccuucuaaaggguggaaugauuggcagcaagugccauucuguagucaccacuuccaccaauugaucaugaaagaugguagggaaaucgucguuccaugucgcaaucaagaugagcuaguaggacgagcuaggguaagucaaggugcaggguggaguuugagggaaacagcauguuuagggaaaagcuacgcgcagauguggcaauuaauguacuuccaccgaagagaucuacgacuagccgcaaaugcuauuugcagugccgugccuguagacuggauaccgacaagucgaacuacuuggaguauacaugcgcaucaucaauggaugacgacagaagacauguuaucagucuggaaccgcgucuggauagaagaaaauccuuggauggaagauaagacacacauuaguucauggggagauguaccguaucuaggcaaaagagaagaccaauggugcgguucccuuauaggauuaacggcucgagcaacaugggcaacaaacauacaagucgcuauaaaucaaguuaggcgacuaauagggaaugaaaauuauuuagauuacaugacuucaaugaaacguuuuaagaaugagucagauccggaaggagcuuugugguaa

SEQ ID NO: 21997 - RNA, 9879 nt, Artificial Sequence
  derived and/or modified CDS sequence (opt6) from DENV-1__JQ045648__SS-prME
ucugugacuaugcuauuaaugcuuaugcccacugcauuggcauuucauuuaacuacuagaggcggcgaaccgcacaugaucgucucuaaacaagaaaggggcaaaucacuauuguuuaaaacaagugcagggguaaauauguguacuuuaauagcaauggaccuaggugaacuaugugaagauacuaugacauauaaauguccaagaauaacagaaacugaacccgaugaugucgauuguuggugcaaugcuacagacacgugggugacuuaugggacuuguucccaaacaggagaacaccggagggauaaaagaucuguagcccuagccccacacgugggacugggauuggagacgcgcacagaaacauggaugaguucggaaggcgcuuggaaacaaauccagcgaguagagacaugggcuuuacgacauccaggauuuaccguuauagcauuauuucuugcgcacgcaauaggcacaaguauaacgcaaaaaggaauaauuuuuauuuuacucaugcuagugaccccuaguauggcaaugagaugcguagguaucgguaguagagacuucguugaaggauuaagcggagcaacuuggguggacguuguccuggaacauggaaguuguguaacaacgauggcuaaagauaaaccaacauuagacauagaacuucugaaaacugaggucacaaauccagcuguuuuacggaaacuaugcauagaggcuaaaauaaguaauacgaccacagauucucgauguccuacacaaggagaagcuacacuuguggaggagcaggacgcaaauuucguauguaggagaacuuuuguggacagaggaugggguaauggaugcggguuguuugguaaaggaucgcugauaacgugugcgaaauucaaaugcguuacuaaacuugaagguaaaauaguacaauaugaaaauuuaaaauauaguguuauagucacaguucacaccggagaccaacaucaaguggggaaugagucaacugagcaugguacaaccgcuacaauaacuccucaggccccuaccaccgaaauacaacuaacagauuacggcgcauuaacuuuagacugcucaccccggaccggguuggauuucaacgaaaugguccuccuuacaaugaaagaaaaaucaugguuaguucacaaacaaugguuccuagauuuaccacucccauggaccagcggagcaagcacgagucaagagacuuggaaccgucaagaucucuuaguaaccuucaaaacagcucaugcgaagaaacaagaaguaguaguauugggaagucaagaaggggccaugcacacagcacuuacaggggccacagagauucaaacaucaggcacaaccacaauuuucgcaggacaucuaaaaugucgguuaaaaauggauaaauuaacccuuaaaggcaugucuuaugucauguguacaggaucauuuaaauuggagaaggaacuugcugaaacucaacauggaacaguauugguucaaaucaaguacgagggaacggacgcaccgugcaaaaucccauuuagcacccaagaugagaaaggagucgcucaaaacggaagacugauaacugcaaauccaauaguaacugacaaagaaaaaccugugaauauagaagcagaaccacccuucggugaaagcuauauagugauaggagccggggagaaagcccuaaaacucucaugguuuaagaaagguucguccauugggaagauguuugaggcgacagcacguggugcgcgucgaauggcaauucuaggggauacagcuugggacuuugguuccauuggaggaguauucacgaguguugggaagcuaguccaccaaaucuuugguacggcauauggaguacuauuuucugguguauccuggacaaugaaaauagggauaggagugcuuuuaacuugguuaggacucaauucuagaucgacuucucuuucaaugaccuguaucgcgguaggauuaguuacuuuauauuugggcguaaugguacaggcugauucgggcugcguuauuaacuggaaaggacgagaacucaaaugcggaucugggauauucguaaccaaugagguucacacauggacugaacaauauaaguuucaagcagauucaccuaagagguuaucugcugcaaucgggaaagccugggaggaaggaguuugugguaucagaagugcaacacgacuugagaauaucauguggaaacaaauaucuaaugaauugaaucacauacuauuggaaaaugauaugaaguucacaguagucguaggcgacguugcuggaaucuuggcgcaagguaagaaaaugauacgaccucaaccaauggaauacaaauauuccuggaaaucaugggguaaagcuaaaauaauuggggcugaugugcaaaacacuaccuuuaucauugacggaccaaauacgcccgaaugcccugacgaucaacgcgcuuggaauauuugggaagucgaggauuacgguuucggaauauuuacaacaaacauuuggcuaaaauuaagggacuccuauacacaaguuugugaucaucgauugaugagugcagcaauaaaagauucaaaagcuguucaugcugauaugggauauuggauagaauccgagaaaaaugagacguggaaacuggccagagccagcuuuauugaaguaaaaacaugcauuuggccaaaaagccauacacuauggaguaaugggguuuuggagucagaaaugauuaucccgaaaaucuacggcggaccgauaucucaacauaauuaccgcccggguuacuucacucaaacggcagguccauggcaucuaggaaaacucgagcuugacuuugauuuaugcgaaggaacaaccguaguuguugaugagcauuguggcaaucguggacccucccuaagaacuacgacuguuacaggaaaaaucauacaugaauggugcugcagaucuugcacacuaccaccauuacgauuucgaggugaagacggauguugguaugguauggaaauccgaccuguaaaagaaaaagaagaaaauuuagugaaauccaugguauccgcugggucuggagaggucgacucauuuagucuagggcuccuauguauaaguaucaugauugaagaaguaaugagaagucguuggagcagaaaaaugcuaaugacaggaacguuagcagucuucuuuuuauugauaaugggacaauuaaccuggaaugacuuaauacgacuuuguaucaugguuggggcgaacgcuucggacagaauggggaugggaacuacauaccuugcauuaauggcaacauuuaaaaugcgcccaauguuugcagugggacucuuauuuagaagguugacgagucgagaaguucuacugcucacaaucgguuuaucucuuguugcaaguguugaauuaccuaauucacuggaagaauugggugauggucuugcuaugggaauuaugauuuuaaaacuacuaacagacuuucaaucccaucaacuaugggcuacucuucuaucccugacauucaucaaaacgacccugucauuacacuacgcauggaagacgauggcaaugguauuaucaauuguuucacuauuuccacuuugcuugucuaccacaagucagaaaacuacuuggcucccaguccuguuaggaaguuuaggaugcaaaccucugacaauguuucuaaucgcagagaauaagauaugggggaggcgaagcuggccacuaaacgaagggaucauggcgguugguauugucuccauccuacucaguuccuuacucaaaaacgauguaccccucgcuggcccacucaucgccggagguaugcugauagcauguuauguaauuaguggaucuucagcugauuugagucuugaaaaagccgcagaagucagcugggaagaagaggccgagcauagcggagccagucacaauauacugguugaaguacaagacgacggaacaaugaagauuaaagaugaagaaagagacgacacacuaaccauucuguugaaagcuacguuacucgcagucaguggagucuauccauuaaguauaccugcuacgcuauuuguuugguacuuuuggcaaaagaagaaacaaagaagcgggguucuaugggacacuccaaguccuccagaagucgaaagagcuguuuuggacgauggaauuuauagaauaaugcaaagaggacucuuaggucgaagucaagugggaguaggagucuuccaagaaaauguauuucacacaauguggcacguaaccagaggagccguccuaauguaccaaggaaaaagacuagagcccucaugggcaucagugaagaaagaucuaauaaguuauggagguggcuggagacuacaaggaagcuggaauacaggagaggaaguucaggucauugcaguugaaccgggcaaaaacccgaaaaauguacaaacugcuccaggaacguuuaaaacaccagagggugaaguuggagcaauagccuuagacuuuaaaccaggaacuucaggauccccuauugucaauagagaaggaaaaaucguaggccuuuauggaaacgggguagugacgacaaguggcacauauguuuccgcaauugcucaagccaaagcuagccaggaggggccgcugccggagauagaagacgaaguauucagaaaaagaaaccucaccaucauggacuuacaucccgguucugguaaaacaagacgauaccugccugcuauuguacgagaagcuauuaagcgaaaguuaagaacucuuauacuagccccgacacgaguagucgcaucggagauggcggaggcucugaaaggcaugccuauccgcuaucaaacuacagccguaaagucagaacauaccgguaaagaaauugucgacuuaaugugccauaccacauucacaaugcguuuacuaagcccugugcgugucccgaacuauaacaugauuaucauggaugaggcccacuuuacagauccaucauccauagcugcucggggcuacaucucaacacgcgucggaaugggagaggcagcagcaauauuuaugacugcgacuccgccugguagugucgaggcauuuccacaaucuaaugccguaauccaagacgaggaacgagauauccccgaacgaucuuggaacucaggcuacgaauggaucacagauuucccaggaaaaacaguuugguuuguaccaagcauaaagucaggaaacgauauugcgaacugucuaagaaagaauggcaaacgugucauucaauuaucuagaaagacauuugacacagaguaccagaaaaccaaaaauaaugacugggacuauguuguuaccaccgacauuagugaaaugggagcgaacuuccgggcagauaggguuauugauccacguaggugucuaaaacccgugauucuaaaagauggaccggaacgggucaucuuagcaggaccaaugccuguuaccguggcauccgcagcccaacgucggggucguauaggcagaaaucacaauaaggaaggggaccaguacauauauaugggccagccucuuaauaaugaugaagaccaugcacacuggacagaagccaaaaugcuuuuagauaauauaaacacaccugaagguaucauucccgcacuuuucgaaccagaaagggaaaagucugcggcgauagacggggaauacagguuacggggagaagcaaggaaaaccuuuguagaauuaaugaggcgcggggacuuaccuguauggcuuucuuacaagguagcaucggaggguuuucaauacagcgacaggcgauggugcuuugauggugaaagaaauaaucaaguacuagaggagaacauggacguagaaauuuggaccaaagagggagaacguaagaaauuaaggccaaggugguuagacgcacgaacguauucggacccauuagcacuaagagaauuuaaagaauuugcagcagggcgacgaaguguuucaggagauuuaauacucgagauugggaaguuaccgcagcauuuaacacaacgugcccaaaacgcccuagacaaucucguaaugcuccauaacagcgaacaagguggacgcgcuuacaggcaugcgauggaagaauuaccagauacaauugaaaccuuaaugcugcuagcucugauugccgugcugacuggggguguaaccuuguucuuccucuccggucgaggacucgggaaaaccucgauagguuuacuuuguguaauggccaguaguguacuucuauggauggccucuguagaaccucauuggaucgcggcguccauaauauuagaguucuuucuaaugguauuacuaauaccagaaccggaucgucagaggacaccccaagauaaucaacuugccuauguagucauuggauuacucuuuaugauccuuacaguagcagccaaugaaauggguuuacuugaaacuacuaagaaagaccugggcauaggccauguagcaguagaaaaccaccaccacgccgcgauguuagacguggacuuacauccugccagugcauggacauuauacgcgguugcaacgacgauaauaaccccaaugaugagacauacuauagaaaacacaacagcaaacaucagccuaacagcuauagcaaaucaagcugcgaucuuaauggggcuugacaaaggcuggcccauuaguaaaauggauaucggaguaccguuauuagcauuggguugcuacagucaaguaaauccauuaacacucaccgcugcaguucugauguuaguagcccacuacgcaauuaucggcccgggucugcaagcuaaggcuacacgcgaagcacaaaaacgaacagccgcaggaauaaugaaaaacccaacuguagacggaauagucgcgauugacuuagacccuguaguauaugaugcgaaauuugaaaaacaacucggacaaaucauguuacuaauauugugcacaucucaaaucuuacucaugcgaacaacgugggcucuaugugaaucaaucacguuggcuacugguccacuaacaacauuaugggaaggauccccggguaaguuuuggaauacgaccauagcgguuucaauggcuaauauauuuagagggucguaccuggcaggggccggauuagcauucucccuaaugaaaaguuuaggaggcggacgacgggguaccggugcgcagggagaaacacuaggagaaaaauggaaaaggcaauuaaaccaacuaaguaaaagcgaauuuaauacguauaaacgaucaggcauaauggaaguagacagaagcgaagcuaaggaagguuuaaaaagaggagaaacuacaaagcaugcaguaucccgcggaacagcaaagcuaaggugguucguugaacguaauuuagucaaaccugaagguaaagugaucgaccuaggguguggaagaggaggauggaguuacuacugcgcaggacuaaagaaaguuacagaggucaaaggauauaccaaaggugguccgggacaugaagaaccaauuccgauggcaacuuacgguuggaauuugguuaaacuucacucagguaaagacguauucuucauacccccagaaaaaugcgacacacuucuaugugauauaggagagaguaguccgaauccgacuauagaggaagggcgcacccuuagaguucuaaagauggucgaaccguggcuaagaggaaaucaauuuuguauaaaaauccucaacccauacaugccgucggucgucgaaaccuuagagcaaaugcaaaggaagcauggcggaaugcuagugaggaauccauugucgagaaacucaacgcaugaaauguauuggguaucuugugggacagguaacauuguaagugcuguaaauaugaccucacgaaugcuacuaaaccgauucaccauggcacauagaaaacccacauaugaacgugacguggaccuuggcgcgggaacgcgacauguugccguagaaccagaaguugcaaaccucgacaucauaggacaacgaauugagaacauaaaacacgagcauaagucuacauggcacuaugaugaagauaaccccuauaaaaccugggcauaccauggauccuaugagguaaaaccuucggggagcgcaucaucuauggucaacgggguaguaaaguuacugacuaaaccaugggacgucauucccaugguaacgcaaauugcaaugacugauacaacaccauuugggcaacagcguguuuucaaagagaaaguggauaccagaaccccuaaagcaaaacguggcacugcacagauaauggagguuacugcaaagugguuauggggauuuuugucacgaaacaagaaaccaagaauuuguacaagagaggaguuuacgagaaaaguuagaucaaaugcagcgauuggcgcuguauuugucgacgaaaaucaauggaacucagcgaaagaagcuguggaagaugaaagguucugggaucuaguccauagagaaagagaacuacauaaacaaggaaaaugcgcaacaugcguuuauaauaugaugggcaaaagggagaagaaacucggugaguucggaaaggcgaaaggaucaagggcuauaugguauauguggcuaggggcucgauuucucgaauuugaggcuuuggguuuuaugaacgaagaucauugguuuagucgagaaaauaguuuaucagguguugaaggagagggacuccacaaacuuggauauauacuacgagacauaaguaaaauaccuggcgggaauauguacgcagaugacaccgcaggcugggacacucgaauuacagaagaugaucuacaaaaugaagcucgaauaaccgacaucauggaacccgaacacgcucuauuggcaaaaaguauauuuaaauuaacuuaucaaaacaaaguagucagaguacaaagaccggcgaaaaauggaacaguaauggaugugauaucccgaagagaucaaagagggagcggacagguugguacuuacggacuuaacacauuuaccaacauggaagcucaauugauuagacaaauggaaucagaagggauauucagcccuagugagcucgaaacaccuaauuuagcagaacgcguauuagacugguuagaaaaguacggugucgaaagauugaaacgcauggccauaaguggagaugauugcguagugaaaccaauagaugauagauuugcaacugcauuaacugccuuaaaugauaugggaaagguccggaaagauauuccacaaugggaaccaucaaaaggauggaaugacuggcaacaagugccguuuuguucccaccacuuucaccaacuuauuaugaaagacggccgagaaauagugguacccuguagaaaucaggacgagcuaguagguagggcucgaguaucacaaggugcagguuggucccuucgagaaacagccugcuuaggaaaaucauacgcucaaauguggcaauuaauguacuuccauaggcgggacuuaagacuagccgcaaaugccauaugcuccgcuguuccggucgauuggauaccaaccacauguacgacaugguccauccacgcacaucaucaauggaugacuacagaagacauguuaaguguauggaauagaguauggauagaagaaaauccuuggauggaggauaagacgcauauaucaucuuggggagauguuccuuaccuggguaaaagggaagaccaguggugcggaucacuuauaggacuaacggcgcgagccacaugggcuacuaauauccagguggcaauaaaucaaguucgaagauuaaucggcaaugaaaacuaccuagauuacaugacgucgaugaaacgauucaaaaacgaauccgauccagaaggagcauugugguag

SEQ ID NO: 21998 - RNA, 9879 nt, Artificial Sequence
  derived and/or modified CDS sequence (opt6) from DENV-1__JQ045649__SS-prME
ucagucacgaugcuuuuaauguuaaugcccacugcuuuagcuuuucacuuaacaacacgcggaggugaaccccacaugaucgucagcaaacaagaacgagguaaaagucuguuauuuaaaacaucggcaggcgucaauauguguacccuaaucgcgauggaccuaggagaacuaugcgaagauacaaugacuuacaaauguccucgaauaacagaaaccgaaccggaugacguagauuguuggugcaaugcuacugauacuuggguuaccuaugggacguguagucaaaccggugaacauagaagagauaaaaggucaguugcccuagcgccacacguuggguugggcuuagaaacgcggacggagacguggaugucauccgaaggugcuuggaaacaaauacaaagagucgaaacaugggcucugcgacauccaggcuuuacagugauagcgcuauuuuuagcacacgcuaucgguacuucaauaacucaaaaaggaauuauauuuauauuauuaaugcuaguuacaccauccauggcuaugagaugcguuggaauaggguccagggacuucguugaaggauuaaguggagcuacaugggucgauguggugcuugaacauggcaguuguguuacuacgauggcaaaagauaaaccuacucuagauauagaauuauuaaaaacugaaguaacgaacccagccguucuacgaaaauuguguauugaagcaaaaauaucaaacacuacaacggacaguagaugcccuacccagggagaagcaacguuaguugaggaacaagaugcaaacuucguuugcagaaggacuuuuguggaucgaggaugggguaacgggugcgguuuguuugguaaagggucgcuuauuacaugcgcaaaauucaaaugcguuacaaaauuggaaggaaaaauuguccaauacgagaacuuaaaauauucuguaauaguaacaguacacacuggggaccagcaccaagucgggaaugagaguacagaacauggaaccacugcuacgauuacaccccaagcaccaacuacggaaauccaacucaccgauuauggugcacuaacucuugacuguagcccuaggaccggacuagacuucaacgaaaugguccugcuaacaaugaaagagaaaagcuggcuaguucacaaacaaugguuucucgaucuaccacugccauggacaagcggugccaguacuucacaagaaacguggaauagacaagauuugcugguuacauucaaaacugcucacgcaaagaaacaggaaguagugguacuaggaagucaagaaggugcgaugcauacugcccuaacuggcgcaacugagauacaaacgucuggcacgacaaccaucuuugcuggucacuuaaaauguagacucaaaauggauaaauuaacauugaaagggaugaguuacguuauguguacaggauccuucaaacuugagaaagaagucgcagaaacgcaacacgguacagugcuuguucaaauaaaauacgaaggaacagaugcaccuugcaagauaccauucagcacucaggaugaaaaaggaguaacccaaaacgggcgcuuaauuacggccaacccgaucgugacggauaaggagaaaccaguaaauaucgaagcugagccaccauuuggugaaucguauauaguuauaggagcuggagaaaaagcguuaaaauuaucaugguuuaaaaaggguucaucuauugggaagauguuugaggcaacggcgcgcggugccagaagaauggcaaucuuaggcgauaccgcaugggauuucgguaguauaggcggcguuuuuaccucagucggcaagcucguacaucaaauauucggaacugcauauggggugcuauuuagcgguguuaguuggacaaugaaaaucggaauaggggugcuuuuaacauggcuugguuugaacagccggucgaccagccuguccaugacauguaucgccguaggauuagugacacuguaucuaggaguuaugguacaggcagauagcggaugcgucauaaacuggaaaggaagagaacuaaagugugguagcgggauauucguuacuaacgaaguucacacauggacagagcaguacaaguuucaagccgauucgccaaagagacucagugcugcuaucgggaaggcaugggaggaaggaguaugcggaauaaggagcgcgacgagacuagagaauauuauguggaaacaaauauccaacgaguuaaaccacauauuauuagaaaacgauaugaaguucacgguaguagugggggacgucgcagguauacuagcucagggcaagaaaaugauuaggccgcaaccuauggaacacaaauauucauggaaaucuugggguaaagccaaaaucauuggggcggaugugcaaaauaccaccuuuauaaucgauggaccaaauacucccgaguguccagaugaccaaagagcauggaauauaugggagguggaagauuacgguuuuggaauauuuacaacaaauauauggcuaaaacuacgcgauucguauacgcagguuugugaucaucgcuuaaugagugcagcaauaaaagacucaaaggcaguucaugccgauauggguuauuggauagaaucagagaaaaaugagacauggaaauuggcacgugcuagcuucaucgaaguuaaaacaugcaucuggccaaaaagccauacacuauggucuaauggcguauuagaaagugagaugauaaucccaaagauauacggaggaccuauuucacaacacaacuaccgucccggauauuucacucagacagcgggaccuuggcacuuagggaaauuagaacuugacuuugauuuaugcgagggaacuacuguggucgucgaugaacacugcggaaacagaggaccuagucuaagaacaacaacgguaacgggaaagauaauacaugaaugguguugcagaaguugcaccuugccuccccuuagguuuagaggcgaggacggaugcugguacgggauggaaauacgaccagugcgugaaaaagaggaaaauuuagugaaaucgaugguaagugccgggucuggugaaguagacuccuuuucccuaggacucuugugcauaucaauaaugauagaagagguaaugcguagccgauggagccguaaaaugcuuaugacagggacuuuggccguauuuuuccuucucauaguaggucaacuaacauggaacgacuuaauacguuuauguauuaugguuggggcgaaugcuucagauagaauggguaugggcaccacauauuuagcauuaauggcgaccuucaaaaugagaccgauguuugcaguugggcuacuauuucgaaggcuaacaaguagagaaguacuacuauuaaccauaggccuuuccuugguagcgucuguagaauuaccaaacaguuuagaagaacuuggagacggauuagcuauggggauaaugauuuuaaaacuuuugaccgauuuucaaucgcaccaacuuugggcgucucuauuaucccuaacguucauuaaaacgacauucucacuccacuaugcauggaaaacaauggcuaugguucugucagucguuagccucuuuccccuaugcuuaucaacgacgagccagaaaacuacuuggcuaccgguacuccuaggauccuuaggauguaagccucugacaauguucuugaucgcggaaaacaaaauuuggggucgcagaagcuggccuuuaaacgaagguauaauggcaguaggaauuguaucuauauuacuuucuagucugcucaaaaacgaugucccccucgccgguccauuaauagccgguggaauguuaauagcguguuauguaauaaguggcucgagugcagaucucucacuggaaaaggcagcagaagugaguugggaagaagaagcagaacacucuggagcaucucacaacauucucguagaaguacaagaugaugggacaaugaagauaaaagaugaagaaagagacgauacauuaacaauacuauuaaaagcaacuuuauuggcggugagcgggguuuauccacuaucgauuccugcuacauuauucguaugguacuucuggcaaaagaagaaacaacgauccggcgucuugugggauacaccuaguccaccugaaguagaacgagcgguucuugaugaugguauauauaggauaaugcagcgagguuuacuuggcagaucacagguaggaguagggguuuuucaagaaaauguauuccacacuauguggcauguaacaaggggagcuguuuuaauguaucaaggcaaacgcuuagaaccuagcugggcuaguguaaagaaagaucuuauuagcuacggaggaggauggcggcuacaaggcagcuggaauacgggcgaagagguacaagucauagccguggaaccugguaaaaaucccaaaaauguccaaacagcaccugguacauucaagacaccagaaggagagguaggggcuauagcauuagauuuuaaacccgguacauccggcucaccgaucguuaauagagaaggaaaaauaguagguuuauauggaaacggaguagucaccacaaguggaacauauguuagcgcaauagcacaagcaaaggcaucacaagaaggaccccugccugaaauugaagacgaaguuuuucggaagagaaaccuuacaauuauggauuuacauccugggucaggaaaaacaaggcgauaccugccagcaauaguaagagaagccauuaagagaaaacuaagaacacugauccucgcuccaacacgaguuguagcgagugaaauggcggaagcauuaaaaggaaugccaauaagauaucaaacuacugcaguuaaaagcgaacacacuggcaaagaaauuguagaucuaaugugccaugccacauucacaaugagacugcucaguccggucaggguuccaaacuacaauaugauuauaauggaugaagcacacuucacugauccgagcucgauagccgcacgaggguauauuucuacacggguaggaaugggcgaagcagcugcaauauuuaugacagcaacuccaccuggcucugucgaggccuuuccacaauccaaugcugucauacaagacgaagaaagagauauaccggagcgauccuggaacucuggauaugaauggauaacagacuuuccagguaaaacaguaugguuuguaccaaguaucaaaagcgguaacgacaucgcaaauugucuccguaaaaauggaaaaagagucauacagcuaucuagaaagacauuugauacagaauaccagaaaaccaagaauaaugacugggauuaugucgucaccacugacauaucugaaaugggagcuaacuuccgggcagauagaguaauagauccucgaagauguuugaaacccguaauauuaaaggacggaccugaaagaguaauacuggcagguccaaugccgguuacgguagcguccgcagcgcaacgucgggguaggauaggacggaaucauaauaaagaaggagaucaguacauauauaugggucagccuuuaaacaaugacgaagaucaugcgcauuggacagaagcuaagauguuacuagacaacauaaauacuccagaagguauaauucccgcauuguuugaaccagagagggaaaagucagcagcuauugacggagaauacaggcuacgcggagaagcucguaaaacuuuuguagaacuuaugagacguggcgaucuacccgucuggcugagcuauaaaguggccucugaaggguuccaguacucagaccgaagguggugcuuugauggagagcgcaacaaucaaguccucgaagagaacauggauguagaaauauggacuaaggaaggugaaaggaagaaacuucgaccaagauggcuagacgcucgaacauauagcgauccacuagcucuaagggaauuuaaagaguuugccgcggggcguagaagugugagcggcgaccuuauauuagagauaggcaaauugccacagcauuuaacacaaagggcgcaaaaugcccuggacaaccuuguuaugcuacauaacucugagcaaggaggacgcgccuauagacaugccauggaagaauuacccgacacgauagaaacauugaugcuauuagcacucauagcagugcuaacaggaggagugacccuuuucuuucuuagcggacguggacuaggaaaaaccucaauagggcuucuaugcgugauggccagcucaguucuacuauggauggcaucaguagaaccacacuggauagcugcaucaauaauuuuggaauuuuuccuaauggugcuuuuaauaccugaaccagaucggcaacgaaccccgcaagauaaucagcuggcguauguggugaucggacuacuuuuuaugauucuaacggucgcugcuaacgaaaugggucuuuuagaaacaacuaagaaagaccuggguauugggcauguugcuguugaaaaucaucaucaugcugcaauguuagacguugaucuccauccggcaucggcauggacgcuuuaugcaguugcaaccacgauaauaacaccaaugaugcgccauacaaucgagaacaccacagcuaauaucaguuuaacagcaauagcaaaucaagcagccauacuuaugggacuugauaaaggauggccuaucucgaaaauggauaucggggugccccuucuugcauuagguuguuauucacaggugaauccauugacguugacugcggcgguccuaaugcuaguagcucacuacgccauuauaggaccuggauugcaagcaaaggcaacucgcgaagcccagaaacguacugcugcggguauaaugaaaaaccccacgguugacggcauaguagcuaucgaucucgacccgguaguauacgacgcgaaguucgaaaaacaacucggacaaauaaugcuacuaauauuguguaccucgcagaucuuauugaugagaacuacgugggcccucugugaaucaaucacguuggccaccggaccucuaacaacacuaugggaaggcucgccuggaaaguucuggaauacaacuauagcaguuucgauggccaacauuuucagaggcucauaucuugccggugcgggauuggcauuuagcuuaaugaaaucucucgguggaggccggagaggaacaggcgcacaaggcgaaaccuuaggagaaaaauggaaacgucaauuaaaucaacugagcaaaucugaguucaacacuuacaaaagaagcggaauaauggaaguagacagguccgaagcaaaagaaggucuaaaacggggugaaacgacaaagcaugcaguaaguagggguacugcgaaguuacguugguuugucgagaggaaucuaguaaagcccgaaggaaaaguuauagaucuuggaugcggaagagguggauggucauauuacugcgcaggacuaaagaaaguaacugaaguuaaaggauauaccaaaggaggacccgggcaugaggagccuaucccaauggcaacguacggguggaaucucguuaaauugcacaguggaaaagacguauuuuucaucccuccagagaaaugcgauacccuacuaugcgauaucggagagucgucgccaaauccaacuauagaagaaggucgaacucucagaguacuuaaaauggucgaaccauggcuucggggaaaucaauucugcauaaaaauccuaaauccauauaugccgaguguugucgagacuuuagaacaaaugcaacgaaaacauggugggaugcuaguaagaaauccauuaucaagaaacaguacgcaugagauguauuggguauccuguggaacaggaaauauaguuucagcaguaaauaugaccucaaggauguuguuaaacagauuuacgauggcccauaggaagccaacuuaugagagagaugucgauuuaggagcugguacuagacacgucgcaguggaacccgaagucgcgaacuuagacauaauaggacaaagaaucgagaauauuaagcaugaacauaaaagcacuuggcauuacgacgaggauaaccccuacaaaacgugggccuaucauggauccuacgaaguaaaaccgaguggcuccgcauccaguaugguaaacgggguaguaaaauuacuaacgaagcccugggaugucauuccaauggucacgcaaauagcuaugacggacacuacgccuuuuggacagcaaagaguuuucaaggaaaaaguagauacaagaacaccaaaagcaaagagaggaacggcacaaauaauggagguaaccgcuaaaugguuauggggcuuuuugucaagaaauaagaaaccgagaauaugcacccgugaggaguuuacaagaaaggugagauccaaugcggccauaggagcaguauucguugaugaaaaucaguggaacagugcaaaagaagcgguugaagaugaacguuuuugggacuugguccacagggagagagagcuacacaaacaaggaaaaugugcaacauguguuuauaauaugaugggaaaaagggagaagaaacucggagaauuuggaaaagcuaaaggaagucgcgcuaucugguauauguggcuuggugcacgguuccuugaauuugaagcccuaggguuuaugaacgaggaucauugguucucacgagaaaacucauuauccggugucgagggugaaggauuacacaaauuagguuacauucuacgugacauuagcaaaauaccaggugggaauauguaugcugaugacacagcugguugggauacuaggaucacugaagacgaccugaaaaaugaagcacguauaacugacauuauggaaccagagcacgcucuacuagccaagaguauuuuuaaauuaacauaccaaaacaagguuguacgcgugcaacgcccagcaaagaaugggacaguaauggauguaauuagccgacgugaucaaagaggguccggccaaguuggcaccuacgguuuaaauacuuucacuaauauggaggcucaauugauuagacaaauggaauccgaagguauauuuucaccuagcgagcuagagaccccgaaucuggcagagagagugcuacacugguuagaaaaauauggaguagagagacugaaaagaauggcuauaucaggagaugacuguguagugaaaccuauagacgacagauuugcaaccgcauuaacagcauugaaugauauggguaaaguacguaaagauauaccacagugggaaccgucgaaaggauggaacgauuggcaacagguuccuuuuuguagucaccauuuucaucaacugauaaugaaagauggacgagaaauagugguuccuugucgaaaucaagaugaauugguugggcgagcaagaguaucccaaggagcgggguggucucugagggaaaccgcuugccucggaaagaguuacgcgcaaauguggcaacugauguacuuccaccgcagagacuuaaggcuggcagcgaacgcgauuuguagugcuguuccaguagacuggauucccacaagcagaacaacguggaguauucacgcacaucaccaauggaugacaaccgaggauauguuaagcguguggaauagagucuggauugaagaaaauccguggauggaagauaagacucacauaucaucguggggugacguaccauaucuagguaagagagaggaucaaugguguggcucacuuauuggcuuaacugcaagagcuaccugggcaacaaacauacaaguagcgauuaaccaagugagacgcuugauuggcaacgagaauuacuuggauuacaugacaucaaugaaaagauucaagaaugaauccgacccagagggagcgcuuugguaa

SEQ ID NO: 21999 - RNA, 9879 nt, Artificial Sequence
  derived and/or modified CDS sequence (opt6) from DENV-1__JQ045650__SS-prME
ucuguaacgauguugcuuauguugaugcccacagcguuggcguuucauuuaacuacgagagguggagaaccucacaugauaguaucaaaacaagaacgaggaaaaagccuucuguucaaaacuucggccgguguuaauaugugcacauuaauagcaauggaucuaggugaauugugcgaagacacaaugacauacaaaugcccucgaauaacagaaacugaaccagacgacgucgacugcugguguaaugcuacggauacgugggugacuuaugggacguguagucaaaccggugaacaucgucgugauaaacgaucaguugcacuagcuccucacgucggacuuggccuagagaccagaacggaaacauggaugucaucugaaggagcauggaaacagauacaaagaguagagacaugggcauugaggcacccggguuuuacggucauagccuuauuuuuagcacacgcaauuggcacauccauuacacaaaaagggauaaucuuuauauuguuaauguuaguaacaccaucuauggcgaugagguguguuggaaucgggucccgcgauuucguggaagguuugaguggggcgacuuggguugacguaguucuagaacacggcucaugcgugacaacgauggccaaagauaaaccuacgcuugacaucgaauugcuuaaaacggagguuacuaaccccgcggugcuuagaaaacuaugcaucgaggccaaaauuuccaauacaaccacagauucaagauguccuacucaaggugaggcgacauugguugaagaacaagacgcuaacuucguuugucgaagaaccuuugucgauagaggcugggggaauggcugcggacuauucggaaaaggaucacucauaacuugcgccaaauuuaaaugcguuacgaaauuagaaggcaagaucguucaauaugaaaauuuaaaauauagcguaaucguuacaguucauacgggcgaucagcaccaggucggaaacgaaaguacggaacaugguacuacggcaaccauaacaccucaggcuccaacgacagaaauucaacuuacagauuacggcgcucuuacuuuagauugcucuccaaggacgggauuggauuucaaugaaaugguuuuauuaaccaugaaggagaaaagcuggcuaguacauaaacaaugguuucuagacuuaccucuaccuuggaccucaggcgcuucaacgagccaagagaccuggaacagacaagacuuacugguuacauucaagacggcccacgccaaaaagcaagaagugguuguguuaggaagucaagagggggcaaugcauacagcucucacuggagcgacagaaauacaaacaaguggaacaacuacaauauuugcaggucaccucaaauguaggcuaaaaauggauaaguuaacucucaagggcauguccuacguaaugugcacuggcucauuuaaauuagaaaaagagcuugcugagacgcagcauggaacugucuuaguacagaucaaauacgagggaaccgaugcuccauguaaaaucccguuuagcacacaagacgaaaagggcguuacccaaaauggccgauugauuacugccaaccccauaguaacugauaaagaaaaacccguaaauauugaggcugaacccccguuuggagaguccuauauuguaauaggagcuggugagaaagcguuaaaacuuagcugguuuaagaaaggaaguucaauaggaaaaauguucgaagcgacagcucgaggcgcccgaagaauggcaauacugggggauacugcaugggauuucggaagcauaggaggaguauucacaagcgucggaaagcucguacaucaaauauuuggaacagcguauggggucuuauucucuggaguuuccuggaccaugaaaauaggaaucggaguccucuuaacauggcucggucuaaauucgagguccacaaguuuaucaaugaccugcauugcaguagggcuagugacauuguauuuaggcgucaugguacaggccgauucagguugcguaauaaacuggaaaggaagagaacucaaaugcggaucgggcauauuuguuacuaaugaagugcauacauggacagaacaauauaaauuucaagcugauucuccaaagcgauuaucggcugcaauuggaaaggcuugggaggaaggaguaugugguauaagaagcgccacgagacuagagaacauuauguggaaacaaauaucuaaugaacuuaaccacauauuacuugaaaacgauaugaaguuuacuguggucgugggagauguggcaggcauacucgcacagggaaagaagaugauacgaccacaaccgauggaacauaaauacuccuggaaaagcuggggcaaagccaaaaucaucggcgcugacguacaaaauacaacauuuauaaucgacggaccgaauacgccugaauguccugacgaccaaagagcuuggaacauaugggaagucgaggacuacggcuuugguauuuucacgacaaauauauggcuaaaauugagggauagcuauacccaaguaugugaucaucguuugaugucugcagcuauaaaagacaguaaggcugugcaugcugauauggguuauuggaucgaauccgaaaagaaugaaacauggaaauuagccagagcaucuuuuauagaggucaaaacuugcauauggccaaaaucacacacacuauggaguaauggcguauuagaaucagagaugauaauuccaaagauuuacggaggaccaauuucucaacauaauuauagacccggauacuuuacucaaaccgcugguccuuggcaccuaggaaaacuugaacuagauuuugacuugugcgagggaaccacgguuguaguggaugaacauuguggcaaucggggccccaguuuacgcacaacaacgguuacuggaaagauuauacaugagugguguugccgauccuguacguugccuccauugcgauucaggggagaagaugggugcugguacgggauggagauccgaccgguaagagagaaagaggaaaauuugguaaaaaguaugguuucagcaggaagcggggaagucgacucguucucguuaggauuguuauguauaagcaucaugaucgaggaaguaaugagaucuagauggucgcgcaagaugcuaaugacagguacgcuugcaguuuucuucuuacuaauagucgggcaacuuacguggaaugauuuaauaagacuaugcaucaugguaggagcuaaugcaucagaccguaugggaaugggaaccacuuacuuggcauuaauggcgacauuuaagaugagacccauguucgcggucggcuuacuauuccggcgcuuaacauccagggaaguucuguuauuaacaauugggcugucuuuaguagccucaguugagcuuccaaauucuuuagaggaacuaggagauggauuggcuaugggaauaaugauucugaaguuacuaacagauuuucagucucaucaacuaugggcaagucuacuaaguuugacuuucauaaaaaccacuuucucacugcacuacgcuuggaaaacaauggcaaugguauuaucgguaguaagucuguuuccauuaugcuuaucaacgacuagccagaaaacuacaugguuaccaguacucuuagguucauuagguugcaaaccacuaacaauguuucuaauugcagaaaauaaaauaugggggcgccguuccuggccccuuaaugagggaauaauggcaguugguauaguuaguauacuauugagcucauugcuaaagaaugacguacccuuagcaggcccucuaauugccggugggaugcugauagcaugcuauguuauauccgguucaucugccgauuugucauuagagaaagcagcagaagucucaugggaagaagaagcggagcauagcggagcaagucauaauauacuuguagaagugcaagacgauggcacuaugaaaauaaaagaugaagagagagacgacacauuaacuauacuguugaaagcuacccuccuggccguuaguggaguguauccgcuaucaauccccgcaacuuuguuugugugguauuucuggcagaagaagaaacaaagaucugguguauugugggacacuccaucuccaccugagguagaacgcgcaguguuagaugauggaauuuacaggauuaugcagagagguuuauugggucgaucucaagugggagucgggguauuccaagaaaauguuuuccauacaauguggcacgucacuagaggagcuguauuaauguaucaaggcaagagguuagaaccaucgugggcauccguuaagaaagaccuaaucaguuacgguggaggauggcgacuucaaggaagcuggaauacaggagaagaaguacaggugauagccguugaaccgggcaaaaaccccaaaaauguucaaacugcgcccggaacuuucaaaacaccagagggagagguuggagcaaucgcacucgacuuuaagccuggcacgucugguagcccaauaguaaaucgagaagggaagauuguuggcuuguacgggaacggaguugugacaacaucagguacauacguaagugcuauugcacaagccaaagccucacaagaagggccacugccagaaauagaagaugaagucuuucgcaaaagaaauuugacaauaauggacuugcauccagguaguggaaaaacccguagguauuugcccgcaaucguacgagaagccauaaaaagaaaacuuaggacauuaauacuagcacccacaaggguaguugcuucugagauggcagaagcacuuaaagguaugccaauacgauaucaaacuacagcagucaagagugaacauacagggaaagaaauagucgaccuaaugugccaugcaacauuuaccaugagacuauuaucgcccgugagggucccgaauuauaacaugauuauaauggaugaagcacacuuuacagauccgucuaguaucgccgcaagggguuacauaucgacaagaguugguaugggugaagcugcagcaauauucaugacggcuacuccaccugguagcguagaggcuuuuccccaaucuaaugcuguaauccaggaugaggaacgugauauaccagaacgaagcuggaacagcggcuaugaguggauaacggacuuuccaggaaaaacggugugguucgucccauccauuaaaucgggaaaugauauagcaaauugcuuaaggaaaaauggcaagcguguaauucaauugucucggaaaacuuucgacacugaauaucagaaaaccaaaaacaaugauugggauuacgugguuacaaccgauauaagugaaaugggcgccaacuucagggccgacagagugauugauccacggcgaugccuuaaaccgguaauuuugaaagaugguccagagagaguuauacuggcagggccaaugccgguuacuguugcaucugcugcacagcgaagagguagaauuggcagaaaccauaacaaagagggggaucaauauaucuauaugggacagccgcuaaacaaugacgaggaucaugcucacuggacugaggcgaaaaugcuguuagauaauauuaauaccccagaagggauuauucccgccuuguuugaaccagaaagagaaaaaucugcggcaauagauggagaauaucgauuacggggagaagcaagaaagacguuuguagaacuuaugcggagaggagaccuaccaguuuggcuuagcuauaaaguagcaagugaaggauuccaguauagcgaccgaagaugguguuuugauggugaaaggaauaaucaagugcucgaagaaaauauggacguugagauauggacgaaagaaggagagcguaagaaacuccguccgcguugguuagacgcuagaacuuauagugauccacuugcauuaagagaauuuaaagaauuugcugcggguaggagaucugucagcggagacuuaauacucgaaauaggaaagcuaccccagcaucuuacucaacgugcacaaaaugcacuggauaauuuagucaugcuacauaauucagaacaaggaggacgcgccuauagacaugcuauggaagaacugccagauacaauagagacauuaaugcuacuggcauugauagccguacuaacgggaggaguaacacucuucuuucuaucagguaggggacuaggcaaaacuuccauugguuuacuaugcguuauggcaaguagcgugcuauuguggauggcgaguguagaaccucacuggauagccgcgucaauaauacuggaguucuuucuaaugguucuacuaauaccggaaccagaccgacaacggacaccacaagauaaccagcucgcauauguaguaauaggauuguuauuuaugauccuuacugucgcagcuaaugaaaugggguuauuagagaccaccaagaaagauuuagggauuggccauguagcuguagaaaaccaucaccacgcugcgaugcuugauguugacuuacacccugcaucagccuggacacuuuacgcaguagcuacaacuaucauaacucccaugaugcgccacacuauagaaaacacaacagcaaauauaucauuaacugccauugcaaaccaagcugcuaucuuaauggggcucgacaaggguuggccaauaucaaagauggacauuggcgucccccuauuagcauuaggaugcuauucccaaguaaacccauuaacauuaacugccgcuguauugauguuaguagcacauuaugccauaauaggaccaggacuacaagccaaagcuacccgggaggcacaaaaacgaaccgcugcugguauaaugaaaaacccaaccgucgaugggaucguagcaauagacuuagauccgguugucuaugaugcgaaauuugagaaacaguuaggucaaauaauguuacucauauugugcacuucacaaaucuuguugaugcgcacgacuugggcauugugugaaucuauuacauuagcaacuggcccauugacgacgcuuugggaggggucaccagggaaauuuuggaauaccacaauugcaguuaguauggcuaacauauuuagaggaaguuaccuagcuggugccgggcuugcuuucagccuaaugaaaaguuuaggcggagggcgaagagggacgggcgcgcagggagaaacacugggggaaaaauggaaacgacaguugaaccaacucucuaagucagaguucaauacguauaaaagaucaggaauuauggaaguagauagaucagaagccaaagaaggacucaaacgaggagaaacaacaaaacaugcaguuucgagaggaacggcaaagcugcgcugguuuguggagcgcaacuugguuaagccagaagguaaaguaaucgauuuagguugugguagaggaggaugggcuuauuauugugcaggcuuaaagaaaguuacagaggugaaaggauauacaaaaggugguccaggccaugaagaaccaauaccgauggcaaccuacggauggaacuuaguaaaacugcauucgggaaaagacguauuuuucauaccacccgaaaagugugauacgcugcugugcgauauuggcgaaucuagccccaacccgacgauagaagaagggagaacuuuaagaguacuuaagaugguagagccauggcuacgcggaaaccaauucuguauaaaaauacugaacccuuauaugccuaguguuguugagacauuggaacaaaugcaacgcaaacacgguggaauguuaguaagaaaccccuugucuagaaacucuacacaugagauguauuggguaagcuguggcacggggaacaucguaagugccguaaacaugaccucgagaauguuauugaauagauucacuauggcccauagaaaaccaacauacgaaagagauguugaucucggagcgggaacacgccacguugcaguagagcccgaaguagcaaaucuugacauaauuggacaaagaaucgaaaacauaaaacaugagcauaaaagcaccuggcauuacgacgaagauaacccguacaaaacuugggcuuaucacgguucauaugaaguaaagccuaguggcagcgcaucuucuaugguaaaugguguaguaaagcugcuaaccaaaccaugggaugugauaccaaugguuacccagauagcgaugacugauacuacgccauucgggcaacaaagaguauucaaagaaaaaguugauaccagaacuccuaaggcaaaaagggggacugcccaaauaauggaggucacagccaaguggcuauggggauuuuugucaaggaauaagaaaccaagaaucuguacgcgagaggaauuuacaaggaaaguucgaucaaaugccgcaauaggagcgguguuuguagacgagaaucaauggaacucagcuaaagaggcuguggaagacgagcgauuuugggacuugguucacagagagcgcgagcuacauaaacaagguaagugugcaacuugugucuauaauaugaugggcaaaagagaaaagaaacugggagaauuugguaaggcgaaggguaguagagccauuugguauauguggcucggagcaagguuuuuagaguuugaagcauuggguuuuaugaaugaagaucauugguuuaguagagaaaacagcuugagugggguagaaggugaaggacuucauaaacuaggauacaucuuaagagauauuaguaaaaucccaggaggaaacauguacgcagaugauacugcaggaugggauaccagaauuacugaagaugaucuuaaaaacgaagcgagaaucacagacauaauggagccggagcaugcucuauuagcaaaaagcaucuucaaacugacauaucagaauaaggucguaagaguacaaagaccggcaaagaauggaacaguaauggauguaauaucuaggcgagaucaacgcgguucaggucaggucggcacauacgggcuuaacacauucacaaauauggaagcgcaacuuaucagacagauggagucagaggggauauuuucuccguccgagcuagagacaccaaaccuugcagagcgaguacuccauugguuagaaaaguauggaguagagagacuaaaaagaauggcaauauccggugacgacugcguagucaaaccaauagacgacagauuugcgaccgcauuaaccgcguuaaaugauaugggcaaaguaagaaaagacaucccgcaaugggaaccaaguaaaggauggaacgauuggcaacagguuccauuuugcucacaccauuuucaccaauuaauaaugaaagauggaagagaaauugucguuccuuguaggaaccaagaugagcuuguagggagagcgaggguuagucagggugccggauggagccuacgugaaaccgcauguuuagguaaaucuuaugcacaaauguggcaauuaauguauuuucaccguagggaucuccgacuagcagcaaaugcgauauguucagcaguucccgucgauuggauaccuaccucucggaccaccuggucgauccacgcccaucaucaguggaugacaaccgaagacauguuaucaguauggaacagaguauggauagaagagaacccuuggauggaagauaaaacucacauuucuucauggggagacguaccauaucuaggcaaaagagaggaucaguggugugguaguuuaaucgguuugacagcuagagcuacgugggcaacaaacauucaggucgccauaaaccaaguaaggagacucauaggaaaugaaaauuauuuagauuauaugacuagcaugaagcgauucaagaaugaaagugauccagaaggagcacuuugguaa

SEQ ID NO: 22000 - RNA, 9879 nt, Artificial Sequence
  derived and/or modified CDS sequence (opt6) from DENV-1__JQ045651__SS-prME
agcgugacaauguuacuaauguugaugccaacugcacuagcguuucacuuaacaacgagagggggagagccacacaugauaguuaguaaacaagaacgagguaaaucacuguuguuuaaaacaagugcuggaguuaauauguguacacuuauagcgauggaucuaggcgaauuaugcgaagacacuaugacuuauaaauguccaaggaucacagagaccgagccagaugauguggacuguuggugcaaugcuacagacacauggguaaccuacggaaccuguucgcaaacgggggaacauaggagggauaaacggucuguagcccuggcgccacaugugggguuaggauuagaaacacguacagaaacuuggaugucaucggaaggagcguggaaacaaauucaaagggucgaaacaugggcacuacgccacccaggauucaccgugauagcccuguuccuagcacacgcaauaggaacgucgauuacucaaaaaggaauaauuuuuauucuacuaaugcuaguuacgccuuccauggccaugaggugcgucgggauaggaucacgugacuuuguagaaggauuaaguggagcaacauggguagacgugguauuagaacaugguuccuguguuacaacuauggcuaaagauaaaccaacauuggacaucgaauugcugaaaaccgaagugacuaauccagcaguguuacgaaaacuguguauagaggcuaaaauaaguaauacuacaacagauagucguugcccaacacaaggcgaggcaacucuaguggaagaacaggacgcaaauuucguauguaggagaacauuuguagacagaggguggggcaauggcuguggacucuuuggaaaaggaucccuuauaaccugcgcuaaguucaaaugugugacgaaacuggaggggaagauaguacaauaugaaaauuuaaaguauucugugauuguuacaguacacacuggugaccaacaucagguaggcaaugaaucaaccgaacacggaacuacagcaacgaucacaccacaagcacccacaacggaaauacaacuaacugauuauggugcauuaacauuagauugcucuccaaggacaggauuggacuucaaugaaaugguacuucuuaccaugaaagaaaagucguggcuaguacacaaacaaugguuccuugauuuaccgcugccguggaccucaggggcuucaaccucgcaagagacuuggaaucgucaggauuuguugguuacuuuuaagacagcucaugccaagaaacaagaggucguaguuuuaggaucacaggaaggggccaugcacaccgcacugacaggagcuacugaaauucaaacgucaggaacaacaaccaucuuugcaggacacuuaaaaugucgacucaaaauggauaaauuaacuuugaaaggaauguccuauguaaugugcacaggaaguuuuaaauuagaaaaggaguuagccgaaacgcaacacggaaccguacuuguacaaaucaaauacgaagguacggacgcaccgugcaaaauuccauuuaguacacaagacgaaaaaggaguaacacaaaacggccgccugauaacggccaaucccauaguuacagauaaagaaaaacccguuaacauagaagcagagccaccuuuuggagaaagcuauauagucaucggggcuggugaaaaggcauugaagcuaaguugguuuaagaaaggcagcaguauugguaaaauguucgaagccacggcacgaggagcccgucgcauggccauucugggagauacugccugggauuucggaucgauuggcggaguuuucacgucggugggcaagcuaguacaucagauauuuggaaccgcauacggaguccuauuuucuggaguaucguggaccaugaaaauagggaucgguguauuacuaaccugguugggauuaaauagccgaucuacuagcuuaaguaugacuuguauugcugugggccuagucacucuauaucuagggguuaugguacaagcugauucagguugugucauuaauuggaaagggagagaacuaaaauguggaucagggauuuuuguuacaaacgaggugcauacuuggacugagcaauauaaauuucaagcagacuccccaaaaagacuaucagccgcaauuggaaaagcgugggaagaagggguuuguggaauacgaagcgccacaagacuagaaaacaucauguggaaacaaauaucuaaugaauugaaccauauauuauuagaaaaugauaugaaauucacuguuguagucggcgauguagcaggaauacuagcacaaggcaagaaaaugauccgcccacaaccaauggaauauaaauacuccuggaaauccuggggcaaagcaaaaauuauuggagcagacguucagaacacaacuuucauuauugaugggccgaacacaccggaaugccccgaugaucaaagggcauggaauauaugggaaguagaagauuacggcuuuggaauauuuacuacuaauauuugguuaaaauugagagauucuuacacgcaaguaugugaucauagacuaaugucggcagcaauaaaagauagcaaagcuguucaugcggauauggguuacuggauagaaagcgaaaagaacgaaacauggaaacucgcaagggcaaguuuuauagaaguaaaaacgugcauuuggccgaaaucgcacacuuuguggagcaauggcguacucgaaucggaaaugaucauaccaaaaauauauggcgggccaaucagucaacauaauuaucgaccuggauacuuuacgcaaacagcaggaccauggcaccuaggaaaguuagagcuagacuucgacuuaugugaaggaacaacagucguaguagaugaacacugcggcaacagagguccuucuuuacgaacgacaacugucacugguaagauuauacacgagugguguugcagaucaugcacacucccuccucuacgauuuagaggagaagacgguugcugguauggaauggagauuagaccgguaaaggaaaaggaggaaaaucuuguaaaaagcaugguaagugccggcucaggagaaguagauucauuuaguuuaggccuucuauguaucucaauaaugauagaagaaguuaugagaucucgauggucaagaaagauguuaaugacuggaacgcuagcgguuuucuuccuacucaucaugggacaguuaacuuggaaugauuuaaucagacuauguaucauggucggagccaacgcaucagacagaaugggaaugggaaccacauaccuagcuuuaauggcaacguucaaaaugagaccaauguucgcaguuggauuacuuuuccgaagacuaacaucaagagaaguccuccuauugaccauagguuuaagucuagucgcaagcgucgaacuaccaaacagucuagaagaguuaggcgacggauuagccaugggaaucaugauuuuaaaauuauugacugauuuccagucucaucaacugugggcaacuuuauugaguuugacuuucauuaagaccacguuuaguuuacacuacgccuggaaaacaauggccaugguacuaucuauuguaucgcuauuuccacugugcuuaaguacaaccucacaaaagacuacauggcuaccgguuuuauugggaucccuaggcuguaaaccauugacaauguuccucauagccgagaauaaaauuugggguagaaggucguggcccuuaaacgaaggaauuauggcuguggguauuguuaguauuuuguuaucgucacuauugaaaaacgacgugccguuagcggggccucucaucgcaggagguauguuaauagcaugcuauguaauuuccgguaguucagcugaccuaucacuagagaaagcagcugaagugagcugggaagaagaagccgagcacaguggugccucucacaacauccuaguagaaguucaagacgauggaacaaugaagauuaaagaugaagaacgugaugauacacuaacaauauuauugaaagccacauuguuagcugugucaggaguauauccgcuaaguauaccagcaacacuauuuguaugguacuuuuggcagaaaaagaaacaacggucaggcguauugugggauacuccauccccgccagaaguugaaagggcgguucuugaugaugggaucuaucgaaucaugcaaagaggauuacuagggcggucccaagugggcguagggguguuucaagagaaugucuuccacacuauguggcacguaacaaggggagcgguauugauguaucaagguaaaagacuagagccuucaugggcaagugucaagaaagacuuaaucucauacggcggaggauggagacuucaggggaguuggaauaccggagaagaaguucaaguuauugccguagagccaggcaaaaaucccaaaaaugugcaaacagcaccugguacuuucaaaacaccagaaggugaagugggagcaauugcgcuagacuucaaaccugggacaaguggaucaccuauagucaaucgggagggaaaaauuguuggcuuauauggaaacggagucguuacaacgaguggaaccuauguaucggcuauagcgcaagcaaaagcaagccaagagggacccuuaccggagauagaggacgaagucuuuagaaaacguaaucugacuaucauggacuuacaucccggaucaggcaagacgcgcagguacuuacccgccauaguuagagaagcaauaaaaagaaaguuacgaacauuaauucuggcuccuacaagagugguugcgucagaaauggcagaagcauuaaaaggaaugccaaucagauaccagacaaccgcgguaaaguccgaacacacgggaaaagagauagucgaccucaugugucaugcuacuuuuacuaugcggcuguugagcccugugagggugcccaacuacaauaugauaaucauggacgaagcucauuuuacugauccuucuucaauagcugcccgagguuauauuucaacaagaguagguaugggggaagcggccgcuauauuuaugacagcuaccccacccgguuccguugaggccuuuccacaaagcaacgccguaauccaagaugaggaacgagauauacccgaaagguccuggaauaguggauaugaauggauaacagacuuuccuggcaaaacaguaugguucguaccuucuauaaaaucaggcaaugauaucgcgaauugucuccguaaaaaugguaaaagaguaauacaguuaagcagaaaaaccuuugauacagaauaucaaaagacuaaaaauaacgauugggacuaugucguaaccacagacauaucagaaaugggggcgaauuuuagagcugauagaguuauagauccaagaagaugccuaaaaccagugauucucaaagacggaccagagaggguaauccuugcuggcccaaugccuguaacaguugcaagugcagcucagcgacgcggccguauuggaagaaaccacaauaaagaaggagaucaauauaucuacaugggucagccccuaaauaaugacgaggaucacgcacauuggacugaagccaaaaugcuuuuagauaauauuaauacccccgaaggcauuauaccugcuuuguuugaaccagaaagggaaaaaucagccgcaauugauggagaauaucgcuuacgaggugaagcaagaaagacauucguugaacuuaugcgcaggggcgauuuaccuguuuggcuauccuacaaaguggcaucagaaggauuccaguauagugauagaaggugguguuucgauggagaacgaaauaaucaaguauuggaagaaaauauggacgucgaaaucuggacaaaagaaggagaaaggaaaaagcuacggccgagauggcuagacgcgagaacauacuccgauccguuggcccuuagagaguucaaggaauuugcugccgggagacguucaguuuccggcgauuugauauuagaaauugggaaauugccucaacacuuaacacaacgcgcacaaaacgcccucgacaaccuaguuauguugcauaauucagaacaggguggcagagcguauagacaugcuauggaagaacugccugauacuauugagacucuuauguuacuugcacugauagcagugcuuaccggaggaguuacacucuucuuuuuaaguggacgaggauuggguaaaacuagcauuggauuauuaugcguuauggcuucaaguguucuucucuggauggcaaguguugagccacacuggauugcagcaucgauuauacuagaguucuuucuuaugguauuacuaauacccgaaccggaucggcaaagaaccccgcaagauaaucaauuggcguacgucgucauaggcuugcucuuuaugaucuugaccgucgcagcaaaugaaauggguuugcucgaaaccacgaaaaaggaucuaggaaucggucacguagccguugaaaaccaccaccaugcagcgauguuagacguugaccugcauccggcuucggcuuggacguuauacgcagucgccacaacuauuauuacuccaaugaugcgccacacaauugaaaacacuacggcgaacauaucccuaacugcuauugcuaaucaagcagcaaucuuaaugggcuuagauaaagguuggccgauaaguaaaauggauauugguguaccauuacuagcuuuagguuguuacagucaagucaauccccuaacacuaacagcagcaguacuuauguuaguagcacauuacgcaauaauaggaccagguuugcaagcaaaagcgacucgcgaagcgcagaaacgaacggcggcaggaauuaugaaaaacccaacgguagaugguauugucgcuauugacuuggauccagugguauacgacgcuaaauucgaaaaacaauuaggacaaauaauguuacuuauacuguguacaucccaaauucuacugaugcguacaacaugggcgcuaugcgaaaguaucaccuuggccacgggcccccuuacaacacuaugggaaggcaguccaggcaaauucuggaauacgaccauagcagugagcauggcgaauauauuucgagguucuuaccuggcuggagcuggguuagcauucucauuaaugaaguccuugggcggcggacggcguggaaccggagcgcaaggcgagacuuugggagaaaaguggaagagacaguuaaaucaacuaaguaagagugaauuuaauacuuacaaaagaagcggcauuauggaaguagaucgcagugaagcaaaagagggucuaaaaagaggggaaacuaccaaauacgcaguaucucgcgguacggcgaaacuaagaugguucgucgaacgaaacuugguaaaaccggaaggaaaaguaaucgacuuagguuguggucgaggaggcugguccuauuauugcgcaggauuaaagaaaguuacagaaguuaaaggauacaccaaagguggaccgggucacgaggaacccaucccaauggcaaccuacggauggaaccuaguuaaacuacacaguggcaaggauguauucuuugugccaccagagaaaugugauacguuauuaugugauauaggagaaaguucgccgaacccaacgauagaagaaggcaggacuuugcgaguguuaaaaauggucgagccuugguuaagagguaaucaauuuuguauaaaaauucuuaauccauauaugccuaguguaguagagacucucgagcaaaugcaaagaaaacacggaggaaugcuuguucggaacccauugucaagaaacaguacucaugagauguacuggguaucaugugggacagggaacauaguaucugcaguuaacaugaccagucgaauguuacuaaaccgauuuaccauggcacaucggaaacccaccuaugaacgcgacgucgauuuaggagccggaacccgucauguugcuguggaaccugagguggccaaccuagacauuauagggcagaggaucgaaaacauaaaacacgaacacaaaaguacuuggcacuaugaugaggauaacccauauaaaacuugggcuuaucauggcucuuaugaaguuaaaccuagugggagcgcguccagcauggucaacgggguagucaaacuuuuaaccaaaccaugggaugucaucccuaugguaacgcaaauugcgaugacggacaccaccccauuuggucaacaacgaguauucaaagaaaaaguggacacaagaacacccaaagcaaaacgagguacagcucaaauuauggagguaacagcgaaguggcuauggggguuucuaagucgaaauaagaaaccgcgaauaugcacucgagaggaauuuacgaggaagguucgaucaaaugccgcaauaggggcaguuuucguggaugaaaaccaguggaacuccgcgaaggaggcuguagaagaugaaagauuuugggaucugguacacagagaaagggaacugcauaagcaggggaaaugugcaaccugcguauauaauaugaugggaaaaagagagaagaaacuaggggaauuuggaaaagcuaaaggcuccagggcaauaugguacauguggcuuggagcacgauuucuagaguucgaagcgcuaggcuuuaugaacgaagaccauugguuuucaagagaaaauucacuuucaggugucgaaggugaaggacuacauaaacuaggguauauauuacgggacauuaguaaaaucccugguggaaacauguaugcugacgacacugcgggaugggauacaaggauuacagaagacgauuugcaaaaugaggcccgaauaacggauauuauggaaccugaacaugcccuauuggcaaaaucuauuuuuaaauuaacuuaccaaaauaaagugguccgaguucaacggcccgccaaaaacggaacuguaauggaugucauuucuagacgagaucagagaggaucuggucaagucgggaccuacggacucaacacguuuacuaauauggaagcccagcugauccgccaaauggagucggaaggaaucuuuaguccaagugaguuagagaccccuaaccuugcagagagaguauuagacugguuggaaaaauaugggguagaacgcuuaaaaaggauggcuauaucuggugaugauuguguagucaaaccaauagacgaucgauuugcaacagcccuaacagcguuaaacgauaugggaaaaguaagaaaagauaucccacaaugggaaccaaguaaagguuggaacgauuggcagcaaguaccguuuugcucacaccauuuccaucaguuaauuaugaaagauggacgugaaaucguaguucccuguaggaaucaagaugagcuaguuggucgcgccagaguaucucagggggcuggguggucuuuaagagaaacggcaugucucggaaagucuuacgcucaaauguggcaacuaauguacuuucacagacgggauuuacgauuagcugcgaacgcgauauguucagcgguuccaguagauuggauuccaacuagcagaacaacguggagcauacaugcacaucaucaauggaugaccacugaggauaugcuauccguauggaauagaguauggauugaagaaaacccuuggauggaagacaaaacacauauaagcucaugggaagauguucccuauuuagggaaaagagaggaucaguggugugggagucugauagguuuaaccgccagagcaacuugggccacaaauauacaaguagcaauaaaucaaguuagacggcugauaggaaaugaaaauuaucucgauuauaugacaaguaugaagagguuuaaaaaugaaagugauccggaaggugcccuuugguaa

SEQ ID NO: 22001 - RNA, 9879 nt, Artificial Sequence
  derived and/or modified CDS sequence (opt6) from DENV-1__JQ045652__SS-prME
uccguuacgaugcuacucauguugaugccaacugcuuuagcauuucaucuaacgacgcgaggaggagaaccucauaugauuguaucuaaacaagaacgaggaaaaagccuucuguuuaaaaccagcgcaggcgucaauaugugcacauugaucgccauggauuugggcgaacugugcgaagauacuaugaccuauaaauguccucguauaacagaaaccgaaccagaugacgucgacugcugguguaaugcuacugacacuuggguaacauauggaacauguucgcaaaccggugaacauagaagagauaaacgaaguguugcacuagcuccgcacguaggccuaggacucgaaacgcgaacugaaacguggaugucaucggaaggggccuggaaacaaauacagagaguagaaaccugggcccuaagacaucccggguuuacaguaauugcucuguuccuagcucaugcaauagguaccucuauaacacaaaaaggcauuauuuuuauucuucuuaugcugguaaccccgucgauggccaugagaugcguaggaauaggauccagagacuuuguagagggucuaaguggagcaaccugggucgaugugguucuagaacauggaagcugugucacgacaauggcuaaagacaaaccgacccucgacauagaauuguuaaagaccgaaguaacuaacccggcagucuugagaaaauuaugcauagaagcgaaaauaaguaauacaacgacugauucuaggugucccacccaaggagaggcgaccuuaguugaagaacaagacgcuaacuuuguuuguagaagaacauucguagaucgaggaugggggaauggaugugggcuguucgguaaaggcucauuaauaacuugugccaaauucaaguguguuacaaaauuagagggaaaaauugugcaauaugagaaccucaaauacucagucaucguaacuguucacaccggugaccagcaccagguugguaaugaaaguacagagcauggcacgaccgcuacuauaacaccucaggcaccaaccacagaaauucaguugacagacuacggagcacuaacacuggauugcagccccagaacgggacuagauuuuaacgaaaugguacuauugacaaugaaagaaaaauccugguuaguccacaaacaaugguuuuuagauuugccuuugcccuggacgucaggugcaucaacuucacaagaaacuuggaaucgucaagaucuuuugguaacauucaagacggcacaugcgaaaaagcaagaagucguaguacucgggucgcaagaaggugccaugcacacugcacuaacgggugccacggagauccaaacaaguggcaccaccaccauuuuugccggccacuuaaagugccgccuaaaaauggauaaauuaacgcuaaaagggaugagcuaugugaugugcacagggagcuuuaaauuagaaaaagaguuagcagaaacccaacauggcaccgugcuaguucaaauuaaauacgaagggacggaugcccccugcaagaucccguucucgacacaggaugaaaagggcguaacucaaaacgguaggcucauaaccgcuaauccaauaguaaccgacaaggaaaagccaguaaauauagaagcagagccaccguuuggagaguccuauauugugauuggagcaggggaaaaagcucucaaauugucgugguucaagaaaggaagcaguaucgggaaaauguuugaagcuacugcucggggagccagaagaauggccaucuuaggagacacagcaugggacuuuggaucaaucggagggguauucacaucgguaggcaaacuuguucaccaaauuuuugguacugcuuacggaguucuauuuucaggaguaucauggaccaugaaaaucggaauaggaguuuuauuaacauggcuuggacuaaauucgaggagcaccucucuaaguaugaccuguauagcuguuggacuuguaacuuuguauuugggcgucauggugcaagcggauuccggauguguaauaaauuggaagggacgugagcugaagugcggcucaggaauauucguaacaaaugagguucauacguggacagagcaguacaaauuucaagcagacucaccuaaacgauuaucugcugcaauuggcaaggccugggaggaggggguauguggaauacguagcgcuacaagacuagagaacaucauguggaaacaaauaagcaaugaauugaaucacauauuauuagaaaaugacaugaaauucacagucguaguaggagacguggccggaauuuuagcccaggggaagaagaugauaaggccacaaccgauggaguauaaauauucauggaagucuugggguaaagcaaaaauaauaggagcagauguccagaacacuacuuuuauuaucgauggaccaaauacccccgaaugcccagaugaccaacgggcuuggaacaucugggaaguagaagauuauggauucggaauuuucacuacaaauauuuggcuuaaauuaagggauucauauacacaaguaugugaccaccgacuaaugucugcugcaauaaaagauucaaaagcuguucaugcagauauggguuauuggauagaaagcgagaaaaacgagacuuggaaguuagccagagcaucauuuaucgaagucaaaacaugcauauggccaaaaagucacacccuguggagcaauggagucuuagagucugaaaugauaauaccuaagauauacggugguccaauaucacagcauaacuaucgaccggguuauuuuacacagacagcugguccguggcaucuugguaaguuagaacuagauuucgaccuuugugaagguaccacuguuguaguggaugaacauugcggaaacagggguccgucauugcgaacaacuacuguaaccggcaagauaauacacgaauggugcugcagaucaugcacucucccaccgcuaagguuuagaggagaagauggauguugguacgguauggagaucagacccgucaaagaaaaggaagaaaaccuaguaaaauccaugguaucagcuggaaguggagaaguagauucguuuaguuuaggccuucuuugcauaagcaucaugauagaagaaguaaugcgaaguagauggucuagaaaaauguuaaugacugggacucuggcggucuuuuuccuacucauuaugggacaguuaacauggaaugaucuaauucgucuuuguauuaugguuggagcaaaugcgagcgaucgaauggggaugggaacaaccuauuuagcauuaauggcgacguuuaaaaugcgaccuauguucgcaguuggucuuuuauuccgaagacugacaucuagagagguacuucucuuaacuaucggacugucguuaguugcgaguguggaauuacccaacagcuuagaagaauuaggugacggguuagcaaugggaauaaugauauuaaaacuauuaaccgauuuccaaucacaucaacuuugggcaacacuuuuaucuuuaacauucauaaaaacaacguuuucgcuacacuaugccuggaaaaccauggcgauggucuuaucuauagugagcuuauuuccacuuugcuuaaguaccacuucacagaaaacuaccuggcugccggugcucuuaggaucacuuggaugcaaaccucucacaauguuuuuaauagcugaaaacaagauaugggguagacgcucauggccucugaacgaagguaucauggccguagguaucgucaguauucuuuuaucgucucuccuaaagaaugauguuccccuugcaggcccacucauugcuggagguaugcugauagccuguuauguaauaucugguaguuccgccgaucuuucgcuagaaaaagcugccgaaguuagcugggaagaagaagcagaacauaguggagcaagucacaacauucuaguagaggugcaagacgacggaacuaugaaaauuaaagaugaagaaagagacgauacacucacgaucuuacugaaagcaacccuguuagcggucucgggaguuuacccuuugucgauccccgcuacauuauucgugugguacuucuggcaaaagaagaaacagaggucuggaguccuuugggauacgcccucgccuccagagguagagcgugcgguucuugacgacggaauauacagaaucaugcaaagaggacuucuagguagaucucagguggggguagguguuuuccaagaaaauguauuccauacaauguggcauguuaccaggggagcaguccuaauguaccagggaaaacgucuagaaccaaguugggccaguguaaagaaggauuuaauaucauaugguggaggauggagguuacaaggcagcuggaauaccggugaggaagugcaagucaucgcaguagagccaggcaaaaauccuaaaaauguacaaacagcgccagguacuuucaaaacaccagaaggagaaguaggugcaaucgcacuugauuuuaaaccuggaacgucagggaguccuaucguaaacagagaaggaaaaauuguagguuuauacgguaacggcguagucacgacgagcggaacauacgugagcgcuaucgcccaagccaaggcuucccaagagggaccguuaccagaaauagaagaugaaguguuucgcaaacggaauuugaccauuauggaucuacaccccggaucaggaaaaacaagacgguauuuaccugcaauagucagggaagcaaucaaaagaaaauugagaacccuaauccuagcuccaacccgaguuguagccucagaaauggcggaagccuuaaaaggcaugccgauucgguaucaaacuaccgccgucaaaagugaacacacugguaaggaaauaguagaccuuaugugccaugcgacguucacaaugagacuuuuaucaccuguacguguaccuaacuauaauaugaucauuauggaugaagcacacuucaccgacccaaguucuauugccgcgagaggauacauuaguacaagggucggaaugggagaagcagcagccauauuuaugacagcuacaccuccaggaaguguagaggccuucccacaaaguaaugcgguaauacaagacgaagaacgcgacauaccagaaagauccuggaauaguggguaugaauggauuaccgacuuuccaggcaaaacugugugguucguaccuucuauaaaauccggaaaugauauugcuaacugccuaaggaaaaacggaaagcgagugauucaacuaagcagaaagacauucgauacugaauaccaaaagaccaaaaacaaugauugggacuacguaguaacuacagacauaucagagaugggagcuaauuuuagagcagaccgugugaucgauccucguagauguuuaaaaccagucauucuaaaagauggaccagagcgggugauccuagccgguccgaugcccgugacgguggcuuccgcagcacaaaggcgcggaaggauaggccguaaccauaauaaagaaggugaucaguauauauauaugggacaaccacuuaauaaugacgaggaucaugcccacuggaccgaagcaaaaaugcuuuuagauaauauuaacacuccugagggaauaauaccagcauuauuugaaccggagagagagaaaagcgcagcuaucgacggcgaauauagauuaaggggugaagcgagaaaaacuuucguggaauuaaugcgacgcggugaucuacccguuuggcuuucuuauaaaguggcgagugaaggcuuccaauauagugacagacgauggugcuuugacggagaacguaauaaccaaguacuagaagagaauauggauguagaaaucuggacuaaagaaggagagagaaagaaacuucguccccgguggcuggaugcuaggacuuauucugauccacuagcauuaagggaguucaaagaauuugccgcuggaagacgaaguguaucuggugacuuaauuuuggaaaucgggaaacugccgcaacauuuaacgcaaagagcucaaaacgcauuagauaauuugguuaugcuucauaauucugaacaaggcggccgcgccuaucgacaugcaauggaagaauuaccugacacuauugagaccuugaugcuucuagcauugauagcaguacuaacaggcggcguaacauuguucuuucuaucgggacgaggacuggguaaaacaaguauuggauuacuguguguaauggcaucaucagugcucuuguggauggcaaguguagagccgcacuggaucgcggcuucaauaauacuagaguucuuucuaaugguauuacugaucccagaaccagacagacaaagaacuccucaagauaaccaacuagcauacguaguaaucgguuuacuauucaugauacucacaguagccgccaacgaaauggguuugcucgaaacgacuaagaaagaucuagguaucggccauguggccguagaaaaccaucaucacgcagcaaugcucgacguugacuuacauccugcauccgcuuggaccuuauacgcgguagcuacaaccauaauaacaccgaugaugaggcauacaauagaaaacacaacagcuaauauuagccuaacggcaaucgcaaaccaggcagcgauucucaugggguuagacaaaggauggccaaucagcaaaauggacauuggaguuccgcugcuagccuuggguugcuacucacaaguaaacccacuaacccugacagcagcaguauugaugcucguggcccacuaugcgaucaucgguccuggucuucaagcuaaagccacaagagaagcacagaaacguacugccgcaggcauaaugaaaaauccuacaguggaugguaucguggccauugaccuugacccuguaguguaugaugcuaaauuugaaaagcagcucggacaaauaaugcuucuuauacugugcacaagucaaauucuucuaaugagaacaacaugggcacugugcgaguccauaacucuagcaaccggaccauuaacaacauugugggaagguucccccggaaaauuuuggaauacaacuauugcggucucgauggccaacauauuuagaggaagcuaucuagcuggugccggucuugccuuuaguuuaaugaaaucacuaggaggcgggagaagaggaacuggugcacagggagagaccuuaggagaaaaauggaaaagacaauugaaccaacucagcaaaucugaauuuaauacauauaaaaggaguggaauuauggaaguagaucguucugaggccaaagaaggacuuaaacgaggagaaacuacgaaguacgcaguaagcagagggaccgcuaaauuaagaugguuuguagaacgaaauuuaguuaaaccagaggggaaaguaauugauuuaggguguggucgagguggauggagcuauuauugcgcuggcuuaaagaagguuacggaagucaaaggauauacgaaagguggaccgggccaugaggaaccuauccccauggcgacuuacggguggaaccucguaaaacuucacucgggcaaagauguuuucuuugucccaccggaaaaaugugacacgcuauuaugcgacauaggugaaaguucaccaaauccaacaauagaagaagguagaacccucagaguacucaaaauggucgaacccuggcuaaggggaaaucaguuuuguauaaaaauauugaauccauacaugccgucagucguggaaacuuuagagcagaugcaacggaaacacgguggcaugcuugugcgaaacccauugucaagaaauaguacacaugaaauguauuggguauccuguggaacaggaaauaucgugagugcuguaaauaugaccucaagaaugcuacuaaacagauucacuauggcucauagaaagccuacauaugaaagagacgucgaucuaggagcaggcacgaggcauguggcuguagaaccggagguagccaauuuagauauaauaggacaacguauugagaacauuaaacaugaacacaaaaguaccuggcacuacgaugaagacaacccauacaaaaccugggcuuaucacgggaguuacgaggucaaaccgucaggcucugcgagcucuaugguaaacggaguugucaaacugcuuacaaaacccugggacguuauuccaauggucacgcaaauagcgaugacagauacaacaccauucggccaacaaagaguguuuaaggaaaaaguagacacacgaacuccuaaagcaaagcggggcacggcucaaauuauggaaguaacggcaaaauggcucuggggauuuuugucucggaacaagaaaccacguaucugcacaagagaagaguucacacggaaaguaagaagcaaugcugcaaucggagccguguuuguagacgaaaaucaauggaacagugcaaaagaagcaguagaggaugaaagauuuugggauuugguccauagggaaagagaauuacauaagcagggaaaaugugcaaccugcgucuauaauaugaugggcaaacgagagaagaaauuaggagaauuuggcaaagcuaagggcucgagggcuauuugguauauguggcugggagcaagguuucuggaauuugaagcucuagguuuuaugaaugaagaccacugguuuagcagagagaacuccuuaagcggcgucgaaggcgaggggcuacauaaauuagguuacauccuucgggauauaucaaaaauaccuggaggcaacauguaugcggaugacacagccggaugggauacuaggauuacagaagaugaccuacagaaugaggcacgcaucacagauauaauggaaccagagcaugcacucuuggcaaaaucuauauucaaacuaacauaucaaaacaaaguagugaggguccagaggcccgccaaaaacggaacaguaauggauguaaucucaagacgcgaccaaagaggaucaggacagguggggaccuauggguuaaacacauuuacgaauauggaggcucaauuaauaagacagauggaaucugagggcauauuuucgccaagugaacuagagacgccuaaucuagcagaaagaguacucgacuggcuagaaaaauauggcguagaaagacuaaaaagaauggccauaaguggggaugauugcgucgucaaaccaauagacgauagguuugcgacagcacuuacagcccugaacgauaugggaaaggugcggaaagauauuccgcagugggaaccauccaaaggauggaacgacuggcaacaaguaccauuuuguucacaccauuuccaucaauuaauaaugaaggauggaagagagauugugguaccuuguagaaaucaagaugaguuaguugguagggcuagaguaagucagggugcaggguggagucuuagggaaaccgcaugccucggaaaaaguuacgcgcaaauguggcaauuaauguauuuccauagaagggaucuaagacuagcagccaacgcaauaugcuccgcuguaccaguugacuggauaccgacaucgaggacaacauggucgauccaugcccaucaucaauggaugacgacugaagacaugcuaucaguauggaacaggguauggauagaagagaauccguggauggaagacaagacacauauaucuucuuggggcgacguaccguaccuaggaaaaagagaagaccaaugguguggaagccuuauuggauugacugcgagagcaaccugggcgacaaauauucaaguagcgauaaaucagguuagaagauuaaucggaaaugagaacuacuuagacuacaugacaaguaugaagagauuuaaaaacgaaucggauccugaaggagcuuuaugguaa

SEQ ID NO: 22002 - RNA, 9879 nt, Artificial Sequence
  derived and/or modified CDS sequence (opt6) from DENV-1__JQ045653__SS-prME
agugugacaauguuauuaaugcucaugcccacagcacuagcguuucacuuaacaacacgugguggugagccacacaugauagugaguaaacaagagcggggaaaaagccuucuauuuaaaacaagugccggugugaacauguguacucuuaucgccauggacuuaggagaauuaugugaagauacaaugaccuauaaaugcccgcguauaacugaaacagagccagaugacguugauuguugguguaacgcaacagacacuuggguaacuuacggaacauguucucaaacuggcgagcaucguagggacaaacgcucuguagcguuagcaccccauguaggacugggacuugagacucgaaccgagaccuggaugucaagcgaaggugcuuggaaacagauucaacgcguagaaacaugggcucucaggcauccuggcuuuacgguaauagcucuauuuuuagcgcacgcuaucggaaccucuauaacucagaaaggaauaauauuuauacuacuuaugcucguuaccccaaguauggcuaugagguguguaggaauagguagcagagauuuugucgaagggcuuaguggagcgaccuggguagauguggugcuagagcacggcaguugugucacuaccauggcuaaagauaaaccgacacucgauauagaauugcuaaaaacagaaguaacuaauccagcaguuuugcgcaaauuaugcauugaagcaaaaauaagcaacacaacaacugauagccgauguccaacacaaggugaagcuaccuuaguugaggaacaagacgcaaauuuugucugucgacgaacgcuuguugaccguggaugggguaacgguugcggcuuauucggaaaagggucauugauaaccugugcaaaauuuaaaugugucacaaaacucgaaggaaaaauuguacaauaugaaaaucuaaaauacucgguaauugucacaguacauaccggggaucaacaucaagugggaaacgagagcacagagcauggaaccacugcuacuauaacaccucaagcaccaaccacagagauacaauuaacugauuauggcgcucugacgcuagauugcucaccgagaacaggacucgauuuuaaugaaaugguccuacuaacgaugaaagaaaaaucguggcugguacauaaacaaugguucuuagauuuaccccucccauggaccagcggugcgaguacgucccaagaaacauggaauaggcaagaucuauugguaaccuuuaaaacugcccaugcgaagaaacaagaagucguaguuuuagggucacaagaaggagccaugcauacugcucuaaccggcgcaacagaaauucagacgucuggaacuacgacaauauuugcuggacaccuuaaauguagacugaaaauggacaaacugacgcuuaaaggaaugucuuauguuauguguacugguucauuuaaguuggaaaaggaacuagcugaaacucagcauggaacuguauuaguccaaauaaaauaugagggaacggacgcucccugcaagauacccuucucgacucaagacgaaaaaggagucacucagaacggacgacucauaacggcuaauccaauugugacagacaaagaaaaaccagugaacauagaggcugagccacccuuuggagaaagcuacauagucauaggggccggugaaaaagcgcuaaaauugaguugguucaaaaagggaaguaguauuggaaagauguuugaagcaacggcucgaggugcaaggcgaauggcaauacugggcgacacagcaugggacuucggaaguauuggagguguuuuuacaucagucgggaaacuuguacaucaaaucuuugguacagcguacggagucuuauuuagcggaguuaguuggacuaugaaaauagguaucggaguccuuuuaacuugguugggacuaaauucaagaucaaccaguuuaaguaugacauguauagcaguaggccuggugacguuauacuuaggaguaaugguacaagcagacucggguuguguaaucaauuggaagggcagggaauuaaagugcggcucagggauauucguuaccaaugaaguacacacguggaccgagcaauacaaauuccaagcggacagcccaaaaagauugagugcagcaauuggaaaagccugggaagaagggguuugcgguauaagaagcgccacgagacuagaaaauauaauguggaaacagauaucaaaugaauuaaaucauauuuugcucgaaaaugauaugaaauucacagucguaguaggagauguggcuggaauccuagcacaaggcaagaaaaugaucagaccucaaccaauggaguauaaauacucuuggaaaaguuggggaaaagccaaaauaauaggugcagauguacaaaauacuacauuuauaauugacgguccuaacacaccggaauguccagaugaccaacgugcuuggaauaucugggaaguagaagauuauggauucgggauauucacaacuaacaucuggcuuaaauugcgggauucauacacucaggucugugaccauagauuaaugagcgcugcgauuaaagacucgaaagcaguccaugccgauaugggguauuggauagaaagugaaaagaaugagacauggaagcucgcaagagcguccuuuaucgaaguaaagacauguauauggccccgaucacauacucuuuggaguaauggaguccucgaaucggaaaugaucauaccaaagauuuacggaggaccaauaagccagcauaauuauagaccgggauauuuuacacagacugcgggaccuuggcauuuaggaaaauuggaauuagauuucgaucugugugaagggacgacaguugugguagacgaacacugcggaaauagaggccccuccuuacguacgacuacuguaaccggaaaaaucauccaugaaugguguugucguucguguacacuaccgccucuuagguuuagaggggaagacgguuguugguacggaauggagauucgaccaguuaaagaaaaagaggaaaacuuaguaaagagcaugguaagugcagguaguggggaaguagauagcuucucucucgguuuguuaugcauuucaaucaugauagaagaagugaugagaucgagaugguccaagaaaaugcucaugacagguacacuugcaguauucuuuuuacuaauaaugggucaacuuacauggaaugaccuaauuagguuauguauaaugguaggagcaaaugcaagugaucguauggggauggguaccacguaucuugcauuaauggcuacauucaaaaugcgcccaauguucgccguuggauuacuauuuaggagauuaacuagcagggaaguguuauuguuaacaauuggcuuauccuuaguugcaaguguggagcuaccuaacucacuagaggaguugggagacggacuugcaaugggcauaaugaucuuaaaauuauugaccgauuuucagucccaucaacucugggccacucugcucagcuuaaccuucauuaagaccacauucucucuacacugugcauggaagacuauggcgaugauauuaagcauugugucccuauucccucuaugccuuucaacaacaagucagaaaacgacguggcucccaguauugcuggguagucuaggaugcaaacccuugacgauguuucugauugcagaaaauaaaauauggggaaggcguuccuggccauugaacgaaggaauaauggcaguugguauaguuucuauucucuuaucuaguuuguugaaaaacgauguaccucuagcuggcccucuaauugcuggggguauguuaauagcuugcuauguaauaagugguucuagcgcagauuugucacuugaaaaagccgcagaaguauccugggaagaagaggccgaacauucuggugcgagccauaauauucuaguagagguucaagacgauggcacgaugaagauaaaagacgaagaacgagaugacacccuaaccauauuauuaaaggcaacauuacuugcgguuucuggaguguauccccuauccauucccgcuacauuguuugugugguauuuuuggcagaagaagaaacagcgaaguggaguacugugggauacuccuucaccuccagagguagaaagagcuguucucgaugauggaauauaucggauuaugcaaagaggacuguuaggaagaagucagguagggguggguguauuucaagaagauguauuucauacuauguggcaugugacaaggggcgcgguauuaauguaccaaggaaaacgauuagaacccagcugggcaucaguuaagaaagauuuaauaucauauggagguggauggagguuacaagguucuuggaauacaggggaagagguacaaguuauagcuguagaacccggcaaaaauccaaagaacguacagacugcuccgggcacuuucaaaacaccggaaggugaagucggugcaauagcucuugacuuuaaaccgggcacauccgggaguccaaucguuaaccgagaaggaaaaaucgugggauuauaugggaacggagucgucacuacguccgggacuuauguuucagcaauagcgcaagcuaaagccucucaagaagggccuuugccagagaucgaagaugagguguuucgaaaaagaaaccuaaccauaauggaucuccauccggguucaggaaagacaagacguuauuuaccagcaauagugcgggaggccauaaaaagaaaguugagaacgcuaaucuuagcuccgacuagaguuguagcuucagagauggcggaggccuuaaaaggaaugccgauuagauaucaaacgacagcaguaaaauccgagcauacuggaaaagagauuguagaccuuaugugucaugcgacauuuacaaugagacuguuaaguccagugaggguuccuaauuacaauaugauaauuauggacgaagcucauuuuacagaccccaguucuaucgcugcgcgaggauacauuucaacaagaguggguaugggugaggccgcagcuauuuuuaugacugcgacaccgccaggaaguguggaggccuuuccacaaaguaacgcaguuauucaagacgaagaaagagauauaccggaaagaucauggaacucuggguaugaauggaucacugauuucccagggaaaacgguuugguuugucccuaguauaaaauccggcaacgacaucgcuaacugcuuacguaaaaauggaaagcgaguuauacaacucaguagaaaaacauuugauacugaauaucagaaaacuaagaauaacgauugggacuauguaguaacuacagacauuagugaaaugggggcaaacuuuagagcugaucgaguaauagauccaagacguugucuaaagccuguuauuuugaaagacggaccagaaagaguaauacuagcagggccgaugccggugacaguggcaucggccgcucaacgcagagggaggauaggacguaaucauaacaaagaaggagaucaauacaucuacauggggcaaccauuaaauaaugacgaggaucaugcucauuggacagaagcaaagaugcuauuagauaacaucaacacacccgaagguauaauucccgcgcuauuugaaccagaaagagaaaaaucugcugcaauugacggagaauaucgccuuagaggagaagccagaaagaccuucguagaacugaugagaagaggggaucugccggucugguuaucauauaagguugcgucagagggauuucaauauucggauaggcgaugguguuucgauggugaacguaacaaucaaguucuggaagaaaacauggauguagaaauauggacaaaagaaggcgaacggaagaaacuucgaccaagauggcucgacgcacgaacauacagugacccucuagcuuuacgagaauuuaaagaauuugcagcugggcggagaaguguuaguggagaucuaauauuggagauaggaaaacucccccaacaccuaacccaacgcgcccaaaaugcuuuggacaauuuaguuauguuacacaacucagagcagggaggaagggcauaucgacaugcaauggaagaacuccccgacacgaucgaaacacuuaugcuacuagccuuaaucgcagugcuaacaggugguguuacauuauucuuuuugucaggccguggauuaggcaaaacaaguauuggacuucuaugugucauggcgaguucgguacuucucuggauggcaucaguggaaccgcauuggaucgccgcaaguauuauacucgaguucuuuuuaaugguacugcuaauaccugaaccagaucggcaaagaaccccacaagauaaccaguuagcuuauguugugauuggauuguuauuuaugauuuuaacgguagccgcaaacgaaaugggucuccuugaaaccacgaagaaggauuuaggaaucgggcauguugcuguagaaaaucaccaucaugcagcuaugcuugauguugauuugcacccugcgagugcuuggacccuuuaugcugucgcgaccacuaucauaacuccuaugaugcgucacacaauugaaaauacaacagcuaauauuucauuaacggcuauagcaaaccaagcugcuauauugauggggcuggauaaaggcuggcccauaucuaagauggauauagguguuccacuacuagcacuuggaugcuauagucaaguuaaucccuugacgcuaacggcugcaguauuaaugcucgucgcucauuacgccauaaucggcccaggauugcaagcuaaagcaacgagagaggcgcaaaaacgcacagcugcuggcaucaugaagaauccuacaguugacggaauuguugcgauugauuuagauccgguaguuuacgacgccaaauuugaaaaacaacucggucaaauaaugcuacugauucuaugcacaagucaaauccuucuaaugagaacuacuugggcuuugugugaaaguaucacgcucgccacuggaccccuaacaacacucugggaagggucuccagggaaguucuggaacacuacaaucgccguaagcauggcaaauaucuuucggggcuccuacuuagccggugcuggcuuagcguuuucucuaaugaaaucuuuaggugggggccgaagagguacuggagcccaaggagagacguuaggagaaaaauggaaaagacaacuaaaccaacugagcaaaagugaauuuaauacauacaaaagauccgguaucauggaagucgaccgguccgaagcaaaagaaggccucaagcgaggcgaaaccacaaaacaugcagugaguagaggaacugcaaaacuaaggugguucguagaaaggaacuugguuaaaccagaaggaaaaguaaucgaucuuggcugcggacgcggcgguugguccuauuauugcgccggauuaaagaaaguaacagagguaaaaggauacacuaaaggagggccuggacacgaggaaccgaucccaauggccacauauggauggaauuuagucaaguuacacucgggcaaagauguauucuuuauaccgcccgaaaaaugugauacccuccuaugcgauauuggcgaaaguucacccaauccaaccauagaagagggucgaacauuacguguucuaaaaaugguugaaccauggcuaagaggaaaucaguuuuguauaaaaauuuuaaacccguauaugccgucugugguagaaacgcuagaacaaaugcaacgaaaacauggugggauguuagucagaaauccauugucuagaaauuccacucaugaaauguauuggguuaguuguggaacggguaacauuguuucggccgucaacaugacaucuagaaugcuacuaaaccguuucacaauggcgcauaggaagccaaccuaugaaagagacguugacuuaggugcagggacucgucacguagcuguugaaccagaagucgcuaaccucgauauuauugggcagagaauagaaaauauaaagcacgagcauaaaucaacauggcacuaugaugaagauaacccauauaagacuugggcuuaucacgguagcuacgagguuaaaccaagcggaagugcgucaucaauggugaauggugugguaaaauuguuaacaaaaccaugggacguaauccccaugguaacucaaauugcaaugacagauacuacaccauuuggucaacaaagaguuuucaaagaaaaaguagauacacgaacaccuaaagccaagagaggcacggcacagauaauggaaguaaccgcgaagugguuauggggcuuccuuucuaggaacaagaaaccccgaauuugcacacgggaggaguucacccgaaagguucgaucgaacgcugcaauaggagcagucuuugucgaugaaaaucaauggaacagugcuaaagaagcuguagaggaugagagguucugggacuuagugcauagggagagggagcuucacaaacaagguaaaugugcaacauguguguacaacaugauggggaaaagggaaaagaagcugggagaauuugggaaggcuaaaggcucgagagcaauaugguacaugugguugggggcuagauucuuggaguucgaagcgcuuggauuuaugaacgaagaucauugguucucaagagaaaauucauuaucagguguugaaggggagggacuacauaagcuaggauauauacuuagagauauaagcaagaucccagguggaaauauguacgcagacgacacagcaggcugggauacucgaauuacugaggaugaccuccaaaacgaagcuagaauaacagauaucauggaaccagaacacgcauuauuagcuaagaguauauucaaacuaaccuaucagaacaaagugguuagaguacaacgcccagcuaaaaauggcacagucauggaugucaucagucgaagggaccagagaggaucaggacaaguuggaacauauggcuugaauacauucacaaauauggaagcacaacuuauuaggcaaauggaaucugaagguauauuuaguccaucugaguuggaaacaccgaacuuagcagaaaggguucuagacugguuagaaaaauacggcgucgaacggcuuaaaaggauggcgauaucuggcgacgacugcguaguuaagccaauugacgaucgauuugccacugcucuaaccgcuuugaaugauaugggaaaaguacgaaaagacauuccucaaugggaaccuucaaaaggauggaacgauuggcaacaaguaccuuuuuguucgcaucacuuccaucaguuaauaaugaaagauggaagggaaauaguugucccaugccgaaaucaggaugaacucguaggcagggcacguguuucccaaggggccggauggucacugcgugagaccgcaugucuggguaaaaguuacgcacaaauguggcaacuuauguacuuucaucgaagagauuuacgacucgcugcgaaugcuauaugcucagcagucccaguagauuggauuccgacuagcagaaccaccuggagcauucaugcucaucaucaauggaugaccacggaagauaugcucuccguuuggaacagggucuggaucgaggaaaaucccuggauggaagauaagacucacauuaguuccuggggagaugucccauaccuagguaagagagaagaccaauggugcggcagucuaauaggguuaacagccagggcuaccugggccacaaacauccaaguggcuauuaaucaagucagaagauuaauagguaaugagaauuaucuagacuauaugacgucuaugaaaagauuuaagaacgagucagacccugaaggagcucuaugguga

SEQ ID NO: 22003 - RNA, 9879 nt, Artificial Sequence
  derived and/or modified CDS sequence (opt6) from DENV-1__JQ045657__SS-prME
ucuguuacuauguuacuuaugcuaaugccuacagcuuuggcauuccaccuaacuacuagaggaggagaaccgcauaugaucguguccaaacaagaaagaggaaaauccuuauuauucaaaacuagcgcaggaguaaacauguguaccuuaauugcaauggacuuaggagaguucugugaagauacaaugacuuauaaauguccgagaauaacagaagcagaaccagacgauguugauuguugguguaaugcuacugacacauggguaaccuaugguaccuguucucaaacgggagaacauaggagggacaaacggaguguugccuuagcgccucauguaggucugggucuagagacacguacagaaacuuggaugucuucagagggugcauggaagcaaauacagaggguagaaacgugggcacuaagacauccaggguucacaguaauagcacucuuucuagcccacgcaaucgguacuucuauuacgcaaaaaggaauuauauucauacugcucauguuagucacaccuucaauggccaugagaugcguaggaauugggaguagagauuucguggaaggacuaagcggagccaccuggguagauguaguccuagaacauggaaguugcgugacuacuauggcuaaagauaaaccaacacucgauauugaauuauuaaagaccgagguaacaaauccugcuguacuucgaaaacuguguauagaagcaaagauaucaaacacuacuaccgauagucgaugcccgacccaaggugaagcaaccuuagucgaggaacaagacgcaaacuuuguguguagaagaacauuuguagacagagguuggggaaacggguguggacuuuucggaaagggaagccuaauuacuugcgcgaaguucaaaugcguuacaaaguuagaaggaaaaauaguucaauacgaaaaccugaaauacuccgucaucguaacaguccacacgggagaccagcaccaagugggaaacgaaucaacagaacacggaacaacugccaccauuacaccucaagcuccguccacggaaauacaacuaaccgacuauggugcucuaacacuagauuguaguccuagaaccggacuagauuucaaugaaaugguccuuuuaacaaugaaagagaaaagcugguugguucauaaacaaugguuuuuagaucuuccauuaccauggacaucgggugccucgaccucccaagaaaccuggaaccguaaggauuugcuaguaacauuuaaaacagcccaugccaagaaacaagagguuguuguccuaggaucucaggagggugcaaugcacacggcauuaacaggagcaacagaaauacagacaagcgguacgacaaccaucuuugcgggacacuuaaaauguagguugaaaauggacaaauuaacccuuaaagguaugucguauguaauguguacgggguccuuuaaacuugaaaaagaaguagcagaaacacagcacgguacuguacugguacaaaucaaauaugaaggaaccgaugccccauguaaaaucccuuucagcacccaagaugagaaaggugucacucaaaauggucgguuaaucacugcgaauccaauaguaacagacaaggaaaaaccggucaauauagaagcagagccaccauucggagaaucauacauaguaauuggagcaggagaaaaagccuuaaaacucuccugguucaagaaaggaaguucaauuggaaagauguuugaagcaacugcgagaggggcgcgaagaauggcaauauuaggagauacagccugggauuuuggaucuauaggagggguauuuacaagugugggcaaauuaguacaucaaauuuuuggaacugccuacggaguacuauuuucuggcguaagcuggacaaugaaaaucggaauugggguacuacucacguggcuuggacuuaacucuaggagcacuagccuaucaaugaccuguauagcagucggacuugugacauuauacuuaggaguaaugguacaagccgacaguggauguguuauaaauuggaaaggacgggaacuaaaauguggaucaggaauauuuguuacaaaugaaguucauacuuggacagaacaauauaaauuucaagcagacucaccgaagaggcuaucggcagcuauugggaaagcaugggaagaagguguuugcggcauucgaaguacaaccagacuagaaaauauaauguggaagcaaauaaguaaugaauuaaaccauauacuucuagagaaugacaugaaauucaccguuguaguuggggacguagcgggcauucuagcucaaggaaagaaaaugaucaggccccaaccgauggaauauaaauauucauggaaguccuggggaaaagccaagauaauaggcgccgauguacagaauacaaccuuuauuauagacggacccaauacuccggaaugcccugacgaccagagggcauggaacaucugggaaguugaagacuauggauuugggauuuuuacaaccaauauaugguuaaaacuucgugauagcuacacgcaaguuugugaucacagguugaugagugcagcuauuaaagauaguaaagcuguucacgcagacaugggauacuggaucgaguccgagaaaaacgaaacauggaaacuagcuagggcaucuuuuauugaaguaaaaacguguauauggccgaaaagccauacuuuguggucaaacggaguguuggagagugaaaugaucauaccgaaaauauauggcgguccuauuucgcagcauaacuaucgaccaggguauuucacacaaacugcuggcccguggcauuuaggcaaauuagaauuggacuucgauuuaugcgaaggaacuaccguagucguagacgaacauuguggcaauaggggacccagcuuacguacgacuacaguaaccggcaagauaauucacgaauggugcugucgcucauguacauuaccaccucuccgauuuaaaggcgaagauggcugcugguacggaauggaaauuagaccggucaaagagaaagaagagaaucuaguaaaauccaugguuucugcaggaaguggagagguagauagcuuuucccuuggucucuuguguauuaguauuaugauagaggagguaaugaggagucgauggucuagaaaaaugcuaaugacaggaacccuagccguauucuuucuauuaaucaugggccaacuuaccuggaacgaccuaaucaggcuauguauaaugguaggugcuaacgcaucagauagaauggguauggggacaacauacuuagccuuaauggcaaccuuuaaaaugagaccaauguuugccguaggacuccuauuuaggcgacucacgucacgggaaguuuuacucuugacgauagguuugucuuuagucgccaguguugaacugccaaacagccuugaagaauugggugacgguuuagcaaugggaauuaugauauuaaaacuacuaacagacuuucaaucgcaccaacuuugggcaacauuauuaucacuaaccuuuauaaaaacaacauucagucuccauuacgcauggaaaacaauggcaaugguauuaucgauugucagcuuguucccauuauguuuaagcacaacuucacaaaagacaacauggcuuccuguguuguuagguaguuuaggaugcaaaccguuaacaauguucuugauagcagagaacaaaaucuggggacggaaaucauggccacucaacgaggguaucauggccguuggcaucguuucaauacuuuuaucaagucuuuuaaagaaugauguuccauuggcaggcccacucaucgcaggaggcauguuaauugccuguuaugucauaagcggguccagcgcagauuuaucauuggaaaaagcagcagaggugucgugggaagaggaagccgagcauucgggagcuucacauaauaucuuaguagagguccaagaugacgguacaaugaaaauaaaagaugaggaacgcgacgauacauuaacaauacuacugaaagcaacauugcuugcuguguccggcguguauccucucagcaucccggcaacucuauucguuugguauuuuuggcagaaaaagaaacaaaggucaggcguauugugggacacaccaagcccgccugaaguugaacgggccguuuuagaugauggaauuuaccguauuaugcagagaggucugcuaggcaggagucagguugguguuggcguuuuucaagaaaacguuuuucacacuauguggcaugugacacggggagcuguauuaauguaucaggguaaacggcuugagccaucaugggccucggucaagaaagaucuaaucuccuacggcggaggauggcgauuacaaggaucuuggaauacaggagaggaaguucaagugauugcaguugaaccaggcaaaaauccuaaaaacguucaaacugccccuggaacauucaaaacuucagaaggugaagucggcgcuaucgcacucgauuucaaaccuggaaccucagguaguccaauuguaaauagggagggcaaaauaguuggccuguauggaaaugguguuguaaccacauccgguacguaugucucugcaauagcccaagcaaaagccucacaagagggcccuuuaccggaaauugaagaugaaguauuccguaaaagaaaccucacaauuauggaucuacacccaggaaguggcaaaacgcgacgauacuuacccgccauaguaagagaagccauuaaacgaaaacugcgaacacugauacuagcaccaacuaggguaguugcauccgaaauggcagaagcauugaagggaaugccaauuagauaucagacaacagcaguaaaaucagagcauacuggaaaggaaaucguugauuugaugugucacgcgacguucacaaugagguugcuaucgcccguuagaguuccuaacuauaauaugauuauaauggacgaagcacacuuuacagaccccucaucuauagcagcacggggcuauauaagcacacguguagguaugggugaggcugcugcuauauuuaugacagcuaccccaccaggauccguugaagccuuuccccaaagcaaugcuguaauucaagaugaggaaagagacauuccugagcguagcuggaacucgggauaugaauggauaacugacuuuccuggcaagacugucugguuuguaccaucaauuaaauccgguaaugacaucgcaaacuguuuaaggaaaaacggaaaaaggguaauucaguuaucuagaaaaaccuucgauacagaauaccaaaagaccaaaaauaaugacugggauuauguagugacgacggauauuucagagaugggagcaaacuucagggcggaucgugucauagauccgagaaggugccugaaaccuguaauauuaaaagaugguccugaaaggguaauacucgcaggcccuaugccggucacuguagcuagcgccgcucaacgacguggccgaaucggucgcaaucauaauaaggaaggagaucaauacauuuacauggggcaaccuuuaaauaaugacgaagaccacgcgcauuggacagaagcuaagaugcuauuggauaauauaaauacucccgaaggaauaaucccagcccuuuucgagccagagagagaaaaaucagcagcuaucgauggggaauaucgauuacgaggugaagcaagaaaaaccuuuguagaacuaaugcgacgaggcgaccugccgguauggcucaguuauaagguugcuagugaaggguuucaauacagcgacagaagauggugcuucgauggagagaggaacaaucagguguuagaagagaauauggauguugagaucuggacuaaggaaggugaaaggaagaaauugcggccacgcugguuggaugcaagaaccuauucagacccacuagcguugagagaguuuaaagaauuugcggcaggacggaggagcguguccggcgacuugauucuggaaauugguaagcucccacaacaccuuacacagagagcacaaaaugcucuagauaacuuggucauguuacacaauuccgagcaaggaggaagggcauaucgucacgcaauggaggaacuaccugauacuauagagacgcuaauguuauuagcuuuaaucgcaguacuuacaggcggaguuacacuauucuuucuuucuggacggggucuugguaaaacuucuauagguuuauuaugcgucauggcaucauccguuuuauuauggauggcgucaguugaaccccacuggauagcagcaaguaucauucuugaguucuuucugauggugcuacuuauuccggaaccagaucgccaaaggacaccgcaagauaaccaauuagcauacguaguaauuggauuguuauucaugauauuaacaguugcggcaaaugaaaugggccuauuagaaaccacgaagaaagauuuagggauaggacacguugccgcagaaaaccaucaccacgcugcuauguuagacgucgaucugcaucccgcuucugcauggacguuguacgcagucgcaacgacgauaaucaccccuaugaugcgacauacgauagaaaauacuacagcuaacauauccuuaacagccauagcgaaccaagccgcgauauuaaugggucuugacaaaggcuggccaauuucgaaaauggacauaggaguaccgcuguuagcgcuagguuguuauagucaaguuaauccucuuacuuuaacagcagcuguucucaugcuuguagcccacuaugcaaucauuggcccuggauuacaggcaaaagcaaccagagaggcgcaaaagagaacugcagcagggauaaugaaaaacccaacuguggauggaauaguagcuauagaucuagauccagucguauaugaugcgaaauuugaaaaacaauugggucaaauaaugcuacuaauucuauguacaucgcaaauucuucugaugcguacaacaugggcuuuaugugaaucuaucacguuagcuacaggaccacuaaccacacuaugggagggaucaccgggaaaguucuggaacacaaccauagcaguaucuauggcaaacauauuccgaggaaguuaccuagcaggcgcaggacuggcuuucaguuuaaugaaaagccuuggaggagggagaaggggcacgggcgcacagggagaaacuuuaggagagaaguggaaacgccaacuuaaucaacuaucaaaaagugaauuuaauacauauaagcguuccggcauaauggagguugacagaagugaagcuaaggagggauugaaacgaggggaaacgacuaaacaugcagugaguagagguacugcaaaacuaaggugguuuguggaaagaaaucuagucaaaccagaaggcaagguaauagaccuagguugcggccgagguggauggucauacuauugugcuggccuaaagaaaguuacagagguuaagggcuauacuaaaggagguccaggacaugaagaaccaauaccaauggccacuuacgguuggaaccuaguaaaacuucauagcggcaaggaugucuucuuuguaccaccggaaaaaugugauacgcucuugugcgauauuggagaaagcucaccuaauccuacaauugaagaaggaaggacacuuagaguauuaaaaauggucgaaccauggcugcguggaaaccaauuuuguauaaaaauccugaaucccuauaugccuuccguaguggaaacauuagaacagaugcaaagaaaacacggugguaugcucguaagaaauccacuaucucgaaauucaacccaugagauguacuggguaucauguggaacugguaacauuguaucagcaguaaauaugaccagucgaaugcuccuuaauagguucacaauggcucaccgaaaaccuacuuaugaaagagauguagaucuuggugcgggaacgcgccaugucgcuguagaaccugaaguagcgaaucuagacauaauugggcaaagaaucgagaacauuaaacacgaacauaaaucaacauggcauuaugaugaagauaaucccuauaagacaugggccuaccauggcagcuaugaagugaaaccaucugguagugcuagcaguauggucaacggcguugucaagcuauugacuaagccuugggaugucauaccaaugguuacgcaaauagccaugacagacacgacaccauuuggacaacaaaggguuuucaaagaaaagguugacacacgaacgcccaaagcuaaaaggggaacagcacagauaauggaaguaacggcgaaaugguuguggggauuucuaagcaggaacaagaaacccagaauauguacuagagaagaguucacgaggaaaguaagauccaaugcugccauaggggcaguuuucgucgacgaaaaucaguggaacuccgccaaagaagccguugaagaugaaagguuuugggacuuaguacauagagaacgagaauuacauaagcaaggcaaaugugccacuuguguguauaacaugauggguaaacgggagaagaaauugggagaauuuggcaaggcgaaaggcucacgggcaauuugguauauguggcucggagccagguuccuagaguucgaagcacuaggcuucaugaaugaagaucauugguuuucaagagaaaacucuuuaucugguguugaaggugaaggacugcauaaauuaggauauaucuugcgggauaucaguaaaaucccaggcgggaauauguaugcagacgauacagcugggugggacacaagaaucacagaagaugaccugcagaacgaggcucggauaacugacauuauggagccagaacaugcacuguuggcuaaaucaauuuuuaaacuuacauaucaaaauaaagucgugagaguucaaagaccggccaaaaauggaacaguaauggauguaauaucuagacgcgaucagcgaggaucggggcagguagguacauacggucugaauaccuuuaccaacauggaagcacaacuaauuagacaaauggaaagcgaagaaauauucucaccgucggaauuagaaacaccuaaucuugcgggaagaguauuagauuggcuagaaaaacaugguguagaaaggcuaaagaggauggccauuagcggagaugauugugucguuaaacccauugaugaucgguuugcuacugcacuaacugcacuaaaugacaugggaaagguuagaaaggauauaccgcagugggaacccucaaaggguuggaaugacuggcaacaagugccguuuuguucucaccacuuucaucaauuaauuaugaaggaugguagagagauaguagugccaugucgaaaccaggacgagcuaguuggccgcgccaggguaagucaaggagcagguuggucucugagagaaacugccugucuagggaaaucauacgcacagauguggcaauugauguacuuucacagaagagaccuaagguuggcagccaaugcuauuuguagcgcaguuccaguugacugggucccaacaagucggacgacauggagcauacaugcucaccaucaauggaugacuacagaggauaugcugaguguguggaaucgaguuuggauagaagaaaauccguggauggaggacaagacacauauaucaucauggggugacgugccauauuuaggcaaaagagaggaccaaugguguggaucuuuaauaggccuaacugcgcgagcuacaugggcaacuaauauacaagucgcaauuaaccaaguuagaagacuuauaggaaaugaaaauuauuuagauuacaugaccucaaugaagcguuucaaaaaugaaucugacccggagggugcgcuaugguaa

SEQ ID NO: 22004 - RNA, 9879 nt, Artificial Sequence
  derived and/or modified CDS sequence (opt6) from DENV-1__JQ045659__SS-prME
ucaguaacuauguuauuaauguugaugccaacagcauuagcauuucaucucacaacuagaggcggagaaccccauaugauaguauccaaacaagaacgagguaaauccuuauuguucaaaacaagcgcugguguaaauaugugcacguuaaucgcaauggauuuaggugaauuaugcgaagauacaaugacauacaaauguccaagaauuacagaaacggaacccgaugauguagacuguugguguaaugcaacugacacauggguuaccuacggaaccugcucucaaacaggggaacaccgcagagauaaaagaucaguugcacuagcuccgcauguaggucucgggcuagaaacaagaaccgaaacguggaugucaucagagggagccuggaaacaaauucaaagaguggaaaccugggcacuuagacauccuggauuuacuguaauagcucuguuucuagcccaugcaauaggaacgaguauuacacaaaaaggaauaauauuuauucuuuuaauguugguaaccccaagcauggcgaugagauguguaggaaucggaucgagagacuuuguagaagguuugucaggcgcuacguggguagaugucguucuagaacacggaagcugcgugacgacuauggccaaagacaaacccacguuagacauagaauuacuaaaaacagagguuaccaauccagcaguacuuagaaaauuaugcauugaagcaaaaauaaguaacacaacuaccgacucacguugcccuacucaaggagaagcaacauugguagaagaacaagacgcgaacuucguuugucgacgaacuuuuguugaucgaggauggggcaauggaugugguuuauucggaaaaggcuccuugauuacgugcgcuaaauuuaaaugcguuacgaaauuagaagggaaaauuguacaguaugaaaaccuuaaauacucuguuauuguaacaguucauacaggagaccaacaucaaguggguaaugaauccacggaacauggaacgacagcaacaauaacaccacaggcacccacaacagagauccagcuuacagacuauggggcuuuaacucuagacugcucgccuagaacaggauuagacuucaacgaaauggucuugcuuacuaugaaagagaaaagcuggcuuguccacaaacaaugguuuuuggaucuaccucuccccuggaccucgggagcaucgacgucucaagaaacguggaaucgucaagaucugcuaguaacauuuaaaacggcucaugccaagaaacaagaaguuguuguucuaggaucacaagaaggagcuaugcauaccgcuuugacaggagcuacagaaauucaaacaucagggacuacgacgaucuuugccggacaucuaaaaugucgacuaaaaauggauaaauuaacacucaaaggaauguccuacguaauguguacugguucuuuuaaauuggaaaaagaaguugcugaaacucagcacggaacuguccugguacaaauaaaauaugaagguacggacgccccaugcaaaauacccuucucaacgcaagaugaaaaaggugcgacucaaaacggucgacuaauaacagcaaauccaauugugacugauaaagagaaaccgguaaauauagaagcugaaccuccauuuggggaaagcuauauagucauaggagcgggcgaaaaagcccuaaaauuauccugguucaagaaaggaucaagcauugggaaaauguuugaagcaacggccaggggcgcuagaagaauggccauacucggcgacacagccugggauuuuggaucaaucggagggguauuuacauccgucggcaaguuaguacaccagauauuugggacagcauacggaguacuuuucaguggaguaucauggacaaugaaaauagggauagguguauuacugacuugguugggacugaacucaagaagcacaucccuuucuaugacauguaucgcugucggccuaguaacuuuguaucugggggugaugguacaagcagacaguggaugcguaauaaauuggaaaggucgcgagcuaaaauguggcucaggaauuuucguuacaaaugaaguacauacauggacugaacaauauaaauuccaggcagacagcccuaaaaggcuauccgcggcuauagggaaagccugggaggaagguguauguggcaucagaucggcgacccgauuggagaauauuauguggaagcagauaucaaacgaauuaaaucacauauuguuagagaacgauaugaaguucacugucguuguaggagacguaacaggaauauuggcgcaaggcaagaaaaugauaagaccacagccuauggaauauaaauacucguggaaaucauggggaaaagcaaaaauuaucggugccgauguccagaauaccaccuucauaaucgacgguccaaacacgccugaaugcccggaugaucaaagagccuggaauauuugggagguggaagauuauggguucggaauauucacaacgaauauuugguuaaaacuaagagauagucauacccaaguuugcgaucacagacugaugucagcugcuauaaaggauucuaaagccguacacgccgacauggguuauuggauugaauccgagaaaaaugaaacguggaagcuagcuagagcguccuuuauagaaguuaaaacaugcaucuggccaaaaucucauacauuauggagcaaugggguacuugaaucugaaaugauaauuccaaagauauacggugggccaauaagucagcauaauuauaggccaggauacuucacucaaaccgcagggccuuggcacuuagguaaacuagaauuagacuuugaucuaugugaaggcacaacagucgcaguugacgagcacuguggaaaucguggaccaucccugcgaaccaccacagucacaggaaaaauuauccacgaguggugcugucgguccuguacucuuccgccccuacgauuuagaggugaagaugguugcugguauggaauggaaauucggcccguuaaagaaaaagaggaaaaucuuguaaaaucaaugguaucugccggaaguggggaaguagacucuuucucacucgguuuacuauguauaucgaucaugauagaggaaguaaugagaagucgauggucuagaaaaaugcuaaugacugguacacuugccguauucuuucuucuaauuaugggacaauugacauggaaugaccuaauuagauuauguauuaugguaggugcuaaugcaucagaccgaauggggauggggacaacauacuuggcuuuaauggcaacuuuuaagaugagaccaauguuugccguuggucuacuuuuucgucguuuaacgucacgcgaaguacuucucuuaaccauaggacuuagcuuagucgccucaauggaauuaccaaauucguuagaagaacuaggugacgggcuggcgauggggaucaugauucucaaacuauuaacggauuuccaaucgcaccaacuuugggcuacgcuauugagucuuacuuucaucaagacuacauuuucauuacauuacgcauggaagacuauggcuaugguccuaucuauuguaagccuauucccacuaugcuuaaguacuacuucacagaaaacuacaugguugccuguccuuuugggcucacuuggauguaagccauugaccauguuucuaauagcagagaauaaaauaugggggagaagaucuuggccauuaaaugagggaauuauggcuguugguauagucucaauauuauugucaucacuucuuaaaaacgauguaccccuagcagguccucuuauugcaggcggcaugcuuauagcguguuauguaauaucaggaucaagugcugaccuaucgcuagaaaaagcugcugaagugaguugggaaaaggaagcugaacacucuggagccagucauaauaucuuaguagaaguccaagaugaugguacaaugaaaauaaaagaugaagaacgagacgauacauuaacaauuuuacuaaaggcaacacuccucgcgguuucuggcguguauccacuuucaauaccggcgacauuauucguuugguauuucuggcaaaagaagaaacaaagaucaggaguguugugggauacaccaucaccgccggaaguagggcgagcaguauuagaugacggaauuuaucgaauuaugcaaaggggacuauuggggagaucacagguaggugugggaguuuuccaagaaaaugucuuucacacuauguggcauguuacccgcggggccguauuaauguaucaagggaaaaggcuagagcccucaugggcaagugucaagaaagauuuaauaucauauggcggaggguggagacuacagggcagcuggaauaccggagaagaaguccaaguuauagcaguagagccagguaaaaaucccaaaaacguccaaacagcaccgggaacauuuaaaacuccagaaggugaaguuggcgcaauagcauuagauuuuaagcccgguacaaguggauccccgaucgugaaucgugaaggaaaaauaguagggcuuuacgguaauggaguaguuacgaccucugguacguauguauccgccauagcucaagcaaaggcuucucaggaagguccuuugccggagauagaagacgaaguauucagaaaaagaaacuuaaccauaauggaucuccaccccggcucaggcaagacacgucguuacuuaccagcuauagugagggaagcuauaaaaagaaaauuacgcacgcuuaucuuagcuccuacacgugucgucgcauccgaaauggccgaagcacuuaaaggaaugccaauccgauaccagacuacagcggucaaaagcgagcacacaggaaaggagauugucgaucuaaugugucacgcaacauucacaaugcgacuacuuagcccaguaagagugccaaauuauaauaugauuauaauggacgaagcucacuuuacugauccuucauccauagcagcccggggauauauaucuacgagaguagguaugggagaagcagcagccauauuuaugacagccacacccccuggauccguagaagcauucccgcaaucgaacgcggucauacaagacgaagaaagagauauaccggaaagaaguuggaacucuggguaugaauggauuacagacuuucccggcaaaacggugugguucguuccaaguauaaagucugguaaugauauagcaaauugccuacguaaaaacggaaaacgaguaauccaauuaagcagaaaaacuuucgacacagaauaccagaaaacuaaaaacaaugacugggacuauguuguaaccacagauauuuccgagaugggggcaaacuuucgggcugacaggguuauugacccccgccgauguuuaaaacccgugauauugaaagaugggccagaacgaguuauucucgcaggaccuaugccaguuacuguagcaucagcugcacaaaggcguggccguauuggccgcaaucauaacaaggagggagaccaguauauuuacaugggacaacccuugaacaacgacgaagaccacgcucacuggaccgaggcuaaaaugcuacucgauaacaucaacacaccugaaggcauaauucccgcucuuuuugagcccgaacgugagaaaagugcugcaauugacggugaauaccgacuucguggugaagcacgcaaaacuuucguugaacuaaugagaagaggagauuuaccaguuuggcugaguuauaagguagccagugaagguuuccaauauagugacaggcgcugguguuucgauggagaaaggaacaaccaaguauuggaagaaaauauggauguugagauauggacuaaagaaggagaacggaagaaauuacgaccccguuggcuagaugcgcguaccuauucugacccguuggcccucagggaguucaaagaauuugccgcaggaaggagaagcgucucgggcgacuuaauuuuagaaauaggcaaauuaccacagcauuugacccaacgagcccaaaaugcccuagacaacuuagucaugcuccacaacucggaacaggguggccgggcuuaucgccacgcaauggaagaauuaccagacacgauugaaacgcuuaugcuccuagcucuuauagcagugcucaccgguggcguaacucucuucuuucuaucuggaaggggcuuggggaaaaccucaauaggacuacuauguguaauggcaucgucuguuuuacucuggauggcaagugucgaaccucacuggauagcagccucaaucauacucgaauuuuuccucaugguccuauuaauuccagaaccugaucgccaaagaacaccgcaagauaaucaauuagcauauguaguaaucggacuccuguuuaugauacuaacaguugcugcuaaugaaaugggccuauuagaaacaacuaagaaagaucuaggaauagggcacguggcaguagaaaaucaccaucacgcggcuaugcuagauguagacuuacauccagcuucagcuuggacacuauaugcuguugcuacaacaauaauuacaccgaugaugcgacauacaaucgaaaacaccacggcaaauaucucacuuacagcuauugcaaaucaggccgcaauauuaauggggcuugacaagggcuggcccauuucgaaaauggauauaggugugccauugcucgcacucggauguuacucucaaguaaacccucuaacacuuacagcagcgguuuuaaugcuuguugcucauuacgcaauuauagggccuggucuacaggcaaaagcaacucgcgaagcacaaaagcguacugccgcugguauuaugaaaaacccaacuguagacggcauuguugccaucgaucuagacccuguaguuuacgaugccaaauuugagaaacaacuuggccaaauaaugcuacuuauuuuauguaccagucaaauacuauuaaugagaaccacuugggcguuaugcgaaucuauuacacuagcaacaggaccacuaacuacuuuaugggaggguucaccaggaaaauuuuggaauacuaccauagcugucucuauggccaauauuuucagagguaguuaucuagccggugcuggguuagcuuucagccuaaugaaaagucuagggggagguagaagagguacuggagcacaaggcgaaacccuaggugaaaaauggaaaaggcaguugaaccaguuaucaaaaucggaguucaauacguauaaaaggagcgggauaauggaaguugaucgaagugaggccaaagaagguuuaaaaaggggagagacuacuaagcaugccguuucuagggguaccgcaaaacuaagaugguucgucgaaaggaacuuaguuaaaccugaggggaaaguaauagaucuuggaugcggaagaggcgguuggaguuauuauugcgcgggacugaagaaagucaccgaagugaagggguauacgaagggagguccuggucacgaagaacccauaccgauggccacauauggauggaaucuuguaaagcuccauucuggaaaggacguguuuuucaucccuccagaaaagugugauacucuacugugugauauaggagagucaaguccaaacccaacuauugaggaagguaggacucuucguguccucaaaaugguggagccuugguuaagaggaaaucaauuuugcauaaaaauauuaaauccauacaugccuagcguaguugaaacauuagaacaaaugcaacgaaaacacggggguauguuaguaagaaacccguuaucuagaaauucaacacaugaaauguacuggguaagcugugggacuggcaauauagugagugcaguaaacaugaccagcagaaugcugcuaaauagguucacgauggcacauaggaagccaacuuacgaaagggauguugauuuaggcgcaggcacucgucauguagcuguugaaccugagguggcaaauuuagauauaauaggucaaagaauagaaaacauaaaacaugaacauaagucaacguggcacuaugacgaggacaacccauauaagacaugggcauaccacggaaguuaugaaguuaaaccuucaggauccgcaucgaguaugguaaacgguguagucaagcuccucaccaagccuugggacgucauaccuaugguuacucaaauugcaaugaccgacacgacuccauuuggacaacaacgagucuucaaagaaaaaguagauacaagaacgccaaaggcaaagcgcggcaccgcucagaucauggaaguaaccgcuaaauggcucuggggguuccugucgagaaacaagagaccucguauuugcacgcgagaagaauuuacacguaaagugagaucaaaugcagccauuggugcugucuucguagacgaaaaucaguggaacucugcaaaagaagcaguagaagacgaaagauucugggaccugguacauagggaacgagaauuacacaagcaaggaaaaugugcaacuugugucuacaauaugaugggaaaacgagagaagaaacuuggcgaguuugggaaagcaaaaggaucaagagcaauaugguacaugugguuaggugccagguuucuagaguucgaggcauuaggcuuuaugaacgaagaucauugguuuuccagggaaaacagucuaagcggcguugaaggagaaggccuacacaaguuaggauauauauuacgcgacauaucgaagauacccggagguaacauguaugccgacgauacggcggguugggauaccagaaucacagaggaugacuugcaaaaugaagcaagaauaacugacaucauggaaccggagcaugcucuccuugcgaaaucaauauucaaauugacuuaccaaaacaaggucguaagaguacagaggccagccaaaaauggaacuguaauggacguaauuucaagacgagaucaaagaggaagcggucaagucggcacauacggacuaaauacauuuacuaacauggaagcucaacuaauacgucagauggaaucugagggaauuuucucgccaucagaauuggaaacuccaaacuuagcggaacguguauuagauugguuagaaaaguauggggucgagagacuaaagagaauggcuaucucgggagaugacugcguuguaaagccuauugaugaccguuucgcaacugcgcugacagcgcucaaugauauggguaaaguuagaaaagauauaccucagugggagcccagcaaaggauggaacgacuggcaacaaguaccauuuugcagccaucauuuucaucaauuaauaaugaaagacggaagagagauuguuguuccaugccgaaaccaagacgaacugguugggagagcacgcguaucucaaggcgcgggcuggucacuuagagaaacggcaugccucggaaaaucauacgcucaaauguggcaauuaauguauuuucaucggcgcgauuuaagauuagccgccaacgcaaucuguucugcaguaccuguggauuggauccccacaagcaggacuacauggucaauucaugcacaucaucaguggaugacaacagaagauaugcugucaguauggaacaggguauggauagaggaaaauccuuggauggaagauaaaacucacaucucgucuuggggagaugugcccuacuuaggcaaacgagaagaucaauggugcgguagccuaauuggucuaacugcuagggcaacuugggcuacaaauauacaaguagccauaaaucaaguaagacgauuaauuggaaacgagaauuaucuagacuacaugacaaguaugaagagauuuaagaaugaguccgaucccgaaggggcacugugguaa

SEQ ID NO: 22005 - RNA, 9879 nt, Artificial Sequence
  derived and/or modified CDS sequence (opt6) from DENV-1__JQ045661__SS-prME
uccguaacuauguugcugaugcucaugccaacagcuuuggcauuucaucuuacuaccagggguggagagccccauaugauagugagcaaacaagaaaggggaaaaagccuucucuuuaaaacgucagcugguguuaauauguguacccuuauagcaauggaucuaggagagcugugugaagacacaaugacauauaaaugcccccgcauuacagaaacugaaccagacgacguugauuguuggugcaaugccacggacacauggguaaccuauggaacaugcagccaaacgggggaacaucgaagggauaaaagauccguagcauuggcaccacacguaggguugggacuagagacaaggacggagacuuggaugucgucggaaggagccuggaaacaaauacaacgcguugaaacuugggcucuuagacacccuggguuuacugugauagcacuauuuuuagcacacgcaauagguacuucaauaacacaaaaaggaauaauauuuauucuacuaaugcuuguaacucccaguauggcaaugaggugcgugggcauaggaucacgcgacuuuguagaaggucugucuggagcgaccuggguugacguaguccuagaacacgguuccugcguaacgacgauggccaaagacaaaccgacacuagauauagagcuucuaaaaacggaaguaacaaaccccgcuguguugagaaaauuauguauugaggcuaaaaucuccaauacuacaacggauagucguugcccaacacaaggcgaggcgacauugguugaagaacaagaugcaaacuuugucugcaggcguaccuucgucgaucgagggugggguaacggaugcggacuauuugguaagggaucuuugauaacuugugcgaaauuuaaauguguaacaaaacuugaagggaagauaguucaauacgaaaauuuaaaauauagcgucauuguuaccgugcacacaggcgaucaacaccaaguaggcaaugaguccacugaacacggaacaacggcgacgaucacaccucaagcgccuacaacugaaauucaacuaacugauuauggcgccuugacacucgauuguucaccccguacgggucucgacuuuaaugaaaugguguugcuaaccaugaaagagaaaagcuggcuaguacacaaacaaugguuucuagauuuaccauuaccauggaccucaggcgcaagcaccucccaagaaacuuggaauaggcaagauuuacuggucacuuucaaaacagcucacgcaaagaaacaagaagugguaguacuuggaucucaagaaggagccaugcacacagcucucacaggugcaacggaaauucaaacaucagggacuacgacaauuuucgccggacaucuaaaaugucgcuuaaaaauggauaaacuaaccuuaaaaggcaugucuuacgugaugugcacaggaucuuuuaaacuugagaaagaauuagcugagacacagcacggaacgguccucguucagauaaaauacgaaggaacagacgccccaugcaaaaucccguucaguacccaagacgaaaaagguguaacucaaaauggucgucuuauaacagcgaacccaauaguaacugauaaagaaaagccuguaaauauagaagcagaaccgccuuucggagagucauauaucgucauuggggccggagaaaaagcccuuaaauugaguugguuuaagaaagggucauccaucgguaaaauguuugaagcaacugcccgaggugcuagacgcauggccauucuaggagauacugcaugggacuucgguucaaucggaggaguauuuacaagcgucgguaagcuagugcaccaaaucuucggaacagcuuauggcguucucuucaguggaguguccuggacgaugaaaauaggaauuggaguccuguuaacuuggcuaggauuaaacaguagaaguaccagcuuaaguaugacuuguaucgcagucggucuggugacacuauacuuaggagugaugguacaagcagauucagguugcgugauuaacuggaagggaagagaacuuaaauguggaucuggaaucuucgugacuaaugaaguacacacuuggaccgaacaguauaaguuccaagcagauucaccaaaaagguuauccgccgcgauaggcaaggcaugggaagaaggaguuugugguauuagauccgcuacgagacuggagaauaucauguggaagcagauaagcaacgaauuaaaucauauuuuauuggagaaugauaugaaguuuacagugguuguaggggacguagccgggauucuagcacaaggcaagaaaaugauucgaccacaaccaauggaacacaaguacucguggaaaaguugggguaaggcaaagaucauaggggccgacguucagaauacaacuuuuaucaucgauggaccuaacacuccagaauguccggaugaccaaagagcauggaauauaugggaaguugaggauuauggauuugguauuuuuaccacaaauaucugguuaaaauuaagagacagcuacacacaaguuugcgaccaucgccuaaugucagcagcuauuaaagauaguaaggcuguucacgccgacaugggguacuggauugagucagaaaagaacgagacauggaaauuagcacgagcuagcuuuauagagguuaagacuuguacauggccgaagagucacacauuguggucaaauggcguuuuagaaagugaaaugauaauuccgaagauuuacgguggcccgauaucccaacacaauuauagaccaggguacuucacccaaacagcagguccguggcauuuaggaaaguuagaacucgacuucgauuugugugaagguacaacuguagugguggacgaacacuguggaaauagaggaccgaguuuaagaacuacaacagucacuggcaagauuauccaugaaugguguuguagaucguguacacuaccaccacuaagauuuagaggggaggacggcuguugguauggaauggaaauucguccuguuaaagaaaaagaagaaaauuuaguuaagaguaugguaagcgcugggucuggcgaaguagauucguuuagccuaggucucuuauguauaucuauaaugauugaagaaguuaugagaucccgguggaguagaaaaaugcuaaugacagguacacuagcaguguucuuucuuuugauugugggacaacucacguggaaugaucuuaucagauuaugcauaaugaucggcgcuaaugcgagugaucguauggguaugggcacaacguaccuagcacuaauggcuacguucaaaaugaggccuauguuugccguagguuuacuauuucgacgacugacgaguagagagguccuauuacucacgauaggucuaucgcucguggccucaguagaguuaccuaacagccuugaagaacuuggagacggcuuagcaauggguauuaugauucucaaguuauuaacugauuuucagagucaucaacugugggcuaccuuguuaucauuaacauucauaaagacaacguucucuuuacacuacgcguggaagaccauggccaugguccuaagcguaguuucucuuuuuccccuauguuugucgaccacuagccagaagacgacuuggcuuccaguucuacuugggaguuuaggauguaaaccacuuacuauguuucuaauagcagaaaauaaaauuugggggagaaggaguuggccauuaaaugaagguauaauggccguagguauaguaagcauacuauuaucuucacuguuaaagaacgacguaccgcuugcaggaccacuaauagcugguggaaugcugauagcauguuacguaauaucuggaucauccgcagauuuaucccuugaaaaggcagcagagguaaguugggaagaagaggccgaacacaguggcgcaucucacaauauacugguagaaguacaagacgacgguaccaugaaaaucaaggacgaagaaagagaugauacuuuaacaauacuucuaaaagcaacacuacuggcaguaagcggcguauacccucuuuccauuccagcaacccuauucgucugguacuucuggcagaagaagaaacaacgguccggaguacugugggacaccccgaguccgccagagguggaaagagcgguucuagacgacggcauauaucguauuaugcaacgaggacuucucggacggucacagguugguguuggggucuuucaggaaaauguuuuccauaccauguggcauguaacgcgcggugcaguacuuauguaccaagggaaaagacucgaacccuccugggcaaguguuaaaaaggauuuaauaucauacggagguggguggagacuacaaggaucauggaauacgggagaagaaguucaaguaauugcuguggaaccagggaaaaacccaaagaacguacaaacagcaccagguacauuuaaaaccccagaaggcgaagugggcgcaauugcauuggacuucaaaccgggaacuagcgggagcccuauaguaaauagagaaggaaaaauaguuggacuauacggaaacggaguaguaaccacaucagguaccuauguaucugccauugcacaagcaaaggcuucacaagaaggaccgcuuccggaaauugaagacgagguuuuucggaaaagaaaccuaacaaucauggaccuacauccuggauccgguaaaacuaggcgguaccuuccagcuaucguucgagaagcaauaaagcgaaagcugagaacuuuaauccuggcuccaacucgggugguagcaagugagauggcagaggcgcuaaaaggaaugccaaucagguaucaaacaacugcugucaagagugaacacacggggaaagaaauuguagauuuaaugugucacgcaacauucacaaugcguuuauuaucaccaguacgagucccuaacuacaauaugauaaucauggacgaagcacacuucaccgacccuucuagcauagcagcaagagguuauauaagcacacgggucgguaugggugaagcggcagccauauucaugacugcgacacccccuggaagcguagaagcauuuccacagucaaacgcgguaauacaagacgaagaacgcgacaucccagagcguucuuggaacucuggauaugaauggauaacagacuuucccggcaaaacgguaugguuugucccaucuauaaagucagguaaugauauagcaaauugccuaaggaaaaauggaaagagaguaauacaacuaucaaggaagacauucgacacagaguaccagaaaacaaagaauaaugauugggacuauguaguaacaacggauauaucggagaugggggcaaauuuccgagcugauagagugauugauccuagacgauguuuaaaaccagucauuuugaaggaugguccugaaagaguuauucuggcaggcccaaugccggucacggucgcuucagcugcccaaagaagaggacgaauaggaagaaaccacaacaaggaaggagaucaguauauauacauggggcaaccacuuaauaaugacgaagaucaugcucacuggacagaagcuaaaauguuauuggacaacauuaacacaccugagggcauuauacccgcacuauuugaaccagaaagagagaaaagcgcugcaauugacggagaguauagacugcgcggagaggcaagaaaaacauuugucgaacuuaugagacgaggcgaccuaccgguaugguuaucauacaaggucgcuagugaaggguuccaguauucugaccgaagaugguguuuugauggagagagaaauaaucagguauuagaggaaaauauggauguagaaaucuggaccaaagaaggugagcguaagaaauuacgaccacgauggcuggacgcacguacauauagcgauccccuagcucuaagagaguucaaagaauuugccgcuggacggagaucuguaaguggcgaucucaucuuagaaauaggaaaauuaccucaacauuugacucaaagagcccaaaacgccuuagauaaucuuguuauguugcauaauucagagcaaggcggacgagcauauagacacgcgauggaagaacuucccgauacgaucgaaacucucaugcucuuagcucucauagcgguauuaacugguggugucacauuauucuuucugucuggacgaggguuagggaaaacaucuauaggauuauuguguguuauggccucuagcgucuuauuauggauggcaaguguggaaccacauuggaucgcugcaucaaucauuuuagaguucuuucucaugguauuacuaauaccugaaccugauaggcagagaaccccacaagauaaccaauuagcauaugucgugauuggccuacuuuuuaugauacuaaccgucgcugcaaaugagaugggauugcuugagacaaccaagaaagaucuugggauaggucauguagcuguagaaaaucaccaucaugcggccauguuagauguagacuugcacccagccucggcuuggacauuauaugcgguagcaaccacuauaauaacaccaaugaugcgacauaccauagaaaauacuacggccaauauuucguuaacagcuauagccaaccaggcugccauacucaugggcuuagacaaaggauggccgauaucaaaaauggacauugggguuccccuauuagcucuuggauguuauucucaagucaauccgcuuacucuuacagccgcaguuuuaauguuaguagcucacuacgcuauuauugguccaggccuucaagccaaagcaacaagagaggcacagaaaagaacggcugcaggcaucaugaaaaacccuacaguugacggaauuguugccauagauuuagacccaguuguguacgaugcuaaauuugaaaaacaacuuggacaaaucauguuacugauacuauguacaucacagauauuacuaaugcgaacuacaugggcauuaugugaaagcauaacuuuagcaacaggaccauuaacgacauuaugggaagguagcccaggaaaauuuuggaauacgaccauagcgguaucuauggcgaacauauucagagguucguauuuagcaggagccggccucgcauuuucacuuaugaaaucucuaggaggggguagaagagggacaggcgcucaaggagagacguuaggagaaaaauggaaaaggcagcuaaaucaacucuccaagucagaguuuaauacauauaaacguuccggaaucauggaaguagauagaucagaagcuaaagaaggucuaaaaaggggagagacgacgaaauacgcaguuucuagagguacggcuaaacuaagaugguucgucgaaaggaacuugguuaaaccugaagggaaggucauugaucucggguguggacgaggcggaugguccuacuacugugccgguuuaaagaaaguaacagaaguaaaaggauacacuaaaggagguccuggacacgaggaaccuauuccaauggcuacauacgguuggaaucuuguaaaauuacauucgggcaaagacguauucuuuauucccccagaaaaaugugauaccuuauugugugacauaggagagagcucgccaaauccgacuaucgaagagggccguacucuccguguauugaaaaugguggaaccuuggcuuagagguaaucaauucugcaucaaaauacuuaauccguauaugcccucuguaguagaaacccuagagcaaaugcaaaggaaacauggaggcauguuaguucggaauccuuugaguagaaauagcacccaugaaauguauugggugucauguggaacugguaauauaguuucugcuguaaacaugacuucaaggauguuacucaauagauucacgauggcacacagaaaacccacauaugaaagagauguggacuugggugcaggcacccgucauguugcugucgaaccugaagucgccaaucuagacauuaucgggcagagaauagagaauaucaaacaugaacauaaaaguacuuggcacuaugaugaagacaauccguacaaaacaugggcuuaccacggcagcuaugaaguaaaaccgaguggaucagccucgucuaugguaaacgguguuguaaaauugcucaccaaaccuugggaugucauaccaaugguuacucagauagcgaugacagacaccacaccauuuggacaacagcgcgucuucaaagaaaaaguagauacaagaacgcccaaagcgaaacgugguaccgcucaaauaauggaaguaacugcgaaaugguuguggggauuccuuucgagaaauaagaaaccccguauuuguacgcgagaggaauuuacacguaagguccgcucgaaugcugcuauaggggcaguauucgucgacgagaaucaauggaacucggccaaagaagcagucgaagaugaacgauuuugggacuuaguccaucgggaacgugaacugcacaaacaggggaaaugcgcaacaugugucuacaacaugauggguaagagagagaagaaacuaggcgaauuugguaaagcaaaggguagucgugcgauaugguauauguggcuuggugcacgauuucucgaauuugaggcucucggcuucaugaaugaagaucauugguucucaagggaaaauucgcuaagcggcguagagggagagggucuccauaaguuaggauauauacucagagauauaucaaaaauacccgguggaaauauguaugcagaugauaccgcgggaugggauacaagaauuacggaggaugauuuacagaacgaagcacggaucaccgacaucauggagccagaacacgcccuucucgcuaaaucuauauucaaacuaaccuaccaaaacaagguaguucgaguccagaggccugccaaaaacggaacaguaauggaugugaucucaagacgcgaucagcgcggaaguggacaagugggcacguacggacuaaauacauucacgaauauggaagcacaguugauuaggcaaauggaaagcgagggaaucuucaguccaucagaacuugaaacgccaaaccuugcagaaagaguauuagauuggcucgaaaaauauggaguugagagauugaaacgaauggcgauuucaggcgacgauuguguuguuaagcccauugaugacagauucgcaaccgcuuuaacagcccucaacgauauggggaaaguaagaaaagauauuccccaaugggaaccuucgaagggauggaaugauuggcagcaaguaccuuucuguagccaccauuuucaucaguugauaaugaaagaugggcgggaaauagugguaccaugccgaaaucaagacgaacucguagggcgugcaagagugucacaaggagcgggcuggaguuuaagagaaacugcaugcuuaggcaaaucguacgcucagauguggcaacuaauguauuuccauaggagggauuuaagguuagcagcaaaugcuauauguucagcagucccggucgacuggauacccaccucuaggacuacauggagcauccacgcucaucaucaauggaugacaacagaggauauguuaagcguauggaaucgaguauggauagaagaaaauccuuggauggaagauaaaacccauaucucaucauggggagacguaccauauuugggcaaaagagaagaccaauggugcggaucacucauagggcuuacagcuagagcaacaugggccaccaacauacaagucgcaauuaaucaaguccguagacuaauuggaaaugaaaacuaccuagacuauaugaccuccaugaaacgcuucaaaaaugaaagcgauccggaaggggcguuaugguaa

SEQ ID NO: 22006 - RNA, 9879 nt, Artificial Sequence
  derived and/or modified CDS sequence (opt6) from DENV-1__JQ045663__SS-prME
ucuguaacuaugcuauugauguuaaugccuacagcccuggcuuuucaucucacgacaagaggaggagagccacacaugauuguauccaaacaagagagaggaaaaucauuauuauucaaaacaucggcaggaguaaacaugugcacuuuaauugcgauggauuuaggagaauugugugaggacacuaugacuuauaaaugcccaagaauuacugaaacggaaccagacgauguagauuguuggugcaaugcaacugauacauggguaacauacggaacauguagucaaacaggggaacaccgucgugauaaaagaaguguagcucuagcgccgcauguuggacuuggacuugaaacaaggacggaaacauggaugucaucagagggagccuggaaacaaauccaacgugucgagacaugggcuuuaagacaucccggauucacagucauagccuuguuucuggcccaugcaaucggaacguccauuacccaaaaagguaucaucuuuaucuuguugauguuaguuacuccgucuauggccaugcgauguguaggaauaggcagccgcgauuuuguagaggggcuaucgggggcgacauggguggacgugguacucgaacacgggagcuguguaacaacuauggcaaaagauaaaccaacacuagauauugaacuccuuaaaacagagguaacaaacccugccgucuuaagaaaauuauguauagaagcgaaaauuaguaacaccacuacagacagucguuguccaacucaaggugaggcaacguuaguugaggaacaagacgcgaauuucgucugucgcagaacguucguggaucguggcugggggaaugggugcggauuguuuggcaaaggaagucuuaucacaugcgcaaaauuuaaaugcguaacaaaguuggagggaaaaauuguucaguaugagaaccugaaauauaguguuauugucaccguucauacgggugaucaacaccaaguagguaaugaaaguacagagcauggaacuacagcaacaauuacaccgcaagcaccgaccacugagauacaacugacagacuacggggcauuaacguuagacugcucaccccgcacuggucuagauuuuaacgagaugguucugcugacgaugaaagaaaaaucaugguuaguacauaaacaaugguuucucgaucugccacuuccguggacgaguggugcaaguacgucacaggaaaccuggaaucgacaagauuuacuuguuacguucaaaaccgcacacgcgaagaaacaggagguaguagucuugggaagccaggaaggagcgaugcauacagcucugacaggcgcgacugaaauucagacuucuggcacaaccacuauauuugcggggcacuugaaaugccggcuaaaaauggacaaacugaccuuaaagggaaugaguuaugucaugugcacuggaucuuuuaagcucgaaaaagaguuagcggaaacucaacacggaacaguccugguacaaauaaaauaugaaggaacggaugcaccuuguaaaauaccauuuucuacacaagacgaaaaagggguaacacaaaauggacgccuaauaacggcaaauccgauugucacugauaaagaaaaaccggucaauauagaagcugaacccccauuuggggaaucguauauugucauaggcgcuggggaaaaagcgcuuaaguuaucuugguuuaagaaagguuccucaauaggaaaaauguucgaggcuacggcucguggugcccguaggauggcgauucuuggggacacugcgugggacuuugggucaauaggugguguguuuacuagcgugggcaagcuaguccaccaaauuuuuggcacggcguacgggguauuguuuuccggcgugucauggacaaugaaaauugguauaggaguucuauugaccuggcuuggucuuaauagucgaagcacgucucugagcaugaccugcauugccgucggauuaguuacguuauaucucggaguaaugguacaggcggauagcggaugugugauaaacuggaaaggacgagaacuaaaauguggaagugguauauuugugaccaacgaaguucauacguggacagaacaguauaaguuccaagcggacagcccaaaaaggcugucagcugcaauaggaaaggcuugggaagaagggguuugcggaaucagaucagcaacacgauuagaaaacauaauguggaaacaaauuucaaaugaauuaaaucauauacuauuagaaaaugauaugaaauuaacuguuguaguuggagauguagcuggcaucuuagcucaaggcaagaaaaugauuaggccacaaccaauggaguauaaguauucauggaagucgugggguaaagcaaaaauaauaggcgcugacguccaaaacacaacguucauaaucgacggcccaaguacaccagaauguccugacgaucaaagagcuuggaauauuugggaagucgaagacuauggcuucgggaucuuuaccacaaacauauggcuuaaacuaagggacagccauacucaaguaugugaucaccggcucaugucagcggccauaaaggacaguaaagcgguucacgcagacaugggguauuggauagagagugaaaagaaugaaacguggaaauuagcuagggccucauuuauagaaguaaagacauguauuuggccaaaaucacauacuuuauggaguaaugggguacucgagagcgaaaugauuauaccaaaaauauacggagggccgauuagucaacacaauuauagaccugguuacuucacacaaacggcugggccauggcaucuaggaaaauuagagcuagauuuugauuugugugaaggaacuacuguugugguugacgaacauuguggaaacagagguccuagucuaagaacaacaacaguaacagguaaaauaauucacgaauggugcugccgaucauguacucucccaccacugagguuucgaggagaggauggauguugguaugguauggaaauucggccaguuaaagaaaaggaggagaacuuagugaaaucaaugguuagcgcagguaguggagaaguagacucauuuucucuuggauuacuauguauauccauuaugauagaagagguaaugaggucgagguggucucgaaaaaugcuuaugacaggaacacucgcggucuuuuucuuauuaauaaugggacaauugacauggaacgaucugauucguuuauguauaauggucggagcaaaugcuucagaccgaaugggaaugggaacgaccuauuuagcuuuaauggcuacuuuuaagaugcgacccauguucgcugugggccuuuuguucagaaggcucaccucacgugaaguccuacuauuaacuauaggacugaguuuagucgcaucagucgaacuucccaacagucuugaagaauuaggagauggauuagccaugggaauuaugaucuuaaaacuguuaacagacuuucaaucacaccaguugugggcaacucuguuaucauugaccuuuauaaaaacaacuuuuaguuuacacuaugcuuggaaaaccauggcgauggugcuaaguauaguuagucuguucccguuauguuuaucaacgacaucccagaaaacgacuuggcuaccaguccuucuugguucuuuaggauguaaaccuuuaacuauguuccuaauagcggaaaacaaaauuuggggacgacgaucauggccacucaaugaagguaucauggccgugggaaucguaucaaucuuguugucaucguuacucaaaaacgauguaccuuuggcgggaccauuaauagccggaggcaugcucauagcauguuauguaauaaguggaaguagugcugaccugucgcuggaaaaagccgcugaaguaagcugggaggaagaagcagaacacaguggggcaucccauaauauauugguagagguacaagaugacggaaccaugaagaucaaagaugaagaacgcgacgauacucuaacgauauuacuuaaagcgacuuuauuggcuguaagugguguuuauccccuaaguaucccugcgacccuauucguaugguacuucuggcaaaagaaaaagcagaggucaggaguuuugugggacacgccgucaccaccggaaguugaacgugcuguguuggaugauggaauauauagaauaaugcaacgugguuuauuaggaagaucgcaaguaggugucgggguauuucaagagaauguguuucacacuauguggcauguaacuaggggagcgguuuuaauguaucaaggaaagcgauuagaaccuagcugggcuucagucaagaaagaucucauaucuuauggaggaggcuggcggcuucagggcucauggaauacgggagaagaaguacaaguaauugcaguugagcccgguaaaaacagcaaaaauguucagacugcaccuggcacauuuaaaacaccagaaggugaaguuggugcuauagcucuagacuucaaacccgggacaaguggaaguccgauagucaacagggaaggcaaaauugugggacuuuacggcaauggggugguaacaacaucagggacguauguaucggcaauugcucaagcgaaggcaucucaggaagggccucugccagagauagaggaugaaguauuuaggaaaagaaauuuaacgauaauggauuuacaccccggcucuggcaaaacgcgaagauaccucccagcgauugucagagaagcuauuaaaagaaaauuacgaacgcuaaucuuggcaccaacgagagugguagcaagugaaauggcggaggcguuaaagggaaugccaauacgcuaucaaacgacagcaguaaaaagugaacacacaggaaaagaaaucguagauuuaaugugccaugcgacauuuacgaugagauuacuaucuccaguaaggguuccgaacuauaauaugaucauaauggaugaagcacacuuuacagauccuucaucaauagcugcgagaggcuauauaucuacucgaguugguaugggcgaggcagcggcuaucuuuaugacagcuaccccaccagguaguguggaagcauuuccucaaucaaaugcuguuauucaagaugaagaaagggauauacccgagaggucauggaacuccggguaugaauggauaacagauuuuccaggaaaaacggugugguuuguaccaagcauuaagucugggaaugauauagccaacugccuccgcaaaaauggcaaaagaguuauccaacucucuagaaaaacauuugacacugaguaccagaaaaccaagaauaaugauugggacuacguuguaacaacggacauaucugaaaugggagcaaauuucagagcagauagagucaucgacccucguagaugucuaaagccaguuauauuaaaagauggaccagagagaguuauacuugcaggcccaaugcccguaacuguggccagugccgcacaacguaggggucgaauaggacgcaaucauaauaaggagggagaucaguauaucuauaugggucagccauuaaacaaugacgaggaucaugcucacuggacggaggcaaaaauguuauuagauaauauaaacaccccagaaggcauuauaccagcacuguucgaaccagaaagagaaaaaucugcagcgaucgacggagaguaucguuuacgcggagaagcaagaaaaacauucguagaguuaaugaggcgcggagaccuaccaguuuggcugagcuauaaaguagcaucugaaggauuccaauauuccgaccguaggugguguuuugacggagagagaaauaaccaaguacuagaagaaaacauggauguugaaauuuggacgaaagaaggagaaaggaagaaacuuaggccaagguggcucgacgcacggacauacagcgacccacuugcauuacgcgaauuuaaagaguucgcggcuggccgaaggucgguaucaggagaucucauuuuagagauuggaaaauugccucagcacuugacacaacgagcucaaaaugcuuuagauaacuuggucauguuacacaauagcgaacaaggcgguagagcuuauagacaugcuauggaagaguuacccgauacaauagaaacccuaauguuauuagcuuuaauugcgguacuaacaggcgguguuacauuauuucuauugagcgguagaggauuagguaaaacgagcauaggguuguuaugugucauggccucaucagucuuacuuuggauggccaguguagaaccacacuggauagcugccucuauaauauuggaguucuuuuuaauggugcuuuuaauucccgaacccgauagacaacgaaccccacaagacaaucagcuugcguacguaguaauuggucuauuauucaugauauuaacagucgcagcaaacgaaaugggacuauuagaaacaaccaagaaagaucuagggauagggcauguagcaguagaaaaucaucaucacgccgcaaugcuagaugucgaucuucacccggcaagcgcuuggaccuuauaugcaguagcaacgaccauuaucacgccuaugaugcgucauacgauugaaaacaccaccgcgaauauuucacuaacagcuauugcaaaucaagcugcuauacuaauggguuuagauaaaggcuggccgauaucaaaaauggacauuggcgucccguugcuugcauuaggcuguuauagucaaguuaacccauuaacucucacggcagcaguguugaugcucguggcucacuaugccauaaucgggccuggccugcaagcaaaagcgacacgagaagcacaaaaacgaacugcugcugguaucaugaagaacccaacagucgacggaauaguagcaauugaccuugauccgguaguuuaugacgcuaaauucgaaaaacaauugggacagauaaugcuucugauauuauguacaagccagauauuauugaugagaacuacaugggcauuaugugaauccaucacucuggcaaccgguccacuaacuacccucugggaagggucucccgguaaauuuuggaacacuacgaucgcaguaucaauggcgaacaucuuuagagguucauacuuggccggugcaggacuagccuucucucuaaugaaaucacuaggcggagggcgacgcggaacaggagcucaaggagaaacauugggugagaaauggaaacgacaacucaaccaacucucuaaaucagaguuuaacacauauaaacggucuggcaucauggaaguugaucggucugaggcaaaagaaggacucaagagaggugaaacuacaaaacacgccguaaguagagguacggcaaaacuacgcugguucguagaacguaaucuuguuaagcccgaaggaaagguaauagaucugggcuguggaaggggaggauggucguauuauugugcaggccuuaagaaagugaccgaagucaaagguuauacuaaaggugggccgggacaugaggaaccuauccccauggcuaccuacgguuggaauuuagucaaauuacacucuggaaaagauguauucuucauuccgccagaaaaaugcgacacacuguugugugauauaggcgaaucaucaccaaauccaacuauagaggaggguagaacacuucgaguacucaaaauggucgaaccaugguuaagagguaaccaauuuugcauaaaaauauugaauccuuacaugccaagugugguugaaaccuuggagcaaaugcagaggaaacacggagggaugcuugucagaaauccauuaucaaggaauagcacccacgaaauguacuggguuucaugcggaacaggaaauauugugagugcuguuaauaugacaucaagaauguuauuaaauagguuuacgauggcgcaucguaagccuacguaugaacgcgauguagaucuaggagcugguacgagacauguagcaguugaaccagaaguagcaaauuuagauauuauaggacagagaauagaaaacauuaaacacgaacacaaaucaacauggcacuaugacgaggacaauccuuacaagaccugggcauaccaugguagcuacgaaguaaagccuucagggucagcgucuagcaugguaaacgggguggugaaauuauuaacgaagccuugggacgugauuccaaugguuacucaaauagcaaugaccgacacuacacccuucggucaacaaagaguuuuuaaagaaaaaguggauacgcggacacccaaggcuaaacguggaacagcccaaauuauggaggucaccgcuaaauggcuauggggauuccuuagcagaaauaaaaagcccagaauauguacaagggaagaauuuaccaggaagguaagaucaaacgcagcuauaggggcgguuuuuguagacgaaaaccaguggaauagcgcaaaggaagcuguugaagaugagcguuucugggaucuuguucaccgcgaacgugaauugcauaagcagggaaaaugcgcgaccugugucuauaauaugaugggaaaaagggagaagaaauuaggggaauuugggaaagcaaaagggucaagggcuauaugguacauguggcuaggugcuagauuucuagaguucgaagcauugggcuuuaugaaugaagaucauugguucagucgugaaaauucauugagcggugucgaaggagaaggacuacacaagcuagguuauauacuucgggauauaucuaaaauaccaggugggaacauguaugcagaugacacugcugggugggacacaagaauuacugaagacgaucuccaaaaugaagcacguauaacggacauaauggagccagaacacgcgcuguuagccaaaaguauuuucaagcuaaccuaccaaaacaaggucguccgugugcaaagaccggcgaagaauggaacgguaauggauguuauaaguagaagagaccagagagggucagggcaaguaggaacauauggacugaauacguucacaaauauggaagcucaguugauacgucaaauggagagcgaagguauauuuucaccaucagaacuggagacaccgaauuuagcggaaagaguguuagauugguuagagaaauauggggucgaacguuuaaaacgaauggcaauaucuggugaugauugugugguuaaaccuauagaugaucgguuugcaacugcacuuaccgccuuaaaugauauggguaagguaagaaaggauaucccacaaugggaaccaaguaaagguuggaacgacuggcaacagguaccauucuguucucaucauuuccaucaauuaauaaugaaagacggaagagaaauuguaguaccgugcagaaaucaagaugaacuuguagguagggcaaggguaagccaaggugcgggauggucacuacgugaaacggcaugcuugggaaaaaguuaugcucaaauguggcaauuaauguacuuucauagacgcgaccuaagacuagcugcuaacgcaauauguucagcagugccaguggauuggauuccaacaagccgaacgaccuggaguauacaugcacaccaucaauggaugaccacagaagauaugcugucaguauggaacaggguuuggauagaagaaaaucccuggauggaggacaaaacgcauauuagcucuuggggagauguaccauaccuagggaaaagagaggaccaaugguguggcucccucauaggcuuaaccgcccgagcaaccugggcaacgaacauccaaguggcuauuaaucaggugcggagauuaaucgggaacgaaaacuacuuggauuacaugaccaguaugaaaagauuuaaaaacgagagcgacccagaaggagcgcugugguag

SEQ ID NO: 22007 - RNA, 9879 nt, Artificial Sequence
  derived and/or modified CDS sequence (opt6) from DENV-1__JQ045665__SS-prME
ucagugacuaugcucuugaugcuaaugccaacggcucucgccuuucaccuaacagcccggggaggagaaccacacaugauaguaucgaaacaagaaagaggaaaaucccucuuauucaaaacaagugcaggaguuaacaugugcacgcuuauagcaauggauuuaggggaacucugugaagacaccaugaccuacaaauguccaagaauuacagagacagaacccgaugacgucgauuguuggugcaacgcgaccgauacauggguaacuuacgguaccuguucacaaacgggagaacaccgaagggacaaaagaucaguagcuuuagccccacaugucggccuggggcucgaaacacgaacagaaacauggaugucaucagaaggagcauggaaacaaauacaaagaguugaaaccugggcuuuacgccauccuggcuucacagugauagcacuauuccucgcgcaugcuauaggaacaagcaucacacaaaaagguauaauauuuauacuccugauguuaguaaccccgucuauggccaugcggugugugggaaucggauccagggacuucguagagggccucuccggcgccacuuggguagacguuguacuagagcacgguuccuguguaacaacaauggccaaagauaaaccaacauuagacauagaacuuuugaaaacagaaguuacgaacccugcaguacuaagaaaauuguguauugaagcaaagaucucaaauacuacgacagauagccgcugcccgacccaaggagaagcuacauuaguugaagaacaagaugcaaauuucgugugccgucgaacauuuguagaccguggauggggaaacggauguggauuguucgguaaggguagcuuaauuacgugugcgaaauuuaaaugcgucacaaaacuagaaggaaaaauuguucaauaugaaaauuuaaaguacaguguaauaguuacgguacauacaggcgaucagcaucaagucgguaacgagaguacagaacaugggacuaccgcaacaauaacgccacaggcuccuacgacggagauucaacuuacugacuauggagcccuuacauuagauuguuccccgagaacaggacuugacuucaaugagaugguauuacugaccaugaaggagaaaucauggcuaguacacaagcaaugguuuuuggauuuaccauuacccuggacuucaggcgcaucuacgagccaagaaacuuggaaucgacaagacuugcucgucaccuuuaaaacggcucaugcaaagaaacaggaaguggucguauuaggcucacaagaaggggcaaugcauacagccuugacaggugccacugaaauacaaaccuccggaacuacaacuauauucgcaggccaucuaaaaugcagguuaaagauggacaaauuaacguuaaaggggaugucauauguaaugugcacugguagcuuuaaauuagaaaaggaacuugcagaaacacaacaugguacaguauuaguacaaauuaaauaugaagggacggacgcuccguguaagauaccauucaguacacaggacgagaaaggagcgacgcagaauggaagacugauaaccgcgaauccuaucguaacugacaaagaaaaaccuguaaacauagaagcagaaccuccuuuuggugagucauacauuguuauuggagcaggggaaaaagcucugaaacuuucgugguucaagaaagguaguuccauugguaagauguucgaggcgacggcuaggggcgcaaggcguauggcaauacugggugacacagcgugggauuuuggaucaauaggugggguauuuacuucuguaggaaaacuuguacaccaaauuuuuggaacagcuuaugggguccuauuuucuggaguaucuuggacaaugaagaucggaauaggaguuuuauugacaugguuaggccuaaacagucgaagcacaucguuaaguaugaccuguauugcgguuggacugguuacgcuauauuuagguguaaugguacaagcagacagcgguuguguaauuaauuggaaagguagagaacuaaaaugugguagugguaucuucguaacaaaugaagugcacaccuggacugagcaauacaaguuccaagcugauagcccuaaaagacuaucugcggcuauuggaaaggccugggaagagggcguuugcggcauccgaagugcaacccgauuagaaaacauaauguggaagcagaucucuaaugaacuuaaccacauuuuauuagagaacgauaugaaauucacggucguuguuggagaugucgcaggcauacuagcacagggcaagaaaaugauacgcccacaaccaauggaauacaaguauaguuggaaaucauggggaaaagcuaagauaauaggcgcagauguucaaaacacaacauucauuauagauggcccuaauacuccagaguguccggaugaucaaagagcauggaacaucugggaaguugaagacuacgguuuuggaauuuucacaacuaacauuugguugaaauuaagagauagcuauacccaggugugugaccaucgguuaaugucugcagcaauuaaagauucuaaggcaguccaugcugacaugggcuauuggauagagagugagaaaaacgaaaccuggaaauuagcaagggcgucauuuauagaagucaaaacaugcaucuggccaaagucgcauaccuuguggaguaaugggguauuggaaagugagaugauaauuccaaaaauauaugguggaccuauuucgcaacauaacuauaggcccggauacuuuacacagacggcuggaccauggcaccuuggcaaacuagaacucgauuucgauuuaugugaaggaacaacagugguaguuaacgagcauugcgguaaucgaggaccaaguuugcgcacaacuacuguaacggguaaaauaauacaugaauggugcuguaggaguuguacuuuaccaccuuuaagguuccgaggagaagauggguguugguaugguauggaaauaagaccaguaaaagaaaaggaagaaaaccucguaaaaaguaugguaucggcuggaagcggcgaaguagauaguuuuucguuaggacuauuaugcauaaguauuaugauagaagagguaaugcggucaagacuuucgcguaagaugcugaugacuggcacuuuagccguauucuuccugcucauaaugggacaauuaacuuggaaugaucucauccgucucuguaucaugguaggugcaaaugcaucagauaggauggguauggguacgacuuaucuggcuuugauggccacauuuaagaugcgaccaauguuugcgguaggacuauuauuucgccgucuuacaucucgugaggugcuauuguuaacuauagguuuauccuuaguagcaaguguugagcucccaaauucguuagaagaacugggggauggacuagcuaugggaauaaugauauuaaaacuucugacagacuuucagucccaucaacuaugggcaacucuccuuaguuuaacauucauuaagacuacauuuucacuccaccaugcuuggaagacaauggcaaugauccucaguauuguaaguuuauuuccauugugcuuaucuaccacuucacagaaaacuacauggcuaccaguuuuauuagggagcuuaggauguaaaccucugacgauguuuuugaucgcagaaaauaaaauaugggggagacggucauggccucucaacgagggaaucauggcgguaggcauaguaagcauucugcuuuccagucuucuuaaaaacgacguuccauuagccggaccuuuaauugcgggagggaugcugauagcguguuauguaauuucaggaaguucagcugauuugucacuagaaaaagcugcggaaguuucaugggaggaagaagcggaacauuccggagcaucucauaacauacucguggaaguacaagacgacggaacaaugaagauuaaagaugaagaacgugaugauacauuaacaauuuuacuaaaagcuacacuuuuagccgucagcgggguauacccucuaucuauuccugccacacuguuuguuugguacuuuuggcaaaagaagaaacagcggaguggaguacuuugggacacaccuaguccaccugaaguagaaagagcaguacuagaugauggcauauaucguauaaugcaaaggggucuguuaggucgaagucaaguaggaguaggaguuuuucaagaaaauguuuuucauacuauguggcacguaacucggggugcaguauuaauguaccaagguaagagacuagaaccgucgugggcuucggucaagaaagaccuaauauccuacggugguggauggcgauugcaggguucauggaacacaggcgaagagguucagguaauugccgucgagccagguaaaaacccuaagaacguucaaacagcaccaggcacguuuaaaaccccugaaggggaaguaggggccauugcgcuagauuuuaaaccugggacaucuggcucuccuauaguaaaccgcgaaggcaagauuguaggacuauacgguaauggugucgucacuacaagcggaacuuauguauccgccauagcccaagcaaaggcgucgcaggaagguccacuacccgaaauagaggacgaaguguuucggaaacguaacuuaacgauaauggacuugcacccaggcuccggaaaaacaagacgauaucuuccagccauugucagagaagccauaaaaagaaaauugcgaacauugauacucgcuccgacacgugucgucgccagcgagauggccgaagcucucaaaggaaugccuauaagguaucaaacuacagcugugaaaucggaacauacgggaaaagaaauuguagacuuaaugugucacgcaacauucacgaugagacuuuuaucaccaguacgaguacccaauuauaauaugauaauaauggaugaggcacauuuuacggacccuuccucgauagcggcaagaggauacauauccacaagaguuggaaugggggaagcggccgcaaucuuuaugacagcuacuccaccuggcucuguagaagcauucccucaaaguaaugcaguuauucaggacgaggaaagagauauaccagagcguucauggaacucuggauaugaauggauuacagauuuucccgguaaaacuguaugguuugucccaucuaucaaauccgggaaugacauugcaaauugccugcgaaagaacggaaaaagaguaauucaacugucccguaaaacguucgauacugaauaucagaaaacuaaaaauaaugacugggacuauguugucacaacggauaucucagaaaugggagcuaauuuuagagcugaccgaguuauagacccacgucggugucugaagccgguaauacuuaaagacgguccagaaagggucauuuuggcgggaccgaugccuguaaccguagcaagugcagcacagagacgaggccgaauuggacgaaaccauaacaaagaaggugaccaauacauuuauaugggccagccccuaaauaacgaugaagaucaugcacauuggacagaggcaaaaauguuacucgauaauauaaauacaccugaaggaauaauaccggcgcuuuucgaacccgaaagagaaaagagugcagcaauagauggggaauauagacugagaggggaagcuagaaagucauuuguagaauugaugagaaggggcgacuugccuguaugguugagcuauaagguagcuagugaagguuuccaguauucugaccgaagauggugcuuugauggagaacgaaauaaccaagugcuugaagagaauauggacguggaaauauggaccaaagaaggggaaagaaagaaacuuagaccucgauggcuugaugcgagaacauauucagacccuuuagcauugagagaauuuaaagaguucgcugcagggcgacggucaguaaguggcgaccuaauauuggaaauuggaaaacuuccacaacaucugacacagcgugcccaaaacgcacucgauaacuuaguaauguugcacaacucagagcaaggaggcagagcuuauagacaugccauggaggagcuacccgauacaauugagacccuaauguuacuagcacuaauugcaguacuaaccggaggaguaacucuguuuuucuugucugggaggggacuagggaagacuagcauuggacuccuuugugucauggccucaucaguacuccuauggauggccagcguagagccacacuggauagcggcaagcauuauucuagaguucuuuuuaaugguacuauuaauuccggaaccggauagacagaggacaccucaagauaaccaauuggccuacgugguuauagggcucuuauucaugauauuaacgguugcagcaaaugaaaugggacuucuagaaacaaccaagaaagaccuaggaauuggucacguagcgguugaaaaucaccaucaugccgcuauguuagaugucgauuuacaccccgccuccgccuggacacuauacgccguagcaacuaccauaauuacuccaaugaugcgucauacaauagagaacaccacagccaauaucucauuaacggccaucgcuaaucaagcugcuauacuaaugggacuagauaagggauggccuaucucaaaaauggacauagguguaccguuguuagcacuaggcugcuacucgcaaguuaauccguugacucuuacagccgcuguccucauguuaguggcucauuaugcuauuaucggaccuggucugcaagcuaaagcaacaagagaagcccaaaagagaacugcugcaggaauuaugaaaaacccuacaguagauggcauaguagcaauagauuuagauccaguuguauaugacgccaaguuugaaaaacaauuaggacaaauuaugcuauuaauccuauguacuucucagauacuguugaugcgaacuacgugggcuuuaugugaauccaucacacuugcaacaggaccguuaaccacguuaugggaagguucaccgggcaaguuuuggaacacaacaauugcaguuucaauggcgaauauuuucagaggcucuuaucuagccggagccggauuggcuuucucgcuuaugaaaucacuaggcggaggacgaagaggcacaggugcccaaggagagacacuaggcgagaaguggaaacgacagcuaaaccagcuaagcaaaagugaauuuaacacauauaaacgaaguggaauaauggaaguagaccggucagaagcaaaagaagggcuuaaacgcggagaaacuacaaagcaugcggugagccgugguacugcgaaacugcguugguuugucgaaagaaauuuaguaaaaccugaaggaaaaguaauagaccuagggugcggacguggaggguggucuuacuacugugcagguuuaaagaaaguaacugaaguaaaaggcuacacuaaaggcggaccuggacacgaagaaccuauaccuauggcgacuuaugguuggaauuugguaaaauuacacucagguaaggauguauucuuuauuccuccagaaaaaugcgauacauuacuuugcgacauaggugaaucgaguccuaacccuacaauagaagaaggacgaacacuaagaguacuaaaaaugguugaaccauggcuaagaggcaaucaauucuguauuaaaauucugaaucccuauaugccaucgguuguagaaacacuagaacagaugcaaagaaggcauggagggaugcuagugcgaaauccgcugagcagaaauucgacccacgaaauguauuggguuucuugcgguacugguaauauaguaucagcagugaauaugacaagcagaaugcuuuuaaacagguucacaauggcacaccguaaaccaacguaugaaagagacguugacuuaggugcagguacaagacacguagccgucgaaccagaaguagcuaauuuagauaucaucgggcaaagaaucgaaaacauaaaacacgagcacaaaaguacauggcauuacgacgaagauaauccauacaaaacuugggcauaucaugguuccuaugaagugaaaccaucaggaucugcaucuucaaugguuaauggaguagugaaacuauugacaaaacccugggacgucaucccuaugguuacacagauagcuaugacggacacgacaccguucgggcaacaaagaguguucaaagaaaaaguugauacaagaacgccuaaggcuaaaaggggaacagcacagaucauggaaguuaccgcuaaaugguuguggggauuuuuauccagaaauaaaaagccacgcauuugcacuagagaagaauuuacaagaaaggucagaucuaaugcagcgauaggcgcuguuuuugucgacgaaaaccaauggaacagcgcaaaagaagccgucgaggacgaaagguuuugggacuugguucaccgugagcgugaacuacacaaacaaggcaaaugcgcaacguguguuuacaacaugaugggaaaaagagagaagaaauuaggugaguucgguaaagccaaaggcucaagagccaucugguauaugugguuaggcgcccgcuuccuugaguucgaagccuuaggauuuaugaaugaagaucacugguuuucaagagaaaacagucuuagugguguagaaggggaaggucuucacaaacuaggauacauuuuaagggauauuaguaagauaccaggaggaaauauguaugcggaugauaccgcaggaugggauacgagaauuacugaagaugauuugcaaaacgaggcgcgcaucacagacauaauggagccagaacacgcguugcuugcaaaauccauuuucaagcuaacauaucaaaacaaagucgugagaguccagagaccugccaaaaacgggacagucauggauguaauaucuaggcgcgaucaaagaggcucaggacagguagggacauauggucucaauaccuuuacaaacauggaagcucaauuaauacgacagauggaaucagaaggaauuuucucuccgucagaacuggaaacuccuaacuuagcagaaagaguacuagauuggcuugagaaguauggggucgagaggcuuaaaagaauggcaauaucuggagacgauugugucgugaagccaaucgaugauagguuugcaaccgcccuaacugcacuuaaugacauggggaaaguaagaaaagacauuccucaaugggaaccuucaaaaggauggaacgacuggcaacagguuccauuuuguagucaucauuuccaccaauuaauuaugaaagacggacgugaaauagucgugccuugucgaaaccaagacgaauuggugggacgagcccgcguuucacaaggagcuggguggucuuuacgagaaacggcaugucuagguaagucauaugcccaaauguggcaacuaauguauuuucauagaagagauuuaagauuggcagcuaacgcaauauguucagcugugccaguagauuggauaccaacaacguguacaacuuggucaauacacgcacaucaucaauggaugacuacugaagacauguuaucgguguggaauagaguauggauagaagaaaauccuuggauggaggacaaaacucauaucagcuccuggggcgacguaccuuacuuagguaagcgugaagaucaauggugugggucacuaauaggguuaacugcaagagcaacgugggcuaccaauauacagguugcuaucaaucaaguaaggcgguuaaucggcaacgagaauuauuuggauuauaugacaucaaugaagagauuuaagaacgagagugauccugaaggagccuuaugguaa

SEQ ID NO: 22008 - RNA, 9879 nt, Artificial Sequence
  derived and/or modified CDS sequence (opt6) from DENV-1__JQ045666__SS-prME
agcgugacuaugcuuuugaugcuaaugccaacggcucuagcauuccacuugacugcacgcgguggugaaccgcauaugauuguaucgaaacaagaaagagggaaaaguuuauuauuuaaaacaucugcgggaguaaauaugugcacauuaauagcgauggaucuaggagaacuaugugaagacacaaugacuuacaaauguccacgaaucacugaaaccgaaccugaugauguugauuguuggugcaaugcaacagacacguggguaaccuacgggacauguucucaaacgggugaacauagaagagauaaacgcaguguugcccuagcaccucauguugguuuggggcuagaaacaagaacagaaacauggaugucuuccgaaggugcguggaaacaaauacaaaggguagaaacaugggcuuugaggcauccaggauuuacaguaauugcauuauuccuagcccaugcaauuggcaccucuauuacacaaaaaggaauuauauucauacuauugauguuggucacuccgucuauggccaugagaugcgugggaauaggaaguagggauuuuguagaaggacugaguggggcgacauggguagaugucguacuagaacaugguucauguguaacaaccauggcaaaagacaaaccuacauuagacauagaacuguuaaaaacagaaguuaccaauccagcaguuuuaagaaaacuauguauagaagcuaaaaucagcaauaccacuacagacucacguuguccaacacaaggagaagcaacauuagucgaagaacaagaugcuaacuucguauguagaagaacauuuguggauagaggaugggguaacgguuguggauuauuuggcaaagguucacucauaacaugcgcaaaauuuaaauguguaacaaaacuggaaggaaaaauaguucaauaugaaaaucugaaauauucugucaucguaacgguacauacaggcgaucaacaucaaguagggaaugaaucuacggaacaugggacuaccgcuacuauuaccccgcaagcgccaacaacagaaauacaauuaacggauuacggagcuuuaaccuuagauuguucaccaagaacaggauuagauuuuaacgaaaugguacuacugaccaugaaagagaaaaguuggcuagugcacaaacaaugguuuuuggacuuaccgcuaccauggacuucgggugccucgaccagccaggaaacguggaaucgacaagaccuucuugugacuuucaaaacugcccacgcaaagaaacaggaaguaguuguacuaggaucacaagaaggagcuaugcacacugcauuaacgggugcuacugaaauacagacaucagguacaaccaccauauuugcggggcaccuuaaaugcagauuaaaaauggauaaacucacauugaaggggaugucguaugugaugugcacagggagcuuuaaacuagaaaaagaguuagccgaaacccaacacggaacaguucuaguacagauaaaauacgaaggaacugacgcacccugcaagauccccuuuagcacacaagaugaaaaaggagcaacacagaacggacgguugauaacugcgaaucccauaguuacagauaaagaaaagccaguaaauauugaagcugaaccacccuuuggggagaguuauauuguuauaggagcaggagagaaagcauugaaauugucaugguucaagaaaggaucuucuaucgguaaaauguuugaagcuacagcuagaggagcgagaagaauggcgauacugggagacacagcaugggacuuuggaucuaucggcggugucuucacaucagucggaaaguuaguccaccaaauauuugguacugcauauggcgucuuauuuucgggugucaguuggacaaugaaaauagggauaggaguuuuauuaaccugguugggauuaaacagcaggucaacgucacuuaguaugacaugcauagcagugggacugguaacacuuuauuuagguguaaugguacaagcagauagugggugcguuauaaacuggaaagguagggagcuaaaaugcggcucaggaauauuuguaacaaaugaaguacauacguggacugaacaauauaaguuucaagccgauucuccaaaaaggcuaucggccgcaaucggaaaggcaugggaggaagguguaugcgggauuaggagugcaacccgccuggagaacauaauguggaagcaaauaagcaacgaacucaaccacauccuauuggaaaaugacaugaaauucacuguagugguuggggauguagcaggaauacuugcacaaggcaagaaaaugauccgcccccaaccaauggaauacaaguacucauggaagucguggggaaaagccaaaauaauaggagccgacguccaaaauaccacuuuuauaauagacggaccaaacacgccagagugucccgaugaucaacgagcauggaauauaugggaaguggaagauuauggcuuuggaaucuuuacuacaaacaucugguuaaaacugagggauucauauacccaaguaugugaucaccgguuaaugucagcugcaaucaaagauagcaaagccgugcaugcugauauggguuauuggauugaguccgagaaaaaugaaacuuggaaauuggcacgagcaucauucauagaaguaaagacauguauuuggccaaaaucgcauacauuauggucuaauggaguccuggagucagaaaugauaauuccaaaaauauauggagggccaauaucacaacauaacuaccgaccuggguacuuuacacaaacggccggaccuuggcaccuaggaaaauuagaauuagauuucgaccugugcgaagggacuacuguaguagugaacgaacauugcggcaacagggggccuucgcuaaggacgaccaccguaacaggcaaaauaauacacgagugguguugucgcagcugcacccuucccccacuuagauuuagaggugaagacggaugcugguauggaauggagaucagaccagugaaggagaaggaggaaaaccuuguaaaaucaaugguaucagccgguucuggggaaguagacagcuuuaguuuaggcuuauuguguaucuccauuaugaucgaagaagugaugagaagucguuuaagcagaaaaauguuaaugacuggaaccuuagcagucuucuuucuucuaaucaugggccaacugacuuggaaugaccucauaaggcugugcaucauggucggagcuaacgcaagcgauagaauggguaugggaacuacguacuuggccuugauggcaaccuucaagaugcguccuauguuugcagucggacuauuauuuagacgguugacuuccagagagguucuguugcuuacgauuggacuuucucuuguugccaguguugagcuuccuaauagcuuagaagaauuaggugacggguuggcgauggggauaaugauacuaaaauuauuaacugacuuccaaucacaucaacuaugggcuacucuauuaagucuaacauucauaaaaaccacauuuuccuuacaucaugccuggaagacaauggcaaugauacuauccauuguauccuuauucccauuaugucucucuaccacaucccaaaagaccacauggcuaccugugcuauuagguaguuuaggauguaaaccauugacgauguuuuuaauugcagaaaacaaaauuuggggccguaggucauggccuuuaaaugaagggauaauggcuguggguauuguaagcauauuauugaguagcuugcuaaagaaugacguaccguuagcugguccacuaauugcggguggaaugcucauagcauguuacguaauaagcgguagcuccgcugauuuaucacuagaaaaagcugcugaagucucaugggaagaggaggcugaacauaguggagcaagucacaacauccuaguagaaguccaggacgauggcaccaugaaaauaaaagacgaagaaagggaugauacccuaaccauucuacuuaaagccaccuuauuagcaguuagcgguguauauccauuaagcauaccggccacuuuauuugucugguacuuuuggcagaaaaagaaacagaggucgggaguauuaugggauacucccucuccgccggaaguugaacgcgccguccuugaugauggaauuuaucgcauuaugcaacgcggucuauuaggaaggagucaaguaggugucgguguuuuucaagagaauguuuuccacaccauguggcacguaacaagaggagccguauuaauguaucagggaaaaagacuggagccaucuugggcaucaguaaagaaagaccugaucagcuacgggggagguuggcggcuacagggaagcuggaacacgggugaggagguucagguaauugcaguggaaccugguaaaaacccaaagaauguacagacugcuccaggaacauucaagacgccagaaggugaaguuggugcuauagcucuagacuuuaaaccugggacaucagguagucccauaguaaauagggaggguaaaauaguugggcuguauggaaacggugugguuacaacuucaggcacuuacguuucugcaauugcacaggcaaaggcuucacaagaagggccgcuacccgaaauagaagaugaaguuuuccgaaagcggaacuuaacaauuauggaccuacauccggguucggggaagacgaggagguauuugccagcuauuguuagggaagcaauaaaaaggaaauuaaggacgcuuaucuuagcucccacuagagucguugcaucugagauggcagaagcacuuaagggcaugccgauuagguaccaaaccaccgcugugaaaucagaacauacaggaaaagaaauaguugaccucaugugucaugcaacauucacgaugaggcuauuaaguccagugaggguaccaaauuacaacaugauaauuauggacgaggcacauuuuacggacccaaguucgauagcggcuagagguuacauaagcacucgggucggaaugggggaagcugccgcuauauucaugaccgcuacuccuccaggaaguguagaggcuuuuccacaaucaaacgcggucauucaggaugaagaaagagauauaccugaacguagcuggaauaguggauacgaguggauaacugauuucccgggaaagacaguaugguuugugccaucaauaaaaucagguaacgacaucgccaacugcuugaggaaaaauggaaagcgaguaauacaauuaucucguaaaaccuucgauacggaauaucagaaaacgaaaaacaaugauugggacuauguaguaacaaccgacaucucugagaugggagcuaacuuucgggcggaccggguuauagauccuagacggugucuaaaaccugugauauuaaaggacggaccugaaagggugauauuagcaggcccgaugccgguaacugucgcgagugccgcucaaagaaggggaaggauuggacguaaucauaauaaagagggugaucaauauauuuauaugggacagccuuuaaauaaugacgaggaccacgcucauuggaccgaagcuaaaauguuacuagacaauauuaacacaccagaagguauuauaccugcacuauuugagcccgagagagagaaaagugccgcaauagacggggaauauaggcuaagaggggaagcucgaaagagcuuuguugagcuaaugcguagaggagacuuaccggugugguuaucauacaaaguagcuagugaagguuuucaauacagugaccguagaugguguuuugauggagaaagaaauaaucaaguauuagaagaaaauauggaugucgaaauauggacaaaagaaggugagaggaagaaacucagaccgagguggcuagacgcacgaacuuacagcgauccccucgcguugcgugaguuuaaagaguucgcagcaggaagaagaagcguaucgggagacuuaauauuagaaauuggcaaauuaccucaacauuugacacaaagagcccaaaaugcccuagauaaucuaguuauguuacauaauucagaacaaggaggacgugcguauagacacgcgauggaagaacugccagacacaauagaaacucuuaugcucuuagcacuaauagcgguacugacgggugggguaacauuauuuuuccuaucgggaagaggcuuaggcaaaacuucaauagggcuccuuuguguaauggcuucaaguguccuuuuguggauggcuagugucgaaccacacuggauagcugcgucuaucaucuuggaguucuuucuuaugguacuucuaaucccugaaccugaucgacaacguacuccacaagauaaucaacuggcguauguggucauuggacuacuguucaugauacugacaguugcugcaaaugaaaugggacuauuggaaacgacuaagaaagauuuaggaauagggcauguggcgguagagaaucaucaucacgccgcuaugcuugacguugaccuccaccccgccucagcauggacauuguaugcuguggcuacaacuaucaucacaccgaugaugcgucauacuaucgaaaauacaaccgcaaauauaucauuaacggcaauagcaaaucaagcagcaauacuaaugggacuggacaaggguuggccuauaucaaaaauggacaucgguguaccucuauuagcacuugguugcuauagucaaguaaauccauugacacuaacugcugcuguauuaaugcucguagcgcacuaugcgaucauuggcccuggucuccaagcuaaggcuacaagggaagcucagaaaagaacugcugcagggaucaugaagaaucccacuguggacgggauugucgcaauagaucuugaucccguagucuaugaugcaaaauuugaaaaacaauuagggcagauuaugcucuugauacuuugcacgagucaaauacuauugaugcgcacuaccugggcccuaugcgagucuauuacacuagcaacagggccacuaacuacucugugggaaggaucuccugguaaauuuuggaacacgacuauagcaguguccauggcaaauauauucaggggcucguauuuggcaggagcuggccuggcauuuucacugaugaagucguuaggcggcgggagacgcggcacaggagcgcagggagaaacucuaggcgaaaaauggaaacgucaauugaaucaacuuagcaagucggaguucaauacuuauaagagaaguggaauuauggaaguugaucgcucagaggcuaaagaaggacugaagcgcggugaaacgacaaagcaugcaguaucacgugguacagccaaauuaaggugguucgucgagagaaauuuaguaaaaccagaaggaaaaguaauugaucuaggguguggaagaggagguuggaguuauuacugcgccggucuaaagaaagugacagaggugaaaggauacacgaaaggagguccaggccaugaggagccuauaccuauggcuacauauggauggaaucuaguaaaacuacacagugguaaggacguauucuucauuccucccgaaaaaugcgauaccuuauugugugacauuggcgaaagcaguccuaacccaacgauagaagaaggucgaacccuccggguauuaaaaaugguggaacccuggcucagaggaaaccaauuuuguauaaagauacuuaacccauacaugccuagcguaguagagaccuuagaacagaugcaacgucgucaugggggaaugcugguccgaaauccccuaucccgaaauucuacgcacgagauguauuggguaagcugugggacagguaauauugucucagcaguaaauaugacgagcagaaugcuacuuaacagauuuacaauggcccaccguaagccaacauaugaaagagaugucgaucuuggagcgggaacucgucacguugcuguggagccugaaguagcuaaccuugauauuaucggacaacgaauugagaauauuaaacaugagcauaaaagcacuuggcauuacgaugaagauaacccguacaaaacgugggcuuaccacgggucuuacgaaguaaaaccuucuggaucagcaucaagcauggugaacggugucguaaaauuacugaccaaaccaugggacgucauaccuaugguaacacaaauugcgaugacagauaccacaccauuuggacagcaaaggguuuuuaaagagaagguggauaccaggacucccaaggcgaaacgugggaccgcccaaauaauggaagugacagcgaaaugguuaugggguuuucuaagucgaaacaagaaaccucguauaugcacucgcgaagaguucacgagaaagguuagaucgaaugcagcaauaggggcuguuuuuguagaugaaaaccaauggaacucagccaaagaagccguagaagacgaacgauuuugggauuuaguacacagagaaagagaacuacauaaacaaggaaaaugugcuacauguguauacaauaugauggggaagagggagaagaaauuaggcgaguucggaaaggcaaaggguucaagagcuauaugguauauguggcugggagcgcgguuucuggaguuugaggcuuuaggguucaugaacgaggaucacugguuuaguagagaaaauagucuuucaggcguggaaggagaaggacugcacaaacuaggcuacauucuaagagacauuagcaagaucccaggagggaauauguacgcagaugauacugcggguugggacacaagaauuacggaggaugaucuacaaaacgaagcgagaauaacugauauaauggaacccgagcaugcgcucuuagcuaaauccauuuuuaagcucacguaucaaaacaaaguaguuagaguacaacgacccgcgaaaaauggcaccguaauggaugugaucagcaggcgagaucagagagggucgggacaaguagguacauauggcuugaacacauucacuaacauggaggcacagcucauuaggcaaauggaaagcgaaggcauuuucaguccauccgaauuagaaacacccaaucucgcugaacgaguccuagauugguuggaaaaauacggaguagaaagauugaaaaggauggcuauuucuggcgaugacugcguaguaaaaccgauagaugauagauuugcgacagcucuuacagcucuuaaugauaugggcaaagucagaaaagacauuccucaaugggaaccgagcaagggauggaaugacuggcaacaagucccauuuuguagucaucacuuccaucaauugauuaugaaagacggucgcgaaauuguggugccaugucgaaaccaagacgagcuaguuggcagggcacgaguuucucaaggcgcaggcuggucuuuaagggaaacagccugccuuggaaaaucauaugcgcaaauguggcaacucauguacuuucacagacgagaccuacgacuagcagcaaaugcaauuuguagcgcgguacccguugauuggauaccaacaucacgaacaaccuggucuauacacgcccaucaccaauggaugaccacggaagauaugcucucaguguggaauagaguauggauagaagaaaaucccuggauggaagauaaaacacacaucagcucguggggugacgucccauacuuaggaaaaagagaagaucaaugguguggaucucuaaucggguugacugcacgagcaaccugggcaacaaacauccaaguugcuauaaaucaggucaggagacucaucgggaacgagaauuaccuagauuacaugacaucgaugaagagauucaaaaaugaaucugacccggaaggggcauuaugguaa

SEQ ID NO: 22009 - RNA, 9879 nt, Artificial Sequence
  derived and/or modified CDS sequence (opt6) from DENV-1__JQ045667__SS-prME
ucaguaacuaugcuuuuaaugcugaugccuacugcucuagcuuuucaucugacgacucggggaggugaaccucauaugauagucaguaaacaagaaaggggaaaaagccuauuauuuaaaaccagcgcgggcgugaacauguguacauuaauagccauggaucugggugaauuaugugaagauaccaugacauacaaauguccgcguauuaccgagaccgaaccggacgauguagauuguugguguaacgcgacagacacguggguaacuuauggaacuugcagucaaacgggggaacauagaagagauaaacguucuguagcuuuggcuccucacguagguuuaggauuagaaacaagaaccgaaacauggaugaguagcgaaggcgcuuggaaacaaauccaacgcguugaaaccugggcacuuagacaucccggcuuuacagugauagcuuuauuuuuagcucacgcgaucgguacaucuaucacacagaaaggcauuauauucauacuacucauguuggugaccccaucaauggcaaugcgauguguagguauagggucuagggauuucguugaaggacuaucaggugccacuuggguagacgucguuuuagaacaugguucuugcgugacaacaauggcuaaagauaaaccaacgcucgauauagaacuuuugaaaacggaaguaacaaaucccgcaauauuaagaaaauuauguauagaagcgaaaauaaguaacacgacuacaaauucaaggugcccuacacaaggugaagcaacucuaguagaagaacaagaugcuaauuuuguuugcagacgcacauucguagaccgcgguuggggaaauggguguggccuauuuggaaaaggaaguuuaauaacaugugcaaaauuuaaaugcguuacuaaacuggaggggaaaauugugcaauacgagaacuuaaaauacucagugauugugacgguccacacaggagaucaacaucaaguaggaaacgaaucgacggagcauggcacuacagccacuaucacgccccaagcuccaacaacagaaauacaacuaacugauuauggcgccuuaacacuugauugcucaccuagaacugguuuggauuuuaacgagauggugcuacuuacuaugaaagguaaaucuugguuaguccacaaacaaugguuccucgaucucccucuaccauggacaaguggcgcuuccacuucacaagaaacuuggaacagacaagaucuucuagugacauuuaaaacugcucaugcgaagaaacaagagguugucguacuaggaucacaagaaggugcaaugcauacggcgcuuacgggcgcaaccgaaauacaaacaucgggcacaaccacaauuuuugcuggucauuuaaaauguagacuaaaaauggacaaauuaacacuaaaagguaugucauacguaaugugcacugggagcuuuaaacuggaaaaagagguugcugaaacccaacacgguacgguacuugugcaaauuaaguaugaagguaccgacgcuccaugcaagaucccuuuuaguacucaagaugagaaggguguaacucagaauggucgauuaauuacagcuaacccuaucguuacggacaaagaaaaaccaguaaauauagaggcugaaccaccauucggugaaaguuacauuguaauaggagcgggagaaaaagcacuuaaauuaagcugguucaagaaaggcucuaguaucgggaaaauguucgaagcgacugcuagaggugcacgaagaauggcaauuuugggggauacagcaugggauuuuggaucuaucggcggcguauuuacaucagugggcaaacugguacaucaaauuuuugguacagcguacggaguucucuucagcggcguaagcuggacuaugaaaauagguauagggguccuacuaacaugguugggucuaaauucacgcucaacaaguuugucuaugacauguaucgcugugggacuuguuacauuguaucucggaguaaugguacaggcagacagcgguugcguuauuaauuggaaagguagagaacuaaaauguggcucuggcauauuugucacaaaugaaguacauacauggacagaacaauacaaauuucaagcagacuccccuaaacgguugagcgcagcaauagguaaagcaugggaagaaggaguuuguggaaucagauccgcaacacguuuggaaaauauaauguggaaacaaauaaguaacgagcuuaaucauauacuuuuagaaaacgacaugaaauucaccgucguaguuggugaugucgcugguauucuagcccaggguaagaaaaugauacgaccccaaccaauggaguauaaguauuccuggaaaucaugggggaaagcaaagauaauaggugcugauguucaaaauacuacauuuauaauagacggcccaaauaccccagaauguccagaugaucaaagagccuggaacauuugggagguugaagauuauggcuuuggaaucuucacaacuaacauaugguuaaagcucagagacucguauacacaaguuugugaccauagauuaaugagcgcugcuaucaaagauucaaaagcaguacacgcagauaugggauacuggauugaauccgagaaaaaugagacuuggaaacucgcaagggcguccuucaucgaaguaaagacaugcauauggccuaaaucgcauacuuuauggucgaacgggguucucgagucggaaaugauuauuccuaaaauuuacgguggcccuauuagucaacauaauuaccgaccgggguacuuuacgcagacugcgggaccguggcaccuagggaaauuagagcuugauuucgauuuaugcgaaggaacuacuguuguuguagaugaacacugcggaaauaggggcccuucauuaagaacuacaaccguuaccggcaaaaucauucaugaaugguguuguagaaguuguacacucccgccacuacgguucagaggcgaagacgguugcugguacggaauggagauccguccuguaaaagagaaagaagaaaaccuuguaaaaucaaugguauccgcgggaucaggugagguagacucauuuaguuuagggcucuuaugcaucucaauaaugaucgaagaaguuaugagaagccguuggucacgaaaaauguugaugacuggaacuuuagcuguguucuucuuguuaauaauggggcaauuaacauggaaugaucuuauacgcuuaugcauaaugguaggcgcaaacgcgucggauaggauggguauggggaccaccuacuuagcauuaauggcgacuuuuaagaugaggccaauguuugcagugggcuuauuauuucguagauuaacuucacgugaaguucuauuacuuaccauaggacucagcuuaguagcaucuguagaacuuccaaauuccuuagaagaauugggugauggucuagcaaugggaauaaugauccuaaaacuucuaacagauuuccaaagcuaucagcugugggccacguuauuaucucuaacauuuauuaaaacaacuuucagucuucauuaugcauggaaaacaauggcuaugguauuaucaauagucucucuauucccucuuuguuuaagcacaaccucccagaaaacgacaugguuaccaguccuuuuaggaucguuggguuguaaaccccuaacuauguuuuuaauagcggaaaauaagaucuggggacgaaggucuuggcccuugaaugaaggaauuauggcgguggggauagucucaauuuuacuuuccagccuucucaaaaaugacgugccucucgcagggccacucauagccgggggaaugcucauggcuuguuacguuauuagcggaucgagcgcugauuuaaguuuagaaaaagccgcggaggucuccugggaagaagaggcagaacauucuggagccagucauaacauccuagucgaaguacaaggugacggaacgaugaaaauuaaagaugaagaaagggaugacacuuugacuauucuccugaaagccacuuuauuggcaguuucugguguauacccauuaaguauuccagcaacacuauuuguaugguauuuuuggcagaagaagaaacaacggucugggguguuaugggauacaccaaguccaccggaaguagggagagcaguacucgaugacggaaucuacagaauaaugcaacgagguuuguuagggagaagucaagucggcgucggcguauuucaagaaaaugucuuucacacuauguggcauguaacgcgaggagcaguucuuauguaucaagguaagagacuugaacccagcugggcuucugucaaaaaggauuugauaucauaugguggagguuggagauuacaaggaagcuggaacacuggggaagaaguccaaguuauagccguagaacccggcaaaaauccuaagaacguccaaacagcgccaggcaccuuuaaaacuccggagggagaaguuggcgcgauugcacuagauuucaaacccgguacaucagguucgccaauaguuaaccgagaagguaaaauaguaggacucuacggaaacggcgucguaacaacaagugggacauauguaagugccauagcccaagccaaagcaucccaagaagguccgcucccugaaaucgaagaugaagucuucaggaaacguaauuuaacaaucauggaccuacauccugggucugggaaaacucgccgguaucuccccgcaauaguccgcgaagcaauaaaaagaaaacuaagaacauugauacuggccccaaccagagugguggccucagaaauggccgaagcucuaaaaggaaugccuauaagauaucagaccaccgcaguuaaaucugaacacacagguaaggaaauaguagacuugaugugucacgcaacuuuuacaaugcgacuguugucuccggugcgugugccaaauuauaauaugauuauuauggaugaagcucauuucacugauccaucaucaauugcagcucgugguuacauaucaacgagagucgggaugggagaggcugccgccaucuucaugaccgcgaccccaccagguagcguugaggcuuucccacaaagcaacgccgucauucaggaugaagagagagauauuccagaaagaucauggaauagugguuacgaauggauaaccgauuucccagggaaaacaguaugguuuguuccaucaauaaaauccggaaaugauauugccaauugucuucgaaagaauggaaagaggguaauccaacuaucucguaaaaccuuugacacagaguaucagaaaacuaagaacaacgauugggauuacguagugacaacugauauuagcgaaaugggggcuaacuuucgugcagaccgagucauagauccacggcgaugucuaaaaccaguaauuuuaaaggaugguccggaacgcguuauucuagcggggccaaugccaguaacgguggcaucagccgcgcagagacgaggccgaauaggacgaaaucauaauaaagaaggggaucaauacauuuacaugggacaaccucuaaauaacgacgaagaucacgcccauuggacagaagccaagaugcuacuggauaacauaaauacaccugaggggaucaucccggcucuguuugaaccagagagagagaaaagcgcggccauagacggugaauaucgauuaagaggagaagccagaaaaacuuuugucgaacuaaugcgccgaggggaucuuccgguuugguuaucuuacaagguagcgucggaaggguuucaauauagcgacagaagaugguguuuugacggagaaagaaacaaucaaguauuagaagaaaacauggacgucgaaauuuggacaaaagaaggggaaagaaagaaauuacgaccaagguggcuugaugcucggacuuauucggacccguuggcucuuagagaauuuaaagaauuugcggcugguagacgcuccguaucuggcgaucuaauacucgaaauugggaaacuaccacaacacuugacgcaacgcgcacagaaugcuuuagauaauuuaguaauguuacauaacagugaacagggcggacgagcauacagacacgccauggaagaauugccagauaccauagagacacucaugcuguuagcacuaauugcagucuuaacuggaggagucacgcuauucuuucuauccggaagagguuuagguaagacauccauaggauuacuuuguguaauggcaucuuccguucuacuauggauggcaucggucgagccccauuggauagccgcaucgauaauccuagaguucuucuugaugguccuucucauuccagaacccgauagacaaagaacaccucaagauaaccaauuagcuuacguugugauuggccuuuuauucaugaucuuaacaguagcagcgaacgaaaugggcuugcuggaaacuaccaagaaagaucuuggaauaggccacguagccguugaaaaccaucaccaugcagcaaugcucgacguugacuuacauccugcauccgcauggacacuuuaugcuguugcaacaacaaucauuacgccuaugaugcgacacaccauugaaaauacgacugcuaauaucucguuaacagcaauugcuaaccaagcagcaauacuaaugggacuagauaagggauggccaauaagcaaaauggacauaggcgucccauuacuagcgcuagguugcuauucucaagucaacccacuaacccuaacagcagcagugcuaaugcuuguggcacauuaugcuaucauuggaccaggguugcaagcgaaggcgacaagagaggcacaaaaacgaacagccgcaggaauaaugaaaaauccaacaguugaugguaucguagccauugacuuagauccuguaguuuaugaugcuaaauuugagaagcaacucggacaaauuaugcuauuaauacuauguacgagucaaauauugcugaugagaacaacuugggcccuaugcgaaucaauuacacuagcaacagguccucuuacuacccugugggaaggaucaccagggaaauucuggaacacuacaaucgcaguuaguauggccaauauauuccgaggaaguuaucuugcaggcgcaggacuagcguuuaguuugaugaaaucacuggguggagggagacguggcacaggugcucaaggagaaaccuuaggugaaaaguggaaacggcaauuaaaccaauugucuaaaucugaguucaauauauacaaaaggaguggaauaauggaaguggacagaucagaggcaaaagaaggucugaaacguggcgagacuacgaaacacgccguguccaggggaaccgccaaacuacgaugguucguggaacgaaauuuaguuaagcccgaaggaaaaguaauagaucuaggcuguggacguggcgguuggucauauuacugcgcuggauuaaagaaaguuacagaagugaaaggauauacgaaggguggcccaggacaugaagaaccaauaccgauggcuacguacggcuggaaucugguaaaauuacauagcgguaaagacguauuuuucauacccccagaaaaaugcgauacucuccucugugacauuggcgaauccagcccaaacccaacaauagaagagggacgaaccuuacguguucucaaaauggucgagccauggcugcgaggcaaucaauuuugcauaaaaauauuaaauccuuauaugccaucaguaguugaaacucuugaacaaaugcaaagaaaacauggugguaugcuaguaaggaauccacuuagucggaacagcacccaugagauguauuggguuucaugugguacuggaaauauagugucagcgguaaacaugacaucucgaauguugcuuaauagauuuacaauggcccacagaaaaccuaccuacgagcgugauguagaucuaggagcuggaacacgccacguagcagucgaacccgaagucgccaaccuugauauaauaggacaaagaauagagaacauaaaacaugaacauaaaucaacuuggcacuacgacgaagauaacccauacaaaacaugggccuaucauggaagcuacgaaguaaagccgucgggaucggcaagcuccauggucaaugggguagugaaauuacuaacuaaaccuugggaugugauacccaugguuacacaaauugcuaugacagacacuacgccguuuggacaacaaagaguauucaaggaaaaaguugauacgcgcacuccuaaagccaaaaggggaacgauucaaauaauggaaguaacagccaagugguuauggggguuuuuaucgagaaauaagaaaccaagaauaugcacacgagaagaauuuacacgcaaagugaggucgaaugcagcaauaggcgcgguuuucguagaugagaaucaguggaacucugccaaggaggcgguagaagacgaaagguucugggauuuaguucauagggaacgcgaguuacacaaacaaggaaaaugcgcaacaugcguauauaacaugauggguaagcgagagaagaaacuaggcgaauuugguaaagcuaaagguaguagggcaauaugguauauguggcugggagcgagauuucuugaauuugaggcgcuuggauuuaugaaugaagaccacugguucaguagggagaauagccuuagcggcguggaaggggaaggucuucacaaacucgguuauauucuuagggacauuucuaaaauuccuggcggaaacauguaugcagacgauacagccgggugggauacgagaauaaccgaagaugaccuucagaacgaggccaggauaacagauauuauggaaccugaacacgcauuacuugcuaaaaguauauuuaaauuaacauaucaaaacaaaguaguuagaguucaaagaccagcuaagaauggaacuguaauggauguaauaagucgcagagaucaaagaggauccggucaaguggguacauauggucugaacacauucacaaacauggaagcacaauugauacgacaaauggaaagcgaaggaauuuucucaccaucugaacuugaaacacccaaucucgcagaaaggguccuugacugguuggaaaaauauggaguggaaagacucaaaagaauggccauauccggagaugauugcguaguaaagccuauagaugaucgauuugcaaccgcucuuaccgcacuaaacgauauggggaaagucagaaaggauaucccacaaugggaaccaucaaaaggauggaaugauuggcaacaggucccuuucugcagucaucacuuccaucagcuaauaaugaaagacgggagggaaauaguuguaccaugucgcaaccaggacgaguuaguugggagagcgcggguuucucaaggggccgguuggucauuacgugagacugcauguuuaggaaaaagcuaugcgcagauguggcaacucauguauuuccaucgaagagauuuaagacuagccgcaaacgcaauuugcuccgcaguacccguugauuggauaccgaccucccggacaaccuggagcauccaugcacaccaccaauggaugacgacugaagacauguugucuguauggaaccgaguauggaucgaagaaaacccauggauggaggauaaaacacacauuagcucauggggagaugucccauauuuaggcaaaagggaagaucaaugguguggcagcuuaauuggacuuacagcacgggcaacuugggcaacuaacauucaaguagcgauuaaucaaguuagacgcuugauugguaacgaaaauuauuuagauuacaugacuagcaugaaacgauucaagaaugagucagacccagaaggagcauuaugguga

SEQ ID NO: 22010 - RNA, 9879 nt, Artificial Sequence
  derived and/or modified CDS sequence (opt6) from DENV-1__KU094071__SS-prME
agcguaacgauguuguuaauguuguuaccaacugcauuagcauuucaccuaaccacucgcggaggagaaccccauaugauugucucuaaacaagagagaggaaaaucauuguuauuuaaaacaagugccgguguuaauauguguacucucauugccauggaccuaggggaauuaugcgaagacacaaugacuuacaaauguccacguauaaccaaagcagagcccgacgacguagacugcugguguaacgcuaccgacacuuggguaacauaugguacaugcagccaaacgggggaacacagacgugauaaaagaucaguagcccuagcuccccacguaggacucggccuugaaacacgugccgagacuuggaugucaucagaaggagccuggaaacaaauacaaaaaguggagaccugggcauuacgacauccuggauucacgguuauugcacuauuucuugcucaugcuauagguacgagcauaacgcagaaaggaauaaucuuuauucuccuaaugcugguaaccccgagcauggcaaugagaugcguaggaauaggaaacagggauuucguugagggacugagcggcgggacauggguagaugucguauuagaacaugguagcuguguaaccacaauggccaaagacaaaccgacauuagauaucgaacuucuaaaaacugaaguaacaaauccggcuguguuacgaaaacuaugcauagaagcaaaaauaaguaauacuacaacugacagucguuguccaacgcaaggagaagccacccuuguagaggaacaagacgcgaauuucguaugccgaagaacauuugucgaccgcggauggggcaauggcuguggauuauuuggaaagggaagccuaauaacuugugccaaguucaagugcguaaccaaauuagaaggaaaaauaguacaauaugagaauuuaaaguauagcgucauagugacgguccacacaggcgaucaacaucagguugguaacgaaaccacagaacacgguacuauugccacaauaaccccgcaagcgccaacaagugaaauccaauugacagauuacggugcacucacacuugauuguuccccaagaacagggcuagacuuuaacgaaauggugcucuugacaaugaagcggaaaagcugguuaguccacaaacaaugguucuuagacuuaccucuuccauggacaucuggugcaaguacaccccaggaaacauggaaucgugaagaccuucuugugacauucaaaaccgcucacgcuaaaaagcaagaaguggucguuuuaggcagccaggaaggugcuaugcacacagcauuaacaggcgcuacugaaauucaaaccaguggaaccacaaaaaucuucgcuggacauuuaaaguguagguugaaaauggacaaauuaacuuuaaagggcaugucguaugucauguguacuggaucguucaaacuugaaaaagagguggcagaaacccaacauggaacuguauugguucaagucaaauaugaaggaacagacgcaccaugcaagauuccguuuaguacacaagaugaaaaagguguaacucaaaauggaagacuaauaacugccaauccaauugugacagauaaagagaagccuguaaacaucgaagcugaaccaccauucggugaguccuauauuguaguuggagcuggagagaaagcacuuaaacucucaugguucaagaaggguaguagcauuggaaagauguuagaagcaacggcuagaggagcuaggcggauggcuauccuaggcgacaccgcaugggacuuuggaucaauaggcggaguuuuuacuucuguaggaaaauuaguacaucagaucuucggaacggcauauggaguacuguuuagcggcgucucauggacaaugaaaauuggcauugguauacuccugacauggcugggucucaacagcagaagugccagucugaguaugaccuguauagccguagguaugguuacauuauauuuggguguaaugguucaagcagacucugggugcgugauaaacuggaaagggcgagaacuuaagugugggucuggcauuuuuguaaccaaugagguacauacuuggacugaacaauacaaauuuagagcugauucuccuaagcgauuaagugcggcaauugggaaagccugggaagaaggcgugugcgggauucguuccgcaacaaggcuagagaacauuauguggaaacagauuaguaaugaauuaaaucauauacuuuuagaaaaugacaugaaauucacagugguaguaggagaugucucugguauacuaacgcaggguagaaaaaugaucgguccacaaccgauggaacauaaauauaguuggaaaucauggggaaaagccaaaaucauuggagcagacguacaaaacacaaccuuuauaaucgauggaccgaauacaccugaauguccggacgaccaaagagcauggaacauuugggaaguagaagauuauggauucgguauauuuacuacuaacauauggcuaaagcugagagauaguuacacucaaguaugcgauccaagguuaaugagcgcugcuauaaaagacucaaaagcugugcacgcugacaugggauauuggauugaaucagagaaaaacgagacauggagacuugcacgggcuucauucaucgaggucaagacguguguauggccgaaaucacauacauuaugguccaauggcgucuuagaaucggagaugauaauaccaaaaauauacggaggaccaaucagucagcauaauuauagaccgggcuauucaacucagaccgccgggccauggcacuuaggaaaacuugaauuagauuuugaccucugugaagggacaacaguaguuguagacgagcauugugguaaucgugguccuagccuacgcacaacaacaguaacgggaaaaaucauacaugaaugguguugucggaguuguacccuaccaccacugagauuuaaaggugaagauggaugcugguacggaauggaaauaagaccaguaaaagacaaagaagaaaaccuuguuaaaagccucgucucggccgggucaggcgaagucgacucuuuuucuuuaggacuacuuuguguuucgauaaugaucgaagagguaaugcgcucaagauggagcagaaaaauguuaaugacaggaacgcuugccgucuucuuguuacugauaaugggucaguuaaccuggaaugacuuaauacguuuauguauuauggucggagcaaaugccucagaccgaaugggaauggguacuacauaucuggcccuaaucgccacauucaaaaugagaccaauguuugcaguaggauuauuauucaggcgauuaacgaguagggagguauuauuacuuacgauuggauuaagccuaguggcuucuguugaauuaccgaauagcuuagaagaacuaggggacggucuggcuauggggaucaugauccucaaacuacuaacagacuuccaaagccaccaacuaugggcugcauuauuaucacuaacguuuauuaagaccacguuuaguuugcauuaugccuggaagacaauggccauggucuuaagcaccguuagccuguucccauuaugucuuucuacgacaucuagaaaaacaacauggcuucccguacuauuagguagccugggauguaaaccacuaacuauguuucuaauugcagaaaauaaaauaugggguagaaagucuuggccacuaaacgaagguaucauggccgugggcauugucuccauauuauugucuucacuacucaaaaacgacguuccacuagcugguccacuaauagcuggagguaugcuuauugccuguuacgucauuagcggaaguagugcugaucuuucuuuagaaaaagcggcggaaguauccugggaggaagaagcagaacacucaggagcuucacauaacaucuuaguagaaguccaggacgacggaaccaugaaaauaaaagaugaggaaagagacgacacgcuuaccauucugcuaaaagcaaccuuguuagcaguaucaggaguguauccaauuagcauucccgcaacacuuuuuguaugguacuuccgacaaaagaagaaacaacgauccgggguauuaugggauaccccuagcccuccggaaguagaaagagcaguauuagacgauggaauauaucgaaucuuacagagaggacuauuaggucgaagucaaguuggcguugguguauuucaggaaggaguauuccacacaauguggcaugucacccgaggcgcaguauugauguaucaggguaaaagacuugagccaucgugggcgucuguaaagaaggauuugauuaguuacgguggcggguggagauuucaaggcaguuggaauacuggugaagaaguccaggucauugcagucgagccaggaaagaaccccaaaaauguacaaacagcucccggaacauucaagaccccugaaggagaaguuggcgugaucgcucuggauuuuaagccgggaacaagugguuccccgaucgucaaucgggaagggaagauaguagguuuauauggaaacggaguggugacaacuucugguacuuacguaagcgcuauagcgcaggccaaagcaucgcaagaagguccucuuccagaaauugaagaugaaguauuuagaaagaggaaucucacaauaauggaccuacauccugggucggguaagacuagaagauaccuaccugcaaucguacgugaagcgauaaagcguaaacuaagaacuuuaauauuggcgccaacgaggguaguagcuagcgaaauggcagaagcacuuaaaggcaugccgauaagauaucaaacaacagccguuaaaucugagcacacugguagagaaauagucgaucuuaugugccacgccaccuucacuaugagacuacuaucuccugucagaguaccaaauuacaauaugaucauaauggacgaagcgcacuuuacugacccggccaguaucgcugcaagaggguauauaaguacacgcguaggaaugggagaggcggcggcaauauuuaugacugcuacuccaccaggcucuguggaagcguuuccccaaaguaaugcaguaauucaggaugaggaaagagauauuccugaaagaagcuggaauaguggcuaugauuggauaacagauuucccagggaaaacaguaugguuuguaccaaguauaaagucgggaaaugauauagcaaauugccuucgcaagaacggcaagagaguaauacagcuaagucguaaaacuuuugacacugaauaucaaaagacuaaaaauaaugacugggauuacguagucacaacugauauuagcgaaaugggugccaacuucagagccgaucgaguuauugacccccgaagguguucaaaaccgguuauuuugaaagaugggccggagcguguaauucuggccggacccaugcccguaacuguugcaagcgcagcacaaaggcggggcagaauagggagaaaucaaaacaaagaaggugaucaguauauuuauaugggacaaccauuaaacaaugaugaagaccacgcccacuggacagaagcaaaaaugcuauuagauaacauuaauacaccagaaggcauuauaccagcgcuauucgaaccagagcgagggaagucagccgcaauagauggugaauaucgccuaaggggugaggcaagaaagacauuuguagaacucaugcgaagaggggaucugccaguuugguuaucguacaaaguugcuucagaaggguuucaguauucugaccgaaaaugguguuuugauggugaacgaaacaaccagguuuuggaagaaaacauggauguagagauuuggacuaaggaaggcgaaagaaagaaacuaagaccacgguggcuagacgcucggacauauucugauccccaggcguuaagggaauuuaaagaguucgccgccggcagacgaagugucucuggugaucuaauauuggaaauaggaaaacuaccgcagcaucuuacccaaagggcacaaaacgcguuggauaauuuagucauguugcacaacucggaacaaggaggaaaagccuaucggcacgcgauggaagaauuaccagacacgauagaaacccuuaugcuauuagcccuaauugccgugcugacuggaggcgugacauuauucuuuuuauccggacggggacuaggcaaaaccagcauaggacuauuaugugucauggccagcucaguacuucuuugggucgcaaguguugaaccacacuggauagcugcaagcauaauacuugaauuuuuccuuaugguacuuuugaucccagagccggauagacaaagaacuccacaggauaaccaauuagcauaugucguaauuggguuguuauuuaugaucuuaacgguagccgcgaaugaaaugggauuauuagaaacaaccaaaaaggacuuaggaauuggacauguagcaguugaaaaucaccaucaugccacgaugcuagauguugaucucaggccggcaagugcauggacacuauaugccguugcuacaacaauaauaacaccgaugaugcgucauacgauugaaaacaccaccgcaaauauaaguuugacagcuaucgcaaaccaggcagccauacuuauggggcuugacaaggguuggccgauaucuaaaauggauauaggugucccccuacuagcauuagguuguuauagccaaguaaauccaccaacuuuaauugcagccguguugauguugguugcacauuacgcaauuauaggucccggucuacaagcaaaggcgacccgagaagcacagaaaagaacggcagcgggaauuaugaaaaauccuacagucgacgggauuguagcaaucgacuuagauccaguaguguacgaugcuaaauucgaaaagcaauugggccaaaucauguuacuuaucuuauguacaucacagauccuaaguaugcgaacuacgugggcacuaugugaaucuaucacuuuagccacugguccuuuaacuaccuugugggaaggaagucccggaaaauuuuggaauaccacgauagcuguuucaauggcaaauauuuucagaggcaguuauuuagcaggagcuggauuggcuuuuccauugaugaaaucgcucgguggcggucgaagagguaccggggcacaaggagaaacuuugggagagaaguggaaaagacaauugaaccaauugucaaaaagugaauuuaauacauauaaaagaucagguauaauggaagucgauagaagcgaagcaaaagaagguuuaaaaagaggugaaacuaccaaacaugcuguuucccgugggaccgcaaaacuuaggugguucgucgaaagaaacuuggucaaacccgaggguaaagugaucgaccuugguugcggucgugguggauggagcuauuauugugcgggucucaaaaagguaacggaggugaaaggcuauacaaaagggggacccggacaugaagaaccaaucccaauggcaacguauggguggaaucuaguaaaguuacauucaggaaaagauguauucuuuacaccgccagaaaaaugugauacauuacuaugugacauaggcgaaucaucacccaauccuacaauugaagagggaaggacgcuucgagugcugaaaaugguagaaccauggcuacguggcaaucaauuuuguauaaaaauccuaaauccuuauaugccgucaguaguggaaacauuagaacaaaugcaaaggaaacauggaggaaugcucguacguaacccuuuguccagaaacagcacacacgagauguauuggguaaguuguggaacggguaacauagugucagcagugaauaugacaagucguauguuacuaaaucgguucacuauggcgcauagaaaaccaacuuaugagagggauguagaucuaggagcuggaacuagacauguagcuguggagcccgagguagcaaauuuggacauaauugggcagcgcaucgaaaacauaaagaacgaacauaaaucuacauggcauuaugaugaggauaaucccuacaaaacaugggcguaccauggcucuuaugaaguuaaacccucagggagugccaguucaaugguuaauggaguaguaagacuacugacaaaaccuugggauguuauuccaaugguuacacaaauugcgaugacagauacaacaccauucggccagcagcgagucuuuaaagaaaagguggacacacgaacuccuaaggcgaaacgugguacugcgcaaauaauggaaguaacugcuaggugguuauggggguucuuaagucgaaacaagaaaccacggauauguacacgagaggaauuuacgcguaaagugcggagcaacgcugccauuggugcaguguucguagacgagaaccaauggaauagcgcgaaggaagcgguugaagacgagagauucugggaccuaguucaucgagaacgugaacuucacaaacaagguaagugugcgacuugcguuuauaacaugauggguaaaagggaaaagaaguugggugaauuugguaaggcuaagggaagucgcgcuaucugguauaugugguuaggggcaagauuucuugaauuugaagcgcucggauuuaugaaugaggaccauugguucagucgcgaaaacucuuuaucagguguggaaggagaagggcuacauaaacuuggauauauuuuaagagauauaaguaagauaccaggagggaauauguaugcagacgauacagcagggugggauacacgaauuaccgaagacgaucuacaaaacgaagccaaaauaacagauauaauggaaccugaacaugcacuuuuagcaacuagcauauuuaaauuaacauaccaaaacaaaguugugcgaguccaaaggccagcuaagaaugggacgguuauggauguaauaucaagaagagaucaacgugggagugggcaaguggguacauauggccuaaauacuuucacaaauauggagguccaguuaauacggcaaauggagucggaggggauauuuucaccuucugagcuugagaccccuaaucuggcugaacguguccuugauugguuggaaaaacaugguguagaaaggcuaaaaagaauggcuauaucaggagacgauuguguugugaagccaacagaugauagauuugcaacagcuuuaacugcucuuaacgacauggguaaaguaagaaaggauauaccacaaugggaacccucaaaggguuggaacgacuggcagcaaguaccauuuuguucacaucauuuccaucagcuaauaaugaaagauggucgagaaaucgucguuccauguagaaaucaagaugaacuuguaggcagagcucgcguuagucaaggagcagguuggagcuugagagagacugcguguuuaggaaaaucauaugcacaaauguggcaauuaauguacuuucacaggagagauuuaagacuagcagcaaaugccauuugcagugcuguuccaauugacuggguaccuacaucuagaacaacguggaguauucaugcacaucaucaguggaugacuaccgaggacauguugucaguauggaacagggucuggauagaagaaaacccauggauggaagacaagacccacguauccagcugggaagauguacccuaucuagguaaacgagaagaucaaugguguggaucacucauuggauuaacugcgagggcaacaugggcaaccaauauucaaguugcaauaaaucaaguucgcagacuaauaggaaaugaaaauuacuuagacuacaugaccuccaugaagagauuuaaagacgaaucugaccuagaaggggcauuaugguga

SEQ ID NO: 22011 - RNA, 9879 nt, Artificial Sequence
  derived and/or modified CDS sequence (opt6) from DENV-1__HQ624983__SS-prME
ucuguaacuaugcuacugaugcuuguaccgaccgcacuagcauuucaccuuacaacacgagguggggaaccgcauaugauaguuucaaaacaagaacgaggaaaaucacuucuauuuaaaacaagugcugguguaaauauguguacacugauagcaauggaucuuggagaauuuugugaagacacuaugacauauaaauguccaagaaucucagaagcagaaccugaugacgucgacuguuggugcaaugcaaccgauacuuggguaacauauggaacaugcagucaaacgggugagcaucguagggauaaaagaucaguggcauuagcaccacaugugggucuagggcuggaaacaagaacagaaacguggaugaguucugagggagcauggaaacaaauacagagaguggagacaugggcgcugagacauccgggguuuacagucauagcccucuuuuuagcacaugcuauugggacaaguauaacgcaaaaaggaauuauuuucauccuacuaaugcucguaaccccaucuauggccaugaggugugucgggauuggcucacgggauuucguggaaggccuuagcggugccacuuggguagauguaguauuagaacaugguucguguguaacuacaauggcaaaagauaaaccaacauuggauauagaacuucucaaaacggaaguaacaaauccagcagucuuacguaaacuuuguauagaagcuaaaauuucaaauaccacaacugacucccgaugcccaacacaaggagaagcuacccuugucgaagaacaagacgcuaacuuuguuuguagacguaccuuuguggauagaggguggggaaaugggugcgguuuauuugguaaaggguccuuaaucacaugugcgaaauucaaaugugugaccaaacuagaaggaaaaauaguccaauaugaaaaucuuaaauauucuguuauagugacaguucauacaggugaucaacaccaaguuggcaaugaaucaacugagcaugggacaacggcuacaauaaccccucaagccccgaguacggagauacaauuaacagauuacggugcacuaacucuagauuguucgccaagaacgggccucgauuuuaaugagauggugcuuuuaacaaugaaagagaaaaguugguugguccacaaacaaugguuucuggauuuaccauuaccguggacuucuggcgcgucgacaagccaagaaaccuggaauagacaagauuuauuaguaacuuuuaaaacagcacaugcuaagaaacaagagguagucguauuaggaagccaagagggggcaaugcacacagcacuaaccggcgcuacggaaauacaaacaucuggaacaacgacuaucuuugcaggucaucuuaagugcaggcuaaaaauggacaagcuaacccugaaggguaugaguuauguuaugugcacagguuccuucaaacuagagaaagaaguggccgaaacgcaacacgggacgguuuuaguacaaauuaaauaugaagguacagacgcuccaugcaagaucccauucagcacccaagaugaaaaaggaguuacgcaaaacggaagauuaauuaccgcaaacccaaucguaaccgauaaagaaaagccagugaacauugaagcagagccuccauucggagaaaguuacauugugauaggcgccggagagaaggcucucaaacuaagcugguuuaagaaaggaagcaguauaggcaaaauguuugaagcaacggcacgaggagcucgucggauggcgauauugggugacacugcaugggacuucgguucaaucggcggaguguuuacaucaguggggaaauuaguacaccaaauauuugguacagcuuacggaguacuauuuucgggaguaaguuggacaaugaagauaggaauaggggugcuuuuaacauggcugggguuaaacagccgaaguacuucacuaucuaugacaugcauugcaguagggcucguuacgcuuuacuuggggguaaugguacaagccgauaguggguguguaauaaauuggaagggacgugaauuaaaauguggaucgggaauauuugucacaaacgaaguucauaccuggaccgagcaauacaaguuccaagcagauaguccuaaaagacugucggccgcgaucgggaaagcaugggaagaggguguuuguggcauccgcagugcuacucgcuuggaaaacaucauguggaaacagauaagcaaugagcucaaucacauauuacuggaaaaugacaugaaguuuacuguaguaguaggcgacguggccgggauauuagcgcaagggaagaaaaugauucgcccccaaccaauggaauacaaauauucuuggaaaucaugggguaaagccaagauuauaggugcagacguucaaaauacgacuuucauuaucgacgguccaaauaccccggaguguccggaugaucaacgcgcauggaauauaugggaaguugaagauuauggauuugggauauuuaccacuaauauuugguugaaacuaagggauucguacacacaaguaugugaccaucguuuaaugucagcugcuauaaaagacaguaaagccguucacgccgauaugggcuacuggauagaaagugagaaaaacgaaacauggaaguuggcacgggccucguuuauugaaguuaaaacauguauauggccaaagagucauacccucuggucaaauggcguacuagagucugaaaugauuauucccaagaucuauggagggccaauuagucaacacaacuaucgcccuggauacuuuacgcaaacggcggggccauggcacuugggaaaauuagaacuugacuucgaucuaugugagggaacaacaguagucguggaugaacacugugggaaucgcgguccgucgcucagaaccaccacagugacggggaaaauaauacaugaauggugcugcagaucuuguacguuaccaccucucagauucaaaggggaggauggcuguugguacggaauggaaauccgaccggucaaagaaaaggaagaaaaccuugucaaauccaugguaagcgccggguccggcgaaguagauucguucucucugggauuauugugcauuuccauaaugauagaggaagugaugaggucucgauggucuaggaaaaugcuuaugaccggcacguuagcaguguucuuuuuacuaauaaugggccaacuaacguggaacgaucuuauacguuuaugcauaauggugggcgcaaacgccagugauaggauggguaugggaaugacuuauuuagcauuaauggcaacauucaagaugcgaccuauguuugcagucggcuuauuauuccgaagacuaacaagcagagagguacuccucuuaaccauugguuugagucuuguggcgucaguggaacugccaaacucacuugaagaauuaggugaugguuuagcuaugggcauaaugauauuaaaacuccucacggauuuucaaucucaccagcugugggcuacccuguugagucuaacguucauaaagacuacuuuuagucuucauuaugccuggaaaacuauggcuaugguucuaaguaucgugagcuuauuccccuuaugcuuaucaacaacaagucagaaaacaacgugguuaccagucuuauugggaucguuaggaugcaaaccucuaaccauguuccuuaucgcugagaacaaaauuuggggucgcaagaguuggccccuuaacgaaggaauuauggccguuggaauaguaaguaucuuacucaguucuuuauugaaaaaugacgugccgcuagcuggacccuuaauagcugguggaauguuaauagcaugcuacguaauaagugggucaagugcagaucuuucauuagagaaggccgcagaaguaagcugggaagaagaggcagaacacagcggcgccucucacaauauuuugguugaaguccaagacgacggaacaaugaaaauaaaagacgaagaaagggaugauacauuaacgauucucuugaaagccacauuacuugcaguuaguggugucuauccccuaucaauaccggcuaccuuguuuguaugguauuuuuggcagaagaagaaacaacgaagcggaguauuaugggauacaccgucaccaccagaaguagaacgugccgucuuagacgauggaauuuaucgcauaaugcagcgcggacuccugggcagaagccagguagguguaggcguguuucaagagaaugucuuucacaccauguggcacguaacaagaggagcggugcuuauguaccaaggaaaacguuuagagccaucaugggcaaguguaaagaaggaucucauuaguuauggaggaggcuggaggcuacagggcagcuggaauacaggcgaagaaguacaaguaauugcaguugaaccgggcaaaaaucccaaaaauguccagacagcaccuggaacguucaaaacaagugaaggagaagucggagcaaucgcucucgacuuuaaaccggguaccucagguagcccaauaguuaacagagaggguaaaauaguaggccuauacgguaauggagucguaaccacgucggguacauaugucucugccauagcccaagcaaaagcaucgcaggaagggcccuuaccugaaauugaagacgagguauuuagaaagcgcaaucuaaccauaauggaccugcacccaggaaguggaaaaacacgacguuaccuacccgcuauaguuagagaagccauuaaaagaaaguuacguaccuugauucuagcaccuacaagagugguugcaucggagauggcugaagcgcuuaaaggaaugccgaucagauaccaaacuacagcuguuaaaucagaacauacaggcaaagaaaucgucgauuugaugugucacgcgacauucacgaugagacuauuaucgccuguucguguuccuaauuauaacaugauaauaauggaugaagcacacuuuacagauccuaguaguauagccgcaagaggauauauuagcacaagaguugggaugggggaggcggcugcgauuuucaugaccgcaacaccaccgggaagugucgaagcauucccucagaguaaugcaguuauacaagaugaagaaagagauauuccagaacguucauggaacucgggcuacgaauggauuacagauuucccuggcaaaacuguaugguuuguccccucgaucaaaucuggcaacgauauugcaaauugucucaggaaaaauggcaaaaggguaauucaacuaucccguaaaacguuugacaccgaauaucagaaaaccaaaaauaacgacugggacuacguuguuacaacggauauuucagaaaugggggcgaacuuccgcgcagauaggguaauagacccccgacgauguuuaaaacccgucauauuaaaagacggcccggaaagaguaauacucgcggguccaaugccagucacaguugccucugcggcccaaagaaggggccgcauaggaaggaaucauaauaaagaaggagaccaauacauuuauaugggccaaccacuaaauaaugaugaagaccacgcacacuggaccgaggcgaaaaugcuacuagacaacauaaauacuccagaggguauuauacccgcauuguucgaaccagagagggagaaaucggcagcaauagauggcgaguauagacuaaggggagaggcacguaaaacauucguagaauuaaugcguagaggggaccuaccgguaugguugagcuacaaaguugcuucagaagguuuccaauauucagacaggaggugguguuucgauggcgaacggaacaaucaaguccuagaggaaaauauggauguugagauuuggacaaaagaaggggaaagaaagaaacuuagaccuaggugguuagaugcgagaacauauagugauccauuagcucugagggaauuuaaagaauuugcagcagggaggcgcuccgucucaggcgacuuaauacucgaaauuggaaaauuaccucaacauuuaacacaaagagcucagaaugcacuagacaaucuugugauguuacauaacucggagcaaggcgggcgcgcuuacagacacgcuauggaagaacuaccagauacuauugaaacccugaugcuucucgcccucauagcaguuuugacaggaggggugacacuauucuuucucucgggccgaggauuaggcaaaacaucaaucgguuugcuuuguguaauggcuuccucuguacuccuuuggauggcuuccguggaaccucacuggauugcagcguccauuaucuuagaguucuuuuuaauggugcuucuaauucccgaaccagauaggcaacgaaccccacaagacaaccaguuggcuuacguugugauaggacuacuuuuuaugauucucacgguagcugccaaugaaaugggacuguuagaaacaacgaaaaaggauuuagguauaggucauguagcaguugagaaucaucaccaugccgcuaugcucgacgucgaucuucacccugccucugcauggaccuuauacgccguggccacaacaauaauuacgccuaugaugcgccauacuauagaaaacacaaccgcuaauauaucauugacagccauagcaaaucaggcugcuauauugaugggacuagauaaggguuggccuauauccaaaauggacaucggcguaccccuuuuagcacuagguuguuacucacagguuaauccucuaacgcuaacagcggccguguuaaugcuugucgcucauuaugcaauuauugggccagguuuacaagcaaaagcaacuagagaagcacaaaaacgaacggcugcagggauaaugaaaaauccuacuguggacggaauaguugcuauagauuuggauccuguaguuuacgaugcuaaauuugagaaacaacuaggacagauaauguugcuuauccuauguacaucgcaaauacuauuaaugagaaccacaugggccuuaugcgaaucuauaacacuagcuacaggcccucugacaacuuugugggaagguucaccggggaaauuuuggaacacaacaauagcugucaguauggcaaauaucuuucgcggcucauacuuagcaggagcaggacuagcuuucucgcuaaugaaaucuuugggaggugggagacguggcaccggugcgcaaggugagacguuaggagaaaaauggaagcgucaguuaaaccaucuaagcaaaucugaauuuaauacuuauaagcguucaggaaucauggaagucgaucgcuccgaggcaaaagaaggguugaagcgaggagaaacaaccaagcacgcaguaucaagagggacagcaaaguuacgaugguuuguagaacggaauuuagugaaaccugaaggaaagguaauagauuuagguugugggcgaggaggguggucguauuauugcgccggacucaagaaagucacugaaguuaaaggcuauacuaaggguggaccuggccacgaagaaccgauacccauggcaacguauggauggaauuuagugaaacuccauagcggaaaggacguauucuucguaccgccugaaaaaugcgauacauuauuaugugauauaggugaaagcagcccuaaccccacaauagaagaaggccggacguuacguguauugaaaaugguugaacccuggcuacgagguaaucaauuuugcauaaaaauacuaaacccguauaugccguccgugguagaaacacuugaacaaaugcaaaggaaacauggugguauguuaguuaggaaccccuuauccaggaacucaacccaugaaauguauugggucucaugcggaacuggaaacauuguaucugccguaaacaugacaucucguaugcuguuaaaucguuucacaauggcucaccguaagccaacguaugaaagagauguagaucuaggugcagguacaaggcacguagcuguagaaccagagguagccaaccucgauauaauuggucaacgaauagaaaacauaaaacacgagcauaaauccaccuggcacuaugaugaggauaauccauauaaaacaugggcguaccaugggagcuacgaaguaaaaccuagugguucugcuucaagcauggugaauggggucgugaaguuacuuaccaaaccuugggacguaauuccuauggucacucaaauagcaaugacagacacaacaccguuuggccaacagagaguuuuuaaggagaaagucgacacgagaacaccaaaggccaagagagggacagcucaaauaauggaaguaacugcuaaaugguuauggggauuuuuaagucgaaauaagaaaccacgcauauguaccagggaggaauuuacacgaaaaguacgaucaaaugccgcuauuggugccguguuuguugacgaaaaucaauggaacucagccaaggaggcaguagaggacgaacguuuuugggaucugguucaccgggaaagagaauuacauaaacaaggaaaaugugcgacaugcguuuauaauaugauggggaaacgagagaagaaacucggagaauuuggaaaagcgaaagggucaagagcgauuugguacaugugguuaggcgcccguuucuuagaguucgaagcucuaggguucaugaaugaagaccacugguucuccagggaaaauucauuauccgguguagaaggagaagggcuacacaaacugggauauauccugagagacauaagcaaaaucucggguggaaacauguaugcagaugacacagcgggaugggauaccagaauuacggaggacgacuugcaaaacgaagcaaaaauuaccgauaucauggaaccggaacaugcgcuacuugcgaacagcauuuucaaacuuaccuaccaaaauaagguggucagaguucagagaccugccaaaaauggcacaguaauggacguaauaucccgaagagaccaacgagguagcggucaaguagguacguauggauuaaacacauuuacuaacauggaagcacaauuaauacgacaaauggaaagugaagggauauuuucucccucugaauuggaaacaccaaaucuugccgaaagaguuuuagacuggcuggaaaaguauggaguugaaagacucaaaaggauggcaaucucuggagacgauugcguuguaaagccuaucgacgauagauuugcaaccgcccuaacugcgcucaaugauaugggaaaagucagaaaagacauaccgcaaugggagccaagcaaaggguggaaugauuggcagcaagucccauucugcucacaccacuuucaccaauuaaucaugaaagauggucgagagaucguuguaccaugcagaaaucaggaugaauuagugggccgcgcgagaguaucacaaggggcgggcuggucacuaagagaaacagcguguuugggaaaaucuuaugcacaaauguggcaacuaauguauuuccaucgccgcgaucuaagacucgcggccaacgcuauuugcucagcaguuccaguagauugggucccaacuagcaggaccacauggucgauucaugcacaucaucaauggaugacugcagaggauaugcugucaguauggaauagaguuuggauugaagaaaauccauggauggaagacaagacccauauuucaucaugggaggaugugccauauuuaggaaaacgagaggaccaaugguguggcagucuuauaggacuaaccgcaagggccacuugggccacaaacauacaaguagcaauuaaucagguaagaagacuaauaggcaaugaaaauuaccuggauuauaugaccucaaugaaaagauuuaagaaugaaagugauccggaaggcgcgcucugguaa

SEQ ID NO: 22012 - RNA, 9879 nt, Artificial Sequence
  derived and/or modified CDS sequence (opt6) from DENV-1__FJ384655__SS-prME
uccguuacgaugcuacuuaugcuccuccccacagcuuuagcauuucaucucacgacaagagggggagaaccucacaugauaguuaguaaacaagaacggggcaaaaguuuauuauuuaaaacaucagcugguguaaacauguguacacuaaucgcuauggauuuaggggagcuuugugaagacacaaugacguacaaaugcccgcgaauuacagaagcagaaccagacgacguagauuguuggugcaaugcaacagauaccuggguaacauauggaacauguucacaaacgggggaacaucgacgggauaaaaggagugucgcgcuagcuccucacguuggccuaggcuuagaaacuaggacugaaaccuggaugucuagugaaggugcauggaaacaaauccaaaaagucgaaacaugggcacugagacacccgggauucacgguaauagcacuguuccucgcucacgcuaucggaaccucaauaacacaaaaagguauuauuuuuauacuauuaaugcuuguaacccccucgauggcaaugaggugugucggaauaggaaacagggacuuuguagaaggacugucuggagcaacuuggguagauguggugcuugaacauggcaguugugugacaacaauggcgaaaaacaaaccuacacuagauauagaacuacuaaaaacagaaguuacaaaccccgcaguacuacgaaaauuauguauugaagcaaaaauaucgaauacaacaaccgauucaagauguccaacucaaggagaagccacacugguggaagaacaagaugcuaacuucguaugucgccggacauuuguagaccguggauggggaaaugggugugguuuguuuggcaaaggaucuuuauuaacaugcgcuaaauuuaaauguguuaccaaauuagaaggcaaaauagugcaauacgaaaauuuaaaauacucuguuauaguaaccguccauacuggggaucaacaccaaguaggaaacgagacgacagaacacggaacgauagccaccauuacuccacaagcacccacaagugaaauucaauuaacagauuauggugcucuuacccuugacugcagcccacguacuggacucgauuuuaacgaaaugguucucuuaacaaugaaagagaaaucauggcuugugcauaaacaaugguuccuggaccuuccauugccguggacaucaggagcaucaacaucacaagaaacuuggaauagacaagaccugcuaguaacguuuaaaacugcgcaugcgaaaaagcaagaggucguaguacugggcagucaagaaggugcaaugcauacagcgcuaacgggugcgacggagauucagaccaguggcacaaccacaauauucgcuggccacuugaaaugucgauugaaaauggauaaauugacuuuaaaaggaacaucauauguaaugugcacuggcucuuuuaaacuagagaaagaaguugccgaaacacaacacggaacagugcuaguacaaguuaaauacgaggguacggaugcacccugcaaaauucccuuuaguacccaggacgaaaagggggugacucaaaacggucggcucauuacagcaaacccaauuguaacagauaaggagaaaccaguaaauauugaaaccgaaccacccuucggcgaaucuuacauaguaguuggggcuggagaaaaggcguuaaaauuaaguugguuuaagaaagggagcucuauagggaagauguuugaagcaacggcacguggugcgagaagaauggcuauuuuaggcgacacugcaugggacuuugguagcauaggaggaguauuuacgucaguuggaaaauugguucaucaaguuuucgguacugcauauggaguccuuuuuagugguguauccuggacaaugaaaauagggaucgggauacuucuaacaugguuagguuuaaacagucggucaacuucucuaucaaugacgugcaucgcaguaggaauggugacacucuacuuaggaguuaugguucaagcugauucuggauguguaauaaacuggaaaggacgcgagcuaaaaugcggcagcgggauauuuguuacaaacgaggugcacacauggacagaacaauauaaguuucaggcugauaguccaaagagauuaagugcggcaauaggaaaggcuugggaagaaggaguuugugguauucgcucagcgacgaggcuagaaaacaucauguggaaacaaauuaguaacgaacuaaaccacauccuguuagaaaacgacaugaaguucacaguaguaguuggugacgcgaauggaauccuugcgcaaggaaagaaaaugaucagaccacaacccauggaacacaaauauucauggaaaagcuggggcaaagcuaaaauuauaggugcagauauacaaaacacaacuuucaucauagacggaccugacacgccagaaugcccagaugaacaacgagcauggaauauaugggaaguagaagauuauggguuuggaauauuuacaacaaauaucugguugaaacuuagggacaguuacacacaaaugugugaucauagauugauguccgccgccauaaaagauaguaaagcuguacacgccgacaugggauacuggauagagucugaaaagaacgaaacauggaaauuagcgcgagcaaguuuuaucgaggugaaaacgugcauuuggccgaaaucgcauacacuauggagcaacggcguauuagaaucagaaaugauaaucccgaaaauauacgguggaccaauaucgcaacacaacuacagaccgggguauuuuacacagacagcgggcccguggcauuuagguaagcucgagcucgacuucgacuugugugaaggaacaacugucgucgucgaugagcacuguggaaaccguggaccgucccuucgaacaacgacaguuaccggcaagauaauacaugaauggugcuguagaucguguacucuaccaccacuccgauuucgcggagaagacggguguugguauggcauggagauacgaccagucaaagaaaaagaagaaaauuugguaagaaguauggucagcgcaggaagcggagaaguagauagcuuuucacuagguauacuauguguaaguauaaugaucgaggaaguaaugcgcagucgauggucaagaaaaauguuaaugacgggaacucuagccguauuuuuacuacuuaucauggggcaacugacauggaaugaccucauuagguuguguauaauggugggagcaaaugcuucagauaaaaugggaauggguacaacauaucucgcccuaauggcuaccuuuaaaaugagaccaauguucgccguuggguuauuguuuaggaggcuggccagccgagaaguauuguuacugacaauaggcuuaagccucguggcaaguguugaauuaccuaauagccuagaagaacuaggcgacggguuagccauggguaucaugaugcugaaacuucuaacagaguuccaaccccaucaucuauggacgacauuauuaucgcuaacguucauaaaaacgacguuaucacuagauuaugccuggaaaacaacagcaaugguacugagcauaguuucauuguuuccacucugucucucuacaacgucgcagaaaaccacguggcuacccguguuacuggguucuuuuggaugcaaaccccugacuauguucuuaauaacagaaaauaaaaucuggggacgaaaaucauggccucugaacgaagggaucauggcaauaggcauugugaguauuuuacuaucuucacuacucaaaaaugauguaccacuagcagguccacuaauagcgggcgguaugcuuauagccuguuacguuaucucaggaucgucggcagaucugagucuagaaaaagcggcagaagucucuugggaggaggaagcagaacauucagggacaagucauaacauccucguggaaguccaagacgacggcgcuaugaaaaucaaagacgaagaaagagacgauacuuuaacaauauugcuuaaggcaacccuucuagcagugagcgguguguauccgaugucgaucccugcaacacuauucguaugguauuuuuggcaaaagaaaaagcaaagaucuggggucuuaugggacacaccaucgcccccugaaguagaaggagcaguucuugaugacgggauauauaggauauuacagagagggcuuuuaggaagaagccagguaggcgucggaguauuccaagaugggguauuucauaccauguggcacgugacccggggcgccguccuaauguaucaaggaaagcgucuggaaccaagcugggcaagcguuaagaaagauuuaauuucguacggaggaggcuggagauuccaaggaaguuggaauacaggagaagaaguacaaguaaucgccguugaaccuggaaagaacccgaaaaauguacaaacuacaccagggacauuuaaaacaccagaaggcgaaguuggggcaauagcacuggauuuuaaaccagguacuucuggcucaccgaucgugucgagagaagguaaaaucguuggacuauauggcaacgguguuguaacgacaaguggcacuuaugucucggcuaucgcacaagcgaaagcgagucaagaaggaccauuaccugagaucgaggaugaaguuuuuaagaaaaggaauuugacuauuauggaucuucauccaggaagcggaaaaacccgaagauauuuaccggcuauagugagagaagcuauaaaaagaaaacuuaggacauuaaucuuggcgccaacccggguuguagcuagcgaaauggccgaagccuuaaaaggcaugccgaucagguaccaaaccaccgcagucaaaagugaacauacugggagagaaauaguggacuugaugugucaugcaacauuuacaaugcgccuccugucaccagucagaguaccgaacuauaacaugauaauaauggacgaagcccauuucacugauccugcaucgauagcagcacgaggauauauaucuacgagagucgguaugggcgaagcggcggcaauuuucaugacagcaacucccccgggaaguguagaagccuucccccaaaguaaugcagucauacaagaugaagaaagagacaucccagaacguaguuggaacucgggauaugauuggauaaccgacuuccccgguaaaacgguaugguuugucccguccauuaaaagugggaaugauauagcaaauugucuaaggaaaaaugguaaaagagugauacaacuuucuagaaaaacauuugacacagaguaucagaagacgaaaaauaaugacugggauuauguuguuaccacagacauaucagagaugggcgcaaauuuuagagcagaucggguaauugacccccgaagauguuuaaaaccgguaauucuaaaggauggaccggaacguguaaucuuagcuggaccuaugccgguaacuguagcgucugcagcacaacgacguggaagaauaggaagaaaucaaaacaaagaaggcgaucaguacguguacaugggucaaccauuaaacaaugacgaggaccacgcacauuggacggaagcaaaaaugcuucucgauaacauaaauacaccugaaggcauuauccccgcgcuauucgaaccagagagggagaaaucagcagcgauagaugguggauacagauuaaggggagaagcuaggaaaacauucguagaauuaaugagaaggggagacuugccagugugguugucuuauaagguagcaucagagggguuucaauauagugacaggcgcuggugcuuugacggugaaaggaauaaccaaguauuggaagagaauauggauguagaaauauggacaaaagaaggggaacgcaagaaauugcgaccaagaugguuagaugcacgaacauauagcgacccuuuagcauugcgugaauuuaaagaguucgcagcaggacgacguuccguaaguggagauuuaaucuuggaaauaggaaaacuuccccaacaucuaacucuuagagcacaaaaugcacuggacaaccuuguaaugcugcauaacagugaacaaggugggaaggcuuacagacacgcaauggaggaacuuccggacaccaucgagacgcuuaugcuacucgcucucauagcuguuuuaacaggagguguuacucuuuucuuccugucgggaaaaggguuaggaaagacgucaaucggauuauuaugugucacagcuucauccgcccuguuauggauggcaaguguagaaccacacuggauagcugcgucaauuaucuuagaguucuuccucaugguacuccuuauaccagaaccugauagacaaagaacaccccaagauaaucaauuagccuauguuguaaucgguuuauuguuuaugauucuuacaguggcugcaaacgaaauggggcugcuagaaacaacuaagaaagaucugggcauuggacacguagcggccgagaaucaucaacaugcuacuaugcuagauguugacuuaaggccagcaagugcauggacuuuauaugcaguagcgacaacuguaauuaccccaaugaugagacacacaauugaaaauacuacugcaaauauuuccuuaacagccauugcaaaucaagccgcuauucuuaugggucuagauaaagguuggcccauuucaaaaauggacaucgguguuccacuauuggcucuuggaugcuacucucaaguaaaccccuugacgcuuacagcggcaguauuaauguuggucgcacauuaugcuauuauugggccaggauugcaagcuaaagcgacuagagaagcgcagaaacggacggcggcugguauuaugaagaauccaacuguugacgguauuguagcaauagacuuggacccgguuguauacgacgcuaaauuugaaaaacagcuaggucaaauuauguuauuaauucuuuguaccucccaaauacucuuaaugcguacuacaugggcacuaugcgaaagcauaacucuggcgacaggaccacuaacaacauugugggaagggucgccagguaaguuuuggaauaccacaauagccgucucuauggcaaacauauuuagaggaucuuauuuagcuggagcaggccuggcauucucacuuaugaaaagucuugguggugggagaaggggaacaggagcccaaggagaaacgcuuggggaaaaauggaaacgccaacuaaaccaauugucaaaaucagaguuuaauacguauaagcgcuccggaauaauggaaguugacaggagcgaggccaaagaggggcuaaaacgaggagaaaccaccaaacaugcaguaagccgggggaccgcuaaauuaagaugguuuguagagcgcaauuugguaaaaccugaagguaaagucauugaccuagggugcggucgaggaggcuggucauauuauugugcaggacucaagaaaguaacugaagugaaaggauauacaaaagguggaccaggacacgaagaaccgguaccgauggcgaccuacggauggaacuuaguaaaguugcauucggggaaagauguauucuucaugccaccugagaaaugcgauacauuauuaugugacauaggcgagucaagucccaacccaacuauugaagaaggaagaacacuacgaguucuuaagaugguagaaccgugguuaagagguaaccaguucugcauaaagauacuaaauccauacaugccuuccguaguugaaacuuuggaacagaugcagcgaaaacaugguggcaugcugguucgaaaccccuuaaguagaaauucuacucaugaaauguauugggugucauguggaaccgggaauauugugucagcagucaacaugacuagcagaauguuacuaaacagauuuacaauggcucacaggaagccaacauaugaacgagacguagaccuuggagcagguacccggcauguagcaguagagccagaaguagccaaucuugacauaauugggcaacgaauagagaauauuaaaaaugaacauaaaucuacauggcauuacgaugaagauaacccauauaagacaugggcauaucacggaagcuaugaggucaaaccuucaggcucggccucaaguauggugaauggcguagugaggcuuuuaacuaagccuugggacguaauuccuauggucacccaaauugcgaugacagauaccacaccuuuuggacaacagcgcguuuucaaagaaaaaguggauacaagaacaccaagagcaaaacguggcacggcucaaauaauggaagucacugcaaaauggcuuuggggauuucuaucaagaaauaaaaagccgcgaauuuguacacgcgaagaguuuacccgaaaaguaagaagcaaugcggcuaucggugcggucuuuguggacgaaaaccaauggaacucagcuaaagaagcaguugaggaugagagauuuugggaucuaguccacagagaaagagaacugcacaagcaaggaaagugugcaacaugcguuuacaacaugaugggaaagagggagaagaaauuaggagaguucggaaaagcaaaaggaaguagagcaauaugguacauguggcugggcgcacgguuuuuggaguuugaggcucuagguuuuaugaacgaagaucacugguuuucaagagaaaacucauuguccggaguggaaggcgaaggauuacacaaacugggauauauccugcgagauauaucuaagauucccggcggaaacauguaugcugacgauacggcugggugggauacacgcauaacggaagaugaccuacaaaaugaagcuaagauaacagacaucauggaaccugaacacgcacuacuagcaacauccauuuuuaaauuaacauaccaaaauaaagucguaagaguccaacgaccagccaaaaauggaacuguaauggacguaauuucccgacgagaucaaagaggaucggggcaaguuggaacuuauggcuuaaauacguuuacaaauauggagguucaauuaaucagacaaauggaguccgaggguaucuucuuaccaagugaacuagagacaccgaacuuagcggaaagaguauuagauuggcuugaaaaacacggggcugaacgcuugaagagaauggcaauaucaggagaugauugcgucguuaaaccaauagacgacagauucgcaacggcauuaauagcccuuaacgacaugggaaaaguccgaaaagauauaccccaaugggaaccgucaaagggguggaaugauuggcagcaaguaccauuuuguagucaucauuuccaccaauugauuaugaaggauggacgcgaaauaguuguacccugcaggaaccaggaugaguuaguaggacgugcaagaguaagccaaggugcaggguggucgcuucgggaaacagcaugucuugguaaaucauaugcacaaauguggcaacuaauguacuuucaccgaagggaucuuagacuagcagcuaaugcaauuuguagcgcuguaccaguagauuggguaccgacaagcaggacaacuuggucaauucaugcacaucaucaauggaugacaacagaagauauguugucuguauggaaucgaguguggauagaagaaaacccguggauggaagacaagacucaugucucgucgugggaagagguaccuuacuuggguaagagggaagaucaauggugugggucacuuauuggccuaacugcucgcgcuaccugggcaaccaacauccaaguggccauaaaucaaguuagacggcuuauugguaacgagaauuaucuggauuacaugaccaguaugaaaagauuuaaaaacgaaucagacccagaaggagcccuaugguaa

SEQ ID NO: 22013 - RNA, 9879 nt, Artificial Sequence
  derived and/or modified CDS sequence (opt6) from DENV-1__KC759167__SS-prME
ucuguuaccauguuauuaauguuaaugcccaccgcgcuagcauuccaucuuacaacuagaggaggagaaccacacaugauuguaaguaaacaagaaagaggcaagagccucuuauucaagacuagcgcuggcguaaacauguguacuuuaaucgcgauggaccucggugaauuaugcgaagacacaaugacguacaaguguccacgaauaaccgaggccgaaccugaugauguagacuguugguguaaugcgaccgauacuuggguaacauacggaacuuguagccaaacuggggaacauaggcgcgauaaaagaucgguggcccuugcgccacacgugggacugggauuagaaacuaggacagaaacuuggaugagcagcgaaggagcauggaagcaaauucagcgaguagaaacaugggcauuaaggcauccuggauucacgguaauagcacuauuccuugcacaugcaauuggaacaucgguuacacaaaaaggaauuaucuuuaucuugcuaaugcugguaacacccucuauggcaaugagaugcguagguaucgggagucgcgauuuuguagaaggccucaguggagccacauggguugaugucguucuggaacauggaucuugcguuacuacaauggcaaaggauaaaccuacccuggauauagagcucuugaaaaccgagguaacuaauccggcgauauuaagaaaauuauguauagaggcaaagaucucaaauacuacaaccgacaguagguguccgacccaaggggaagcaccagaaguggaagaacaggacgcuaauuucgucugcaggagaacuuuuguagauaggggauggggaaauggcuguggucuuuuugguaagggauccuugauuacaugugccaaguucaaaugcguuacuaaauuggaaggcaagauuguacaauaugaaaacuuaaaguauucuguaauugucacgguucacacaggggaccagcaccaagucggaaaugaaucaaccgaacacggcacaacggcuaccauaacgccacaggccccuacaacugagauacaauuaacugauuauggagcccugacuuuggacugcucuccaagaacgggucuagauuuuaaugagaugguguugcuaacuaugaaagaaaagaguugguuaguccacaaacaaugguuucuagauuuaccacuuccauggacaaguggggcaucaaccagucaagagacguggaacagacaagaucuucucgugacuuuuaaaaccgcacaugcuaaaaaacaagaaguaguaguauuaggaucucaagaaggagccaugcacacugcccuuacaggugcuacagagauacaaacaucugguacuacuacuauauuugcaggacauuuaaagugccggcugaagauggacaaacuaacucuaaaaggaaugucauauguaauguguacagguucuuucaaauuagagaaagagguagccgaaacacaacaugggaccguacugguccaaauuaaguaugagggaacagacgccccgugcaagauuccguuuucuacacaagacgagaaaggagucacucaaaacggccgccuaauuacagcaaacccuauagucacugacaaagaaaagccuguuaauauagaggcaaagccgccuuucggagaaucaugcauaguaauaggagcaggugaaaaagcauuaaaauuaucaugguucaagaaaggaaguaguauaggaaaaauguuugaagcaacugccagaggagcuaggcgaauggcaauacuuggagauacagccugggacuuuggcaguaucggcggaguguuuacguccguaggaaaauuaguucaucaaaucuuugggacugcguaugguguacuuuuuucugguguaucauggacaaugaaaauagggauuggugugcuuuuaaccugguuaggacuaaacucuagaucgacaagccuuuccaugacaugcauagcaguuggcuuaguuacgcuuuauuuaggcgugaugguucaagcagauuccggcugcgugauaaauuggaaagguagagaacuuaaaugcgggucagggauauuuguuacaaacgaaguccacacuuggacagagcaauacaaauuucaagcugauucuccuaaacgauuaucagcugccauugggaaagcgugggaagaaggggucuguggaauaaggucagcuacaagacuugaaaacauuauguggaagcaaauauccaacgaguuaaaccauaucuuguuagaaaacgauaugaaauuuacuguagugguuggggacgucgcuggaauucuagcacaagguaaaaagaugauucgaccccaaccgauggaguauaaauacaguuggaaaucuuggggaaaagcgaaaauaauaggcgcagaugugcagaauaccacauucaucauagauggaccgaacacgccggaaugucccgacgaccaaagagcauggaacauuugggaaguggaagauuaugguuuuggaauuuuuacaacuaacauuugguuaaaacuaagagauucuuauacacaaguaugugaucaccggcuaaugagcgcugcaauaaaagacagcaaggcaguucacgcugacaugggcuacuggauugagucagaaaaaaaugaaacguggaaguuagcacgggcaucauuuauagaaguaaaaacauguauuuggccuaagucgcacacuuuauggucuaacggaguguuagaaucagaaaugauuaucccaaagauauauggcggcccaaucagucaacacaacuauaggccaggauauuuuacacaaacagcggggcccuggcaccuuggcaaacuugaacucgacuuugaccuuugcgaggguacuacuguggucguagaugagcacuguggaaacaggggaccaucauuaaggacgacuacagugacggguaaaauaauacaugaguggugcuguagaucaugcacaccuccgccuuuacgauucagaggagaagaugggugcugguacggaauggagauacgaccaguaaaggaaaaagaggaaaaccucgucaaaaguaugguaagugcuggaaguggugaaguagauagcuuuucccuagggcugcuauguauauccauaaugauugaggagguuaugaggucuagguggucacguaaaauguugaugacuggagcacuagccguuuuuuuacuucuaauuaugggacaauuaacauggaaugaucuuauacguuuauguaucaugguaggugcaaaugcuagcgacagaauggggauggguacgacuuacuuggcucuaauggcaacauuuaagaugcgaccuauguuugccgugggccuucuuuuuagaaaauugacaaguagagaaguauuacuacucacuaucggacugagccuggucgcaucaguagaguuacccaauucucuagaagaauugggugauggucuagcaauggguauaaugauacuaaaauuacucacagauuuucagagccaucaacugugggccacacucuuaucucucacauucaucaaaacuacuuucaguuuacauuaugcguggaaaacgauggcgaugguauugagcaucguaucuuuauucccucuaugucucaguacuacuucccagaagacgacauggcuacccguacugcugggaucucuagguugcaaaccacugacgauguuccuaauagcugagaacaaaauauggggaaggagaaguuggccgcucaaugaaggaauaauggcaguaggcauaguuucuauauuacuauccaguuuacuuaagaacgacguaccucucgcaggacccuuaauugccggcgguauguuaaucgcauguuaugugaucagcggaaguucggcagaccuaagccuagagaaagcggcugaaguuagcugggaagaggaagcugaacauucuggagcaucucauaacauauugguagaaguacaagaugauggaacgaugaaaauuaaagacgaagaacgugaugauacacucacaauacuacugaaagcaacgcucuuagcagugucugggguauauccacuuuccauuccagcaacuuuauuuguuugguacuucuggcgcaaaaagaaacaaaggucaggaguacuuugggauaccccgucuccaccagaaguggaaagggcaguuuuggaugacggaauuuauaggaucaugcagcggggauuauuagggcguucccaaguaggaguagguguauuccaggagaauguguuccacacaauguggcacgugacuagaggugcaguucuuauguaccaaggaaaaagacuugagccuaguugggcuaguguuaaaaaggauuugauaaguuauggggguggguggagacuucaagguagcuggaauaccggugagggaguccaggugaucgcaguggaacccgguaaaaacccaaagaauguucaaacagcgccaggaacguuuaaaacgccggaaggcgaaguaggagcgauagcuuuggacuuuaaaccggguacaagcggaucgccgauaguaaacagagaaggaaagauaguaggcuuauacggaaacggggucgucacaacgucugguacauacgucucagcgauagcacaggcaaaagcuucgcaagagggaccgcuuccggaaauagaagaugaaguauucagaaaaaggaaucuaacaaucauggaucuacauccagggagugguaagacaagaagguauuuaccagcaauagugagagaagccauaaaacgaaaacuccguacacuaauacuagccccuacccgugucguagccucagaaauggcggaagcacugaaagguaugccuauuagauaccaaacuacagcagugaaaucagaauauacuggaaaagaaauaguugaucucaugugucacgccaccuucacgaugcgauuguuaucaccagucagagucccaaacuacaauaugaucauuauggaugaagcacacuuuacagauccaucaagcauagcggcaagagguuacauaucaacacgcguaggcaugggugaagcugcugcaauauucaugacugcuaccccccccgggucuguugaagccuuuccacaaucaaacgcuguaauccaagaugaagaacgggauauaccggagagaucauggaauucggguuaugaauggauaacugacuuccccgggaaaacaguaugguuuguaccaaguauuaaaaguggaaaugauauagccaauugccuaagaaaaaacggaaaacgggucauucaacuuucacgcaagacuuucgauacugaauaucagaaaacaaaaaacaaugacugggauuacguugugacuaccgacauaagugaaaugggagcgaacuucagagcagauagaguaauugauccacgccguugucugaaaccuguuaucuuaaaagacggcccugaaagagucauuuuagcgggacccaugccaguaacagucgcaucggcagcacaaagaagggguagaauuggucggaaccacaacaaggagggagaucaguauauauauaugggccaaccuuuaaauaaugaugaggaccaugcacauuggacugaagcuaaaaugcuauuagauaauauuaacacaccugaaggcaucauuccagcucuauuugagccagaaagagaaaaaagcgccgcuaucgauggagaauaccggcugcgaggggaagcuagaaagacguacguagaacuaaugcgcaggggugauuugcccguaugguugucguauaaagucgcuucagaggguuuccaguacuccgaccgacgcugguauuuugacggggaaagaaauaaccaaguauuagaagaaaacauggacguagagauuuggacuaaagaaggagaacggaaaaagcuaagaccgcgaugguuagacgcaagaacuuauucagaccccuuagcacucagggaauuuaaagaguuugcggcggggagaagaucggugaguggugacuuaauacuugaaaucgguaagcugccgcaacauuuaacucaaagggcccaaaaugcauuggacaaucugguuaugcuacauaacucagaacaaggagguagagcauacagacacgcaauggaggaauugccugauacaauugaaacuuuaaugcuacuagcuuuaauagcuguuuuaaccgguggaguuacguuauuuuuucuaucagggagaggucuugggaaaacaaguaucggcuuacucuguguuauggccagcaguguacuccuauggauggcuuccguagagccacauuggauugcagcaagcauaauauuagaguucuuuuugaugguacuacuaauacccgaaccugacagacaacgcacgccucaagacaaucaacuggcguacguaguuauuggucuauuauucaugauuuuaacaguagccgcaaacgagaugggauugcuggaaacuaccaagaaagaccugggcauaggccauguugcgguaggcaaucaucaucacgcagcaaugcuagacguugaucuacacccggccagcgcguggaccuuauaugcaguagcaaccacuauaauaaccccuaugaugcgccauacgauagaaaauacaacagccaacauuucccuuacggccaucgcuaaccaagcagccauauugaugggauuggauaaaggauggccaauaucuaaaauggauauuggaguucccuuacuagcgcugggcugcuauagucaaguuaacccuuuaacacuaacagcagcagucuuaaugcucguggcucacuaugcaaucaucggucccggauugcaagcuaaagcuacucgagaagcccaaaagagaacugcagcaggaaucaugaaaaauccuacgguagaugguauaguggccauugacuuagauccaguggucuaugaugcgaaguuugaaaagcaauuaggucagauaaugcuauugauuuuauguacaagucaaauuuuacugaugagaacaaccugggcguuaugcgaaaguauaacacuggcgacaggaccauuaacgacucuaugggaggguucacccggaaaauucuggaacacuacaauagcagugucaauggccaauauauucagaggcagcuaccucgcgggcgccgggcuagcuuuuagucuuaugaaaucacuagguggagggagaagaggcacuggugcccaaggugaaacuuuaggagaaaaguggaaaagacagcuuaaccaacugucaaaguuagaauuuaacucuuacaaaagaucgggaauuauggaaguggacaggagugaagcuaaagaaggauuaaaaaggggggaaacaacaaagcacgcggugucaagaggaacagcuaaauuaaggugguucguagaaagaaauuugguaaagccagaagggaaaguuauagauuuaggauguggcaggggaggguggucauauuauugugccggccugaaaaaaguaacugaagugaagggauacacaaaaggaggaccaggacaugaagaacccauaccaauggcaaccuacggguggaaccugguaaaacuacacagcggaaaagauguauuuuuuauucccccagaaaaaugugauacacuucugugugauaucggagagagcagcccaaacccuacaauagaggagggacgaacacugcguguacucaaaaugguagagccauggcugagagguaaucaguuuugcauaaagauacuuaaccccuauaugccgucagucguagaaacucuagaacaaaugcagagaaaacaugguggaaugcuuguucguaacccacuaucucgaaauagcacucacgaaauguacugggugagcugcggaacugguaacauuguaagugccgugaacaugacauccagaauguuacuaaaccgauucacuauggcucaccguaaaccuacauacgaacgugacgucgaucuaggcgcuggaacgaggcauguugcuguugagccagaaguggcaaacuuagacauuauagggcagcguauagaaaacauaaaacaugaacacaaaaguacauggcauuaugaugaggauaauccauauaaaacaugggcuuaccauggcucauacgaagugaaaccaucggguaguagcucgucgaugguaaauggggucguaaaacuauugacaaaacccugggauguaauaccgauggugacucaaauagcaaugacagauacuaccccuuuuggucaacagcgcguguuuaaagaaaaaguagacacacgaacuccuaaggcaaagagagguacagcgcaaauaauggaggugaccgcuaaauggcuaugggguuuuuuaucacgaaauaaaaagccucguaucuguacaagagaggaauucacaaggaagguaagaucaaaugccgcaaucggggcuguauuuguagaugaaaaucaauggaauagugcaaaggaagcggucgaagacgaaagauuuugggaccucguucaucgugaacgcgaacuucacaaacaagggaaaugugcaacuuguguauacaauaugaugggcaaaagagaaaaaaaacuaggugaguucggcaaggcaaaaggaucccgcgcaauuugguauaugugguugggagcacgcuuucucgaauucgaagcacuaggcuuuaugaaugaggaccacugguuuucgagggagaauucacugucaggagucgaaggugaaggacuacacaagcucgguuacauuuuacgggauauaucgaagauuccuggaggaaacauguaugcggaugacacagcaggaugggauacaagaauaacggaggaugauuuacaaaacgaagcgcgaauuacggauauaauggaaccugaacacgccuugcuggcuaaaucaauauucaagcuaacuuaucaaaacaaaguggugagaguacaacgaccagcaaaaaauggaacgguaauggauguaauuaguagaagggaccagcgagguaguggccaaguggguaccuauggacuaaacacauucacaaacauggaagcucaguuaauaagacaaauggaaucggaagaaauauuuaguccgucagaauuggaaacuccuaaccuugcggaaagaguacuagauuggcuggaaaaauauggaaucgagcggcuuaaaagaauggcaauaucaggcgacgacugugugguaaaaccaauagauaaccgauuugcgacagcauugaccgcacuuaacgauaugggcaaaguaagaaaagauauaccgcaaugggaaccuucgaagggauggaacgauuggcaacaaguuccguuguguucacaucauuuucaucagcuuauaaugaaagaugggcgugaaauuguuguaccaugccggaaccaagaugaauuaguagggagagcucgagugucacaaggagcuggguggucacuuagagaaaccgcaugccuagguaaaucguaugcccaaauguggcaacucauguauuuccaucgcagggauuuaagauuagcggcaaaugcuauauguagcgcugucccgguagacuggauuccuacuucaagaacaacauggucaauucaugcucaucaccaauggaugacaaccgaagacaugcuaagcguuuggaaucgaguguggauugaagagaacccauggauggaagauaaaacucauauuaguucuuggggagacgugccuuauuuagguaaacgugaagaucaauggugcggcucacuuauagguuuaacggcacgagcgacaugggccacaaacauccaaguggcuauaaaccaagugaggcgacugauaggcaacgagaacuaucuagauuauaugacuucuaugaaacgcuuuaagaacgaaucugacccggagggcgcccucugguag

SEQ ID NO: 22014 - RNA, 9879 nt, Artificial Sequence
  derived and/or modified CDS sequence (opt6) from DENV-1__JQ048541__SS-prME
ucggucacuaugcuccuaaugcuaaugccaacagccuuagccuuucaucuaacuacacgagggggagaaccccauaugauaguaucuaagcaggagcgaggaaaaucccuacucuucaaaacauccgcaggugugaacauguguacccuaauagcaauggaucugggcgaauuaugcgaagauacaaugacguauaaaugcccuagaauaacagaagcagaaccagacgauguugauugcugguguaaugccacagacacuugggugacauacgguacuuguucgcaaacaggagaacauagacgggacaaaagaucgguagcacuugcaccucauguuggucuaggcuuagaaacaagaaccgaaacauggaugagcucagaaggugcguggaagcagauucagcgaguagagacaugggcuuugcgccacccuggguuuaccguuaucgcuuuauuuuuagcacaugcgauaggcacuuccauaacacaaaaagguauaauuuucauacuacuaauguuaguuacuccgagcauggcaaugcggugugucggaauuggaucacgagacuuuguggaaggccuaucaggagcaacaugggucgauguggugcuagaacacgguaguuguguaaccacuauggcaaaagauaaaccaaccuuagacauugaauugcuuaaaacagaagugacaaauccugcgguccuccguaaguuguguauagaagcaaaaauaagcaauacaaccaccgacucacggugcccuacgcaaggagaagcgacauuaguugaggaacaagaugcaaacuuugugugcaggagaacauucguggaccgugguuggggcaacggaugugguuuauuugguaaggggucccuuauaacaugcgcgaaguuuaaauguguuacgaaauuggaaggaaagauuguucaauacgagaauuuaaaauauucaguaauugucacaguacauacaggugaucagcaucaaguggguaacgaaucuaccgaacaugguacaacagcuacaaucacaccacaggcaccaacuacagaaauacaauugacugauuauggcgcacuuacgcuagacuguucucccagaacaggacuagacuuuaacgaaauggugcuacuaacgaugaaagaaaaaagcuggcucguucacaagcaaugguuccuggacuuaccauugccauggaccagcggggcuucuacaucacaagaaacuuggaaucgucaagacuugcuaguuacauuuaagacagcucaugcaaaaaaacaggaaguugugguuuuaggcucacaagagggcgcaaugcacacagcucugacgggugcgacggaaauacagacaagugggacaaccaccaucuuugcuggccauuugaaaugcagacuaaaaauggacaaauuaacguuaaaaggaaugucauauguaaugugcacagguaguuuuaaauuagaaaaggaaguagcagaaacgcagcauggaacuguccuuguacagauuaaauaugagggcacggaugcaccguguaaaaucccauucuuaacucaagaugaaaaagguguuacgcaaaaugggagacuuauaacagcaaauccuaucguuacugauaaagagaaaccaguuaauauugaagcugaaccaccuuuuggggaaucuuacauugugauaggagcaggagaaaaggcacuaaaacuuucaugguucaagaaagguagcucaaucggcaaaauguucgaggcaacugcaagaggagcgagacguauggccauuuuaggugauacagcuugggacuuuggaaguauuggaggaguauuuaccaguguagguaaguugguucaccaaauuuuugguacagccuaugggguuuuauucaguggaguaucguggacuaugaaaauuggaauuggaguacuacugaccuggcuaggcuugaacucuaggucaacaagucugaguaugacuugcauugcuguaggccuaguuacucuauacuugggggucaugguacaagcugacucaggauguguaauuaacuggaaagggcgggaacucaagugcgggucagguauauucguaacuaacgagguacauacuuggacggagcaauacaaauuccaggcagacucaccgaagaggcuuagcgcagcuauaggaaaagcaugggaagagggagucuguggcauccggucagcuacaaggcuagaaaacauuauguggaaacaaaucagcaaugaguuaaaucauauacuacucgagaaugacaugaaauuuaccguaguuguaggcgacguagcuggaauuuuagcacaagggaaaaaaaugauccggccacagccaauggaacacaaauauucuuggaagucuuggggcaaagccaaaaucauaggcgcagacguacagaacacgaccuucauaaucgacgggccaaacacucccgaaugcccggaugaucaaagagcuuggaauauuugggaagucgaagacuauggcuucggaauauuuacaacaaacaucuggcugaaauugcgagauaguuacacacagguuugugaccacagauuaaugagcgcagccauaaaagauucaaaggcgguacaugcugacaugggcuauuggauagaaucugagaaaaaugaaacauggaaacuugcuagggccaguuuuauagaaguuaaaacauguauauggccuaaaucacacacuuuguggucaaauggaguacuagaaucggaaaugaucauuccgaaaauuuauggcggaccgauaucccaacauaagcuaaggcccggauauuucacccaaacagcuggcccauggcaccuagguaaguuagaguuggauuuugaucucugugaaggaacuacgguagugguggacgaacauugugggaacaggggaccaucucugaggaccacgacuguuacugggaagauuauacaugaguggugcugucgaagcuguacacuaccaccacuccgauucagaggagaagauggcugcugguauggaauggagauccgcccugucaaagaaaaagaagaaaaucuaguuaaaucaaugguaagugcgggcagcggagaaguagauucauuuagucuaggacuuuuaugcauuaguauaaugauugaagaaguuaugagaaguagguggucacgaaagauguugaugacaggaacauuggcugucuucuuucuucuaauaaugggucaacuaaccuggaaugaucuuauaaggaguuguauaaugguaggcgccaacgcuucagaucguauggguauggggacaacauaucucgcucuuauggcuaccuuuaagaugagacccauguuugcaguuggauuacuauuuagacggcucaccucgcgcgaaguauuacugcuuacaauaggauuaagucucguagcaucaguggaacugccuaauagccuagaagaacuaggagacggccuagcaauggggauuaugauacuaaaacuacuuacugauuuucagucucaucaguuaugggcaacuuuauuaucacuaacguuuauuaagaccacuuuuucacuacacuaugcauggaagacuauggcaaugguauugucaauuguaucacuuuucccacuaugucuuaguaccacuucucaaaaaaccacauggcuaccgguuuuauuaggauccuuggguugcaaaccgcuuacaauguuccuaaucgccgaaaacaaaauauggggucgaaagaguuggccacucaaugaaggcauuauggcaguuggaaucguaucuauauugcugagcucccuccucaagaacgacguaccuuuagcugguccccuuauugcuggcgguaugcuaaucgcauguuauguaauaagugguucguccgccgaccuuucauuagagaaggccgcugaaguuaguugggaagaggaggcagaacauagcggagcaucacacaacaucuuagucgaaguucaggacgauggaacuaugaagauaaaagaugaagaaagggaugauacuuugacaauauuacucaaagccacacuacucgccguaucgggaguuuauccacuauccaucccagcaacccuauuugucugguacuuuuggcaaaagaaaaaacaaagaagugggguucuaugggacacgccaucaccaccagaaguagagagagccguauuagaugauggcaucuauagaaucaugcagaggggauuacuuggaagaucacaaguaggcguagggguuuuccaggaaaacguguuucauacaauguggcacguaacacgcggagcgguauuaauguaccaaggaaagagacuggagccaagcugggcaagugucaaaaaagaucuuauaaguuacgggggaggauggcgacuucaaggcucauggaauaccggugaagaaguacagguaauagcaguugaaccgggaaagaaucccaaaaauguacagacugcaccuggcacguuuaaaacaccagaaggagaagucggugcaaucgcgcucgauuucaagccggguacaaguggaucuccuauugucaacagggaaggaaaaauaguugggcuauauggaaacggaguggucacgacuaguggcacuuauguuucagccauagcgcaagccaaggcuucacaagaagguccauuaccugaaauugaagacgaaguuuuucgaaaacggaaucugacuaucauggaccuacauccugggucuggaaaaacucgucgguauuuaccggcuauagugagggaagcaauuaagcguaaguuacguacucuaaucuuggcaccaacgcgagugguugcaucagaaauggcagaagcccuaaaaggcaugccaauacgauaccaaaccacggcagucaaaucagaacauacugguaaagagaucguugaucuaaugugucaugccacuuuuaccaugcgacuguuaagcccaguacgaguaccaaacuauaauaugaucauaauggaugaagcacauuuuacugauccuagcuccauugcugcgagaggauauauaagcacacguguggggaugggugaagcugcagcuauuuucaugacugcaacucccccuggauccgucgaagcauuuccucaguccaaugcaguuauucaagaugaagaacgcgauauaccagaacgaagcuggaauuccggguacgaguggaucacggacuucccugguaaaacuguaugguuuguaccaaguauaaaauccggaaacgauauagcuaacugccuaagaaaaaauggaaagagaguuauucaacuguccagaaaaacauucgauaccgaauaccagaaaacuaagaacaaugacugggauuauguggugacaacugacauaagcgaaaugggggccaacuuucgugcagaucgagucauagauccaaggcgcuguuuaaaaccggugauauuaaaggauggucccgaaagaguuauauuagcagggcccaugccuguaacagucgcaucagcagcccaaagacgaggacguauaggaagaaaucauaauaaagaaggagaucaauauauuuauaugggucagccucuaaauaacgacgaggaucacgcacauuggacagaggcuaaaaugcuucuugauaacauaaacacaccagaagggaucaucccugcauuguucgaaccugagcgagagaaaagcgcugcaauagauggggaauauaggcuuagaggugaagcaaggaaaaccuucguggaauuaaugagacggggugauuuaccaguguggcuaucauauaaaguggcaagugaagguuuccaguauucagaccggcgaugguguuuugacggcgagcguaauaaccagguacuugaggaaaauauggauguagagauauggacuaaagaaggagagcgcaaaaaauugagaccuagauggcuggaugcuagaaccuauucagauccuuuagcgcuacgugaauucaaggaauuugcugcaggacggagaucggucuccggagaucuaauccuugagauaggcaagcugccacaacaucucacacaaagagcacaaaacgcuuuggauaacuuaguaaugcuucauaauagugagcaaggcggacgagcauaucgacaugcuauggaagaacuaccagacacaaucgaaacgcugaugcugcuugcauuaaucgcaguucuaacuggaggaguaacucucuuuuuccucagcggucggggacucggaaaaacaucaauagguuuacucuguguaauggccucaagcguccuccuauggauggccagcguugaaccacacuggauagcagcaaguauuauacuugaauucuucuuaaugguacugcuaauacccgagccggaucgacaaagaaccccccaagacaaucaauuggcauacguagugauaggucuucuguuuaugauauuaacgguagcagcaaaugaaaugggacuauuggaaacaacuaaaaaagaucuagggaucggacauguagcgguugagaaucaccaucacgccacaauguuagauguugaccuacauccagcaagugcauggacacuguaugcaguugcuacgacaauuauuacaccaaugaugcgacacaccauagaaaauacaacagcaaacaucucacuaacagcuauagcuaaucaagcagcaauuuugaugggauuagauaaaggauggccuaucaguaaaauggauaucggaguaccauuauuggcccuuggauguuauucacaagugaacccucugacacuaacggcagcagugcucaugcuuguugcucacuacgcuauuaucgguccagggcugcaggcuaaggccaccagggaagcucagaaaagaacugcggcuggaaucaugaaaaacccuacugucgauggaauaguagcgauugaucuagauccaguaguauacgaugcaaaauucgaaaaacaauuggggcaaauuauguuauugaucuuaugcacgagucaaaucuuauugaugagaacgacgugggcgcucugugaaucuauuacacuggcaaccggaccauugacaacauugugggaaggaucucccgguaaauucuggaacacgacaauugcaguuagcauggcaaacauuuuucgagguagcuacuuggcaggagcaggacuggcauuuucguuaaugaaaucauuaggaggaggccggagaggaacaggagcccaaggugagacacuaggagaaaaauggaagcgccaauuaaaccaauuaucuaaaucugaguuuaacacguacaaacgaagcgggauaauggaaguugaucgaucugaagcaaaggaaggguugaaaagaggggaaacaacaaagcaugcuguaucaagggguaccgccaaguuacgcugguuugucgagcggaaucuuguaaaaccagaaggcaaaguuaucgaccucggcugcggccgagguggguggaguuacuacugcgccggucuaaagaaaguaaccgaaguuaaagguuacacuaaaggaggaccaggucacgaggagccuauaccgauggcaacuuauggauggaaccuaguuaaacuuuauagcggaaaagauguuuucuucaugccuccagagaaaugugauacgcuacuuugugauauaggagagucuagcccaaaucccacaauagaggaaggccgaacauugagggucuuaaaaaugguagaaccaugguuacgaggaaaucaauucugcauuaaaguacugaauccuuauaugccaucggugguagaaacacuggaacaaaugcaaagaaaacauggaggcaugcugguaaggaacccauugagccguaauagcacacaugagauguacugggucucgugcgggacaggaaacauuguuucugcuguuaacaugacaucgagaaugcuucuaaauagguuuacuauggcucacagaaaaccaacguacgaacgugacguagauuuaggagcggguacgcggcacguagcagucgaaccagaaguagcgaaucuggauauuauagggcaaagaauagaaaauauaaaacacgaacauaagucaacuuggcauuacgacgaagauaauccuuacaaaacaugggcguaccaugguucuuacgaaguuaaaccgucagguuccgcaucaaguaugguaaacggcguaguaaaacuuuuaacuaaaccuugggauguaauaccaaugguaacgcaaauugcaaugacugacacuaccccauuuggacaacaacggguguucaaggaaaaagucgacacacgcacucccaaagcuaaacgaggaacagcacagauaauggaaguaacagcucgaugguuauggggauuuuugagucgaaacaaaaaaccccggauauguacgcgagaggaguuuacucggaaaguacguaguaacgcagcgauuggagcaguuuucauagaugaaaaccaauggaacucggcaaaagaagcuguugaagacgaacgguuuugggaucuaguacaucgcgaaagagaacuacacaaacaaggcaaaugcgcgacauguguuuauaacaugaugggaaaaagagagaaaaaacucggagaauucggaaaagcaaaagguucccgugcaauuugguacaugugguuaggagcucgauuccuggaauuugaagcauugggguuuaugaacgaagaucauugguucucacgugagaacucauuaucuggaguggaaggagaaggcuugcauaagcucggguauauccuacgggacauuuccaaaaucccgggaggcaauauguacgcagacgacacugcaggaugggauacacgaauaacagaggaugauuuacaaaacgaggcuaagauuaccgauaucauggaaccugaacacgcguugcuugcuaaggccauauuuaaauugacauaccaaaauaaaguagucagagugcaacguccugccaaaaaugguacuguaauggaugugauaucuagacgagaccagcgagggagcggucaaguaggaacauauggccuaaacacguuuacaaacauggaagcacaacuuauuagacaaauggaaagugaaggaauauucucaccaucagaacuagaaacaccaaaucuugccgaacgaguacuugauuggcuugaaaaauacggaguugaacggcugaagcgaauggccauaucaggggacgauugugucgucaaaccuauugaugacagauuugccacagcauuaacagcguuaaaugauauggguaagguaagaaaagacauuccgcaaugggagccuucuaaagguuggaaugauuggcagcaggugccauuuuguucccaucauuuucaucaacuuauaaugaaagauggucgagagauaguaguuccgugucgaaaccaagaugaacugguuggaagagcaagggugucgcagggagccggcugggguuugagagaaacagccugucuuggaaagucauaugcacaaauguggcaauuaauguacuuccacagaagagauuuaagacuugcagcaaacgcgauuuguucagccguaccgguagauugggugccuacgagcagaacuaccuggaguauacaugcacaucaucaauggaugacaacugaagacauguuaagcguauggaaccgaguuuggauagaagaaaauccauggauggaagauaaaacacauauuucaucaugggaagacgucccuuaccuagggaagagagaggaccagugguguggaaguuuaauaggucugaccgcaagagcuacuugggccaccaacauucaaguagcaaucaaucaagugagaagauuaaucggaaacgaaaauuaccuagauuauaugacaucaaugaaacgcuuuaaaaacgaauccgacccggaaggcgcccuuugguaa

SEQ ID NO: 22015 - RNA, 9879 nt, Artificial Sequence
  derived and/or modified CDS sequence (opt6) from DENV-1__JN697056__SS-prME
aguguaacaaugcucuuaaugcuguuaccaaccgcucuaacuuuccaccuaacaacaagagguggcgaaccacauaugauaguuaguaaacaagaacgagggaaaucacucuuauuuaaaacaagcgcuggggucaacaugugcacccuaauugcaauggauuugggggaauugugcgacgacaccaugacuuacaaauguccucggauaacggaaaccgaaccagacgacguggacugcuggugcaaugcgacugaaacguggguaacguaugguacaugcucacaaacuggugaacauaggagagauaaaagaucuguggcacuugcaccacauauaggauuaggacuugaaacuagaacugaaaccuggaugaguucagaaggggcauggagacaaauccagaaaguagaaacaugggcguuacggcaccccggauucacuguuaucgcacuauucuuggcccacgccauagguacuuccauaacacaaaaagguauaaucuuuauucugcugauguuaguaacuccgaguauggcgaugcgauguguagggauaggaaaucgagauuucguagaaggucuuucuggagcuacguggguagacguggugcuagaacauggaucuugugugacuacaauggcuaaagacaaaccaaccuuagauauagaauuauugaaaacggaagucacuaaccccgcaguccuacgcaaacucugcaucgaagcuaaaaucagcaacacaacaacagacagcagaugcccuacacagggcgaagcuacccugguugaagaacaagauacaaauuuuguguguagaagaacauuuguagaccgaggauggggaaaugguugcggguuauuuggaaaaggaucucucauaacaugugcaaaauuuaaaugcguaacaaaacuagaaggcaaaauuguucaauacgaaaacuugaaauacucuguaauagugacuguucauacgggagaucagcaccaaguaggcaaugaaaccacugagcaugggacaauugcuaccauaacuccacaggcgccaaccucagaaauacagcuaacugauuauggagcacuuacacuagauugcagcccuagaacgggauuagacuucaacgagaugguacuauugacgaugaaagagaaaaguugguuaguacacaaacaaugguuucuagauuugccuuugccuuggacaaguggagccuccacaagucaggaaacuuggaacagacaggacuugcuagucacguuuaaaaccgcccaugcuaaaaagcaggaagucgugguucuaggcagucaagaaggugccaugcauaccgcgcugacgggagcuaccgaaauacagacgagugggacaacaacgauuuucgcaggucaucuaaaauguagacucaaaauggauaaacuaacccucaaaggcaucucguauguuauguguacggggccauucaaauuagaaaaggagguugcugagacucaacauggaaccguucugguccaaguuaaauacgaggguacagacgcaccauguaaaauacccuuuaguucccaagacgagaagggaguaacccaaaauggacgacucguaacggcaaacccgaucgugacugauaaagagaaaccagucaauauagaagcagagccaccguucggagaaaguuacauugucguaggugcuggcgaaaaggcuuuaaaacuuucaugguuuaagaaagggucgucaauagguaaaauguuugaagcaacggcccgaggcgccagaaggauggcaauacuuggagauaccgcgugggauuucggaucaaucgguggcguguucacuucaguuggaaaauuaguccaucaaauauuuggaacagcauacgguguccuauucaguggaguaaguuggacuaugaaaauaggaauuggcauacuacuaacauggcuaggacuuaacucucguagcacaucguuaaguaugaccuguaucgccgugggaaugauuacguuauaccuaggcguuaugguacaagcagauucagggugcgucauaaauuggaaaggaagagaauuaaaaugcggaagugggaucuuuguaacaaacgagguccauaccuggacagaacaauacaaauuccaggcggacaguccaaaacgucugucagccgcuauaggcaaagcaugggaagaagguguuuguggaauuagguccgcaacgagauuagaaaauauaauguggaaacaaauaaguaaugagcugaaucauauuuuacuugaaaacgacaugaaauuuacugugguaguuggugaugugagcgguauacuugcgcaggguaagaaaaguauaagaccacagccaauggaacacaaguacaguuggaaaaguuggggaaaagcgaagauuauaggugccgacguucaaaauacuaccuucaucauagauggaccaaauacaccugaguguccugacgaccaaagggcauggaauauaugggaaguagaagacuauggcuuuggaauauuuacaaccaacauuuggcuaaaacucagggacucauacacacaaguaugcgaccauagguuaaugucagcagcuauaaaggauucaaaagcaguucaugccgauaugggauacuggauagaauccgagaaaaaugagacuuggaaacuggcccgagcaaguuuuauagaaguuaaaacgugcaucuggcccaaaagucauacccuuuggucaaacgguguacuagagucggaaaugaucauucccaaaauuuauggcggucccauuucucaacauaacuacagaccaggauauuuuacucaaacugcugguccauggcaccuuggcaaauuagaacucgauuuugauuugugugaaggcacuacgguagugguagaugagcauuguggcaauagaggaccgagccuaagaacaacgacuguuacuggcaagauaauccacgaaugguguuguagaucauguacucuaccaccacugagguuuaaaggugaagauggauguugguacgggauggaaauacgaccaguaaaggaaaaagaagaaaauuuaguaaagaguaugguaagugcuggaaguggagaaguugacaguuuuucacuaggauuauuaugcauaagcauaaugauagaagaaguaaugagaagucgcuggaguaagaaaaugcuaaugaccggaacauuggcaguguuucugcugcuuacaaugggacaauuaacuuggaacgacuuaauaagguuguguauaaugguaggugcaaacgcaucugauaauauggguauggguacaacuuauuuagcauuaauggcuacuuucagaaugagaccuauguuugcuguaggauuacuguuucgaagacuaacgagucgagaaguucuacuacuaacggugggccuaagucuuguagccucuguagaacuuccgaauagcuuagaagaacugggcgauggucuagcgaugggaaucaugauauugaaauuauuaacagacuuucaaagccaccaacucugggcaacucuauuaucauuaacuuucguuaaaaccacuuuuucgcuacacuaugcguggaaaacaauggcgaugauauugucaauuguuucccuauuaccuuuguguuuauccacaacuagccagaaaacaacuugguuacccguccuacuuggaucauuaggcugcaaacccuuaacaauguuucuaauaacugaaaauaaaaucugggguagaaaaucauggccucuaaaugagggaauuauggcgguagguaucgucucaauauuguugucaucacuacugaaaaacgacguaccacuugccggaccacucauagccgguggcaugcucauagcaugcuauguuaucucaggcaguucugcggaucuuucacuggagaaggccgcggaaguaucuugggaagaagaagcggaacauucaggagcaagucauaacauacugguugaaauacaggacgacggaacaaugaaaauaaaagacgaagaaagagacgacacaauaaccauauuacuaaaagcuacauuguuagcaaucucgggaguauauccuaugucaaucccugcaacacuauuugugugguauuuuuggcaaaagcgcaagcaacguagcggaguacucugggacacacccagcccaccugaaguggaaagagcuguccuagacgacgguauauauaggauucuacagcggggauugcuagguagaucccaggucggcgugggaguuuuccaagagggagucuuccacacuauguggcacguuacgagaggagcaguauuaauguaucaagggaaaagacucgaaccaucgugggcaagcguaaagaaggauuugauaaguuauggaggaggguggagauuccaagguuccuggaacacuggugaagagguucaagucauagcaguggagccuggaaagaaucccaaaaauguacaaacugcuccggguacuuucaaaacuucagaaggcgaggugggagcaaucgccuuagauuuuaaaccgggaaccagugggaguccaauagucaacagagaagguaaaauaguugguuuauacggaaaugguguuguuacgacuucuggcacguacgugucagccauagcgcaagcuaaagcaucucaggaaggaccucuuccagaaaucgaagaugagguuuuuagaaaacgcaaucuaacgauaauggaucuacauccggguuccggcaagacacgacgcuaucuaccugcaaucguacgggaagcuauuaaaagaaaauuacguacauuagucuuagccccgacacgaguugucgcuagugaaauggcggaagcgcuuaaagggaugccuauuagguaccagacgacugccgucaaaucugaacauacuggccgagaaaucguugaccucaugugccacgcgacuuucacgaugagacuacugagccccguuagaguaccaaacuacaauaugaucauuauggaugaagcucauuucacagauccugcgaguauugcagcacgugguuauauaaguacaagaguuggaaugggugaggcagcggccauauuuaugacagcaacgccacccggcucaguagaggcuuuuccucagucuaaugcgguuauauuggacgaagaaaaagauauuccugaaagaucauggaacuccggauaugauuggauuaccgacuuuccaggaaagacuguaugguuuguaccuaguauaaagucaggaaaugauauugcuaacugccugagaaagaauggaaaacgaguuauccaacuaucucguaagacuuucgacacagaauaucagaaaacaaagaauaaugacugggacuacguggugaccacggacauauccgagaugggcgccaacuucagagcagaccgaguaauagauccgaggagguguuuaaaaccggugauacuaaaagauggaccugagcguguuauacuggcagggccuaugccggucacgguagcuucugcggcacaacgacggggaagaaucggaagaaaccaaaauaaagaaggagaucaauacauauacauggggcaaccuuugaauaacgaugaagaucacgcucacuggacugaagcgaaaaugcugcuugauaauauuaacacuccugaagguauaauccccgcacuuuuugaacccgagagagaaaagagugccgccauagacggagaauauagauuacgaggugaagcaagaaaaacauuuguagaacuaaugagacgcggagacuuaccuguaugguugucauauaaaguggcaagcgaagguuuucaauacucugacaggagaugguguuucgacggcgagcggaauaaccaaguccuagaagaaaacauggauguggagauauggacaaaagaaggugaaagaaagaaacuucgaccucgguggcuugacgcaaggacauacagugauccacuugcacuuagagaguuuaaagaguucgcugccgggcgacgaucaguaucaggcgauuugauuuuagaaauagguaaacuaccacaacaucuuacgcaacgggcacaaaacgcacuagauaaucuaguuaugcuccauaacucugagcaaggagggaaagcguaccgucacgcgauggaggaacuccccgacacgauagagacucucauguugcuagcgcugauagcggucuugacagggggcguaacgcuguucuucuugaguggcagggggcucgguaaaacaucuaucggguugcuuugcguuaugucaaguucagcacugcucuggauggcaucaguagaaccucacuggaucgcugcauccauuauauuggaguucuuuuuaaugguauuacuaauuccugaacccgauagacaacgaacuccacaggacaaucaacuggcauaugucguaauaggcuugcuuuuuaugauucucaccgucgccgcuaacgaaaugggucuauuagaaacuacaaagaaagacuugggaaucgggcaugccgcugcagaaaaccaucaccaugcagcaaugcuggaugucgaucuucauccagcaagugcguggacacucuacgcaguugcaacgacaauaauaacuccaaugaugagacacacaauagagaauacuacagcaaauaucuccuugaccgcuauagccaaucaagcugcuauacuaauggggcucgauaaaggauggccaauuaguaaaauggauauaggcguaccguuguuagcguuggguuguuauagccagguaaauccacuuacacuaacugccgcuguucuaauguuaguugcacauuaugcaauuaucgggccuggcuugcaagcaaaagcuacuagagaagcucaaaaacgaacagcagccggaauuaugaagaauccaacuguugauggcauaguagcaauugaucuagaccccguaguauacgaugcaaaauuugaaaaacaacuuggacaaauaaugcuucuaauauuauguacaucacaaauacuucuaaugcggacaacuugggccuuaugcgaaucaauuacccuugcuaccgggccauuaacuacguuaugggaagguucucccgguaaauuuuggaacacaacaauagcuguuucgauggcgaacauauucagaggaaguuauuuagcuggugcuggauuagcauuuucacugaugaaaagccuaggcggcgggcgccgaggaaccggagcacagggggaaacucugggggaaaaauggaagagacaacuaaaccaauuaucaaaaucggaguucaacaucuauaaacgcucuggaauaguggaaguggacagaagcgaggcuaaagaaggauuaaagcggggcgaaacaaccaaacacgcaguaucaagaggaacugcuaaauugcgcugguucguugaaagaaauuuagucaaaccagaaggaaagguuauagauuuaggauguggaagaggugguugguccuauuacugcgccggucuaaagaaaguuacggaaguaaaaggguauaccaaaggaggaccggggcacgaagaaccaauaccuauggcaacuuacggcuggaacuuagucaaauuauacucugguaaggacguuuucuuuauuccgccagagaaaugcgauaccuuauuaugugauaucggcgaaaguuccccuaauccaaccauagaagaaggacgaacuuuacguguccuaaaaaugguugaaccuugguuacgaggaaaucaguucuguauaaaaauucuaaauccuuacaugccaucgguaguggagacacuugagcaaaugcaacgaaaacacggagggaugcuugugcgaaacccauuguccagaaauucaacccacgaaauguacuggguaagcugugggacagggaauauugucucugcaguuaauaugacaucgaggaugcuacuaaaccgauucacaauggcucaucgaaaaccaacuuaugaacgcgauguugaucuuggugcgggaacaagacauguugcaguggaaccagaaguagcaaaucuagacauaauuggacaacgaaucgaaaacaucaaaaacgaacacaaaagcacauggcacuacgacgaagauaauccauacaagacuugggcauaucacggauccuaugaaguaaaaccuucuggaucagcaagcucuaugguuaacggugucguccgucuccuaacaaaaccgugggacguaauuccuauggucacccaaaucgcaaugacugauacuacaccauucggacaacaacgaguauuuaaagaaaaaguagauacucguacaccaaaagcgaagcgagguacagcgcaaauaauggaaguaacggccaaaugguugugggguuuccugucccguaauaagaaaccgagaauauguacucgagaagaauuuaccagaaaaguaagaucuaaugcagcuauaggagcuguauuuguagaugaaaaccaguggaacagcgcuaaggaagcuguagaggaugaaagauucugggauuugguccgccgagagcgugaauuacauaaacagggaaaaugcgcuaccuguguuuauaacaugaugggaaaacgcgagaagaaacuaggagaguucggaaaggcuaaagggucccgggcuauuugguauaugugguuaggggcgagauuuuuagaguucgaagcguuaggguucaugaaugaggaucacugguuuaguagggaaaauucauuauccgguguugaaggagagggguuacauaaauugggauauauucuucgagauauaucaaaaauaccaggaggaaauauguacgcagacgacacagcagggugggacacacgcaucacugaggacgaucuacaaaacgaagcuaaaauaacggauauaauggagccugaacaugcguuguuggcuacauccauauucaagcucacuuaucaaaauaagguuguaagaguacaacguccagccaaaaauggaacaguaauggacguaaucucaaggcgggaccagagggggucaggucaaguaggaaccuauggacuaaauacauucacaaauaugggagcacagcuuaucagacagauggagagcgaaggcaucuuuuuaccuagugaguuagaaacuccaaaucuugcagggagaguauuagacugguuagaaaaacaugggauugaacguuugagaaggauggcuauuuccggugaugauuguguuguuaaaccaauagaugaucgguuugcgaccgcguuaacagcccuaaacgauaugggaaaaguccgaaaggauaucccacaaugggagccguccaaagguuggaaugacuggcagcaagucccuuucuguagccaucacuuucaucaauugauaaugaaggauggacgagaaauuguaguacccugucgaaaccaagaugagcuaguagggcgugcgcgggucagccaaggugcaggguggucucuaagagaaacugcuugccuaggaaaaagcuaugcccagauguggcaacuuauguacuuccauagacgugaucuaaggcuagcugccaaugcaauauguucugcagugccaguagacuggguaccaacaucccggacgacauggucaauacaugcacaccaucaauggaugacaaccgaagacaugcuaagcguauggaauaggguauggauagaagaaaacccguggauggaagacaaaacucacguuucaagcugggaggauguucccuaucuugguaaacgugaagaucaauggugugggucacugauugggcuuacugcucgugcuacaugggcuaccaacauacaggucgcaauaaaucaagugagacguuuaauaggcaaugaaaauuacuuggauuauaugacaagcaugaaacgcuuuaagaaugaaagugauccagaaggggcacuuugguag

SEQ ID NO: 22016 - RNA, 9879 nt, Artificial Sequence
  derived and/or modified CDS sequence (opt6) from DENV-1__JN697057__SS-prME
aguguuacgaugcucuuaaugcucaugccaacugcucuugcauuccaucugacaacuagaggaggagaaccacacaugauaguaucgaaacaggaaagagguaaaucauugcuuuuuaaaacaagugcgggaguaaauauuuguacccuaauagcaauggaccuuggagaauuaugugaagacacuaugacauacaaaugcccgcggauuaccgaagcugaaccggacgauguggacuguugguguaaugcuaccgacacguggguaacauacgggacuuguucucagacgggcgaacaucgcagagauaaacgaucggucgcacuagcgccacauguaggcuuagggcuagaaacccguacagaaaccuggaugucaagcgaaggcgccuggaaacaaauacaaagaguugaaacuugggcucuacgccacccaggcuucacuguaauugcacuguuucuggcucaugcgaucggcacaucaauuacacaaaaaggcauaaucuuuauacuucucaugcuuguaacacccucaauggcaaugcggugcguagguauugguucuagagacuuuguggaaggacuaaguggugccacguggguugauguagugcuagaacaugggaguuguguuacgacaauggcgaaagacaaaccuacgcuugacaucgaauuauuaaaaacagaagucacgaauccugcgguucuaagaaaacuguguauugaagcaaagauaucuaauacuacuacggauucgagaugcccgacucagggugaagcgacucuagucgaagaacaggaugcgaauuuuguauguagacgaacuuuuguagaccgcgguuggggaaauggauguggccuuuucggcaaaggcagcuuaaucacgugugcgaaauuuaaaugcgugacgaaacuggaaggaaagauaguacaauaugaaaauuuaaaauauaguguaauuguaacagugcauacaggugaucagcaucaaguaggaaacgaaagcaccgaacacggaacgacggccacaaucacuccgcaagcgccuacaacggaaauucaauuaacagacuacggugcacuaacuuuggacuguagcccacguacaggcuuagacuuuaacgaaauggucuuacuuaccaugaaagagaaaaguuggcuuguccacaagcaaugguuucuggaucucccacuaccguggaccaguggagcgucuacaucccaagaaacauggaauagacaagaucuacugguuacguuuaaaacagcccaugccaagaaacaagaagucguaguauuagguucucaggaaggagcuaugcauacagcucuuacuggagcuacagaaauacaaacaucaggaacuaccacaauauucgcgggccauuugaagugcagacuuaaaauggauaaacugacucuaaaaggcaugagcuacgugauguguacaggaucauucaaauuggaaaaagaaguugccgaaacacaacaugggacaguucuaguacagauaaaauacgaaggcacagacgcuccauguaaaauaccuuuuucaacacaagaugaaaaaggagugacucagaaugguaggcuuauaacagcaaacccaauagugacugauaaagaaaagcccguuaauauugaagcagagccacccuuuggagaaucauacauagugaucggugcaggagaaaaagcgcuaaaaguaucuugguuuaagaaagguucaucuauuggaaaaauguuugaagcuacagcaaggggagcaagacgaauggcuauacuaggagacacggcgugggauuuuggaucuaucgggggcguuuucaccagugucgguaaauugguucaucaaauauucggaaccgcuuauggaguuuuauucucaggggucucauggacaaugaaaauagggauaggaguacuccucacauggcucggucuaaacucuagaucaacuucccuaucaaugacauguaucgccguggggcuugucacacuuuaccucgguguaaugguacaagcagacucgggguguguaauaaacuggaagggaagggaguugaaaugcggcuccggcauauuuguaacaaaugaaguacauacguggacagaacaguacaaauuccaagcagacucaccaaaaagauuguccgcggccauagguaaagcaugggaagagggggugugugggauacggagcgcuacgagacuugaaaauaucauguggaaacaaauuuccaacgaauuaaaccacauccuuuuggagaaugauaugaaguucacaguaguggucggcgauguagcuggaaucuuagcucaagggaagaaaaugauaaggccccaaccaauggaacacaaauauagcuggaaaucuuggggcaaagcuaaaauaaucggggcagauguacagaauacaacauuuaucaucgacgguccaaacacacccgagugccccgaugaccaaagagcguggaauauaugggaaguagaagacuacgguuuugguaucuuuacuacgaacauuuggcuaaaacuuagggauucauauacgcaaguuugugaucacagacuaaugucggcagcaauuaaagacaguaaggcaguacaugcugauaugggguauuggaucgaaucagagaaaaaugaaacauggaaauuagcaagagcaucguucauugagguaaaaacaugcauauggcccaaaagucacacacuauggagcaacggagucuuagaaucagaaaugaucauaccuaaaaucuauggcggaccuauaagucagcauaauuauagaccaggcuauuuuacacaaacugccggcccguggcaucuaggcaaauuagaacuugacuucgaccuuugcgagggcacuacuguugucguugacgaacauuguggaaauaggggaccaucauuacgaacgacuacaguaacagguaagauaauucaugaaugguguugucgaucaugcacguuacccccauuacguuucagaggggaagauggaugcugguacggaauggaaauucggccgguuaaggaaaaagaagaaaauuuagugaaaucaauggucucugcuggcagcggugagguagauaguuuuagucugggucuguugugcauaagcauuaugauagaagaaguuaugcgaucacgauggucuagaaagaugcuuaugaccggaacucuagcaguguucuuucuccuaaucaugggccaauuaacuuggaaugaccuuauaagauuaugcauaaugguaggcgcaaaugcuagcgacagaauggggauggguacuacauaucuagcguuaauggcuacauucaaaaugagaccuauguuugcuguuggucugcuauucagacgacuaacauccagagaagugcuccuacuaaccauaggauuaucauuagucgcaaguguagagcuuccuaauaguuuagaagaacuaggggauggacucgcgauggguaucaugauacugaaacuucugacggacuuucaaucucaucaauuaugggugacccuauugaguuuaacuuucauaaagacagcuuuuaguuuacacuaugcauggaagacaauggcaaugguucuuucaauuguuagcuuguucccucuuuguuuaaguaccacaagccaaaagacaacauggcucccaguacuauuaggaaguuugggaugcaaaccucuaacgauguuucuaauugcagaaaauaaaauaugggguagaaaaucauggccauuaaacgaagguauaauggcaguugggauuguaucaaucuuacugucaagucucuugaaaaacgauguuccccuagcggguccgcuuauugccgggggaauguuaauagcuuguuauguaauaucgggaucaucggcugaucuaagccuggaaaaggcagcagaaguaaguugggaagaggaagcugaacauucuggggcgucccauaacauucuaguugagguucaggacgauggaaccaugaaaauaaaagaugaagaaagagaugauacuuuaacaauauuacuuaaggcaacgcuguuagccgucucaggaguguauccccuaagcaucccagcgacgcucuuugugugguacuuuuggcaaaagaaaaagcaacgaagcgggguacucugggacacacccaguccaccugaaguugagcgagcaguuuuagaugacgguauauacagaauaaugcaacguggucuuuuagggaggucacagguaggcguuggaguuuuccaggaaaacgucuuucauaccauguggcaugugacacguggugcaguacuuauguaccaagguaaaagauuagaaccaucaugggcaucugucaagaaagauuuaauaaguuacgguggaggguggagacuacaaggaucuuggaauaccggcgaagaggugcaagucauagcgguugaaccuggcaaaaaccccaaaaauguacaaacggcuccaggcacauuuaaaacgccagagggugaaguuggagcuauugcuuuagacuuuaagccagggacaucaggcucgcccauaguaaauagggaaagaaaaaucguaggacuguacggcaauggaguuguaaccaccagcgguacauaugucucggcaauagcacaggcaaaggcaucacaagagggaccacuacccgaaauugaagacgaagucuucagaaaaaggaaucuaacuauaauggaccuacacccagguucagguaaaacuagaagauacuugccagcuaucguaagggaggccauaaaaagaaaguuacgaacauuaauacuggcaccuacuagggugguugccagcgaaauggcagaagcccugaaaggaaugccaauacgcuaccaaacaacagcugugaaaucugaacauacaggaaaagagauaguugauuugaugugccaugcuacuuuuacaaugagacuacuaucuccuguaagaguaccaaauuauaauaugauuaucauggaugaagcucauuucaccgacccaucuaguauugcagcacgugguuacauaucaacgcgaguggguaugggcgaggccgcagcgauauucaugacggccacaccuccaggaucuguugaggcuuucccgcagucuaacgcugucauacaggacgaagaaagagacauucccgaaaggucauggaauagcggauaugaguggauaacagauuucccaggaaaaacaguuugguucguuccaagcauaaagucuggaaacgauauagcuaauuguuuaaggaagaacgggaagaggguaauacaacuuaguagaaagacuuuugauaccgaauaccaaaagaccaaaaauaaugacugggauuacguugugacaacugauauaucagaaaugggcgcaaauuuccgagcugacagaguuauagacccuagaagaugcuuaaaacccguaauacuuaaagaugguccagagcguguaauacuagcugguccgaugccuguaacaguugcuucugcagcucaaaggagaggacguauuggaagaaaucacaauaaagaaggagaccaauacauauauaugggacaaccauuaaacaacgaugaagaucaugcacacuggacagaagcaaagaugcuacuagacaacaucaauacccccgaaggcauuauaccagcacuauuugagccagaacgcgaaaaaucagcagcgauugauggagaauauagauuaagaggagaagccaggaagacauucguugaauugaugagaagaggggaucuuccagugugguugaguuacaaagucgcaagcgagggauuccaauauuccgacagaaggugguguuucgacggugaaagaaacaaccaaguuuuagaagaaaacauggauguagagauuuggacuaaagaaggggaaaggaagaaacucaggccacgaugguuagacgcccgaaccuacucagacccucuagcuuugcgugaguucaaagaguucgcugcuggucgacgaagugucucuggggauuuaauccuagagauaggaaaauuaccucaacaucuaacgcagcgugcucaaaaugcauuagauaacuuaguaaugcuacauaauagugaacaaggagggcgcgcauaccgacaugcaauggaggaacuacccgacaccaucgaaacuuuaauguugcuagcgcugauugccguacuuacaggaggggucacgcuuuucuuuuuaucagggcgcgggcuugguaaaaccucuauaggccuucuaugcguuauggcuucaucaguuuugcuauggauggcaucgguggaaccccauuggauagcugcuucuauaauccuugaguucuucuuaaugguucuuuugauuccugaaccugauagacaaaggacgccucaagacaaucaacuugcauauguagucauagguuuauuauucaugauacucacaguagcagcaaacgaaaugggacuacuagaaaccacaaagaaagauuuagguauuggacacgucgcuguagaaaaucaccaucacgcugcuaugcuugacguugauuuacaucccgccagugcuuggaccuuauacgcugucgcuacaacgaucauaacccccaugaugcgccacacaauagagaacacuacagcaaacaucagcuugacggcaauugcaaaucaagcagcgauucugaugggucuagauaaaggauggccaauuuccaaaauggauaucgggguaccauuguuagccuugggaugcuacucucaggucaacccucuuacacuuacggcugcagugcuaaugcuagcggcccauuaugcaauaauaggaccaggccuacaagcaaaagcaacuagggaggcacagaagagaacugcagcgggcauaaugaaaaacccuaccguagacggcauaguugcaaucgauuuagauccugucguguacgacgcuaaauucgaaaagcaacuuggacagauuaugcugcuuauacuuugcacaucccaaauccugcuaaugcguacgacaugggcauugugugagaguauaacgcuugccaccggcccucuuacgacauugugggaagggagucccggcaaauucuggaauacuacaauagcgguauccauggcuaacauauuucgagguaguuauuuggcuggagccggcuuagcauuuucuuugaugaagaguuuaggugguggcagaagaggcacuggagcacaaggagaaacccuuggagaaaaauggaaacggcaacuaaaucaacuaucaaaaagugaguucaauacguacaaaagaucugggauaauggaaguugaccgaucagaagcuaaggaaggccuaaaacgaggugaaacaacgaaacaugcuguaucacgcggcacagcuaaguuacguugguuuguagagcgaaaucuuguaaagccagaaggcaaaguaguagaucucggaugcgggaggggaggaugguccuacuacugcgccgggcuaaagaaaguuacagaagugaaggguuacacgaaaggagggcccggucaugaagaaccaauaccaauggccacuuacggauggaauuuagugaagcuacauucagguaaggauguguuuuucauaccaccagagaaaugugauacauuacuuugcgauauaggcgaaucauccccuaacccaacuauugaagaaggacgaacucuacggguacugaaaaugguagaaccguggcuaagaggcaaccaauuuuguauaaaaauacuaaacccauacaugccgucgguuguagagacccuugaacaaaugcaaagaaagcauggaggaauguuggugcgaaacccauugucacgcaacucuacucaugaaauguacuggguuucauguggaacaggaaacauuguaucugcuguaaacaugaccagucggauguuacuaaaccgguuuacaauggcccaccguaagccaacuuacgaaagggauguugaccuuggcgccgggacacgacaugucgcaguggaaccagaaguagcaaacuuagacauaauuggacaaagaauugaaaauauaaaacacgaacauaaaaguacauggcauuacgaugaagauaacccuuauaagaccugggcuuaccauggcagcuaugaggugaagccaagcgggagcgcuagcagcauggugaacgggguuguuaaacuucugacaaaaccaugggacguaauuccaauggucacucaaauugcaaugacagauacaacaccuuuuggacagcaaagagucuuuaaagaaaagguggauacacgcacuccaaaggcgaaaagaggaacugcgcagauaauggaagugacagcacgauggcuauggggcuuucucucacggaacaaaaagccgcggauaugcacaagagaagaguucacuaggaaaguacgcuccaaugccgcaauaggcgcgguuuucguugacgaaaaccaauggaacucggcgaaagaagcaguugaggacgaacgguuuugggaccucguccaucgagaaagggaauugcauaaacaagguaagugugcuacguguguauauaauaugaugggaaagagagagaagaaacuaggagaauuuggcaaagcaaaagggucccgcgcaauaugguacauguggcuaggagcccguuuccucgaguucgaagcgcuaggauuuaugaacgaggaucauugguuuaguagagaaaauagccuaucugguguagaaggagagggucuucauaaauugggauacauauuacgagacauaucaaaaauucccggagggaacauguacgcagacgacaccgcaggaugggauacaagaauaacagaagaugauuugcaaaaugaggccaaaauaacugauauaauggaaccuaaacacgccuuacuggccaaagccauauucaaacucacauaccaaaauaaaguugucagaguccaaagaccugcuaaaaacggaacgguuauggauguuauaucccgucgagaucaaagagguagcggacaaguugggacuuauggauuaaauaccuuuacuaauauggaagcacaauugauuagacaaauggaaucagaaggaauauucagcccuucugagcuagaaacuccuaaccuggcugaaaggguuuuagauuggcuggaaaaauacggaguagaacguuuaaagaggauggccaucaguggagacgacugcguaguuaaaccuauagacgaucgauuugccacggcucuaacugccuuaaaugacaugggcaaaguccguaaagauauaccacaaugggaaccuaguaaaggguggaacgauuggcaacaaguuccuuuuuguagccaucacuuucaccaguugauaaugaaagacggccgagaaauuguaguaccaugccguaaccaagacgagcuagugggacgcgcgaggguuagccaaggugcuggcugguccuuaagagaaaccgcaugccuuggaaaguccuacgcgcagauguggcaacuuauguauuuucacagaagagaucuacgguuggcagcaaacgcuauaugcagugcuguuccggucgauugggugccgacgucaagaaccacauggaguauucaugcacaucaucaauggaugacaacagaagauauguuaaguguuuggaaccgaguauggauugaggaaaaucccuggauggaagacaaaacccacaucucaaguugggaagaugugccauaucuagguaaacgugaagaccaauggugcggcucucuuauuggacugacugcuagagccacaugggcgacuaacauccaaguagcaauaaaucagguaagacguuuaauugggaacgaaaacuaccuugacuacaugaccagcaugaaacguuucaaaaaugaaucggauccagagggugcuuugugguga

SEQ ID NO: 22017 - RNA, 9879 nt, Artificial Sequence
  derived and/or modified CDS sequence (opt6) from DENV-1__HQ624984__SS-prME
uccguaacuauguuauugaugcucaugccaacagcccuugcuuuucauuuaacaacaagaggaggagaaccacacaugauugucucaaaacaagaaagaggaaagagccugcuguuuaagacaagugcagggguaaauaugugcacguuaaucgccauggauuugggggaacuaugugaagauacgaugacauacaaauguccuagaauuacugaagcagaacccgaugauguugauuguugguguaacgcaaccgacaccugggucacauacgggacuuguagucaaacuggugaacauagacgcgauaagagaagcguagcauuggcaccucacguugguuuaggguuagaaacgaggacugagacauggaugucaagcgaaucggcuuggaaacaaauucaacgaguugaaacuugggcacuuagacacccgggauuuacuguaauagcucuauuuuuagcccaugccauagguacguccauaacacaaaaggguauuauauuuauucuacugauguuagugaccccuucaauggcuaugcguuguguaggaauagguaguagggacuuugucgagggcuuaaguggggcuacuuggguugacguagucuuagaacauggaagcugugucacuaccauggcgaaagacaagccaacauuggauauagagcuauuaaaaacagaagugacuaaccccgcaaucuuaaggaaguuaugcauagaggcaaagaucagcaacacaacgacugacaguagaugucccacucaaggagaagccacauugguggaggagcaagacgcaaauuucguuugccgaagaaccuuuguagaucgugguuggggaaauggcugcggccuauucgguaaaggauccuuaauaacaugcgcaaaauuuaaauguguaacgaaauuagaggggaaaauugugcaauacgaaaacuuaaaauauuccguaauaguaacuguacacacaggugaccaacaucaagucgguaaugaaucaacugaacacggaacaaccgcaacuauaaccccacaagcaccaaccacggaaauccaauugacagacuacggcgcucugacucuggacuguucgccacguaccggccuugacuucaacgaaaugguuuuauuaacaaugaaagagaaaagcuggcuagugcacaaacagugguuucucgaucuuccgcuaccguggaccucuggggcauccacgucgcaagaaacauggaacagacaagaucuuuuggucaccuuuaaaacugcccaugcuaagaaacaagaaguaguuguguuaggcucacaggaaggcgcuaugcauacagcacugacuggcgccacugaaauucaaacuucuggaacuacaaccauuuuugccggacacuugaaaugucgacuaaaaauggauaaacuuacgcucaagggcaugucguaugucauguguacagguucguucaaauuagaaaaggaaguagcggaaacccaacauggcaccguucuagugcagaucaaauaugaagggacggaugccccauguaaaauuccguuuucaacgcaggaugagaaagguguaacucaaaacggcaggcugaucaccgccaauccgauaguuacagacaaagagaaaccagugaauauagaagcugagccuccauucggggaaaguuauaucguuauuggagcaggagaaaaagcucuaaaauuaagcugguuuaaaaaggggucgucuaucggaaagauguucgaagcuacugcccguggcgcgagaagaauggcaauccugggggauaccgcuugggacuucgguaguauuggagggguuuucacaaguguagguaaacugguacaucaaauauucgguacagcuuacgguguacuauuuucgggaguuucauggacgaugaaaauagguauaggcguauuauugacguggcugggacuaaauagcagaaguaccaguuugucaaugacaugcauagcugucggccuuguaacacuguaucuuggagucaugguucaagccgauagcggcugugucaucaacuggaaaggcagagaacucaaaugcgggaguggaaucuuuguuacaaacgagguucacacguggacggagcaauacaaauuucaagcggauucaccaaaaagguuaagugcagcgauaggaaaagcgugggaagaaggcgugugcggcauuagaucagcaacccgacuagaaaacauuauguggaaacagauaucaaaugaguugaaucauauacugcuugaaaaugauaugaaauucacggugguuguaggagauguugccggaauacuagcacaaggcaagaaaaugauacguccacaaccuauggaauauaaguauaguuggaaaagcuggggcaaagcaaagauaauaggugccgaugugcaaaauacuacguuuauaauagauggaccuaauacuccugaauguccggacgaucaacgugcauggaacauuugggaaguggaggauuacggauuuggcauauucacaacgaacaucuggcucaaguuaagggauuccuacacacagguaugugaccacaggcuuaugucugcagccaucaaagauuccaaggccgugcaugcggauaugggguacuggauagaaucagaaaagaaugaaacauggaaacuugcuagagcaucguuuauagaaguuaaaacuugcauuuggccaaaaucccauacauuauggucaaauggaguauuagaaucagaaaugauaauucccaaaauauauggaggaccuauaucacaacacaauuaccguccaggguauuucacccagaccgcagggccauggcaccuaggcaaacuagagcuagauuucgauuugugcgaggguacaacuguagucguugacgaacacuguggaaacagggggccaucguuaagaacgaccacagucacaggaaaaauaauacacgaaugguguuguagaaguuguacacucccaccauuaagauuucgaggugaggaugggugcugguaugguauggagaucaggccuguuaaagaaaaggaggaaaauuuaguaaaaucaauggugucggcaggcucaggagaaguagauucauuuagccuaggacuacuuuguauuucaauuaugauugaagaggugaugcguagucgauggucucgaaaaauguugaugaccggaacucucgcagucuuucuucuguuaauuaugggacaauuaacauggaaugaccucauucgacuuuguauuaugguuggagccaaugcaucagaucgaauggggaugggaaccacauacuuggccuuaauggcaaccuuuaaaaugagaccuauguuugcuguaggcuuacuuuuucgccgucuaacaagcagggaaguucuacuucuaacaauaggucuuucacuugucgccagcgucgaacugccuaacucauuagaagaacuaggggacggacuagcaaugggaauuaugauauuaaaauuguuaaccgauuuccaaagccaccaacuaugggcaacuuuauuaucgcucacuuuuauuaaaacgacuuucucauugcauuaugcguggaagacaauggcgaugguucuaagcauagucucucuuuuuccccuuuguuuauccacgacgucccagaaaacgacguggcuucccguuuuacucgguucucuagguugcaaaccacuuacaauguuucugaucgcagaaaacaaaaucuggggucgacgaaguuggccacuaaaugaagguauaauggcggucgggauaguuuccauccuuuuaagcucacuccucaagaaugauguaccgcuggcaggcccacuaauagcugguggcauguuaauagcuuguuacgugauaaguggaaguucagcggaucugaguuuagaaaaagccgcugagguaucuugggaggaagaagcagaacauagcggggcgucacacaacauuuugguagagguacaagaugauggaacuaugaaaauaaaagaugaagaaagagacgacacucucacaauccugcucaaagcuacuuuacuagcaguauccggaguuuauccacugaguaucccagcaacacuauuuguuugguacuuuuggcaaaagaagaaacagagaucagggguguugugggacacccccucuccaccggagguagagagggcuguuuuagaugacgguaucuacagaauaaugcaacgcggucugcucggaaggucacagguuggaguagggguauuucaggagaauguauuccauacgauguggcacguuacgcgaggcgcggugcuuauguaucaaggaaaaagacuagaacccucgugggcaucuguuaagaaggaccucauuaguuacgggggaggguggcgccuacaagguaguuggaacacaggugaggagguacaaguaauagcaguugaaccugguaaaaacccaaagaacguucaaaccgcaccgggaacauuuaagacaucagaaggcgaggugggagcaauagcuuuagacuucaagccaggaacgucaggaucaccuauaguaaauagagaaggaaaaauaguugggcuuuaugguaacggagucguaacgacgucugggacauaugugucagcaauagcccaagcaaaagcaucucaagagggaccccuuccagaaaucgaggacgagguauuucguaagcgaaauuuaacgauaauggaccugcauccaggaucagguaaaacaagaagauauuuaccagcaauaguaagagaggcaauaaagcgaaaauugcguacgcuaauauuagcaccaacgcgaguagucgcuagugaaauggccgaggcuuuaaaaggaaugccaauaagauaccaaacuacggcagucaaauccgaacauacagggaaagaaauuguagaccugaugugucaugcaacauucacaaugaggcucuuaagccccguacgcgucccgaauuacaauaugauuauuauggaugaggcacauuucacagauccaucaaguaucgcugccagaggauauauaucgaccaggguuggaaugggugaagcggccgcaauauuuaugacggcuaccccaccgggaucgguagaagcauuuccgcaaucaaaugcauugauucaagacgaggaaagagacauucccgaacgauccuggaacagcgguuacgaauggauuaccgacuucccaggcaaaaccgugugguuugugccaagcaucaaaagugguaaugauauugcaaauuguuuaaggaaaaauggaaaacgcgucauacaauuaucacguaaaacuuuugauacagaauaucagaaaaccaaaaacaaugauugggacuacguggugacaaccgauauaagcgagaugggggcuaauuuccgugcagauagagugauagaccccaggcgcugcuuaaaaccaguaauuuuaaaggauggcccggaacgugugauucuugcgggcccgaugccagugacugucgccucggccgcccaacgaagaggaaggauugggcgaaaucauaauaaagaaggcgaucaauauaucuauaugggucaaccacugaauaacgacgaagaucaugcucacuggacagaagcaaaaauguugcucgauaauaucaacacaccagaaggaauaauaccggcacucuuugaaccagagcgcgagaaaucagcggcaauagauggggaguaucgucugagaggcgaggcccgaaaaacauucguugagcugaugagaagaggcgauuuaccggucugguuaaguuauaaaguugcuucagaaggguuucaauauucagacagaagaugguguuuugauggcgaacgcaacaaucaaguguuagaggaaaauauggauguugaaaucuggacuaaagaaggagagagaaagaaacuucgucccagauggcucgacgcaagaacauauagugauccguuagcacuaagagaguucaaagaauuugcugcgggucgaagaagcguuaguggcgacuuaauauuagaaauaggaaagcugccacaacaccucacucaaagggcacagaaugcauuggauaacuuaguaauguuacauaauucggaacaagguggccgugcauacaggcacgcaauggaagaauuaccggauacaaucgaaacauugauguuauuagcguuaauagcaguauugacaggaggggugacacuauucuuuuuaucaggccguggauuggguaaaacaucaauaggacuccuaugugucauggcuucuagcguccuguuguggauggcaucaguagaaccucacuggauagcggcaaguauaauacuagaguucuuucuuauggucuuacuaauuccggaaccugaucgucagaggacaccgcaggacaaucaguuagcuuauguuguaaucgggcuucuauuuaugaucuuaacaguagcagcaaaugaaaugggucuauuagaaaccacuaagaaagauuuagggauuggacauguagcaguaggcaaccaucaucaugcugcuaugcuggaugucgaucuacaucccgcguccgcauggacgcuauaugcuguugcuacgacaaucaucacgccgaugaugcgccacacaaucgaaaauacaacagcaaauaucucuuugacagcuauagcaaaucaagcagcuauauugauggguuuagauaaaggauggccgaucagcaaaauggauauaggaguaccauuguuagcuuuagguugcuauucacaaguaaacccuuugacucuuaccgcagcuguccuaaugcuaguggcccauuacgcuaucaucggcccuggguugcaagcaaaagcuacaagagaggcgcagaaaagaacagcggccggaauaaugaaaaacccaaccgucgacggaauagucgccauagaucuagauccuguagucuaugaugcaaaauuugaaaaacaauugggacaaaucaugcugcuaauucucuguacaucacaaauuuuacuuaugagaacaacuugggcccuuugugaaucgauaacauuggcuacggguccacuaacaacguuaugggaagguucacccggaaaauuuuggaacacaacuauugcagugaguauggcuaauauuuuucgcgguucuuaucuagcuggggcggguuuagcauuuagucucaugaaaucucugggcgggggcaggcgagguacuggagcacaaggagaaacucucggggagaaauggaaacgacaacuuaaccaacuaaguaaaucugaauuuaauacauacaaacgcucagguauaacagaagucgaucguagugaagcuaaagaaggauuaaaaagaggagagaccacaaaacacgcuguaucaagggguacugccaaacuaagaugguucguggaaagaaaucuaguuaaaccagaagguaagguaauugauuuagguugugguagagggggauggucuuacuauugcgcggguuugaaaaagguaaccgaagucaaagguuauacaaagggcggucccggacacgaagaacccauaccuauggcaacguauggauggaaucuagugaaauuacauucuggaaaggaugucuuuuucauaccaccugaaaaaugugacacguuauugugcgacauaggcgaaucaucuccaaacccuacuauugaggaaggacgaacccuaagaguuuuaaaaaugguggaaccguggcuucgcggcaaccaauuuugcauaaagauacuuaacccguacaugcccagcgucguugagacccuagaacaaaugcaaagaaaacauggaggaauguuaguccguaacccacuuagucgaaacucuacacaugagauguauuggguuucaugcgggacuggaaacauaguuagugcugugaauaugacaagccgcaugcucuugaacagauucacaauggcucauagaaagcccacauacgaaagagauguagaucugggagcagggacuagacaugucgcgguagaacccgagguugcgaauuuggacauuauagggcaaaggauugagaacauaaaacaugaacauaagucuacguggcacuacgaugaggacaacccuuacaaaaccugggcuuaucacggaucauacgaagugaaaccuucggguagugcaucuucaaugguuaauggaguagugaaauuauuaacaaagccaugggacguaauaccuauggucacccaaauugcgaugacagacacaaccccguucggacaacaaagggucuuuaaagagaaaguagacacuagaacaccuaaagcuaagagaggcaccgcccaaauuauggaaguaacagcuaaauggcuguggggcuuucucucgcgcaacaagaaaccaagaauaugcacgagagaagaguuuacaagaaaaguaagauccaaugcugcuauaggugccguauucguggacgaaaaucaauggaauagcgcaaaagaagccguagaggaugaacgguucugggauuuaguccauagagaaagagaauuacauaaacaaggcaaaugugcaacuuguguauauaauaugaugggaaagagggagaagaaauugggagaguucggaaaagcaaaaggaucucgagccauaugguauaugugguugggcgcucgauucuuagaauuugaagcgcuuggauucaugaacgaagaucauugguuuucuagagaaaauagccuaucggggguggaaggugaaggguugcacaaauuaggguauauacuaagggacauuucaaaaauaccugguggaaacauguaugcugacgauacagccggcugggauacucguauuacggaggaugaucuacaaaacgaggcaagaauaacagauauaauggaaccugaacaugcgcuccuagcuaaaucuauuuucaagcuaacauaucagaacaaaguuguacgaguacaaaggcccgcgaagaacggcaccguaauggauguaauuagcagaagagaccaacggggaucgggacaagugggaacuuacggucuaaacacauucacaaacauggaggcacaguuaauaagacaaauggaaucugaagguauauuuucgccgagcgaacucgaaacaccuaaucuugcugagcgaguucuagauugguuggaaaaauacggcguugaacgguuaaaacgaauggcaauaucuggagaugauuguguugugaaaccaaucgaugauagauucgcaacugcauuaaccgcacugaaugauaugggaaagguucgcaaagauauaccacagugggaaccaagcaaaggcuggaacgacuggcaacaaguacccuuuuguucucaucauuuucaccaauuaauaaugaaagauggccgugaaauugucguacccugccgaaaccaggaugaauugguaggccgagcucgcguuagccaaggugccggcuggucccugagagaaaccgcuugucuaggcaaaucguacgcucaaauguggcaacuaauguauuuccaucgaagggaccuaagguuagccgccaaugccauuugcucugcaguaccuguagacuggauucccacuucacgcacuaccuggagcauacaugcacaucaccaauggaugacuacagaagauauguuaucaguauggaaccgugucuggauugaagaaaacccauggauggaagauaagacgcacauaaguucuuggggagacguaccguauuuagguaaaagggaggaccaguggugcggaagccuuauuggauuaacagcgcgugcaacgugggcuacaaauauacaaguagcaauuaaccaagugagaaggcucauaggaaaugaaaauuauuuggauuacaugacgaguaugaaaagauucaaaaacgaaucagacccggaaggagcguugugguaa

SEQ ID NO: 22018 - RNA, 9879 nt, Artificial Sequence
  derived and/or modified CDS sequence (opt6) from DENV-1__HQ891314__SS-prME
ucaguuacaauguuauuaaugcuaaugccuaccgcguuagcauuucaucuaacuacacguggaggugaaccucauaugaucguaaguaaacaagaacgggggaaaaguuuacuauuuaaaacaucugcagggguuaauaugugcacucuaaucgcgauggaccuuggagagcuaugugaggacacaaugacuuacaaaugcccaagaauaaccgaggccgaaccugaugauguugacuguuggugcaacgccacggacacauggguuacuuauggaacauguagucaaacgggagaacacagacgggacaaaaggagcgucgcauuggcaccccacguuggauuggggcucgagacacgcacggagacguggaugucaucagaaggagcauggaaacaaauucaaagaguggaaacuugggcacuucgacacccaggauuuaccguaauagcacuguuuuuggcacaugcaaucggaaccucaaucacacaaaaagguauaauuuucauccugcuaaugcuaguaaccccaucaauggcgaugcgcugcguugguaucggauccagggauuuuguggaagggcuaucgggagcuacaugggucgacguaguucuagagcacgggucaugugucacuacaauggcgaaagauaaacccacuuuagacauagaguuacuuaaaacagaaguaaccaauccugcaguacugagaaaacugugcauugaagcuaaaauuucaaacacaacgacagacaguagaugcccaacucaaggggaagcaaccuuaguugaagaacaggacgcgaacuucguaugucggaggacauuuguugaccgaggaugggguaauggaugugguuuauuuggaaaagguucgcucuuaaccugugcuaaauucaaaugcgugacaaaacuggaaggcaaaaucguacaauacgaaaacuuaaaauacagcgucauaguuaccguacauaccggagaccaacaccaaguagguaaugaaucaacggagcacgguacaacugcaacaauuacuccccaagcaccaacaacagagauucaacuuacagauuacggugcacuuacauuagauuguucaccgcgaaccgggcuagauuuuacagagaugguuuugcuaacgaugaaagagaaaagcuggcucguucacaaacaaugguuccuugaccuaccguuaccuuggacaucaggagcaucaacaagucaagaaacuuggaaucgacaggaccuacucgugacguuuaaaacagcacaugcaaagaaacaggaaguugucguacucggaagucaggagggugcaaugcacacggcacuaacaggggccacugaaauccaaacaucaggaacaaccacaauuuucgcaggucacuuaaaaugccgccucaaaauggauaaacucacucuuaaagguaugucauauguaauguguaccggauccuuuaaauuagaaaaagaagucgccgaaacucagcaugggacaguccuaguacaaauaaaauacgaagggacagaugcgccgugcaaaauaccuuuuaguacacaagaugaaaaaggaguaacgcagaauggacgauuaauaacggcuaauccuaucguuacagacaaagaaaaaccuguuaauauagaggcggaaccacccuucggggaaucuuauauuguaaucggagcuggugaaaaagcauugaaauuaucuugguucaagaaagguaguagcauagggaaaauguuugaagcaacggcacguggugcccguagaauggccauuuuaggcgauacggcaugggauuucgggaguaucggugguguuuucacuagcguggguaagcuaguucaucaaauauuuggaacagcauacggaguucuauucuccggagucucauggacaaugaaaauaggaauugggguucuacucacguggcuuggucuaaauaguagauccacaaguuuaucaaugacaugcaucgcuguaggauuagucacacucuacuuagggguuaugguacaagcugauucgggaugugugauaaauuggaaaggucgagaauugaaaugugggucagguauuuuuguuacgaaugaaguucacacuuggacagaacaguauaaauuccaagcugauucaccgaaacgacuaagugcagccaucgggaaagccugggaggaagguguguguggcaucagauccgcaacuagacuugaaaauauaauguggaaacaaauuucuaacgagcuaaaucauauauuauuggagaacgauaugaaauucaccgucguagugggugacguggccggaauauuagcacaaggaaagaaaaugauacggccgcaaccuauggaacacaaauacucuuggaaaaauugggggaaagcaaaaauuaucggcgcugacgugcaaaauagcaccuucauuauagacggaccaaauacaccagaauguucagacgaucaacgcgcuuggaacauuugggaagucgaagacuacggauuuggaauuuucacgacgaacauuugguuaaaauuaagagauaguuauacacagguaugugaucaucgauuaaugucugcagccauuaaagauucaaaagcgguacacgcagauaugggauauuggauagaaucugagaaaaaugaaacuuggaaauuagcacgugccucguucauagaagucaaaaccugcauauggccuaaaucacauacucucuggucgaauggcguucuagaaagugagaugauaauuccaaagauauacggaggaccaauaagucagcacaauuaucgaccgggguacuuuacccagacagcaggucccuggcaccuugguaaacuugaauuagauuucgaccuuugcgaggguaccacaguuguuguagacgagcauugcggaaacaggggucccagcuuacguacgacgacaguuacggguaagauuauacacgagugguguugcagaagcugcacauuaccgccucuaagguuucguggggaagaugggugcugguacggaauggaaauuagaccagugaaggagaaggaggagaaccuaguuaaaucgaugguuagugccgguucgggcgaaguggacucauuuaguuuaggucuacuauguauaucaauaaugauugaggaagucaugaggucgagauggucuagaaaaaugcuuaugacaggcacuuuagcuguauucuuuuugcucauaaugggacaacuaacguggaacgaucucauucgcuuauguauaaugguaggggcaaaugcgagcgacagaaugggaaugggcacaacauacuuagcuuuaauggcaacauucaaaaugcgaccgauguucgcuguaggauugcuauuuaggcguuuaaccucgagagagguccuuuuacucaccauuggucuaaguuuaguagcuaguguggaacugcccaacucauuagaagaauuaggugacggucuugcaauggguauuaugauacuaaaacuacuaacagauuuccaaucucaucagcugugggcgacauuauuaucuaugacauucaucaagaccaccuuuucuuuacacuaugcuuggaagacuauggccauggucuugagcauuguaucuuuauuuccucuuugucuuucaacaacuagccaaaagacaacauggcuuccggugcuacuuggaucacuaggcuguaaaccauuaacaauguucuugaucgcagaaaauaaaauauggggacguaaaucuuggccgcuaaacgaaggaauaauggcugucgguauugucucuauauugcucucaucauugcucaaaaaugacguucccuuagcaggaccguuaauugcagggggcaugcuaauugcauguuacguaaucagcggguccagcgcugauuuaucguuagagaaagcagcggaaguaaguugggaagaagaagccgaacacucaggagcgucacacaauauacuuguugagguucaagacgacggaacaaugaagauaaaagaugaagaacgugacgauacucucacaauauuacucaaggcuacacuauuagcggugucuggcguauaucccuugucgauaccagcaacuuuauuugugugguauuuuuggcagaagaagaaacaacgaucugggguauuaugggacacaccaaguccuccaaaaguagagcgcgccguacuugacgauggcauauacagaauaaugcaacgaggucuuuuggggcguucucaaguuggagugggaguauuccaagaaaauguauuucacacaauguggcacguaacgagaggagccguauugauguaucaaggcaaacgacuagaacccucuugggccagugugaagaaagaucuaauaucuuacggaggagguuggaggcuacaggguucauggaauacuggagaagaggugcaagucauagcagucgaaccuggcaaaaaucccaaaaacguucagacugcaccaggaacuuucaagacaccugagggugaggugggagccauagcacuugauuuuaagccgggaacauccggaucuccuauuguuaauagagaaggaaaaauuguaggucucuacgguaauggcgugguaaccacaaguggaacauauguaagugcaauugcacaagcuaaagcaagucaagaaggaccgcuaccagaaauagaagacgaagucuuccgaaaacguaaucucacaauaauggauuuacauccugguagugggaaaacaaggcgauaccuuccggcaauaguaagagaagcuauaaaacgaaagaugagaacacuuauucuggcacccacgagaguuguugccucagaaauggcugaggcacuaaagggaaugccaauacguuaucaaacaacugccguuaaaucagaacauacuggcaaagaaauaguugaccuuaugugucacgccacauucacgaugagacuauuaucaccugugcgcgugccaaacuauaacaugauuauuauggacgaagcucauuucacggaucccucaucaauagcagcacggggcuacauuucuacacgaguggguaugggcgaggcagcugcuauuuuuaugacagccacacccccggguagcguugaggcuuuuccucaaucaaaugcgguaauucaagacgaagagagggacaucccggagcgaaguuggaacucaggauaugaauggaucacugacuuuccuggaaagacaguuugguuugugccgaguauuaaagcggguaaugauauagcaaauugcuugcgcaaaaaugggaaaagggucauacaacuaucuagaaaaacuuucgauacagaauaccaaaagacaaagaauaaugauugggacuauguuguaacuaccgacaucucugaaaugggcgcuaauuucagagccgacaggguuauagauccgcggagaugcuugaagccaguaauauuaaaagauggcccggaacggguuauucuggcagguccaaugccagucacaguagcuucggcugcacaacgaagggggaggauaggaagaaaucacaacaaagaaggggaucaauacauauauauggggcaaccccuuaauaaugaugaagaccaugcacacuggacagaagcaaaaauguugcuugacaacaucaacacaccagaagggauuauuccugcccuuuuugaaccugaacgggaaaaaucggcagcuauugauggugaauacaggcuacguggugaggcacggaagaccuucgucgaacuaaugcgacgcggcgaucuuccagucuggcucucuuauaaaguugcaucagaaggauuucaauauuccgaucguagaugguguuucgauggagagcggaauaaucaagugcuggaagagaauauggauguagaaaucuggacaaaagaaggugagcgaaagaaacuacggccacguugguuagaugcccggacauauucagauccucuggcacucagagaauuuaaggaauuugccgcaggaaggcgaucaguaucuggagauuuaaucuuagaaauaggaaaacucccccaacaucuuacccaacgugcacaaaacgcauuagauaaucuuguaaugcuacauaacucggaacaggguggaagggcuuacaggcaugccauggaggaacuaccugacacuauugagacacugaugcuuuuagcauuaauagcugugcucacuggagggguaacauuauuuuucuuaucgggaaaaggacuugguaagaccuccaucggauuacuuuguguaauggcuaguucugcccuacuuuggauggcuagugucgagccacauuggauagcugcguccauuauucuagaguucuuucugaugguauuauugauaccagaaccagacagacaacguacuccgcaagacaaccagcuagccuauguaguaauaggcuugcuauucaugauacugacggucgcagcgaaugaaaugggucuauuagaaacaacgaagaaagacuuaggaauagggcaugucgcagucgaaaaccaucaucacgcugcaaugcuagauguagaccuccaccccgcuagugcauggacucuuuacgcuguagcgaccacgauaaucacucccaugaugaggcauacaaucgaaaacacaacagcaaauauaucguuaacagcgauagcuaaccaagcugccauuuuaaugggccuugacaaggguuggccuauaucuaagauggauauaggggucccacuauuagcuuugggauguuauagccaaguaaacccauuaacacugacugcggcaguacuaaugcuuguggcucacuaugcgauuauaggaccgggauugcaagcaaaagcaacucgcgaagcacagaaaagaacagcggcuggaauaaugaaaaaucccacaauugauggcauagucgcaaucgaccuagaccccguagucuacgaugcgaaguuugaaaaacaacucggacaaauaaugcuacuaauauuguguacaucccaaauauuacuuaugcggacaacaugggcacuuugugagagcaucacucuagcaacuggaccccuaacaaccuuaugggaaggaucuccuggaaaauucuggaacacuaccauagcaguaucuauggcaaauauuuuucggggaucguaucuggcuggagcaggacuagcguucucacuaaugaaaagucugggaggaggcaggcggggaaccggagcucaaggagagacuuuaggagaaaaauggaagcgccaauuaaaucaacuaaguaaaagugaguuuaacacguacaagcgcaguggaauaauggaaguugaucguagugaagccaaggaaggucuaaaaagaggcgaaaccacgaaacaugcagucagucguggaacggcaaaacuaaggugguuuguagagagaaaucuggucaagccagaaggaaaaguaauagaucucggcugugguagaggaggauggagcuauuacugugcagguuugaagaaaguaacagaggucaaaggcuauacaaaagggggcccuggacacgaggaaccuaucccaauggcuacauaugguuggaaccuagucaaacuacauucggguaaagauguauucuuuauuccaccugaaaagugcgacacucuuuuaugugauauaggcgagucauccccgaacccaacuauugaagaggguagaacuuuaagaguguugaagaugguggaaccaugguuacgaggaaaucaauuuuguauaaaaauucuuaauccauacaugccaucaguaguagaaacauuggaacagaugcaacggaaacaugguggaauguuagugaggaauccacuuagcagaaauaguacccaugaaauguacugggugaguugcggaacgggaaacauuguuagugcaguuaauaugaccucucguauguuacugaaccgauucacaauggcccacaggaaaccaacauaugaacgcgacguggaccuaggagccggaacgagacauguagcuguagagccagaagucgccaacuuagauauaauagggcaacggauagaaaacauuaagcaugaacacaaguccacauggcauuaugaugaggacaauccuuauaagacaugggcuuaucacgguagcuaugaaguaaaaccuucuggcucugcaucaucuaugguuaauggugucgucaaauuauugaccaagccaugggauguaauaccuaugguaacacagauagccaugaccgauacuacaccguuuggacaacaacgcgucuuuaaagagaagguagauaccagaacaccgaaagccaagcguggaacggcacaaauaauggaggugacugcuaggugguuauggaguuuccuuagccguaacaagaaaccaagaauuuguacgcgggaagaauuuacgagaaagguaaggucaaaugccgccauaggcgcagucuucguugaugagaaccaauggaacuccgcgaaagaagcaguagaagaugauagauuuugggaccuaguucacagagaacgagaguuacacaaacagggaaaaugcgcaacuuguguuuacaauaugaugggaaaaagagagaagaaacuaggagaauuuggcaaagcgaaagguagccgagccaucugguauauguggcuuggagcaagauuccucgaauuugaagcacuggguuuuaugaacgaagaucacugguucucaagagaaaauucguuaaguggugucgaaggagagggacuucauaaauuaggguacauucuccgggacauaaguaagauaccuggaggaaauauguaugcagacgacacugcuggaugggauacaaggauaacugaagaugauuuacaaaaugaagcaaaaauaaccgauauaauggaaccugaacaugcguuacuagcaaaauccauauuuaaguugaccuaucagaauaaaguagugcgcguccaacguccagccaaaaaugguacgguuauggaugucauaaguagaagagaccagagaggaucgggccaaguagguacauacggguugaauaccuuuaccaacauggaggcgcaauuaauuagacaaauggaaucggaagaaauauuuucuccgaaugaacuagaaacccccaauuuggcggaacgcguuuuagacugguuagaaaaguauggugucgaacgauuaaaaagaauggcuauuucaggcgacgauuguguaguaaaaccaaucgaugauagguucgcgacagcauuaacggcacuaaacgauaugggaaagguaagaaaggauaucccacaaugggaaccaagcaaaggcuggaaugacuggcaacaagugccguucuguagucaucauuuucaucaguuaauaaugaaagauggaagagaaaucgucgucccuugucgcaaucaagaugaauugguuggcagagcaagaguaagucagggcgcaggauggagucuacgagaaacggcgugucuugguaaaagcuaugcgcaaauguggcaacucauguauuuccauagaagagacuuacgauuggcagccaacgccauuuguagugccguuccuguagauuggguuccuaccucacguacaaccuggaguauucaugcgcaccaccaauggaugacuacugaggauauguugaguguuuggaacaggguauggauagaagaaaauccauggauggaggacaaaacgagaguaaguucaugggaagacgugccuuaucucggcaaacgagaggaucaauggugcgguagcuuaauagguuugacggcuagagcaacaugggcaacaaauauucaagucgcuaucaaucaaguacggcguuugaucggaaacgagaauuauagugacuacaugacgaguaugaaaagauucaagaaugagucggaacccgagggcgcacuaugguaa

SEQ ID NO: 22019 - RNA, 9879 nt, Artificial Sequence
  derived and/or modified CDS sequence (opt6) from DENV-1__HQ891315__SS-prME
ucaguaacuauguuacuaaugcuuaugccgacggcguuagcauuucaccuaaccacgcgcgguggagaaccacacaugauagugucgaaacaggaaaggggaaagagcuuauuguucaaaacaucagccggaguaaacauguguacguugaucgcaauggaucucggagaacugugcgaagauacaaugacauacaaauguccccgaauuaccgaagcagaaccagaugacguagauugcugguguaacgcaaccgacacuuggguaacauacgguacuugcagccaaacaggggaacaucgaagagacaaaagaucugucgcgcuugcaccgcacguaggauuggguuuggaaacaagaacugaaacauggaugaguagugaaggcgcuuggaaacaaauccaaagaguugaaacuugggcucucagacaucccggauuuacuguaauagcguuguuucuugcucacgcgaucggaaccaguauaacucaaaaaggaauaaucuuuauucucuuaaugcuagugacuccaucuauggcuaugcgaugugucgguaucgggucucgugauuuuguugaagguuuaucuggagccacuuggguggaugucguccuugaacaugggucaugugugacaacuauggcaaaagauaaaccaacacuugacauagaauuacugaaaacugaagucacuaacccagcuguacugcgaaaauuaugcauagaagcuaagauaucaaauacgacaacggauucaagauguccaacacaaggcgaagcaacauugguagaagaacaagaugccaauuuuguaugucgacgaacguuuguagauaggggauggggaaaugguugcgggcuauucggaaaagguucacuuuuaacaugugcuaaauuuaagugcgucacgaaauuagaaggaaaaauugugcaguacgaaaaucuaaaguauuccguaaucgugacaguacacacgggugaccaacaucagguagguaaugaaucgaccgagcauggaaccacagcgacaauuacaccucaagccccuaccacugaaauucaguuaaccgauuauggggccuuaacuuuagacugcucacccaggacagguuuagauuuuaaugaaaugguguuacuuaccaugaaagagaaaaguugguugguacauaaacaaugguucuuagauuuaccacuaccauggaccucaggggcuagcacaucucaggagacauggaacagacaggacuuguuaguaacauucaaaacugcacacgccaagaaacaagaaguagugguauuaggaucacaggagggagcaaugcauacagcacuaacuggagcaacagagauccagacaucagguaccaccacgaucuucgcgggacaucuuaaaugcaggcucaaaauggauaaguuaacacuaaaaggaaugagcuacguuaugugcacagguuccuuuaagcuggagaaggaaguugcagagacgcaacacggaacggucuuaguacaaauuaaauacgaagguacagaugcgccguguaaaauuccauucucuacucaagaugagaaagggguaacgcaaaauggucgacugauaacagcgaaccccauuguuacagauaaggaaaaaccaguuaauauagaagcggaaccgccauuuggagagucauacauaguaauuggugccggugagaaggcccuaaaacuaucuugguucaaaaaggguaguucaauaggaaaaauguucgaggcaaccgcucguggagccagacgcauggccauucugggugacaccgcgugggacuucggaagcauaggaggggucuucacaaguguggguaaauuaguacaccaaauauuuggcacagccuacggaguucuguucucgggcguuagcuggacaaugaaaauaggaaucggaguauuacuuacauggcuaggucuaaacucacgcagcacaagccuaucaaugacaugcaucgcugucggucuaguaacacuauaucuuggagugaugguucaagccgacaguggcugcgucauuaauuggaaagggcgugagcuaaaaugugggucagggauuuuugugacaaaugaaguacauaccuggacugaacaauacaaauuucaagcggauuccccuaaaagacuaucagcugcuauagguaaggcaugggaagaaggggucugcggaauaaggucggccacccgcuuagaaaauauaauguggaaacaaauaaguaacgaauuaaaucauauuuugcucgaaaaugauaugaaauuuacugucguuguuggagauguagcggggauccuggcacaaggcaagaaaaugauaagaccgcaaccgauggagcauaaauauucauggaaaaauuggggcaaagccaaaauuauuggagcagacgugcaaaacucaacauucauuauugaugguccaaacacuccagaauguagugaugaucagcgcgccuggaauauuugggaaguagaagauuauggguuugguaucuucacaacuaauaucuggcuuaaacuucgagauucguauacacaagucugugaccacagacuaaugagugcugcaauuaaggauaguaaggcaguacacgcagauauggguuacuggauugaauccgagaaaaaugagacauggaaguuagcuagagcuaguuucauugaggucaaaacauguaucuggccaaaaagccauacucuauggucgaaugguguucuugaaagugaaaugauaauaccaaagauuuaugguggaccaauaagucagcacaacuaucgaccaggguauuuuacucaaacugcgggcccuuggcauuugggaaaacucgaacuagauuuugaccucugugagggcacaacaguaguaguggaugaacauugcggaaacagagggccaucauuacgaacgacaacaguaacugggaagauaauacaugaauggugcugcagauccugcacccugccaccguuacgguuuagaggggaagauggcuguugguacgggauggaaauucgaccugucaaagaaaaagaagaaaaucuugugaaaucuauaguguccgcugguagcggugagguagauucauuuucacuaggacuccuuugcauuucgauuaugauagaagaagugaugcgcucgagauggagucguaaaauguugaugacagggacucuagcaguauucuuucuacucaucaugggucaauuaacuuggaaugaucuuauaagauuauguauaauggucggagcaaaugccucagacagaauggguauggguacaacauaucuggcccugauggcaacauucaaaaugagaccgauguuugcuguuggauuacuuuuucggcgacucacuucaagagagguauuacuucucacuauaggacuuucauugguugccucuguagaacuaccaaauucacuugaagaguuaggugauggucuggcgaugggaauaaugauacuaaaauuguuaacagacuuucaaagucaccagcuuugggcaacccuuuuaucgaugaccuucauaaaaacuacauucucuuuacacuacgcauggaaaacuauggcaaugguacuaagcauagugagucuguuuccauuaugucuaagcacaaccagucaaaagacuaccuggcuacccguuuugcuuggaagucuagguuguaaaccucuaaccauguuuuuaauugcugaaaauaaaaucuggggucgaaagaguuggccccuaaaugaaggaaucauggcuguagggauaguuucuaucuuacuaaguucacugcucaaaaaugauguuccacuagcaggcccacugaucgcaggagguaugcucauugccugcuaugugauuucggggucuagcgcagaucuuaguuuagagaaagcggcugaagugucaugggaagaagaagcagagcauaguggggcaucacauaauauccuugucgaaguacaagaugacgggaccaugaagauuaaagaugaagagagagacgacacauugacaauauuguuaaaagcaacucuguuagcaguaaguggaguuuacccacuuuccauacccgcgaccuuauucguaugguacuuuuggcagaagaagaaacagcgcagcggaguacucugggauacaccaaguccgccaaaaguugaacgagcaguauuggaugauggaauauaccgaauaaugcagcgagguuuauuagggcguucucaagugggaguaggagucuuccaagaaaauguauuucacaccauguggcaugucacaagaggugcuguauuaauguaucaaggcaaacgacuugaaccgucaugggcuuccguuaagaaagaucucaucagcuaugguggcgguuggagauuacaggguucauggaauacaggugaagaaguucagguaaucgcuguagaaccgggcaaaaauccuaaaaacguacaaaccgccccuggaacauuuaaaacacccgaaggcgaaguuggcgccauagcauuagacuucaaaccuggcaccucggguaguccaauugugaacagggaagguaaaauuguaggauuauacggaaauggggugguuacaaccagcgguacauauguaagugcaauagcgcaagccaaagccagccaagaggggccucuaccagaaauagaagacgaggucuucagaaaaagaaaccuuacuauaauggauuuacauccagguagcgguaaaacacggagguaccugccagcaauuguacgagaagcaauaaaacgaaagaugagaacccuaauuuuggcaccaacacggguaguagcaucggaaauggcggaagcauuaaaagguaugccaauacgcuaccagacgacggcagucaagucagagcauaccgguaaagaaauaguagauuuaaugugucacgcaacauucaccaugcgcuuauuguccccagucagggugcccaauuauaacaugauuauuauggaugaagcccauuuuacagacccaaguucaauagccgcaagaggauauauuuccacaagagucggcaugggagaggcggccgcgauauuuaugacagcuacuccaccgggaagcguugaagccuuuccacaaaguaaugccguaauacaagacgaggaacgcgacauuccggaacguuccuggaacucaggauaugaauggauaacagauuucccgggaaaaacugucugguucguuccgagcauuaaggcggguaaugauaucgcgaacugcuuacguaaaaacgguaaaagaguaauucaauugucucggaaaacauucgauacagaauaccaaaagaccaaaaacaaugauugggauuaugucguuacaacggacauauccgaaaugggagcuaacuuucgugcggauagaguaauagacccacggaggugucuaaaaccggugauuuuaaaagacggucccgagagaguaauuuuagcaggaccaaugccuguaacuguagccagugcagcgcagcggagaggaagaaucgggcgaaaccacaauaaagagggugaccaguacaucuacaugggucagccuuuaaauaacgacgaggaccaugcacacuggacagaagcuaaaaugcuacucgacaauaucaauaccccagaagggauaauuccagcguuauucgagccagaaagagaaaaaucagcagcaauagauggcgaauaucgguuacguggggaagcucgaaaaaccuuuguagaacuaaugagaaggggcgaucuaccaguuuggcuauccuacaaaguagcuucagaagguuuccaguauucugauaggaggugguguuuugauggagaacgcaacaaccaaguacuggaagaaaauauggacguugaaauauggacuaaagagggggagcgcaagaaacuucgcccccgauggcucgaugcccgaacguacucagauccauuagcccuaagagaauuuaaagaauuugcggcgggcagacggaguguuucgggggaucuuaucuuagaaauuggcaagcuaccgcaacaucuuacacaaagagcucagaacgcauuagauaauuuaguuauguuacauaauagcgaacaaggcggacgagcuuauaggcaugcuauggaggagcuaccagacacuauagaaacccuaaugcuccuugcccuaauugcaguauuaacaggugggguaacacuauuuuuccucagugggaagggucuaggcaaaacaaguauuggguuacuauguguuauggccucaagugcccuccuuuggauggcaucagucgaaccacauuggaucgccgccaguauaauccuugaguucuuuuuaaugguucuuuuaauaccagaaccagauagacaaagaacaccacaagauaaucagcuugcauaugugguuauuggccuccuuuuuaugauauuaacaguagcugcaaacgaaaugggguuauuagaaacaacuaagaaagauuuaggaauuggacauguugcuguggagaaucaucaccacgcugccauguuagacguugaucuccauccggccucagcauggacauuauaugcuguagcgacuacaauaauaacgccgaugaugagacacacuauagaaaauacaaccgccaauauuucguuaacugcaaucgccaaccaagccgcaauauuaaugggucuggauaaagguuggccaaucucgaagauggauauagggguaccccugcuagcgcuuggaugcuacagucaagugaauccucuuacacuuaccgcagcaguuuugauguuagucgcccacuaugcuauaaucgguccugguuuacaagcaaaagcaacccgggaagcccaaaagaggacagcugcagggauuaugaagaacccaacuauugauggaauaguugcuauagacuuagacccaguaguuuaugaugcuaaauucgagaaacaauuaggccaaauaaugcuacuuauuuuguguaccagccagauccuuuuaaugagaacaacgugggcccuaugugaaucaauaacauuagcaacaggcccccucaccacguuaugggagggaucuccggguaaauuuuggaacaccacaauugcuguuucgauggcaaauauauucaggggcaguuauuuagccggcgcgggauuagcuuucucacucaugaagucuuugggaggagggaggagagguacuggugcucaaggagagacauuaggagaaaaauggaaacgucaacuaaaucaguuaucaaaaucggaauuuaauacuuacaaaagaucggggauuauggaaguagacagaucagaagcaaaagaggggcuaaaaagaggugaaacgacuaaacacgccguuagcagaggaacagcaaaguuaaggugguuuguagaaagaaaccuagucaaaccugaaggaaagguaauagaccuuggaugcggaagaggagguuggucauauuacugugcaggacucaagaaaguaacagaaguaaaaggauauacaaaaggaggcccgggccacgaggaaccgauccccauggcaacauaugguuggaaccuuguaaaacuacacaguggaaaagacguauuuuucaucccaccugaaaagugcgauacacuccuaugugauaucggugaaucuaguccuaacccaacuauagaagaaggacggacgcuccgaguguuaaaaaugguagaaccuuggcuaagaggcaaccaauuuuguauuaaaauucuaaacccauacaugccaaguguuguggaaacacuagaacaaaugcagcgcaaacacgggggaaugcuaguuagaaauccccugucuaggaacuccacucacgagauguauuggguuucuugcgguacaggcaauauagugucugcaguuaauaugaccucccguauguuguuaaaccgauuuacaauggcacaccguaaaccuacauacgaaagagacguagacuugggagcugguacgcgacacguugcaguagaaccagaaguagcuaaucuugauauaauaggacaaagaauagaaaacauaaaacaugaacauaaaaguacuuggcauuaugacgaagacaacccuuauaaaacuugggcuuaucacgguaguuaugaaguuaaaccuagcggaagcgcuagcuccauggugaauggcgugguaaaauuauuaacgaagccuugggacgugauuccaaugguaacucaaauugcaaugacugauacaaccccuuuuggucagcaaagaguauucaaagaaaaggucgacacaagaacuccaaaggcuaaacguggaaccgcccagaucauggagguaacagcgcgaugguuauggucauuccuuucccggaauaagaaaccgagaauauguacgcgagaagaguucacaagaaagguaaggucaaaugcagcaaucggagcaguuuuuguugaugaaaaucaauggaacucugcaaaggaagcaguggaagacgauagauucugggacuuagugcaucgagaacgggaacuacacaagcaagggaagugugcaacaugcguauauaacaugaugggcaaaagggaaaagaaauugggagaguuugguaaagccaaggguucuagagccauaugguauauguggcugggugcucgcuuucuagaguucgaggcuuuggguuucaugaaugaagaucacugguuuuccagagaaaauucguuaucagguguagaaggagaaggauugcauaaacuuggauacauacugagagacauaucaaaaauaccuggggguaacauguacgcagaugacacggcuggaugggacacucgaauuacugaagacgaucuccaaaacgaggcaaagaucaccgacauaauggaaccagaacaugccuuacuugcuaaaaguauauucaaacuuacauaucagaacaaagugguacggguacaacgaccggcgaagaauggaacgguaauggaugucauuucuagacgugaucagagggguucuggacaagucggaacguacggacuaaacacauuuacgaauauggaagcacaacuuauacgacagauggaaucagaagagauauucucacccaacgagcuugagacuccaaaccuggccgaaagaguucuagacugguuagaaaaguacgguguagaaagacucaaacguauggccauuucuggagaugauugcguaguaaaacccauugaugaucgauuugcaacugcauuaacugcccuaaacgacauggggaagguuaggaaagauauuccacaaugggaaccgucaaaaggcuggaaugauuggcagcaaguuccuuucuguucucaccacuuccaccaacuaaucaugaaggauggacgggagauagucguaccauguagaaaucaggacgagcuaguuggcagagcacguguuucucaaggggcaggauggagcuuaagagaaacagccugcuuaggaaaaucuuaugcacagauguggcaguuaauguauuuucaucgacgagauuuacgccucgccgcaaacgccauuugcucugcaguaccaguugacuggguuccuacaucaagaaccaccuggaguauacacgcucaccaccaauggaugacaacggaagacauguugucgguauggaaccgaguuuggaucgaagaaaacccuuggauggaagacaaaacaaggguaaguucaugggaagaugucccguauuuaggaaagagagaggaccaauggugugguagccuaauaggauuaacagccagagcaacuugggcaacaaauauucaaguggcgauaaaccaaguucguagauugauagguaaugaaaacuacuccgauuacaugacuuccaugaagcguuuuaaaaacgaauccgaaccugagggcgcauuaugguaa

SEQ ID NO: 22020 - RNA, 9879 nt, Artificial Sequence
  derived and/or modified CDS sequence (opt6) from DENV-1__HQ891316__SS-prME
agugucacgaugcuacuuaugcuaaugccgacggcucuggcuuuucaccuuacuacuagaggaggggaaccucacaugauaguuucaaaacaagaacgagggaaaucauuacuguuuaaaacaagcgcugggguuaauaugugcacuuuaauagcaauggaccuaggagaauuaugugaagauacaaugacauauaaauguccucggauaacagaagcagaacccgaugauguugauuguugguguaaugcaacagauacgugggucacuuacggaacuugcucgcaaacaggagagcauagaagagauaaaagauccguggcacuagcaccgcauguagggcuagguuuagaaacgagaacagagacauggaugaguagugagggagcguggaaacaaauucaacgaguagaaacaugggcuuuacgacacccuggauuuacaguaauagcccuauuucuagcacacgcuauaggaacaucaauaacacagaaaggaauaaucuucauacuauugauguuagucacucccucaauggccaugagaugugugggcaucggaucucgugauuucguggaaggacuaucaggugccacuuggguagauguaguguuagaacauggcucaugugugacgacuauggcuaaagauaaaccgaccuuagauauugaauuacuuaaaacagaaguuacaaauccggcaguuuuaagaaaacugugcauugaggccaaaauuucuaacacaacaaccgauaguagaugcccuacgcaaggagaagccacuuugguugaggaacaagaugcaaauuucguaugucgacguacauuuguggaucguggcugggguaauggcugcgguuuauuugggaaaggcucuuuauuaacaugugcuaaauuuaaaugugucacaaaacuagaaggaaaaauaguucaauacgaaaaucuaaaauauagcguuaucgugacagugcauacuggagaccaacaucaaguuggaaacgagucaacagaacaugguacuacagcuacaauuacgccacaagcuccaaccacagaaauucagcugacggauuacggugcacuaacgcuagauugcucgccaagaacaggccuagauuuuaacgaaaugguauuauuaacgaugaaagagaaauccugguuaguccacaaacaaugguuccuugaccucccauuaccuuggaccucgggugccucaacuagccaagaaacguggaaccgucaagauuuauuggugacguuuaaaacagcacaugcaaagaaacaagaaguaguaguauuaggaucgcaggaaggggcuaugcauacagcacucacuggugccacugagauucaaacaucaggaaccacgaccauuuuugccggacauuuaaaauguaggcugaaaauggacaaauuaacauuaaaaggcaugaguuacguaaugugcacggggagcuuuaaauuggaaaaagaaguugcagaaacacagcaugggacugucuuagugcagauuaaauaugaaggaacugacgcgccgugcaagauaccauuuagcacacaagacgagaaaggaguuacacagaauggcagacuuauuacagcgaacccuaucguuacggauaaggaaaagcccguuaacauagaagcugaaccaccauucggagaaucauacauaguuauaggcgccggugaaaaagcauuaaaacugagcugguucaagaaaggaagcagcauaggaaaaauguuugaagcaacggcaagaggcgcacguagaauggcaauacuuggagauacagcuugggauuuugguuccauaggaggaguauuuacaaguguagguaaacuugugcaccaaaucuuuggaacugcuuacggaguucuauuuucaggaguaucauggacaaugaaaaucgggauaggagugcuauuaacgugguuaggacuaaauucaaggucuacgaguuuaaguaugacaugcauugcagugggauuagucacucuguauuuagguguaaugguacaagcagacagcgguugcgucauaaauuggaaaggucgagaacuaaaguguggaucgggaaucuucgucacuaacgaggugcauacauggacagaacaauauaaauuucaggcugacucacccaaaagacuuucagcggcaaucgguaaggcuugggaagagggaguuugcggcauucgguccgccacaaggcucgagaauauuauguggaaacaaauaaguaacgaauuaaaccauauccucuuagagaaugacaugaaguuuacaguaguuguaggagauguugccggcaucuuagcccaggggaagaaaaugauaagaccccaaccaauggagcauaaguacucuuggaagaauuggggcaaagcaaagaucauaggggcagacguacagaacuccacauuuauaauugacgguccuaacaccccagaauguagcgacgaccaaagagcauggaauauaugggaagucgaagauuauggauucgguauauucaccacaaauauaugguuaaaguugagagauucauauacucaggucugcgaccauagacuaaugucugcagcaauaaaggauuccaaagcaguucaugcagacaugggauacuggaucgaaagugagaaaaaugaaacguggaaacuugcacgcgcuucauuuaucgaaguuaaaacauguauauggccuaaaagccauacacuauggucgaacgguguauuagaaagcgagaugauaauuccgaaaauuuauggaggcccgaucucccaacauaauuaucggccgggguacuuuacacaaacagcaggaccguggcaucugggaaagcuggaguuggauuucgaccuaugugagggaacuacugucguuguagacgaacauugcggaaacaggggaccuucacuaagaacuacaacgguaacuggcaagaucauccaugaaugguguugccggucuuguaccuugccaccacuacgauuuagaggagaggaugguuguugguacggcauggaaauaaggccuguaaaagaaaaggaagagaauuuagugaagucaaugguaucggcgggaucuggggaaguugauaguuucucacugggccuacucugcauuucgaucaugauagaggaagugaugagaucacgauggagcaggaaaaugcugaugacaggaacuuuagcaguauuuuucuuacuuauuauggggcaacucacauggaacgauuuaauaagacuuuguauaauggucggggcuaaugcaucagacagaaugggcaugggcacgacuuaucuugcauuaauggcuacuuucaaaaugaggccgauguuugcagugggacuacuguuuagaagacuuacgucgagagaaguacuacuucuaacaauaggacuaucauugguagcuuccguagagcucccuaacagccuagaagaguuaggagacggcuuagccauggguaucaugauauuaaaauugcugacagacuuucagagccaucaacuaugggcaacauuacuuaguaugacuuuuauuaaaacaacauuuagucuacacuaugcuuggaagacaauggcaaugguacuuaguauaguaucuuuauucccacugugcuugagcacuacuucacagaaaaccacgugguuaccuguguuguuaggaagccugggcuguaaaccccuaacuauguuucuuauugcugaaaauaagauuugggggagaaaaucuuggccguugaacgaaggaaucauggcuguagguauagugaguaucuugcugucaucacuccucaaaaaugaugucccucuggcuggaccauuaauagcagggggaauguugauugcgugcuacguuauuucaggaaguucugcagauuuaucccucgaaaaagcagcggaaguaucuugggaggaagaagcggaacauaguggcgcuucacauaacauccuaguagaaguacaggacgauggaacaaugaaaauaaaagacgaggaaagagaugauacacuuacuauauuauuaaaagccacuuuacuagcuguaucgggaguauacccacuaucgauaccagcaacauuauucgucugguauuuuuggcaaaagaaaaagcaaagaucaggaguacuuugggacacaccauccccgccaaaaguagagagagccguacucgaugacggaauauauaggauaaugcaaagaggacuucucggaagaucgcaaguaggcguugguguauuucaagagaauguauuucacacuauguggcauguaaccagaggagcggugcuaauguaucaagguaagagauuagaaccaucaugggcaucuguaaagaaagaucuaauuaguuauggaggagguuggaggcuacaaggcagcuggaacacaggagaggaaguccaggugauagcaguagagccggggaaaaauccaaagaacguacagacagcuccuggaacauucaaaacuccugagggggaaguaggagcuauugcauuggauuucaagccaggaacuuccgguucaccaauugucaauagagaaggaaaaauaguagguuuauacgggaacggagucguuacgacuucaggaaccuacgugucugcgauagcccaagcaaaggcuucccaagaggggccucucccggaaaucgaagacgagguauucagaaagagaaaucuaacgauaauggaucuacauccggguagcggcaaaacaaggcgauacuuacccgccaucguucgugaagcgauaaaacggaaaaugcggacauuaauacucgccccgacucgaguaguggcaucugaaauggcagaagccuuaaaagguaugccaauaagguaucaaaccacagcgguaaaaagugaacacaccggcaaagaaauaguagacuugaugugucaugccacauuuacaaugcgacuacugaguccaguaagagugccaaacuauaauaugauuauaauggaugaagcacauuucacagauccgaguaguauagcugcccggggauauauaaguacuagagucgggaugggagaagcugcagcaaucuuuaugacagccacaccuccaggaucuguggaagcauuuccgcaaucaaaugcuguaauucaagaugaagagagagacauaccugaacgaucguggaacuccgguuacgaauggauaacagauuuuccuggcaaaacgguaugguucguaccuaguauaaaggccggcaaugauauugcgaauuguuugcggaaaaauggcaaaagaguaauucaauuaagucgaaaaaccuuugauaccgaguaucagaaaaccaaaaauaaugacugggacuacguaguuacaacggacauuagugaaaugggugcaaauuuucgugccgacagaguaauagauccuaggcgaugucuuaaaccgguaaucuugaaagaugggccagaacguguuauucuggcaggaccaaugccuguuacaguagccagugcugcucaaagacgugggcguauuggucgaaaccauaauaaagaaggcgaccaauauauauauaugggucaaccuuuaaauaaugacgaggaccacgcacacuggaccgaggcaaaaauguuacuugacaauauaaauacaccugaaggaauaauaccagcacuuuuugagccagaacgggaaaagagugcugcgauagauggagaguauagacucagaggggaggcuagaaaaaccuucguagaacuuaugcgacgcggggauuuaccuguauggcuuuccuauaagguagcaagcgaggguuuccaguacucagauagaagguggugcuuugauggagagagaaacaaucaaguucuugaagaaaacauggauguggaaaucuggaccaaagaaggugagaggaagaaacuaagacccagauggcuugaugcacgcacuuauucugauccauuggcauuacgggaauuuaaagaauuugccgccggaagacgaaguguuaguggagaccuaauauuggaaauaggcaaacuaccucaacaucucacacaacgggcucaaaacgcucuggauaauuuagugauguugcauaacucugagcaagguggacgggcauaucgccacgcaauggaagaacuuccugauacaauugagacauuaauguuauuggcccucauugcaguacuaacaggcggagugacucuguuuuucuuaucaggaaaaggcuuaggaaagacauccauagguuuacucugcguuauggcuucuagcgcauuacuuuggauggcaaguguagaaccacauuggauagcagcgaguauaauauuagaauuuuuccuaaugguacuguugaucccugaacccgauagacagagaacaccucaggacaaucagcucgccuacguuguuaucggauuacuauuuaugauauuaacgguugcagccaaugagauggggcuucuggaaacaacuaagaaagaccuuggaaucgggcacgucgccgucgaaaaucaccaucacgcagcaaugcuagauguggaucugcacccggcaucugcguggaccuuauaugcuguggcgacaacuauaaucacacccaugaugagacauacaauagaaaauacgacagcuaauaucucucugaccgcaauugcaaaccaagcggcgauauuaaugggcuuggauaaggguuggccaauaaguaaaauggacauagguguuccacuacuagcacuaggcuguuauucgcaagugaauccccucacuuuaacagcggccguacugauguuaguagcgcauuacgcuaucaucgguccuggguuacaagccaaagcuacaagagaagcacagaaaaggacugcagcaggaauaaugaagaauccaacgaucgauggaauugucgcaauugauuuagaccccguagucuaugaugcaaaauucgagaaacagcucggacagauaaugcuuuugauauuauguacaucacagaucuuguuaaugcgaacuacaugggcguuaugcgagaguauaacucuugcgaccggaccuuuaacuacacuaugggagggaaguccaggaaaauuuuggaacacaacaauugccguaaguauggcuaacauauuuagaggaaguuaccuggcaggggccggucuagcuuuuucccuuaugaaaagucucgggggcggacguaggggaacuggagcucaaggcgaaacauugggggaaaaauggaaacgacaacuaaaucaacuaagcaagagcgaguucaauaccuauaaacgcuccggcauuauggaaguugauagaucagaagcuaaagaagguuugaaaagaggcgagacgacaaaacaugccgugagcagagggacggcgaaacuaagaugguuugucgaaaggaauuuaguaaaaccugaagguaaaguuauagacuugggaugcggacguggcggguggagcuacuauugugcuggcuugaagaaggucacugagguaaaggguuauacaaaagguggaccaggccaugaagaaccgauaccaauggcaacuuacggauggaaucuaguuaaauuacacucagggaaagauguauucuuuauuccacccgaaaagugugacacucuuuuaugugauauaggugaaucauccccgaaucccaccauugaagagggaagaacacuaagaguccuaaagaugguugaaccuuggcuacgaggcaaucaguuuuguauuaaaaucuuaaacccuuauaugcccagcguaguagaaacacuugaacaaaugcagagaaaacacggugguaugcucguccgaaaccccuuaucucgcaauucgacgcacgaaauguacugggugagcugugguacggguaacauuguaucagcggugaacaugacaucacgcauguuacuaaaccgauucacuauggcacaucguaaaccgacuuaugagagagauguagaccuuggcgcagguacacgacauguagccguagaacccgaaguggccaauuuagauauaauuggucaaagaauugaaaauauaaaacaugagcauaagucaacuuggcacuacgacgaggauaauccauauaagacgugggcauaucacggguccuaugaaguaaagccguccgggagugcuagcuccauggucaauggcgugguuaaacuacugacgaagccgugggaugugauuccuauggugacucaaauagcgaugacagacacgacgccuuuuggacaacaaagaguauuuaaggaaaaagucgauacccgaaccccaaaagcaaaacgugguacugcacaaaucauggaagucacagcaaggugguuauggucauucuuaucacgaaacaagaaaccaagaauauguacaagagaagaguucacccgcaaagugagaaguaaugcugcgauaggagccguauucguagaugaaaaucaguggaacuccgcaaaagaggcaguugaagacgaucguuuuugggaccuaguacaucgcgaaagagaacuacacaaacaaggaaagugugcaacuuguguauauaacaugaugggaaaaagagagaagaaacuuggggaauuuggcaaggcaaagggcucacgugcgauaugguacaugugguuaggugcaagguucuuggaguucgaagcguuaggcuuuaugaaugaagaccauugguucucaagagaaaauucgcuaaguggaguggagggagagggcuuacauaaacuagguuauauacuaagggacauaagcaaaauacccggagguaacauguaugccgaugauacagccggaugggacacgagaauaaccgaggaugacuuacagaacgaggcaaaaauuacggauauaauggaaccggaacaugccuuauuagcuaaaucuauuuucaaauugacauaucaaaauaaaguaguccguguacagcgucccgcgaaaaaugguacaguuauggauguuauuagcagacgugaccaacgaggcucugggcagguugggacauauggacucaacacauucacaaacauggaagcucagcuuauacgacagauggaaagugaagagauauuuagcccaaaugaauuagaaacaccuaaucuugcugaacggguacuugacuggcuggagaaauaugguguugagcgcuuaaaaagaauggcuaucagcggagaugacugcguaguuaaaccuauagacgaucguuuugcaacagcucuaacugccuugaacgauaugggaaagguaaggaaagacaucccgcaaugggaaccauccaagggcuggaacgauuggcaacaaguucccuucugcagccaucauuuucaccaauugauaaugaaggauggaagggaaauaguaguuccguguagaaaccaggacgaauuaguuggacgagcacgagugagucaaggugccggauggucuuuaagagaaacggcauguuuagguaagagcuaugcucaaauguggcaacucauguauuuccaucggcgcgaccuacgauuagcggcaaaugcaauauguagugccguaccaguugacugggugccuacgaguagaacuacauggaguauccaugcacaucaucaguggaugacaacugaggacaugcugucgguuuggaaccguguuuggaucgaggaaaaucccuggauggaagauaaaacacgagucucuaguugggaagacgugccauacuuaggaaagagagaagaucaauggugcgguagucucauagguuuaacagcucgugcuacaugggcaacaaauauacaaguagcgauuaaucagguaagacgacucauaggaaaugagaauuauagcgauuauaugacaaguaugaaacgauuuaaaaaugaaucagagccagaaggcgcacuaugguaa

SEQ ID NO: 22021 - RNA, 9879 nt, Artificial Sequence
  derived and/or modified CDS sequence (opt6) from DENV-1__JN054256__SS-prME
agcguaacaaugcucuuaaugcuuaugccuacagcuuuagcauuucaucuuacaacaagagaaggagaaccacauaugaucguuucaaaacaagaaagaggaaaaucccugcuauuuaaaacuucagcugggguaaacauguguacauuaauugcaauggauuugggagaauuaugcgaagauacaaugacauacaaauguccccguaucacagaagcagaaccugacgauguggauuguuggugcaaugcgacugacaccuggguaacuuacgggaccuguagucaaacaggugaacacagacgcgauaaaaggucuguagcacuagcaccacaugugggccuaggacuagaaacgcgaacggaaacguggaugucuagugaaggcgcauggaaacaaauacaacgaguagaaacaugggcuuugagacacccggguuuuacaguaauugcccuuuucuuagcgcaugccaucgguacuucaauaacacaaaaaggaaucauauuuaucuuauuaauguuagucacgccuaguauggccaugagaugcguugggauuggcagcagggacuuuguagaaggucuuaguggagcaaccuggguugaugugguuuuggaacaugggucgugugucacuacgauggcaaaagauaaacccacacuagacauagaauuguuaaaaacugaaguuacuaauccagcuguacuacgaaaguuauguauagaagcaaagauuaguaauacgacaaccgacucgagauguccgacgcaaggagaagcgacacuuguggaagaacaagaugcaaauuucguauguagaagaacauuuguugaccguggauggggaaauggcugcggucuuuuuggaaaaggcagcuuguuaaccugcgcgaaauuuaagugugucacuaaacuggaaggaaaaauaguccaauacgaaaauuugaaauauucugucauugugacugugcauacgggugaucaacaccaaguugguaaugaaagcaccgaacaugguacaacagcaacaauuacaccacaagcaccgacuaccgaaauccaguuaaccgacuauggagcauuaacccucgacuguucgccccgcacagguuuagauuuuacagaaaugguuuugcuaacaaugaaagaaaagaguuggcucguucacaaacaaugguuucuagauuuaccauuaccauggacgaguggggcgaguacaagccaggaaacauggaauaggcaagacuugcugguaacauucaaaaccgcacacgccaagaaacaagaaguuguaguccuaggaucacaagaaggugcuaugcauacugcuuuaacuggugccacagaaauacagacaucaggaacgacaacaauauuugcagggcaucuuaaauguagacucaagauggauaaguuaacgcuuaagggcaugaguuacguuauguguacuggcuccuucaaauuagaaaaagaaguggccgaaacucagcaugggacgguccuaguacagauaaaguaugaaggcaccgaugccccauguaaaauacccuucaguacgcaggaugagaagggcgugacccaaaacggcagacuaaucaccgcaaauccaaucguaacagacaaggaaaaaccagugaauauagaagcggaaccaccguuuggcgagucuuauauaguaauaggcgcuggagaaaaggcuuuaaaauuaagcugguucaagaaagguucaagcaucggaaaaauguucgaagcuacagcacgcggugcaagaaggauggcaauuuuaggggacacagccugggauuucgguucuauaggugguguguuuacaucaguagguaaacuuguucaucaaauauucggaacagcauauggaguacuguucagcggaguuucuuggaccaugaaaauuggcauugggguucuguuaacuugguuaggauuaaauucucggucuacgucgcuaucaaugacauguauugcaguuggucucgugaccuuauauuugggcguaaugguacaagcggacucagggugcgucauuaauuggaaaggaagagaacuaaagugcgguagugggauauuuguaacaaaugaaguacauacauggacggaacaguacaaauuccaggcggacagucccaaaagacucucagcagcuauagguaaggccugggaggaaggugucuguggcauccguucugcaaccagacuagaaaauauaauguggaaacagaucuccaaugagcugaaucauauauuauuggagaaugacaugaaauuaacuguuguuguaggggaugucgcgggaauacuggcacaaggcaagaaaaugauacggccccaacccauggaacacaaguacucauggaaaaauugggggaaggcaaaaauuauuggggcagacguacaaaacagcacauuuauuaucgacggaccaaacacaccugaauguagugacgaucaacgugccuggaacauaugggaaguugaagauuauggauuuggcauuuucacaacaaauauuuggcuaaaauuaagagauaguuauacacagguaugugaccacagguuaaugagugccgcaauaaaagauucgaaagcgguccaugcggacaugggauauuggauagaaagcgagaaaaaugagaccuggaaauuagcgagagcauccuucaucgaaguuaaaacguguauuuggcccaaaucucauacauuauggucuaacgguguucuugaaagcgaaaugauaauaccuaaaauauauggcggcccaauuucucaacacaacuacagacccggauauuuuacgcaaacagcggguccguggcaccuagguaaguuggagcuagauuucgauuuaugcgagggaacaacagucguaguggacgaacauuguggcaaucgcgguccaucacuaagaacuacaacuguaacaggcaaaauaauccaugaauggugcugccggucauguacccucccuccccuuagguuuagaggagaggauggauguugguacggcauggaaauacgcccuguuaaagaaaaagaggaaaauuuagugaaaagcauggucagugcaggcucgggugagguugacaguuuuagccuaggacuacuuugcauaucuaucaugauugaagaggugaugagauccagauggucaagaaaaaugcugaugacuggaacacuugcuguauucuuucuguuaauaaugggccaacucacauggaaugacuuaauacggcuauguauaaugguaggugcuaacgcuucagacagaaugggaaugggaacuacauauuuagcccuaauggcuacauucaaaaugcguccuauguuugcaguaggccuacuguuccguaggcucacaucgagagaagucuuacuucugacaauagguuugucgcuaguagcuagugucgagcuaccaaauuccuuggaagaacuaggugaugguuuggcuaugggcauaaugauauuaaaacuguuaauagacuuucagagucaucaacuuugggcaacguuacugaguaugaccuuuauaaaaaccacauucucuuuacacuaugcauggaagaccauggcaaugguacuuucaauaguaucccuuuucccucugugucuuagcaccaccucgcagaaaacuaccuggcuaccaguguuauuaggaucacugggaugcaaaccucuaacuauguucuuaauugcugagaacaaaauauggggcaggaaaagcuggcccuuaaaugaaggcauaauggccguggguauaguuucuauacuucuaaguucgcuccugaaaaacgaugucccuuuagcagggccauuaauugcgggagggaugcucauugcuugcuauguaauuucaggcaguagugcagaccuuaguuuggagaaagccgcagagguaucuugggaggaggaagcagaacacucuggagcaucacauaacauucuaguagaagugcaagacgauggaacaaugaaaauaaaggaugaagaaagagaugauacacuaacuauacuucugaaagccacguuauuagccguuagcggaguuuaucccuuaucaauaccggcgacccuauuuguaugguauuuuuggcagaaaaagaaacaacgaucgggagucuuaugggacaccccuuccccuccaaaaguagaacgagcugucuuagaugauggaauauaccggauaaugcaaaggggacuacuaggucgaagccagguugggguugguguauuccaagaaaauguuuuucauacaauguggcaugucacuaggggugcagucuugauguaucaaggaaaaagauuagaaccgucaugggcaagugugaagaaagauuuaauuaguuaugggggaggauggagguuacaagguaguuggaacaccggagaagaaguacaaguuauagcgguggaaccaggcaaaaacccaaagaaugugcagacagcuccagggacauucaagacgcccgagggagaaguaggagcuauagcauuggauuuuaaaccagguacaucuggaucgccaaucgucaauagagagggcaaaauaguaggcuuauauggaaauggugucguaacuacaucagguaccuaugucuccgcaauagcgcaggccaaggcuucccaggagggcccacuaccagaaaucgaggaugagguuuuucguaaacggaacuuaacuauaauggauuugcacccaggcucagguaaaacacgacgauauuugccagcaauaguaagggaggcaauuaaaagaaagaugcgcacgcuuaucuuagcacccacgagagugguggcaucggaaauggcggaagcauugaaagguaugccaauuagguaucagacaacagcaguaaaaagcgagcacacggguaaagaaauaguagaccuaaugugccacgccacauucaccaugagacuucuaucuccuguaagagugccaaauuacaauaugauaauuauggaugaagcacauuuuaccgauccaucaucaauugcugcuagaggauacauuaguacgagaguagggaugggagaggccgcagcuauauucaugacggcaacgccgccaggcagcguggaagcguucccgcagagcaaugcuguuauucaggaugaggagagagacauuccagaaagaucauggaacucaggguaugaguggauaaccgacuucccagguaagacuguaugguucguuccuucuauuaaagccggaaaugauaucgccaauugucucaggaaaaauggaaagcguguaauucaacugucucguaagacauucgauacugaguaccagaaaaccaaaaauaaugauugggauuauguagucacuacugacauuagcgaaaugggugcaaauuuuagagcugacagaguaauugauccccgucguugucuaaaaccaguuauauuaaaggacggaccagagcgaguuauacuugcgggaccuaugccuguuacuguugcaucagcugcgcaacgcagagggcgaaucgguagaaaucacaauaaagaaggagaucaauauauuuauaugggucaaccuuuaaauaacgacgaagaucaugcacauuggacagaggcgaaaaugcuuuuggauaauauaaauacaccugaggggauuauaccagcucuuuuugaaccagagcgagaaaagucugccgcuauugauggugaauaucgacuaagaggagaagcacgaaaaacuuucguugaguugaugaggagaggcgauuuaccuguaugguugucauacaagguugcaagugaaggauuccaauauagcgaucgaaggugguguuucgacggugagcgcaacaaccaagugcucgaagaaaauauggauguugaaauauggacgaaagagggugagagaaagaaacuaagaccaagguggcuagaugcacgaacguauagcgauccuuuagcacuucgcgaguucaaagaauuugcggcaggccggagaucggucaguggagaccugauccuggaaaucgguaaauuaccacaacaucuaacucaacgagcgcaaaaugcacuagacaaucuggugauguugcauaauucugaacaaggcggccgugcauacagacaugccauggaagaacucccggauacuauagaaaccuuaaugcucuuggcguugauagcagucuugacugggggaguaaccuuauuuuuccucucaggaaaaggccucggaaaaacgagcauuggacuuuuauguguuauggcaagcuccgcucuauuauggauggcgucaguugaaccgcacuggauagccgcaucgauuauauuagaguuuuucuuaaugguucuacugaucccagaaccagauagacaaagaacaccgcaagauaaccaauuagcguauguaguuauuggcuuacucuucaugaucuugacgguugcagcuaacgaaaugggccuacuugaaacgaccaagaaagauuuaggcaucggucaugucgcaguagaaaaccaucaucaugcugcuauguuagacgucgaucuucaccccgcuucugcauggacccuauacgcuguggcaacaaccauaauaacuccuaugaugcgccauacuauagaaaacacgacagcgaacaucaguuuaacagcuauagcaaaucaagcugccauauuaaugggucucgauaaaggauggccgauuuccaaaauggacaucggaguaccuuuauuagcacucggaugcuauucccagguaaacccucucaccuugacggccgcuguguuaauguuaguugcacauuacgcaauuaucggcccagggcuacaagcuaaggccacacgagaagcccagaagcgcacagcggcaggaauuaugaaaaaccccaccauagacgguauuguugccauugauuuagauccuguuguauacgacgcaaaauuugaaaaacaauuggggcaaauaaugcuacuuauauuauguacaagccaaauauuacucaugaggacaaccugggcauuaugcgagucgauaacuuuagcgacaggaccauuaacgacacuaugggagggaucuccaggaaaauucuggaauaccacaauagcagucucgauggcaaauauuuuucgaggaucauaccucgcaggagcuggauuagcguucagccugaugaagucacugggaggaggcagaagggguaccggagcacaaggagaaacgcucggggagaaauggaaacgacaauuaaaucaauuaucaaaaagcgaguucaauacauacaaaagaaguggaaucauggaaguagacagaucagaagcaaaagaaggucuaaaacgaggagagacgacuaaacacgccguuaguagaggaacggccaaguugcgcugguucguggaacgcaaucuuguaaaaccggagggcaaaguuauagaucuaggauguggaagaggcgguuggucauauuauugugcuggacugaaaaagguuacggagguuaagggauauacaaaagggggaccaggucaugaagaacccauaccgauggcgacauauggauggaaccuaguuaagcuacacucaggcaaagacguuuucuuuauucccccagaaaaaugugauacgcuacucugugacauaggagaguccucgccaaauccaacaauagaagagggaagaacuuuacgaguacuaaagaugguugaaccuuggcuacgcgguaaccaauuuuguauuaaaauacuaaauccguauaugccaucaguaguggagacacucgagcagaugcagcggaaacauggugguaugcuaguuagaaauccguuguccagaaauucgacucaugagauguauugggucucuuguggcacugggaauauaguaucagccguaaacaugacaucacgaauguuacuuaaucgcuucacaauggcccauagaaaaccaacguaugaacgugauguagacuuaggagcagguacgagacauguagccguagaaccagaaguugcuaaucucgacaucauuggacaacgcauugagaacauuaagcaugaacauaaaagcacauggcauuacgacgaagacaaucccuauaaaacaugggcuuaccaugguaguuaugaaguaaagcccucagguucggcaaguagcauggugaaugggguuguuaaauuacuaacuaaaccuugggacguaauaccaauggucacgcaaaucgcaaugacugauacuacaccauuugggcaacaaagagucuuuaaggagaaaguagacacuaggacuccgaaagcgaaacgaggaacugcacaaauaauggaaguaacugcacgguggcuuuggucauuucucucucgaaauaagaaaccacgaauauguacacgagaagaauuuacccguaaagugaggagcaaugcagccaucggggcuguauuuguugacgaaaaccaauggaacucggcgaaggaagcgguugaagaugacagauucugggauuuaguccacagagaacgagagcuucauaaacagggcaaaugcgccacguguguuuauaacaugauggguaaacgugagaagaaacucggagaguucgguaaagcuaaagggucaagagcuauuugguauauguggcuuggagcuagauuucuagaguuugaggcuuuaggauuuaugaaugaggaucacugguuuaguagggaaaacuccuuaucgggaguagaaggagaaggguugcacaaauuaggcuauauuuuacgugauauaaguaaaauuccuggaggcaauauguacgcugacgacacagcaggaugggauacaagaauaacugaagaugauuuacaaaacgaagcaaagauaacagauauuauggaaccggaacacgcccuccuugccaaaagcauauuuaaauuaaccuaccaaaauaaaguaguccgaguccagagaccugcuaaaaauggcacaguuauggacgugauuucuaggagggaccagaggggaaguggacaaguugguacuuaugggcuaaauacuuuuacuaauauggaagcccaauuaauaagacaaauggagucggaagaaaucuucuccccaaaugaguuggaaacaccaaaucuagcagaacgaguuuuagauuggcuugagaaauauggaguagagagauugaaaaggauggcuauaaguggugaugauugcgucguaaaaccaaucgacgauagauuugccacggcucuaacagcguuaaaugauaugggaaaagucagaaaagacauuccacaaugggagccuuccaaaggauggaacgacuggcaacaaguucccuuuuguucgcaucacuuccaccaacuaauaaugaaggauggcagagaaauaguggugccaugcaggaaucaggaugaguuaguaggacgagcaaggguaagucagggagcaggauggaguuuacgugaaacggcuugcuuggggaaaucauaugcucaaauguggcaacuaauguacuuucacagacgugaccuccgacuugccgcaaaugcaauaugcucagcaguucccguggacuggguaccaacuucaagaacaaccuggucaauacacgcacaucaucaauggaugacuacagaggauauguugucaguauggaaccgaguauggauagaggagaauccauggauggaagacaaaacaagaguaaguagcugggaagauguaccguaucuagggaagcgagaagaucaaugguguggaaguuuaauugguuuaacagcgagggcaacuugggcaacaaauauacaaguagcuauaaaucaaguucgacguuuaaucggcaaugagaauuauagcgacuauaugacuucgaugaaaagauucaagaaugaaagcgaaccagagggagcccugugguga

SEQ ID NO: 22022 - RNA, 9879 nt, Artificial Sequence
  derived and/or modified CDS sequence (opt6) from DENV-1__JN054255__SS-prME
ucuguaacgauguugcuaauguugaugccaacugcccuagccuuucacuuaacaacacgaggcggagaaccucauaugauaguuagcaaacaagaacgaggaaaaucauuacuuuucaagacgucggccggaguaaacaugugcacguuaaucgcgauggauuugggagaacuuugcgaagauacaaugaccuacaagugcccaagaauaacagaagcggaaccugacgacguagacugcuggugcaaugcaaccgacacauggguuacuuaugguacaugcucacaaacuggagaacauagaagagauaaaagauccguagcgcuugcaccucacguagguuugggucuagaaacuagaacugaaacguggaugagcucagaaggugcuuggaaacaaauccaacgaguagaaacuugggcauugcgacacccgggauucaccguaaucgcacuauucuuagcgcaugcuaucgguacgaguauaacucaaaaggguauaauauucauuuuauuaaugcuaguuacuccuucuauggcuaugcguuguguaggaauaggaucacgagacuuuguagaaggguuaaguggggcgacuuggguugacguaguauuagaacacggcucaugcguuacaacaauggcaaaggacaaaccaacauuagacauagaauuauugaagaccgaaguuacaaauccagcaguucuuagaaaauuauguauugaagcuaaaaucucuaacacaacaacagauucacgguguccuacucaaggagaagccacacucguagaagaacaagaugcaaauuuugucugccggagaacuuuuguggauagagggugggggaacggaugcggacuuuucggcaaggggucucugcuuacgugcgcgaaguucaaaugcguaacaaaacuagaaggaaaaauaguacaguacgagaaucugaaguauucaguaauaguaacaguucacacaggcgaccaacaucagguaggaaacgaauccacagagcauggcacuacggcaacgauuacgccucaagcuccgaccaccgaaauucaauuaaccgacuauggagcacugacucuugacugcaguccacgaaccggacuagacuuuaaugaaauggucuuauuaacaaugaaggagaaaagcugguuaguccacaagcaaugguucuuagaucucccucuuccauggacaucaggugcuuccacaagccaagagacauggaauagacaagaccuucuugucacauuuaaaacagcccacgccaagaaacaagaggugguaguacuuggcagucaggaaggagcgaugcacacagcuuuaacaggagcgaccgaaauucagaugucuggaacaaccacaaucuucgccggucaucuuaaaugcagguuaaagauggauaaguuaacucucaaggguaugucuuauguuaugugcaccggaucauuuaaacuggaaaaggaaguagcagaaacacaacacggaacggugcuaguacaaaucaaauacgaagguacugaugccccuugcaaaaucccuuucucuacucaagaugaaaaaggaguuacacaaaaugggcgacucauaacggcgaaucccauaguaacagacaaagaaaaacccguaaacauugaagcagagcccccauucggagaauccuacauuguaauaggagcaggggagaaagcccugaaacuuucaugguucaaaaagggauccucuauuggaaaaauguucgaggcaacagcucguggagcgcgcagaauggccauacuuggugacaccgcaugggauuuuggguccauagguggaguuuucacaaguguuggaaaauuagugcaccaaaucuucggcacugccuacgguguucuauucucaggcguuucuuggacuaugaaaauaggaauaggagugcuacuuacaugguuaggacucaauucuagaaguaccucucugucaaugaccuguauagcggucggacugguaacauuguauuuaggugugaugguacaagcagauaguggauguguuauaaacuggaaaggaagggaguugaaaugcgguucaggaauuuuuguaaccaaugagguacacacuuggacugaacaauauaaauuccaagcagauucccccaaaagauugucugccgcgauugguaaagcaugggaggagggagugugugguauuagaagcgcaacgagacuagaaaauauaauguggaagcagauaagcaaugaacuuaaucacauucuuuuggaaaaugauaugaaguuuacaguuguaguaggagauguugcuggaauacucgcacaagggaaaaagaugauccgaccgcaaccuauggaacacaaauauagcuggaaaaauugggguaaagccaaaauaauaggagcagauguucaaaauucaacuuuuauuauagauggaccaaauaccccagaaugcucugaugaucaaagagcauggaacaucugggaagucgaagauuauggauucggaaucuuuacaacuaacauuugguugaaacuucgagacuccuauacgcagguaugugaccauaggcuaaugucggcggcaauaaaggacagcaaagcuguucaugcagacauggguuacuggauugaaagugagaaaaacgaaaccuggaaauuagcaagagcuuccuucauagaaguaaagacuugcauauggccaaaaagccauacauuguggucgaaugggguuuuagagucggaaaugauuaucccuaaaauuuacgggggccccauuucacaacacaacuaucgaccaggguauuuuacgcaaacagcaggcccauggcauuuggguaaacuugaauuggacuuugaccuuugugaagguacaaccguugugguagaugaacacugcgguaaucguggacccagcuugcgaacaacaacugucacaggaaaaauaauacaugaauggugcugccguagcuguacucuaccgcccuugagguuuaggggcgaagaugggugcugguauggaauggaaauacgacccgugaaagaaaaggaagaaaacuuaguaaagucaauggucucggcaggaaguggugaagucgauaguuucagucuugggcuguuguguaucaguaucaugauagaagaaguaaugagaagucgauggucuaggaaaauguuaaugacagggaccuuggcagucuucuuucuauuaauuaugggacaacucacuuggaaugaucuuauccggcuaugcauaaugguaggugccaacgcaagcgaucguaugggaaugggaacuacuuauuuagcccucauggcaacauuuaaaaugcguccgauguucgcgguuggacuccuauuccguagauuaacauccagggaaguccuacuacugacuauaggucuauccuuaguagccaguguugaacuacccaacagccuagaagaauuaggggauggauuggcuauggggauuaugauucucaaacuauuaacagacuuucagucgcaucaauuaugggcgacacuauuguccaugacguuuauaaaaaccaccuuuucacuucacuacgcauggaaaacaauggcuaugguauuaucuaucgucagcuuauucccacuuugccucaguacuacgagccagaaaacuacuuggcucccuguacuucuugguagucucggauguaaaccacuuacaauguuuuuaauugccgagaauaaaauuuggggucgaaagucauggccauugaaugaaggaauaauggcaguugguaucguaaguauacuacuaucgaguuuauuaaagaaugauguuccacuugcaggaccuuuaaucgcaggaggaaugcuaauagcaugcuauguuauuagcggcucguccgcagauuuaucgcuagaaaaagcagcagaaguuucgugggaagaagaagcagaacacaguggggcgucacauaacauucuaguagaaguucaggaugacggaacuaugaaaauaaaagacgaagaacgagacgauacacuaaccauacuauuaaaagcuacuuuguuagcuguaucugggguuuacccacucaguauaccugcuacccuuuuugucugguacuucuggcagaaaaagaaacaaaggucaggaguacuaugggauacaccaucaccgccgaaggucgaaaaagcagugcuagaugacggaauauaccguauaaugcaacgaggucuauuaggcaggucacaagucgguguaggaguauuucaagaaaaugucuuucauacaauguggcauguuacuaggggagccguucuaauguaucaaggaaaacgauuagaaccuucgugggccucagucaagaaagauuuaauaagcuauggaggggguuggagauuacaaggaucauggaauacaggggaagaaguacaaguuauagccguggagccugggaaaaaucccaaaaacguccaaaccgcaccagggacguuuaaaacaccagaaggcgaggucggcgcgauagccuuggacuuuaaacccgggacuagcgguucacccaucguuaauagagaaggcaagauuguaggacuguauggaaacggaguaguuacgacaucugguacuuacguaucaggaauagcacaagcaaaagcuagccaggaaggaccacuaccugaaaucgaggacgaaguguuuaggaaaagaaaccugacaaucauggaucuacacccaggaucggggaaaacaagaagauaccuucccgccaucguaagagaggcaauuaaacgaaaaaugagaacauuaauacuugcuccaacaaggguuguagccuccgaaauggcugaagcccuuaaaggaaugccaauacgauaccagacaacagccguuaaaucagagcauacagggaaggaaaucguagauuugaugugucaugcaaccuucaccaugagauuguuaagcccaguuagagugccuaauuauaacaugauaauaauggacgaagcacauuuuacagacccgucgaguauagcagcacgagguuacauuucgaccaggguuggaaugggugaagcugcugcaauauucaugacagcaacuccaccaggguccgucgaggcauucccacaaaguaacgcuguuauacaggaugaagaaagagauaucccagaaagauccuggaacuccgguuaugaauggauaacagauuucccuggaaaaacggucugguucguaccuaguauuaaagcuggaaaugauauagcgaacuguuugagaaagaaugguaaaagaguuauucaauuaucaagaaaaaccuucgauacagaauaucagaagaccaagaacaaugauugggacuauguaguuacaacagauauuagcgaaaugggugcaaacuuuagagccgauagagugauagacccccgacgcugccuaaaaccuguaauucuaaaagaugguccagaaagggucauacucgcugggccaaugccaguuacuguggcuagugcagcgcagagacggggacgaauuggacguaaucacaauaaggagggcgaccaguacauuuacaugggacaaccauuaaacaacgacgaaaaucaugcgcacuggaccgaagcaaaaaugcuucuggacaacaucaauacaccggaggggauaauccccgccuuguuugaaccugaaagggagaaaagugcagcaauugacggcgaauauagauugagaggggaggcucgaaaaaccuuuguagaauuaaugcguagaggggaucuuccaguauggcugagcuauaaaguggcauccgaaggauuccaauacagugaucguagauggugcuucgacggugagagaaacaaucaaguacuagaggaaaacauggacguggagaucuggacaaaagagggagaaagaaagaaauuaaggccaaggugguuagaugcaaggacauauucagauccacuugcauugcgagaguuuaaagaauuugcggcaggucgucguucaguuaguggcgaucuaauucucgaaauuggaaagcuaccccagcacuugacucagcgagcucaaaaugcucuugacaauuuaguuauguuacacaauagugaacaaggagggagggcuuacagacacgccauggaggaacucccggauacgauagaaacgcugaugcuuuuagcucuaauagccgugcuuacugguggagucacuuuguuuuucuugaguggaaaaggucugggcaagacgucaauaggauuacuuuguguuauggcaaguucagcgcuucuauggauggcaaguguugaaccacauuggauugcugccaguaucaucuuagaguucuuucuaaugguacuauuaauucccgaaccagaucggcaaagaaccccgcaagauaaccaauuggcguaugugguaauuggacuacuguuuaugauccuuacaguggcagcaaaugaaaugggacuccuagagacgacuaagaaagaccuaggaauaggacaugucgcuguagaaaaccaucaucaugcagccauguuagauaucgacuuacauccugcuagugcuuggacucuuuaugcuguugcaaccaccauuaucacucccaugaugcgucauacuauagaaaacacaacagcaaacauaucguuaaccgccauugcuaaucaggcagcaauccuaaugggauuagacaaaggauggccaaucaguaaaauggauauaggcguccccuuauuagcccuagggugcuacucgcaaguuaauccacuaaccuugacggcugcgguccuaauguuaguggcacacuacgccauuauugguccuggauuacaagcaaaagcgacaagagaagcacaaaaacgcacagccgcaggcaucaugaaaaaucccaccauagaugggauaguugcuauugaucuagauccaguaguauaugaugcaaaguuugaaaaacaauuaggacagauaaugcuauugauucugugcacaagucaaauuuugcuuaugcggacaacaugggcacuaugcgagucuaucacacuagcuaccgguccacuuacuacacugugggagggaucgccaggaaaauuuuggaauacaaccauagcggugagcauggcaaauauauuccgaggaucuuauuuagcuggcgcuggcuuggcguuuagucucaugaagucuuuggguggagggcgacgcggcacgggugcacaaggcgagacacuuggugaaaaguggaagcgacaacuaaaccagcuuaguaaaucugaguucaacacguauaagagaaguggcauaauggaaguggauagaucagaggcuaaagaaggucuaaaacguggggaaacaacaaaacacgccguauccagagguacagccaagcuaagaugguuuguggagcgaaauuuaguuaaaccugaaggcaaggucaucgacuugggaugcggacgaggugguuggucauacuauugcgcuggauuaaagaagguaacagaagugaaaggguacaccaagggcgggccggggcaugaagaacccauacccauggccaccuaugguuggaaucuuguaaaauuacacagcgguaaagauguauucuuuauuccaccugagaaaugugacacccugcuaugugauauaggggaaagcucuccgaacccuacaauagaggagggacggacucuuagagucuuaaagaugguagaaccuuggcuucgaggaaaucaauucuguaucaaaauauuaaauccuuauaugcccucaguugucgaaacauuagagcaaaugcaacggaaacauggcggaauguuagugcggaauccauuaucgagaaacaguacucacgaaauguauuggguuucuugcggaaccgggaauauagugagcgcagucaauaugacauccaggaugcugcuaaauagauuuacaauggcucauaggaaaccuacauacgaacgagaugucgacuuaggagcugggacaaggcacguagcaguggagccggaaguugcaaauuuagauauaauaggacaaagaauagaaaauaucaaacacgaacauaaauccacauggcauuaugacgaagauaaucccuauaaaacgugggccuaucacgguucuuaugaagucaaaccauccggauccgcaucauccauggucaaugggaugguuaaauuacuaacgaaacccugggacguuauuccuaugguaacucaaauagcuaugaccgacacgacuccguuuggccaacagcgaguuuuuaaggagaaggucgauacaagaacgccaaaggcuaaaagggguacugcgcaaauaauggaaguaacagcuagauggcuauggucauucuuaucacguaauaagaaaccgagaauuugcacaagagaggaguucacacguaaaguaagaucgaacgcugccauaggagcuguauuuguugacgaaaaccaauggaauagcgcaaaggaagcaguagaggaugaucguuucugggaccuaguccauagagagcgugaacuacauaagcaagguaaaugugcgacauguguauacaauaugaugggcaaaagagagaagaaacuaggagaauuuggcaaggcgaaagguagcagggcaauuugguauauguggcugggcgcucguuuucuagaguuugaggcucuaggauucaugaacgaagaccauugguuuucuagagaaaauucacuuucaggugucgagggugaaggucuccauaaacuugguuacauucuacgugacauaucgaagauaccgggcgguaauauguacgccgaugauaccgcagguugggacacuagaauuaccgaagaugaucuucaaaaugaagcaaaaauuacggacaucauggagccagaacacgcacuguuagcaaaaagcauauucaaacucacauaccagaauaaaguaguucguguacaacgaccuaguaaaaacggaaccguaauggaugugaucucacgacgagaccaacgaggcucaggccaaguugggacauauggauuaaacacauucacgaauauggaagcgcaguuaauuaggcaaauggagucagaggagaucuuuucgccaaaugaauuggaaaccccaaauuuggcaaaacgcguacuagauugguuagaaaaauauggggucgaacgucuuaaacggauggcaauauccggagacgacugugucguaaagcccauagacgauagguucgcuacagcucuaacagccuuaaacgacauggguaaggugagaaaagacauuccacaaugggaaccaucaaaaggauggaaugacuggcaacaggucccuuucuguucacaccacuuccaucaauuaaucaugaaggauggucgagagauuguaguaccaugccgcaaucaagacgagcucguaggcagagcucguguaagucaaggggcaggauggucauuaagagaaacugcaugucuuggaaaaucauacgcacaaauguggcagcuaauguauuuccaccgccgugaucugagguuggcugcaaaugcuaucuguagugcaguacccguggauuggguaccaacaaguaggacuaccuggucgauacaugcccaucaucaauggaugacaacagaagauauguugucaguuuggaaucguguauggauagaagagaacccguggauggaagauaaaacaaggguaucgaguugggaagacguuccauacuuaggaaaacgggaagaccaauggugcgguucuuuaauugguuuaacugcgagagcaacuugggccaccaauauacaaguugcuauuaaccaaguaagacggcuaauuggaaacgagaauuauagugauuacaugacgaguaugaaacgauuuaaaaaugaaucagagcccgagggagcauuaugguaa

SEQ ID NO: 22023 - RNA, 9879 nt, Artificial Sequence
  derived and/or modified CDS sequence (opt6) from DENV-1__KP406801__SS-prME
ucaguaacaaugcuuuuaaugcuacucccuacggcacuugcuuuccaucugacuaccagaggcggugaaccacacaugauaguuagcaaacaagaacgcgggaaaagucuucuguucaaaacuucagcuggggugaauaugugcacucuaauagccauggacuuaggcgaacugugcgaagauacaaugacauacaaaugcccuaggauaacagaagccgaaccagacgauguagacuguugguguaaugcuaccgauacaugggugacauacggcacauguucccaaacaggugaacauaggagggauaaaaggucuguagcucuagcuccucaugucgguuuaggauuagaaacgcguacagaaacauggaugucauccgaaggggcuuggcgucaaauacaaaaaguagaaacuugggcacuacgacauccagguuucacaguaaucgcuuuguuuuuagcacacaccauuggaacaaguauaacacaaaaggggauaauauuuauucuauuaauguugguaacaccguccauggcgaugcguugcguuggaauuggaaauagagacuuuguagaagguuugucaggggcaacuuggguagacguugugcuagagcauggaaguugugucaccacuauggccaaaaacaaacccacuuuggacauugaacuuuuaaaaacggaagucacaaauccagccguucugaggaaguuaugcauugaagcgaaaaucagcaauacgacuacagauaguaggugcccaacacaaggugaggcaacucuuguugaggaacaagacgcaaauuuuguuugccgaaggaccuuuguagaccguggaugggguaauggaugugggcuauuugguaaaggaucuuuacuuacuugcgcaaaauuuaaaugcgugacaaaauuggaggguaaaaucguccaguaugaaaacuugaaauauaguguuauugucaccguacauacaggagaccaacaucaaguggguaacgaaacuacagaacacggaacuauagccacuaucacuccucaagcgccuacauccgaaauccaacuaacagauuacggcgcucuaacauuagauugcucuccccgcacuggucucgauuuuaacgaaaugguauuacuaacuaugaaagaaaaaucuugguuggugcacaaacaaugguuccuagacuuaccguuaccuuggacaucuggggccuccacaagccaagaaacuuggaauagacaagaccuacucguaacauucaaaacggcccacgccaagaagcaagaaguuguuguccuaggcucccaagaaggugcaaugcacacagcacuagcaggagcaacagaaauucaaaugucggguacaacaacaauuuucgcgggccaccuaaaguguagauuaaaaauggauaaacuaacgcuuaaagguguuucauaugugauguguacuggcaguuucaaacuugaaaaagaaguagcugagacgcagcauggaacaguucuuguacaaguuaaguaugaagguacagaugcgcccuguaaaauaccguucucuauucaagaugaaaaaggcgugacgcaaaauggcagacuaauaacagccaacccgauagcuacagauaaagaaaaacccguaaauauagagacugaaccuccguuuggugaauccuacaucgugauuggugcgggagaaaaggcccugaaacuaucgugguuuaagaaaggaaguucuauaggaaaaauguucgaagcuacagcacguggagcaaggagaauggcaauccugggggauacagccugggauuuugguaguauaggaggaguuuucacguccgugggaaagcugguacaucaaguauuugguaccgccuauggugucuuauucagcggagucucuuggacgaugaaaauagggauugguauccuucuaacuugguugggcuuaaacucacgguccacaucucucagcaugacaugcaucgccguaggcaugguaaccuuauaucuuggcgucaugguucaggcugacucuggaugcguuauaaauuggaaaggaagagagcuaaaguguggaucagguauuuuuguuacuaacgaagugcauacuuggacagagcaauauaaguuucaagcugauucccccaaaagacuaagcgcugcaauaggaaaggcuugggaggaaggagucugcgguauaagguccgcaacccgucuggaaaauauaauguggaaacaaauaucaaacgaauuaaaucauauacuucuugagaaugacaugaaguucaccguuguaguuggcgaugcaaacgguauauuaacccaagguaagaaaaugauucgaccgcaacccauggaacauaaauauagcuggaaaaguuggggaaaggcaaagaucaucggcgcagacacucagaauaccacuuuuauuauagacggucccgacacaccggaauguccugaugaucaaagggccuggaacauaugggaaguugaggauuauggauuugguauauuuacaaccaauaucugguugaaauugcgugauagcuauacucaaaugugcgaccauagauuaauguccgcggcaauuaaagauagcaaagcaguacaugcagacaugggguauuggauagagagugagaaaaacgagacuuggaaacuagcaagagccagcuuuauagagguaaaaacuugcauauggccacgaucgcacacauuauggaguaauggaguccuagaaucagaaaugauaauaccgaaaaucuaugguggaccaauaagccaacacaauuaucgaccuggauacuucacgcagacagcagguccguggcaccuggguaaacuagaguuagacuucgaccuuugugaaggaacuacaguagucguugaugagcauugcgguaaucgagggccaucauuacggacaacgacuguaacagguaaaauuauacacgagugguguuguagaucaugcacguuaccacccuuacgauucaaaggugaagauggauguugguacggcauggaaaucagaccuguaaaggaaaaagaggagaaucucguaagaaguauggucucagcaggaucaggagaaguugacucauucagucuuggauugcuuugugucaguauaaugauagaagaagugaugcgcaguagauggucacguaaaaugcuaaugacgggaacucuagcagucuucuucuuacuaauaaugggucaauuaacuuggaaugauuuaauucgucuuuguaucaugguaggcgcaaauguaucugacaggauggguauggguacaaccuauuuagcccuaauggccacguucaagaugagacccauguuugcaguaggguuacuauuuagaagauugacgagcagagaaguuuuauuguuaacgauagguuuaucguugguagccagugucgaacuuccaaauuccuuagaagaauuaggggacggguuagcuaugggcauaaugauguuaaaauuguuaacggauuuucaaagucaccaauuauggacuaccuuauugucacuuacauuuaucaaaacaacgcuuucacuagacuaugcguggaagacuauugcuaugguacucaguauaguuucauuauucccucuaugccugucaacaaccagucagaaaacaacaugguuaccggucuuguuaggcuccuuuggauguaaaccauugaccauguuuuugauaacagagaauaagauuugggguagaaggucauggcccuugaaugagggaauaauggcuguaggaauagucaguauacuacuuucuucuuuacuuaaaaaugauguaccccuagcugguccguuaauugcgggcgguauguuaauagcauguuauguaauuaguggaagcuccgcagaccuuagccuagagaaagcagcugaaguaucaugggaggaagaggcugaacauucaggagcgucucauaauauuuuaguagaaguacaagacgaugggacaaugaaaauaaaagacgaggaacgugacgauacacuuacgauucuucuuaaagcaacacuacucgccguaagcggggucuacccuaugaguauaccagccacccuuuuugugugguauuucuggcagaagaagaaacaaagauccgguguacugugggacacucccucaccucccgaaguugaaagagcaguguuagacgauggaauauauaggauucuccaaagaggauuauuagggagaagccaaguaggagucgguguguuccaagauggaguuuuucacaccauguggcacguuacacgaggagcuguacuaauguaccaggguaaacgauuagagccaucaugggcuagcgucaagaaagaccugaucucauacggcgguggauggcgauuccaaggaaguuggaacacuggagaggaaguucaaguuaucgccguagaaccugguaaaaauccuaaaaacguucaaacgacaccuggaaccuucaaaacuccagaaggggaaguuggggccauagcacuggauuucaagcccggaacaagugguagccccaucgucaaucgagaagguaaaauagugggacuuuacggcaaugguguuguuacaacaaguggaacguaugugucugcaauagcacaagcuaaagccagccaggaggggccccucccugaaauugaagaugagguuuuuaagaaaagaaauuuaacaauuauggaucuacacccugggucaggaaaaacaagaagauauuuaccugcgauaguuagagaagcaaucaagcgaaaacuucgaacgcuaauauuagcgccaacaagagugguugcuagugaaauggcagaagcguuaaaaggcaugccuaucagauaucaaacgacugcaguuaagagcgaacauacaggaagagaaauaguggauuuaaugugccacgcaacguucacaaugcgcuuauuaaguccuguucgggugccaaacuauaauaugauuauaauggacgaggcacauuuuacagauccugcgucgauagcugcaagaggguacauuaguacaaggguaggaaugggugaagcugccgcuauuuucaugacugcaacuccuccagguaguguagaggcguucccacaaaguaaugcgguaauacaggacgaggaaagagauauaccggaaagaaguuggaacucuggcuacgacuggauaacugacuucccagggaaaacaguaugguuugugccaucgaucaaaagugggaacgacaucgcaaacuguuugcggaaaaauggaaaacgaguaauacaacuuaguagaaaaaccuuugauacugaguaccagaaaacuaaaaauaaugauugggauuacgucgucaccacagauauaucggaaaugggagcgaacuuucgugcagaucgcgugauagauccacgucguugcuugaagccuguaaucuuaaaagacggaccagaaaggguuauacucgcaggaccaaugccagugacaguagcaucagccgcucaacguagaggaagaauuggccguaaccagaacaaagagggcgaccaauauauuuacaugggucagccucuuaacaaugaugaggaccacgcucauuggacagaagcgaaaaugcucuuagauaacauaaauacacccgaagggaucauuccggcgcuuuuugaaccagaacgcgagaaaagcgcggcaauugacggagaauacagauugcgaggagaagcacgcaaaacauuugucgaacuuaugcgaagaggagaucuaccagucugguuauccuauaaaguugcaucagaagguuuccaauacucagacagacguuggugcuucgauggcgaaaggaauaaucaaguauuagaagaaaauauggacguagaaauauggaccaaagaaggggaacgcaagaaacuaagacccagaugguuagaugcgcgcaccuauucggacccucuugcauuaagggaguuuaaagaauuugcggcaggccgucgaucaguaucaggagacuuaauuuuggaaaucgggaaacugccccaacacuuaacgcuucgcgcccagaaugccuuagauaaccugguuaugcuucacaacucagaacaaggagguaaagcauacagacaugcuauggaggaacuaccugacacaauagaaacacucauguuauuagcccuaauagcaguuuugacuggugguguaacccuauucuuucuaucaggcaaaggacuaggaaagacuagcauagguuuacuauguguaauggcuaguaguguacugcuauggauggcguccgucgagccccacuggaucgcagcuucuauaaucuuagaauuuuucuuaaugguuuuauuaauaccugaaccagacagacaacguacuccacaggauaaccaguuagcauaugucguaauaggacuuuuauuuaugauacuaacuguagcggcgaacgagaugggguuauuagaaacuacaaagaaagaccuggguauaggacacguuguggcugaaaaucaccaccaugcaacaauguuggauaucgacuuacacccagcaagugcauggacuuuguacgccguagcaaccacuaucauaacuccaaugaugaggcauacaauagaaaauacuacugcaaauaucucacucacugcuauugcaaaccaagcggccauauuaauggggcuagacaaagguuggccuauaaguaaaauggacauuggaguuccuuuguuagcguuaggauguuauagucaaguaaauccgcuaacccugacggccgcgguacuaauguuaguagcacauuaugcaauaauuggaccaggauuacaagcgaaagcaaccagggaagcucagaaaagaacagcagcugggauaaugaaaaauccgacgguggaugguauuguagccauagaccucgauccaguugucuaugacgcaaaauuugaaaaacagcuaggucagauaaugcuucugauauuauguacaagucaaauauugcugaugcgaacaacuugggcacucugcgaaucgauaacacuugcuacuggaccacuuacgacccucugggaagguaguccagguaaauuuuggaauacgacgauagcuguaagcauggcaaacauauuuaggggaucuuaucuagcuggcgcgggucucgccuuuucccucaugaaaucacuaggagggggcaggcguggcacuggugcgcagggugaaacauuaggcgaaaaauggaagcgucaauuaaaccaauugaguaaaucagaauuuaauacauauaaaaggaguggaaucauggaaguagaucgaagcgaagcaaaagaaggauuaaaaagaggagaaacaacgaagcaugcaguaucccguggaaccgccaaacuuagaugguuuguagaacguaaucucguucgcccggaaggaaaaguaauugaccuuggcugcggccgaggggguuggucauauuauugugcagggcucaaaaaggucacugaaguaaaaggauauacgaaaggugguccaggacacgaggagcccaucccaauggccacauauggauggaaucuggucaaauuauacaguggcaaagacguuuucuuuacaccaccggagaagugugacacuuuacuaugcgauauaggggagaguaguccuaauccuacaauagaggaagggaggacacugcgggugcucaaaaugguggaaccguggcuaagagggaaucaguuuuguauaaaaauucuuaacccauauaugccaaguguaguggaaacauuagaacaaaugcaacgaaaacauggugggauguuagugcgaaauccucuaucaagaaauucuacucaugaaauguauugggugagcugugggaccgguaauauaguaucugcuguaaauaugaccucacgaaugcuuuuaaaucgcuucaccauggcucaccgaaaaccgacauacgaacgagauguagaccucggagcugguacgcgacacguagcagucgagccugaaauugcuaaccuugauauaauaggacagcggaucgaaaacauuaaaaaugaacacaaauccacauggcacuaugaugaagauaauccuuacaaaaccugggcauaucaugguucauacgaaguaaaaccaagcggauccgcaucaaguaugguaaacgggguuguacgucuauuaacgaaaccaugggauguaaucccgaugguuacccaaauagcuaugacagacacaaccccauuuggacaacagagaguauuuaaagagaaagucgauacaaggaccccacgaccuaaaagagguacagcacagauaauggaaguaacugcaaaguggcuuuggggguuucuaucaaggaauaaaaagccacgaaucugcacaagggaagaguucacaagaaaaguccggucaaaugcagccauuggagccguauuuguagacgaaaaccaauggaauagugccaaagaagcuguggaggacgaaaaauuuugggaucuuguacaucgggagcgugaauuacauaaacaagguaaaugugcuacaugugucuauaacaugaugggaaaacgagagaagaaacuaggggaguucgguaaagcuaaggggagcagagccauaugguacauguggcuaggcgcuagauuucucgaauuugaggcucuaggguuuaugaacgaagaccacugguuuucuagggaaaacagcuugucaggaguugaaggugaagguuuacauaaacucggauauauuuuacgagauauaucaaagaucccgggaggcaacauguaugcugacgauacggcgggaugggauacccgcauaacagaagacgauuugcaaaacgaagcaaaaauaacugacauaauggaacccgaacacgcacuauuagcaacgagcaucuuuaaacuaacauaucagaauaaaguggucaggguucaaaggccagcaaaaucugguacgguaauggaugugauaagccgaagggaucaacgggggaguggacaaguaggcaccuauggguuaaauacauucacuaacauggagguacaauuaauacggcagauggaaagugaagguauuuucucuccgucagagcuagaaaauucuaauuuagcugaacgaguuuuagacuggcuugaaaaacauggaguagaaagacuuaagagaauggcuauaaguggugaugauugcguuguuaagcccaccgaugaccgauuugcaaccgcucuaacggcacucaaugauauggguaaagugaggaaggauauuccacaaugggaaccaagcaaagguuggaacgauuggcaacaaguuccuuuuugcucacaucacuuccaccaacuuauuaugaaagauggccgugaaauaguuguaccuugucgaaaccaggaugaacucguggggagggcgcgaguaucacagggcgcggguuggucgcuaagagaaacagcuugccucgggaaaaguuaugcacaaauguggcaauuaauguauuuccaucggcgugauuuaaggcucgccgcuaaugcaauuugcucagcugugccaguugauuggguaccaacuucucgcacuaccuggagcauacacgcacaccaccaauggaugacgacggaagacaugcuaucaguauggaacagaguauggaucgaagaaaacccauggauggaagauaaaacucaugugagcucaugggaagaugugccauaucuugguaaacgagaagaucaauggugugguucacuaauugguuuaacggcacgcgcaacuugggcgacuaauauucaaguugcaauaaaccaagugagaagauugauuggaaaugagaauuaucuagacuauaugacgucuaugaaaagauuuaagaaugaaucagauccugaaggggcuuuaugguga

SEQ ID NO: 22024 - RNA, 9879 nt, Artificial Sequence
  derived and/or modified CDS sequence (opt6) from DENV-1__KP406802__SS-prME
aguguaacaauguuacugaugcugaugccuaccgcuuuggcguuucaccuaacaacgagaggaggagaaccccauaugauuguuucgaaacaagaaagaggaaaaagccuuuuguucaaaaccucagcagggauuaauaugugcacacugauagcuauggacuuaggggaacuaugcgaagauacauugacauauaaaugcccgcgaaucacugaagcugaaccagaugauguggacugcuggugcaaugcgacagauacgugggugacauauggaacuuguagucaaacaggcgaacauagacgggauaaacguagcguagcccuagcuccccacgucggguuaggauuggaaacaagaacggaaaccuggaugucuucggaaggugcguggaaacaaauucaacgaguggaaacaugggcacuucgucaucccggauucacuguuauagcuuuauucuuggcccaugcuauugggaccaguauaacacaaaaaggcauaaucuuuauacuucuuauguuagucacacccaguauggcuaugcgaugcguaggcauugguagcagagacuucguugaaggacuaucgggugcaacuuggguugacgugguccucgaacacggcucuugcgugaccacgauggcgaaagauaaaccgacuuuagauauagaacuuuuaaaaaccgaagucacuaauccugcaguucucaggaaauuauguauagaagcuaaaauaucgaacacaaccacagacucuagaugcccuacucagggugaagcgacauuagucgaggaacaagaugcaaacuucguauguaggcgcaccuuuguugacagagggugggguaaugguuguggcuuauuuggaaaagggucauuaauaaccugugcuaaauucaaaugcgucaccaaauuagaaggaaagauuguccaauacgaaaaucuuaaauauagcguaaucguaacugugcauacaggggaucaacaccaaguagggaaugagaguacggagcauggaacuaccgcaaccauaacaccccaagcuccuacuacugaaauacaauuaacagauuauggugcauuaacauuggauuguuccccaagaacuggauuagacuuuaacgaaaugguacuacuaacaaugaaggagaaaucaugguuagugcauaaacagugguuucuggaccuaccacugccuuggacaucgggcgccaguacaucccaagaaauauggaaccgacaagaccuguuagucacauucaaaacagcccaugcaaagaaacaagagguagugguccuugggucucaggagggugcaaugcauacugcacuaacaggagcuacagagauacaaaccucggguacaacuacaaucuuugcaggccauuuaaaauguagguuaaaaauggacaaacuaacguuaaaaggcauguccuauguaauguguacagggagcuuuaaauuagaaaaagaaguugcugaaacacagcaugggacgguacuuguacaaauuaaauacgaaggcacugaugcuccauguaaaauuccauucucgacacaagacgaaaaaggcgucacucaaaauggacggcuaauuacagcaaauccaaucguaacagacaaagaaaagccaguaaauauagaagcggaaccgccuuuuggcgaaagcuauauaguaauaggagcuggagaaaaagcacucaaacuuagcugguucaagaaagguaguucaauaggcaaaauguuugaagcaacagcaaggggugccaggaggauggccauacuaggagacacggcaugggacuuugguucaaucggaggaguauucacaucuguggguaaacucguacaucagaucuuuggaacugcuuacggaguccuauuuucaggagugucguggaccaugaaaauugggauaggggugcuacuaacaugguuaggacuaaauucaagaucgaccucauugaguaugacuuguauagcaguaggccucguaacgcuauaccuuggaguuaugguacaggcugacuccggauguguaauaaacuggaagggaagggaauuaaagugugggagugggaucuuuguaaccaacgaaguucacacuuggacggaacaauauaaguuccaagcugacaguccaaaaagacuuucggcggccauaggaaaggcaugggaagaaggaguauguggcauaagaucugccacaagguuagagaacauuauguggaagcagaucagcaacgagcuaaaucacauccuguuagaaaacgacaugaaauuuacugucguuguaggcgauguugcagggauccucgcacaagguaagaaaaugaucaggccacaaccaauggaacauaaguacaguuggaagucuugggguaaagcuaagaucaucggagccgacguucagaauaccacauuuauaaucgacgguccaaauacuccagaauguccugacgaccagagagcauggaacauaugggaagucgaagacuacgguuuugguauauuuaccacuaauauauggcucaaauuaagagauagcuacacgcaagugugugaccaucgacuaauguccgcagccauaaaagacucaaaagcaguucaugcggacaugggauauuggauugagagcgagaaaaaugaaacguggaaacucgcucgcgcaucguucauagaggucaaaacauguauauggccgaaaagccauaccuuauggucgaacggagugcuggaaagugagaugaucaucccuaaaaucuaugguggcccuauaucgcaacacaauuaucgaccaggguauuuuacccaaacagcgggaccguggcaccuagguaaacuagaauuggauuuugaccugugugaaggaacuacggugguaguagaugaacauuguggaaauagagguccaagccuaagaacgacuacaguuacuggaaaaauaauacacgaaugguguuguagaucuuguacuuuacccccauugcgcuucagaggugaggaugguuguugguacggaauggaaauccgacccgucaaagaaaaagaagaaaauuugguaaagucaauggucagugccgguagcggagaagucgauagcuucucgcuagggcugcuuuguauaucaauaaugauugaggaagucaugcguagcagauggucaagaaaaaugcuuaugacgggaacucuggcuguauucuuuuugcuaauaaugggacaauuaacauggaacgaucuaauccgacuauguaucaugguuggggcuaacgcgucagacagaaugggaaugggaacaacauaucuagcacuuauggccacguucaagaugagaccaauguuugcggucggucuacuauuucgucgauugacgucaagggaaguucuguuguugacaauaggauuaucuuuaguggcaucuguagaacucccgaauagucuagaagaauuaggagauggguuggcuaugggaauaaugauuuuaaaauuauuaaccgauuuccaaagucaccaguuaugggcgacguuacuaagucuuacauucauaaaaacgacuuuuagcuuacauuacgcauggaagacgauggcaauggugcuaaguauugugaguuuauuuccccuuugucuaucaacuacaucucagaaaaccacaugguuacccguauuauuggguucguuaggcuguaagccauuaacaauguuuuugaucgcagaaaacaaaauauggggucguaagucauggccauuaaaugagggaauuauggcgguuggaauaguuucuauuuuauugucaucucuacucaaaaacgauguuccuuuagcgggaccauuaauagcagggggaaugcuuaucgcguguuauguaauaucugguucgagcgcggaccucaguuuagagaaagcugcggaagucucgugggaagaagaagcugagcauucgggugcuucacacaacaucuuaguugagguucaagacgaugguacgaugaaaaucaaagacgaagaacgggaugauacauuaacgauccuacuaaaagcaacccuacuagcaguaagugggguauacccccuuagcauaccagcuacccuauucgugugguauuuuuggcagaagaagaaacagcguaguggcguauuaugggauacaccgucaccuccugaaguggagcgugcggugcucgaugauggaauauaccgaauaaugcaacgagguuuacucggaagaagucaaguugguguggguguguuccaagaaaaugucuuccacacaauguggcaugugacaagaggagcuguauugauguaucagggcaaacggcuagaaccaaguugggcgagcguuaagaaagaucuaauaagcuaugguggaggcuggcgccuacaaggauccuggaauacaggagaagaaguacaaguaauagcaguagagcccggcaaaaauccuaaaaauguacagacggcuccuggaacauucaaaacacccgaaggcgaaguaggcgcaauugcacucgauuucaaaccaggaacgagcggguccccgauugugaaucgagaggggaaaaucguugggcuuuauggaaauggaguaguuacgacaagugggaccuacguuucagcaauugcucaagcgaaggcgucacaggaaggcccccuaccagagauagaagaugaagucuuccgaaagcgaaaucucaccauuauggaucuccacccuggaagcggcaagacaagaagauaccuaccugccauaguuagggaagcaaucaagcgcaaacuaagaacgcuaauauuagcgccgacgagaguaguagcuagugaaauggcagaagcucugaagggaaugccuauucgcuaucagacuacagccguaaagagcgaacacacaggaaaagaaauaguagacuugaugugccacgcaacauuuacaaugcgacuacucucgccagugcguguaccuaauuacaacaugauaauaauggaugaggcgcauuucacagacccgucuucaauugcagcgagagguuauauaucuacacguguagggaugggugaagccgcugcuauuuuuaugaccgcuacaccuccagguucuguugaggcuuuuccucaaaguaaugcugugauacaagacgaagaacgagacauaccggaacgaagcuggaacucagguuaugaauggauaacggacuuuccuggaaaaacgguuugguuuguaccaaguauuaaaucagguaaugacauagcuaacuguuuacggaaaaauggaaaaagagucauacaauuaucgagaaaaacauuugauaccgaguaucagaaaacuaaaaacaacgauugggauuacguggucacaacagauauaagugaaaugggagccaauuuucgagcagauagaguaauagauccacgacguugccuaaaaccuguaauuuuaaaagacggaccugagcgaguuauacucgcgggaccuaugccuguaaccguugcuagugcugcccagagacgaggacgaguagggcguaaucacaacaaagaaggugaccaguacauuuacaugggacaaccuuuaaacaaugacgaagaccacgcgcacuggaccgaagcaaaaaugcuucuugacaacauaaauaccccggagggaauuauaccugcauuauuugaaccugaacgugagaagucagcagcgauagauggagaauacagacuacgaggcgaggcgagaaaaaccuuuguggaacuuaugaggcguggugaucugccgguauggcucucuuacaagguagcaagugaaggguuucaauauagugaucggaggugguguuucgacggugaacgcaauaaucagguauuggaggaaaacauggacguugagauuuggacaaaggagggagaacggaagaaauuaaggccaagauggcuggacgccaggaccuauucggauccgcuggcacugagggaauuuaaagaauuugcugcggguagacguagugugucaggcgaucuuauauuagaaauagguaaauuaccacagcauuuaacacaaagggcacagaaugcucuugacaacuuagucauguugcacaauagcgaacaaggagggagagcguacagacaugcaauggaggaguuacccgauaccauugaaacucuuaugcuucuagcacucauugcuguucucaccggaggagugacguuguuuuuccuaucaggaagaggacuugguaaaacaaguauaggcuuacuaugugucauggcaucuucaguacuauuguggauggcaucgguagaaccacauuggauagcugccaguaucaucuuagaauuuuucuuaaugguauugcuaauccccgagccagaccgacagcggacaccucaagauaaucaacucgcauauguagugaucggauuacuauuuaugauuuugacaguagcagcuaacgaaauggggcuacuagagaccaccaagaaagacuugggaauuggacaugucgccguggaaaaucaucaccaugcagcaaugcuggacguagauuuacauccagcuucugcguggacacuauacgcaguggccacaacuauaauuacuccaaugaugagacauacaauugaaaauacuacagcuaauaucagucugacagcgaucgcaaaucaagcggcgauauuaaugggcuuagauaaaggguggccaaucaguaaaauggauaucggaguaccucugcuggcacuuggauguuacucacaaguuaacccguuaaccuuaacagcugcuguacuaauguuaguagcacacuaugccauuauuggcccuggccuccaagccaaggcuacacgagaggcacagaaaagaacagcugcgggaauaaugaaaaauccuacuguagaugguauaguugcuauagaucuggaccccgugguauaugaugcaaaauuugaaaagcagcuuggccaaauaauguuguuaauccucugcacaucacaaaucuuacuuaugcgaacaaccugggcccuaugcgagucuauuacucuagccacagguccacuuacuacucuaugggaaggaucacccgggaaauuuuggaacacgacuaucgcgguuucuauggcaaacauauuccggggaaguuaccuagcuggugccggacuagcauuuucucuaaugaaaaguuugggcggcgguaggagagguacaggagcgcagggcgaaacgcuuggggaaaaauggaaacggcaacuuaaucaacuaucaaaaucagaauuuaacacuuauaaacggaguggaauaauggaaguagaucgcucugaagccaaggaagguuuaaaacguggugagacaacuaaacaugccguauccagaggaacggccaaauuaagaugguuuguagagagaaaucucgucaaaccagaaggaaagguaauugaccucgguuguggacgaggaggauggucuuacuauugugcaggacucaagaaaguaacagaaguaaagggguauacuaaagguggaccugggcaugaagaaccaauaccaauggcuacuuauggguggaaucugguaaaguugcacaguggcaaagaugucuucuuuaucccuccagaaaaaugugacacccuacuuugugacauaggagaaaguucuccuaauccaacaauugaggagggacgaacacuaaggguccuuaaaaugguugaacccuggcugcgaggaaaccaauuuuguauaaaaaucuuaaacccauauaugccgucgguuguagaaaccuuagaacagaugcaaagaaaacaugguggaauguuaguacguaauccauuaucacgcaauaguacacaugagauguauuggguaaguugcgggacagguaacauaguuagugcggucaacaugacuucgagaaugcuucuaaacagauucacuauggcccaccgaaagccaacauacgaaagagauguagauuuaggggcuggaacucgccacgucgcaguagaacccgaggucgcuaauuuagauauaauaggacaacgaaucgagaauauuaaacacgaacauaaaucuacauggcauuaugacgaagauaacccauacaaaacgugggccuaucauggaagcuacgaagucaaaccaagcggcagugcuucuaguaugguaaaugguguggucaaacuauuaacgaaaccuugggauguuauuccaauggugacgcaaauugcaaugacugauacgacaccuuuuggacagcaaagaguauuuaaagaaaaaguagauacacgaacuccaaaggcaaagcgaggcacgacccaaauaauggaaguuacugccagauggcugugggguuucuuaagccgaaauaagaaaccgagaauauguacgagagaagaauuuacuagaaaaguccgaucaaaugcugcaauaggggcaguguucguagaugaaaaucaauggaacucagcuaaagaggcuguagaagacgaacguuucugggaccuuguccacagagagcgagaauugcauaagcaaggaaagugugcgacauguguauacaauaugaugggcaagagagagaagaaauuaggugaguucggaaaagccaaagguagucgagccauuugguauauguggcucggcgcuagauuucuugaauuugaagcacugggauuuaugaacgaagaucauugguuuagcagggaaaacucucuaucagguguugaaggugaagguuuacauaaauuagguuauauacuucgagauauuucaaaaaucccaggugguaacauguacgcagaugauacggcagguugggacaccagaauaacggaagacgaucuucaaaaugaggcaaaaauuaccgacauaauggagccggaacacgccuuauuggccaaagcuaucuuuaaauuaacguaucaaaacaaaguuguucgaguacagcguccugccaaaaaugggacaguaauggacguaauuucacguagagaucaacgaggcaguggucaagugggaaccuauggucuuaacaccuuuacaaacauggaagcccaauuaauaagacaaauggaaucagaaggaauauuuucaccauccgaauuggaaacaccuaauuuggccgaaagaguacuagauugguuggaaaaguacggaguagagagguuaaagcgaauggcaauaucgggagaugauuguguagucaaacccaucgaugaccgcuuugcuacagccuuaacagcacuaaaugauaugggaaaaguuagaaaggacauaccgcagugggaaccaucgaaagguuggaacgacuggcaacaaguaccuuucuguucacaucauuuucaccaacuuauuaugaaagaugguagagaaauagugguaccuugccgaaaucaagaugaguugguaggucgagcucgaguuagccaaggggcaggauggucacuuagagaaaccgccugccuaggaaaaucuuacgcucaaauguggcaacuaauguacuuccacagaagagaucuucgucucgcagccaaugcaauuugcucggcuguacccguggacuggguaccuacaucgcgaacgacuuggaguauccacgcacaucaccaauggaugacuaccgaagauauguugagcguauggaacagaguauggauugaggaaaauccauggauggaagacaaaacacacauaaguaguugggaagauguuccauacuuaggcaaaagagaagaucagugguguggcucacugauaggccugacugcgagagcuacaugggcaacaaauauacaaguggcaauaaaucaaguccgaagauuaauagguaacgaaaacuacuuagauuacaugaccaguaugaaaagguuuaaaaaugagucagacccggaaggagcauuaugguag

SEQ ID NO: 22025 - RNA, 9879 nt, Artificial Sequence
  derived and/or modified CDS sequence (opt6) from DENV-1__KP406803__SS-prME
ucaguaacuauguuguuaaugcuacuccccacugcucuagcauuucaucuuaccacccgugguggagaaccccacaugauagucaguaaacaagaacguggaaaaagccuacuauucaaaacauccgcggggguuaacauguguacuuuaauagccauggaucucggggaacugugugaagacacaaugacguauaaaugcccacgcauaacagaaacagaaccagaugacguagauugcugguguaaugcgacggagacauggguaacauaugguacguguucucaaacaggugaacaucgcagagauaaacguaguguugcgcuagccccacauguaggucuaggacuugaaaccagaaccgaaacauggaugucaucggaaggagcuuggcgccaaauucaaaaagucgaaacaugggcauugagacauccagguuuuacaguaauagcuuuguucuuagcacacgcuauaggaaccagcauaacacaaaaagguauaaucuuuauccuacucaugcuaguaacucccuccauggcgaugaggugcgucgguauuggaaauagagauuuuguggaaggucucucgggagcgacgugggucgaugucguacuagaacacgguucauguguuacuacaauggcuaaagauaaaccuacccuggauauugaacugcuaaaaacugaaguuacaaaccccgcaguacuacguaaacuaugcauugaggccaaaaucucgaauacgacaaccgacucgcgguguccgacucaaggagaagcuacauugguggaagaacaagacacuaacuuugugugcagaagaacguuuguagacagaggaugggggaauggaugcggauuauucggcaaaggaucgcugauaacuugugcaaaauucaaauguguaacaaaauuggaaggaaaaauuguccaauacgaaaaucuaaaauauaguguuaucguuaccguccauacaggcgaucaacaucaaguaggaaaugaaacaaccgaacacgggacaacugcaacaauaacaccgcaagcgcccacauccgagauccaacuaacggauuauggggcccuaacuuuagauuguucucccagaaccgguuuagauuucaaugaaaugguacugcuaacaaugaaagagaaaagcuggcugguacacaaacaaugguuucuagacuuacccuuacccuggacguccggggcaagcacaagucaagaaacauggaauaggcaagaccuuuuagugacauuuaaaacggcucacgccaagaaacaagagguuguaguacuuggcucacaagaaggcgcaaugcauacugcacuuacaggugcuacagaaauccaaacaucugggacaacaacuauauucgcgggacaucuuaaaugcagguugaaaauggauaaacucaccuuaaaggggguaagcuacguaauguguacggguaguuucaagcuagaaaaagaaguagcagaaacucaacacggcacuguuuuaguucaaguaaaauaugaaggaacagaugcgccuuguaagauuccguuuagcagucaagaugaaaaaggaguaacacagaaugguagauuaaucacggcgaaucccauuguuacagauaaagagaagcccguuaauaucgaagcggaaccuccauucggggaaucauauuuagugguaggagcaggagaaaaagcguugaaguuaagcugguucaagaaaggaaguucgauaggaaaaauguuugaagcaacggcuagaggagcaagaaggauggcaaucuuaggagauaccgcaugggacuuugggagcaucgggggagucuucacuucagucgggaaacuuauacaucaaauuuuugguacugcauaugggguacuguuuuccgguguuagcuggacuaugaaaauaggcauaggcauucuuuuaacauggcuaggccuaaauaguagaagcaccagcuuaucaaugacaugcauagcgguuggaaugguaacgcuauacuuggguguuauggugcaagcugauucaggcugcguaauuaacuggaaagguagggaguuaaaauguggauccggaauauucguaacuaacgagguacauacguggacagaacaauauaaguuccaggcagacucgcccaagagguuauccgcugccauaggaaaagcgugggaagaagguguaugcgggauuagaucagcuacacgacuagagaacauaauguggaaacaaauauccaacgaacucaaccacaucuuacuugaaaacgacaugaaguucacuguaguaguuggcgaugucaaugggauuuuagcgcagggaaagaaaaugauacguccgcaaccaauggagcauaaauauucauggaaaucuugggguaaagccaaaguuauuggcgcagauguucagaacauuacguuuaucauugauggcccaaacacucccgagugcccagaugaucagagagcauggaauauaugggaaguugaggacuauggguucggcauuuuuacaacaaauaucugguuaaagcugagagauagcuauacacaaguuugcgaccauagacuaaugagcgccgcaauuaaagauucuaaagcuguacaugcagauaugggauacuggauugaaucggagaaaaaugaaacauggaaguuaaccagagcauccuucauagaaguaaagaccuguguguggcccaaaucucauacguuauggaguaauggcguccuagaaagcgaaaugaucauuccgaaaauuuacggugggccaauaucacaacacaauuaccgaccugguuauuucacacaaacagcgggaccauggcaccuggguaaacuugaauuagauuuuggucuaugugaagguaccacgguggucguggacgagcacuguggaaacagaggaccaucuuugcguaccacuacagucacaggaaaaauuauccacgaguggugcugcaggagcugcacccuaccaccccuaagguucaaaggagaagaugggugcugguacgguauggaaauuagaccuguaaaagaaaaagaagaaaauuugguaaaaucuaugguuagcgccggcucaggagaagucgauagcuucaguuuaggcuuguuaugcauaucuauaaugauagaagaaguuaugcggagcagauggagcagaaagaugcuaaugacaggaacacuagcaguauuucuguuauuaauaaugggucaacuuacguggaacgaccucauacgucuauguauaaugguaggagccaaugcaagugauaaaauggguaugggaacuaccuaccuagcguuaauggcuacauucagaaugagaccaauguucgcgguaggacuucuauucagacgauuaacaagucgugagguucuguugcucacuguaggauugucacugguagcaucaguugaauuacccaauagccuagaagaacuaggcgacgggcuagccaugggaauaaugauguugaaauuauuaacggacuuucaaucccaccaacuuugggccgcacuauugucacuaacuuucgugaaaacgacuuuuucucuucacuacgcguggaaaaccauggcgaugauuuuaagcauagucucacucuucccucuauguuuaagcacaacaagucagaagacaacguggcucccgguauuguuagggucacuaggauguaaaccacuuacuauguuccugauaacagaaaauaaaauaugggggcgaaagaguuggccgcugaaugaaggaauuauggcgguuggcaucguaucaauacuuuuaucuucacuccuuaaaaaugauguacccuuagcuggaccguuaauugcggguggaaugcuuauagcuuguuaugugauuucaggaucuagugcagauuuaucauuagaaaaagcagcugagguauccugggaagaagaagcagagcauaguggugcuagucauaacauccuaguagaaguucaggaugaugguacaaugaaaauuaaagaugaagaacgagaugacacacugacaauucuacuuaaggcaacgcuacuagcuauuagcggcgucuacccaaugaguauaccagcaacauuauucguuugguauuuuuggcagaagaagaaacaaagaucgggaguacucugggacacuccaucgccaccggaaguggaacgcgcugucuuggaugacgguauauaucgaauauuacagagaggacucuuagggaagucacaggugggagugggagucuuccaggaaggaguuuuucauaccauguggcauguuacaagaggugccgucuuaauguaccagggaaaaagguuggaacccucgugggcuucgguuaagaaagauuugauaaguuacgggggaggauggagguuucagggcuccuggaacacgggcgaagagguccagguaaucgcugucgaaccuggcaaaaaccccaaaaacguucaaacagcaccugggacauuuaaaacaccagagggggaaguaggggcgauagcacucgacuucaaaccuggaaccucagggaguccuauaguuaaucgugaagguaagauugucggacuauacggaaaugguguaguuaccacuucagggacuuauguuuccgcaaucgcucaggccaaggcuucacaagaagguccauuaccggaaauagaagacgaaguuuuccguaaaagaaacuuaacuauaauggauuugcauccuggcagcgguaaaacaagacguuaucuaccugccaucgugagagaggcgauaaaaagaaaacuuagaacccuuguacucgcaccuacaagaguaguagccucagaaauggccgaggcguuaaaagguaucccuauaagauaucaaacaacagcugucaaaucagagcauacagguaaagaaauuguagauuuaaugugccaugcuacguuuaccaugagacuauuaaguccuguaagagugccaaauuauaacaugauaauuauggaugaagcgcauuucacugauccggcaagcauagcggcaagaggauauaucagcacuagaguuggaaugggcgaggccgcggcuauauuuaugacugcgacaccgccuggaaguauggaggcuuuuccucagagcaaugcagcaauacaagaugaagaaagagauauuccagaacggucauggaacaguggauaugauuggauuacagauuuuccaggaaagacgguuugguuuguaccgaguauaaagucggggaaugauauugcuaacugcuuacggaaaaaugggaaaagagugguucaacucaguagaaaaacauuugacacugaauaccagaaaacuaaaaacaacgauugggauuauguaguuaccacagauaucucagaaaugggcgcaaauuuucgugccgauagaguuauugacccaagaaggugcuuaaaaccaguaauacuuaaggacggaccagagcgugugauucucgcagggccaaugccggucacugucgccucagcagcucaacgacgcggacguauaggucgaaaucaaaacaaagaaggcgaucaguacaucuauauggggcaacccuuaaauaaugaugaagaccaugcgcacuggacggaagcaaaaauguuguuagacaauauaaauacaccugaaggaauaauuccggcucuauuugaaccagaacgagaaaagagcgccgccauagacggcgaauaccgauuaagaggugaagcgagaaaaacauuuguagaacugaugagacgaggagaucuuccaguuuggcuaaguuauaagguugcauccgaaggguuccaauauagugaucggagaugguguuuugacggagaacgaaauaaccaaguucucgaagaaaauauggacguugaaauauggacaaaagagggcgagagaaagaaacuaagaccacgguggcuugacgcaaggaccuacagcgauccuuuggcucuaagggaguuuaaggaauuugcugcaggcagaagaucaguaucaggagauuuaauccuagagauaggcaaauuaccacaacacuuaacacagagagcucaaaaugcauuggauaacuuagugauguugcacaacucugaacaaggcggaaaagcguacagacaugccauggaagaacuaccggauacaauugaaacucuaauguuacuagcucuaaucgcugucuuaacgggagggguuacccuauucuuucuaagugggagaggcuuaggaaaaacuucaaucggguugcuuuguguaauggcaaguucugcucuguuauggauggcaagugucgaaccccauuggauugcggcgucaauuauccuggaguucuuucuaaugguauuauuaauaccagaaccagauaggcaacggacgccacaggacaaucaauuagcauauguugucauaggccugcuuuuuaugauacuuacuguugcagcgaacgaaaugggauuacuagaaacuacuaagaaagaucucgggauaggacaugucgcagcugaaucccaccaucacgcagcuauguuggacgucgaccuucauccagccuccgccuggacucuauaugcaguugcaacuaccauaaucaccccaaugaugagacacacaauagaaaacacuacagccaacauaagccuuacagcuauagcuaaccaagccgcaauuuugaugggucuugacaagggauggcccauaucgaagauggauauuggagugccucuuuuggcucuagguuguuauagucaagugaauccguuaacacugacugccgcagugcucaugcuuguagcgcacuaugcaauaauaggucccggauugcaagcaaaagcaacgagagaggcacaaaaacgaaccgccgcugggauuaugaaaaauccuacuguugauggaaucguagcaauugaucuagauccaguaguauaugacgcaaaauucgaaaagcaguuaggccaaauuauguuauuaauauuauguacaagucagauacuccuaaugcguacaacaugggcacuaugugaaaguaucacacucgcuacggguccguugacuacucuuugggaggguuccccuggaaaauucuggaacacaacgaucgcugugaguauggcuaauauuuuuagaggcucuuaccucgcaggagcuggcuuagcauuuagccucaugaaaucuuugggugguggacgccgcgguacuggggcacaaggagagacacuaggggaaaaguggaaacgccaauugaaccaguugaguaaaucagaguuuaacaccuauaagagaucaggcaucaucgaagucgauaggucggaagcaaaagagggucucaagagaggagaaacaacuaaacacgcaguaucucgaggaacagcuaaacuacguugguuuguagaacgaaaccugguuaaaccagaagguaaaguaauugaccugggguguggcagaggagguugguccuauuauugugcaggcuuaaagaagguaaccgagguaaagggcuauacgaagggcggucccggacaugaggaacccauaccaauggcgaccuacgguuggaauuuaguaaaguuauauaguggaaaagacgucuucuuuacuccaccugaaaaaugcgauacuuuacuuugugacauaggggagucuagcccaaaccccacuaucgaagaagggagaacacucagaguacugaggaugguugagccuuggcucaggggaaaucaauucugcauuaaaguauuaaacccauacaugccgucuguaguagaaaccuuagaacagaugcaaagaaaacauggggguaugcuaguuagaaauccacugucucgaaauucuacacaugaaauguauugggugucgugcgguacuggcaauauugucucagcagucaauaugacaaguaggauguugcuuaaucgauuuacgauggcucaccgaaaaccaacauaugaacgagacguagaucuaggagcaggaacacggcaugucgcaguugaacccgaaguugcgaaccuagauaucauuggacagcguauagagaauaucaaaaaugaacauaagagcacuuggcauuacgaugaagacaacccuuauaaaaccugggcuuaccacggcucuuacgaagugaaaccaagcggcagugccucgucuauggucaaugggguuguuaggcuacuaacaaaacccugggauguaauacccaugguaacgcagauagcgaugacugauacuacaccuuucggacaacagcgggucuucaaagaaaaaguugacacgcgcacuccaaaagccaaaaggggaaccgcucaaaucauggaaguaacagcuagaugguuauggggauuccuuucaagaaacaagaagccucgcauuuguaccagagaagaauuuacgagaaaaguacgaucgaaugccgcuauaggcgcagucuuuguugaugagaaucaguggaacucagccaaggaagcuguagaagacgaacgguuuugggaccuaguccaucgagaaagagaacuucacaaacaggggaaaugugcgacaugugucuauaacaugaugggcaaacgagaaaagaaauuaggagaauuugggaaggccaaaggaucacgugcgaucugguacauguggcuaggcgcaagguuucuugaauuugaagcccucgguuuuaugaaugaagaucauugguucagucgagaaaauagucuauccgguguagaaggagaggggcuccauaaacuagguuacauauuaagagauaucaguaaaauaccgggagggaauauguaugcugaugauacugcaggaugggauacgaggauaacggaagaugacuuacagaacgaggcuaagauuacugauaucauggaaccagaacacgcuuugcucgcaaccucaauuuucaaauugacauaucagaacaaggugguaaggguccaacgcccggcaaagaacgguacaguaauggacguaauaagccgacgagaucagagaggaucaggucaaguagguacguauggucuaaauacauucacuaauauggaagcucaauuaauuagacaaauggaaagugaagggauauuccuucccucagaacuggaaaccccuaaccuugcugaaagaguauuagauuggcuugaaaaguacgguauagaacgacuaaaacgaauggcuauaaguggagacgacuguguuguuaaaccuauagaugacagguuugcaacagcacuaacggcucuuaacgacauggguaaagugagaaaggacauuccacaaugggaacccaguaaaggauggaacgauuggcaacagguuccuuuuugcagucaccacuuucaucaacugauaaugaaagauggacgugaaauuguaguuccaugcagaaaccaagaugagcuaguuggacgagcaagagucucgcaaggcgcgggauggaguuugagggaaaccgcauguuuagggaaaaguuacgcacagauguggcaacuuauguauuuucaucgaagagauuugagguuggcagcgaacgcaaucuguagugcaguacccgucgauuggguuccgacaucuaggacgacauggucuauccacgcucaucaccaauggaugaccacugaggacaugcuaaguguauggaaucguguuuggaucgaggaaaauccauggauggaagacaagacacauguaaguucaugggaagauguaccuuaccugggaaaaagggaggaucaauggugugggucgcuuauagguuuaacagcacgggccacuugggccacaaacauucaaguagcaaucaaccaggucagaagacuaaucgggaacgagaauuauuuagacuacaugacuucaaugaaacgauucaagaaugaaagcgacccugagggcgcgcuuugguga

SEQ ID NO: 22026 - RNA, 9879 nt, Artificial Sequence
  derived and/or modified CDS sequence (opt6) from DENV-1__KJ438293__SS-prME
agcguuacaauguuacuuaugcucaugcccaccgcucucgcauuucaucucacaacaagaggaggggaaccccauaugauugucuccaaacaagaaagaggaaaaucauuauuauucaaaacuagcgcgggagucaauauguguacauuaauagccauggaucuuggggaacuaugcgaagauacaaugacguauaaaugcccaagaauuacagaagccgaacccgacgacguugauugcugguguaaugcaacugauacaugggucacauacgguacuuguagucagacaggagagcauagaagagauaaaagaucugucgcucuagcuccacacgugggauugggacuagaaacacguacagaaacauggaugucuucugaaggcgcauggaaacaaauucagcguguggaaacaugggccuugaggcacccaggauucacaguaauagcguuauuuuuagcccaugcuaucggaacaucuaucacucagaaagguauaauuuuuauccucuuaaugcuuguuacaccaaguauggccaugagaugcguagggauagggucccgagacuuuguggaaggauuaagcggagccacuugggucgaugucguauuggagcauggaaguugugugaccacuauggcuaaagauaaacccacauuagauauagaauuauugaaaacagaagucaccaacccagccauauuacguaaacuaugcaucgaagcgaaaauaucaaauacaacaaccgauagucguugucccacccagggagaagcuacacuugucgaagaacaagaugcuaacuucguaugucgacggaccuucguugauagaggauggggaaacggcuguggacuauucggaaaagguucacucaugacgugugcaaaauuuaaauguguaacaaaacuggaaggaaaaauugugcaauacgagaaucucaaauauucgguaauugugacaguacauacgggcgaucaacaccaaguagguaaugaaucaaccgaacaugguacaacugcaaccaucacaccgcaggcuccgaccacggaaauacaacucacagauuacggcgccuuaacacuagauuguuccccucgcaccggccuagauuucaaugaaaugguuuugcuuaccaugaaggagaaaucauggcuaguucacaaacaaugguucuuagaucuaccccuccccuggaccucaggagcaagcacaucucaggaaacguggaaucgacaggauuuacugguuacuuucaagacugcccaugccaagaaacaagaggucguuguuuuggggagucaggaaggugcgaugcauacagcgcuaaccggagccaccgagauccagacuagcggaacgacgacgaucuuugcuggacaccuaaaauguagacuuaaaauggacaaacuaacuuuaaaaggaaugagcuacgugaugugcacaggaaguuuuaaacuugaaaaggaggucgcagaaacucaacauggaacugucuuaguacaaauuaaguaugaaggcacggacgcuccuuguaaaauaccuuuuucaacacaagaugagaaaggugucacgcagaacggacgacuaauuacagcgaauccaauagugacagacaaagagaaaccggucaacauagaagcugaaccaccauuuggagaaagcuacauaguuauuggcgccggugaaaaagcauuaaagauuagcugguuuaagaagggaaguucaauaggaaagauguuugaggcaacggcuagaggagcaagaagaauggcaauauuaggugacacggcaugggacuuuggauccauaggaggcguauucacauccguaggcaaguuaguccaucaaauuuuugguacagcauauggagucuuauucuccggagucagcuggacuaugaaaaucggaauaggaguacucuuaacaugguuaggcuuaaauucaaggaguaccucauuaaguaugacguguauagcuguuggcuuaguaacccuauaccuuggaguuauggugcaagcggacaguggguguguuauaaacuggaaagggcgggaacucaaauguggcagcggcaucuuuguaacuaacgaggugcauacuuggacugagcaguacaaauuccaagcggauucgccuaaacgucucucggcugcaauaggaaaggcuugggaagaagggguuuguggcauucgaagugccacaaggcuugaaaauaucauguggaaacaaaucucuaaugagcucaaucauauuuugcuugaaaaugauaugaaauucacaguaguggugggagacguggccggaauauuagcacaaggcaagaaaaugauaagaccgcaaccaauggaauauaaauauucauggaaaagcugggggaaggcaaaaauaauuggcgcagacguucaaaauacuacauuuauaauugacggccccaacacccccgaauguccugaugaccagcgcgcauggaauaucugggaagucgaggauuacggauuuggcauuuucacuaccaauauuugguuaaaacuuagggauucauauacacaagucugugaucaucgcuuaaugucggcagcaauaaaagacuccaaagccgugcacgcagauaugggguacuggaucgaaagcgagaaaaaugaaacuuggaaauuggccagagcgucauuuauagaagucaaaacuugcauuuggcccaaaucacauacucuauggaguaaugggguucucgaaagugaaaugauaauaccaaaaauauauggcggacccauuucacaacacaauuauagaccaggauauuuuacgcaaacggcgggcccauggcaccucgggaaacuagaguuggacuuugaucuaugcgaagguacuacaguaguagucgaugagcauugcgguaauaggggaccaucgcuacgaacaaccacugucacuggaaaaauuauucacgaaugguguuguagaaguugcacguuacccccauuacgguucagaggagaggacggcugcugguauggcauggaaauuagacccguaaaggagaaagaggaaaacuuaguaaagaguauggugucagcaggaaguggcgagguagacagcuucucauuaggcuugcuaugcauaaguauaaugauagaagaaguaaugcgcucaagguggucaaggaagaugcuuaugacagggacucuagcaguguuuuuccuucugaucaugggccaacuaaccuggaaugacuuaauccgauuauguauuaugguuggagcaaaugcaagugacagaaugggaauggguacuacuuacuuagcauuaauggcaaccuucaaaaugcggccaauguuugcuguugggcuguuauucagaagguuaacuagcagagaaguauuacuauuaaccauuggacuaucgcugguagcuagcguggaauuacccaacucucuggaagaacucggagacggacucgcaauggguaucaugauucucaaauuauuaacaggauuucaaucccaucaacugugggcaacgcucuugucucuuacauucauuaagacaacuuuuucauuacauuaugcauggaaaacaauggccaugguuuuaucuaucguaucacuguuccccuugugucugucaacgacuucacagaagaccacauggcuaccuguacuccuagguucgcucggguguaaaccauugacaauguucuuaauaacagaaaacaagauaugggguagaaaaucuuggccacuaaacgaaggcauaauggcagugggaauugucuccauacuuuuaagcucauuacuaaagaaugacguaccccuagccggacccuuaauagcgggaggaaugcuaauugcaugcuaugucauaucgggaaguucugcagaucugucacuggaaaaagcagcagaagucagcugggaagaggaggcggaacauuccggagcgucccacaacauuuuaguagagguucaagaugaugggacaaugaaaauaaaagacgaggaaagggacgauacauuaacuauauuguuaaaagcaaccuuauuagccguuagcggaguuuauccacuaagcauccccgcaacacuuuuugugugguacuucuggcagaaaaagaaacaacguucaggcguacuuugggauaccccaagcccuccggagguagaaagagccguccuagacgauggaauauacagaaucaugcaaagaggccuuuuagguagaucacaagugggcguaggcgucuuccaagaaaacguauuccauacaauguggcacgucacgaggggcgcgguucuaauguaucaagggaagagacuagaaccaucgugggcaucugucaagaaagacuuaaucucauacggcggugguuggagacuucaggguucauggaauacuggcgaagaagugcaaguuauagcuguagaacccgguaaaaaucccaaaaacguucaaacagcuccaggaaccuuuaaaaccccagagggcgaaguaggcgccauugcacuagauuuuaaaccaggaacaucaggaagucccauugugaaucgcgaagguaagauaguagguuuguaugguaacgguguaguuacgacaaguggaacguacguauccgcgauugcacaagcuaaagcuagccaagaagguccacucccagaaauugaagaugaaguauuuagaaaaagaaaccugacuauaauggaccuacacccagguuccggaaaaaccagaagauacuuaccagcaauaguaagggaagcaauuaagagaaaauuaagaacauuaauauuggccccaacaagaguaguggcaucagaaauggcagaggccuugaaggguaugccaauccgauaccaaacaaccgcaguaaagucagaacauaccggcaaggagauagucgaucuaaugugccacgcgacuuuuacaaugagacuacuuaguccaguacgagugccaaacuacaauaugauaaucauggacgaagcccauuuuaccgaucccucgagcauagcugccagagguuacaucagcaccaggguggguaugggagaagccgccgcaauauucaugacagcaaccccgccaggaucuguugaagcauuuccccaaaguaacgccguuauacaagacgaagagagagacauaccagaaaggucauggaacuccggguacgauuggauaacagauuuuccaggaaagacaguaugguuuguaccauccauaaaauccgggaaugauauagcaaauugcuuaaggaaaaauggcaagcgugugauccaauuauccagaaagacguuugauacagaauaccagaaaaccaaaaacaaugauugggauuauguaguaacgacagacaucagugagaugggagcuaacuucagagccgacagaguaauugaccccagaagauguuugaagccggucauccugaaagacgggccugaaagagugguucuggcugguccgaugccuguaaccguagcauccgcagcccagcguagagggcgaauaggucgaaaccacaacaaggaaggggaucaauauaucuauaugggacaaccucucaacaacgaugaagaccacgcucacuggacagaagcuaaaauguuacuugauaauauuaacacaccggaaggaauuauaccagcauuauucgagccagagcgcgagaaaagcgcagcuaucgacggcgaauaucgccucagaggagaagcgcgcaaaacauucguagaacuaaugcggaggggagaucuccccguguggcuaaguuauaagguggcaagugaaggauuucaauacucagaucggagaugguguuuugacggagaaaggaauaaucaaguguuagaagaaaacauggacgucgagauauggacuaaggagggagaaaggaagaaauuaagacccagguggcucgacgcgcgaacuuacucugacccacuagcccuaagagaauuuaaagaauuugcagccggcagacgaagugucaguggagaccuaauauuagaaauuggcaaacugccccaacaccuaacacaaagagcacagaaugcucuagacaacuuagugauguuacauaauagcgagcagggaggucgcgccuauagacacgcuauggaggaauuaccggauacgauagagacccuaaugcuacuugcgcuaauugcuguacuaaccggaggaguaaccuuauucuucuuaaguggucgaggguuggguaaaacaucgauuggauuacuauguguaauggcuucuuccguacuccuauggaucgcuucugucgaaccucauuggauagcagccaguauaauccuagaguucuuccuaaugguccuguuaauaccugaaccggaccgccaaagaacaccccaagacaaucagcuugcuuacgucguaauuggauuauuauucaugauauugacgguugcagcaaacgagaugggucuacuagaaacaacgaagaaagaucucggcauaggucauguagcaguagaaaaccaccaucacgccgcaauccuggauguagauuuacacccagcuucagcauggacgcuguaugcaguggcuaccacuauaaucacucccaugaugagacauacuauagaaaacaccacagcaaacauaucacuuaccgcaauagcaaaucaagcagccauacucauggguuuggauaaaggauggccaauuagcaaaauggauauuggaguacccuuauuagcauuaggcuguuauagucaggugaacccccuaacgcuaacggcugcaguauuaaugcucgucgcacacuacgcaauuauagguccaggacugcaagcuaaggcaacucgggaggcucaaaaacgaacggcagcgggaauaaugaagaacccaaccguagauggaauuguggcuauugauuuagauccuguuguguaugaugcaaaauuugaaaaacaguuaggucaaauaaugcuauugaucuuauguacgagucaaauacuuuuaaugcgaacaaccugggccuugugugagucaauaaccuuagcuaccgggccgcuaacaacacugugggaaggaucgcccggaaaguuuuggaauaccacaauugccguaucaauggcaaauauauuuagaggcucauaccuagcgggugcagggcuagcauuuucauuaaugaaaagucuagguggugggagaagaggcacaggagcacaaggagaaacccuaggagaaaaauggaaacggcaacuuaaccaguuaagcaagagugaauuuaauacuuacaaacgaucaggaauaauggaaguagacagaucugaagcuaaagaagguuuaaaacgaggagaaacgacaaagcaugcagucagcagaggcacagcaaagcuaaggugguuuguagagagaaaccuugugaaacccgagggaaaagucauugauuuagguuguggucgggguggauggucuuauuauugcgcuggccucaaaaaggucacugaggugaaaggguacacaaaagguggaccagggcacgaagaaccuauaccuauggccaccuauggauggaauuugguaaaacuguacucuggaaaggacguuuucuucauaccucccgaaaaaugcgauaccuuacuaugugauauaggugaaucaucaccuaacccaacaaucgaggaaggaagaacauugcgagucuuaaaaaugguugaaccauggcuacgggggaaccaguuuugcauuaagauacuuaauccauauaugccaagugucguagaaacacuggaacaaaugcaaagaaagcauggagguauguugguuaggaacccacuaucacgaaacucaacucacgagauguacuggauaaguugugggacagguaacaucguaucagcugugaauaugaccagucguaugcuccuaaaccgauucacuauggcgcauagaaagccuacauaugagagagacguugaucucggcgcagguacaaggcauguagccguggaaccggaagucgcgaaucuggauauaauaggccaaaggauugaaaacauaaagcaugaacacaagucaacauggcauuaugaugaagauaacccguauaaaacaugggcauaucacggaucguacgaagugaagccaagcggcucagcaaguucaauggugaacggagucgugaaacuucuuacuaaaccaugggaugucaucccuauggugacucagauagcuaugacagacacuacaccuuucggacaacaacguguauucaaggaaaaaguggacacuaggaccccaaaggcaaaacggggcaccgcucaaauuauggagguaacagcccgauggcuauggggcuuuuuaaguagaaauaagaagcccaggauuuguacacgagaagaauuuaccagaaaaguaagaagcaaugccgcuaucggagcaguauuuguagaugaaaaccaauggaacucggcaaaagaagcaguugaagaugagagauucugggaucugguucauagagaaagagagcuucauaaacaaggcaaaugcgcaaccugugucuauaauaugauggguaaaagagagaagaaauugggggaguucggcaaggcuaagggauccagggcuauuugguauaugugguugggcgcgcgauucuuggaauuugaggcuuugggguucaugaacgaagaccacugguucucucgugaaaauucuuuaucugguguagagggggaaggauuacacaaacuuggauauauauuacgcgauauaaguaagauaccuggagguaauauguacgcugaugacacagcagggugggauaccagaauaacagaggaugauuugcagaacgaagcuaaaaucacggauauaauggagccugaacacgcucugcuggcuaaagcuaucuuuaaacucaccuaccaaaacaaaguagucagaguacagcguccagcgaaaaacgguacagucauggauguaauuucuagacgagaucaaagaggauccggacaaguaggaaccuaugggcucaauacauuuacaaacauggaagcucaauugauuaggcagauggagucugaaggaauuuuuaguccaucagaacuugaaacucccaauuuagcugaaagagucuuagauuggcuagaaaaauacggagucgaaagguugaaacgaauggcaauaagcggagaugauugcgugguaaaaccgauagaugaccgguuugccacugcauuaacagcgcucaacgacauggggaaagugaggaaagauauaccccaaugggaaccgaguaaaggcuggaaugacuggcagcaaguccccuuuugcagucaucacuuucaccaauugauaaugaaagauggcagagagauuguagugcccuguagaaaucaagacgaguuaguagguagagcacguguuucucaaggugcggguuggucauuaagggaaacagcaugccuagguaaaaguuaugcgcagauguggcagcugauguauuuucauaggcgugauuuaaggcuugcagcaaacgcaauaugcucagcaguucccguagauuggguaccgacgucacgaacgacguggucaauacaugcucaucaucaguggaugacuacugaagauauguuaaguguuuggaaccgaguuuggauugaagaaaauccauggauggaggauaaaacucacauaucaaguugggaagaugugccauaucuaggcaaacgagaagaucaauggugcggaucacuaauaggccugacugcuagagccacgugggcgaccaacauucaaguggcaaucaaucaaguacgacgucugauagguaacgagaacuauuuggacuauaugacaaguaugaaaagauucaagaaugaaucagaccccgaaggugcuuuaugguaa

SEQ ID NO: 22027 - RNA, 9879 nt, Artificial Sequence
  derived and/or modified CDS sequence (opt6) from DENV-1__KJ438296__SS-prME
agcgucacgaugcuauuaaugcugaugccuacagcccuagccuuucacuuaacaacaagaggaggcgaaccacauaugauggucaguaaacaagaaagaggaaaaucucuacucuuuaaaacuucggcuggaguuaauauguguacacugaucgcuauggaucuuggugaauuaugugaagacacaaugacuuauaaauguccaagaauaaccgaagcugagcccgacgacguggauuguugguguaaugcuacagauaccuggguuaccuacgguacauguucacaaaccggugaacaucgacgagauaaacggucugucgcgcuugcaccacauguaggucuaggauuggaaacacggacagaaacauggaugaguagugaaggugcauggaaacaaauccaacggguagaaacgugggcgcucagacauccaggauucacaguaauagcacuuuuccuagcgcaugcuaucgguacaucuauaacucagaaagguaucauuuucauuuuacuaauguuagucaccccguccauggcgaugagaugcguagguaucggaagccgagauuucguugaagguuuaucaggggccacauggguugauguuguccucgaacauggaucaugcguaacuacuauggcaaaagauaaaccuacacuugacauagaacuacuuaaaacugaaguuacaaauccagccguauuacguaaauuaugcauagaagcaaaaaucucaaacacaacaacggacucuagaugcccaacgcagggagaagcgacacuuguagaagaacaagaugccaacuucguaugcagacggacauucguugaucgaggaugggguaacggcugugggcuguucgguaaagggucuuuaauaacgugcgccaaauuuaaauguguaacuaaacuugaaggcaaaauuguacaauaugaaaaucuaaaauacucuguuauagugacagugcacacuggggaccagcaccaaguuggaaaugaaaguacggagcacgguacaacagccacuaucacgccacaggcaccaacaacagaaauucaacuaaccgauuacggagcucugacauuggauugcucaccgagaacgggauuagauuuuaaugaaaugguucuacuuacgaugaaagagaaaaguuggcugguccacaaacaaugguuccuggaccuaccccucccauggacuuccggagcaucgaccucacaagagaccuggaauaggcaggaucuuuuaguaacauucaaaacggcucaugcuaagaaacaggaagucguaguauuagguagccaagagggagcgaugcauacagcuuuaaccggagcuacggagauacaaaccucgggaacuaccacaauuuuugcaggacacuugaaaugucgauuaaaaauggauaaacugaccuugaaaggaauguccuauguaaugugcaccggcucguuuaagcuggaaaaagaaguagcagaaacacagcacggaacaguguuaguccagauaaaauacgaggguacggacgcaccauguaagauaccguuuucaacacaagacgaaaagggcgugacacaaaacgggcgauuaauaacugccaauccaauaguaacugauaaagaaaaaccuguaaauaucgaagcugaaccacccuuuggcgagucauauauagucauuggagcuggugagaaagcauuaaaacuaucuugguucaagaaagguucaucaaucgggaaaauguuugaggcaacugcuaggggagcuagaaggauggcuauauuaggagauacagccugggauuucgggucgauaggugguguguuuaccagcguagguaaauuaguccaccaaauauuuggaacagcauacgguguacuauuuaguggcguuagcuggacaaugaagauuggaauagggguucuauuaacuugguuaggucucaauagucgaucaaccagccucucgaugaccugcauugccguuggccuaguaacguuauauuuagggguaaugguccaagcugauucaggaugcgugauaaauuggaagggaagggaacuaaaaugcgguucaggaauuuucguuacaaacgaaguacacacauggacagaacaauauaaauuccaggccgacucccccaagcgacuuucugcagcaauugguaaagcaugggaagaaggggucuguggaauacgcucggcgacaagacuugaaaacauuauguggaaacagaucucuaaugaacuuaaucauauauuacucgaaaacgacaugaaauuuacugucgucgugggugauguagcuggaauacuugcacagggcaagaaaaugauaagaccucaaccaauggaauauaaauauucauggaagucauggggaaaagccaaaauaauaggugcugacguacaaaacaccacuuucauuauagauggaccaaauacaccagaauguccagaugaucaacgagcguggaacauuugggaggucgaagacuacggguucggcauuuuuacuacuaauauaugguuaaagcuaagagacaguuauacgcaagucugugaucacagauugaugucggccgcuauaaaagacucaaaggcaguacacgccgauaugggauauuggaucgaaagugagaaaaacgagacauggaaacuagcucgagcuucauucaucgaaguaaaaacuugcauauggcccaaaucgcauacacuuuggucaaaugggguucucgaaagugagaugauuauccccaaaaucuauggagguccuaucagccaacauaacuacagaccaggguauuucacgcaaacagcgggacccuggcacuuagguaaacuugaacuggacuucgaucucugugaagguacaaccgugguaguagacgagcauugugguaauaggggcccuucacuucgaacuacuacugucacggggaagauuauucaugaauggugcugccguaguugcacccuaccgccucuaagauuucguggcgaggacggauguugguacggaauggaaauuagaccuguaaaagaaaaggaagaaaacuugguaaaguccaugguuucagcaggcucaggagagguggauagcuuuaguuuaggucucuuauguauaucuauaaugauagaggaaguaaugcgaucacgauggaguagaaagauguugaugauugggacguuggcaguauucuuuuuguuaauuaugggucaacugacauggaaugacuuaauuagauuguguauaaugguuggcgcuaacgcaagugaccgaaugggaaugggcacaacguacuuagcauuaauggcgacuuuuaaaaugagacccauguuugcagucggacuacuguuuaggagacuaaccaguagagaaguccuccugcuuacuauuggauuaucgcucguagcgagcgcagaauugccaaauucacuagaagaauuaggggauggacuagcuauggggauaaugauccuaaaauuacugacagacuuucagucccaucaauuaugggcaacucucuuaucuuuaacuuucauuaaaacuaccuucaguuuacacuacgcauggaagacuauggcgaugguuuuaagcauagucuccuuaauaccucugugucuuucaacgacuucacagaaaacaacaugguugccaguguuacuagggagucuagguuguaaaccucuaacgauguuucuaauagcagaaaacaaaauuugggguaggaagucguggccauugaacgaagguaucauggcgguugguaucgucucaauacuacuuaguucuuuguugaaaaaugacguuccucuugcagguccguuaauagcugguggcaugcuuaucgcuuguuauguaauuaguggcucaagcgccgacuuaucuuuggaaaaagcagcggaagucaguugggaagaggaagcugagcauagcggugcaagccacaacauuuuaguggaaguucaagacgauggcaccaugaagauaaaagaugaggagcgggacgauacuuuaaccauacuccuuaaagcaacacuacuagcaguaucugguguuuuuccucucucaauaccggcuacauuguuuguuugguacuuuuggcaaaagaagaaacaaagaucgggaguuuugugggauacacccuccccaccggaggucgaacgugcaguucuggacgaugguauuuauagaauuaugcaaagaggacugcuaggaaggucacaagucggagugggaguuuuucaggaaaauguuuuucauacgauguggcacguaacgcgaggcgcuguucugauguaucagggaaaacgauuagaacccagcugggcaaguguaaagaaagaccuuauuagcuacggcgguggauggaggcuucagggaucguggaauacaggagaagagguucagguaauugcaguagaacccgguaaaaauccuaagaacguccaaacagcaccgggaacuuuuaaaacgcccgaaggagaaguaggugccaucgcuuuagauuucaaaccaggcaccagcggcuccccgauagugaacagggaagguaagauaguuggacuuuauggcaauggagucguuacuaccagcgggacauauguuucugcaaucgcccaagcgaaggcaucccaagaggggccauuaccagaaauugaagaugaaguguuuagaaagcgaaauuuaacuauaauggacuuacacccuggaucaggaaaaacaaggagauacuuaccugcuauugugcgugaagccauuaaacgcaagcuacgaaccuugauccuagcaccgacacggguuguugcaucugaaauggcagaagcacuuaaaggcaugccaauacgauaccaaacaacagcgguuaagagugaacauacagguaaagagauaguugaccucaugugccaugcaacuuuuacaaugcgcuuauuaaguccaguucggguaccuaacuacaacaugauuaucauggacgaagcucacuucaccgaccccagcucaaucgcagcgagaggguauauaaguaccagaguuggaaugggggaagcugcugcaauuuucaugacagcaacaccaccaggcagcgucgaggcauucccucaauccaaugcagucauucaagaugaagaacgagauauaccugaaagaagcuggaauagcggauaugaauggauaacagauuuccccggcaaaacaguuugguuugucccuucaauuaaaucaggcaaugauauugcaaacugccuccguaaaaacgguaaacgggucauacaacuaaguagaaagaccuuugauacugaguaucagaaaaccaaaaacaaugauugggacuacguggugacaacagauauaucggagaugggugcaaauuucagggcugaccgagugaucgauccaagacgaugccuaaagccugucauacuuaaggauggaccugaaagagugaucuuggcagguccgaugccugugacuguugcaucagcugcucaaagaagagggaggaucgggaggaaccauaauaaagaaggggaccaauacauuuauaugggacagccacugaauaaugaugaagaccaugcucacuggacagaagcgaaaaugcuacuagacaauauaaacacuccggagggaauaauaccagcucuuuuugaaccugaaagggaaaaaucagcagcgauugacggugaguacaggcuuaggggcgaagcucggaaaacauuuguagaacuuaugaggagaggugaccuacccgucugguuauccuacaaaguugcuagcgagggguuucaauauucggaucgucguugguguuuugauggugaaagaaauaaccaaguuuuagaagagaacauggauguugaaauauggacaaaagagggagaaaggaagaaacuacgaccgcgcuggcuagacgcgcguacuuacucagauccguuagcccuaagagaguucaaggaauuugcagcuggaaggcguucaguaucuggugaucuuauccuagaaauaggaaaacuaccacagcacuuaacccaaagggcucaaaaugccuuggauaauuugguaaugcuccacaauagugaacaaggaggucgagcauacagacacgcuauggaagaacucccggauacaauagaaacccuaauguuauuggcacugaucgcuguauuaacuggaggaguuacccuuuucuuuuuaucaggacgaggauuagggaaaacgucaauaggacuguuauguguaauggcuaguagcguccuucuuuggauggcgucuguagaaccacauuggauagcagccaguauaauuuuggaguucuuucuaaugguacuauugaucccggaaccugaccgacaaagaaccccacaggauaaucaauuagcguauguagugauaggauugcuauucaugauacugaccgucgccgcaaacgaaaugggccuauuagaaacaaccaagaaagaucuugggauaggucacguggcaguugaaaaucaucaucaugcagcaaugcuagauguagaccuacaccccgcaagcgcguggacauuauacgcagucgcaacuacuauaauaacaccuaugaugagacauacaauagaaaacacaaccgccaauauaucauuaacagcuauugcaaaucaagccgcuauauuaaugggauuagauaaggguuggcccaucagcaagauggacauuggugucccucuccuagcauuaggaugcuauagucaagucaacccccuuacgcuaacugcagcuguuuuaauguuggucgcgcauuaugcaauaauaggaccuggacuacaagcuaaagcaacucgagaagcacagaaaagaacugcggcagggauaaugaaaaaucccacaguagaugggauagucgcaauagaucuagauccugucgucuaugacgcaaaauuugaaaaacaacucggacagauaaugcugcuaauauuauguacuucacagauucuguugaugcguaccacuugggcuuuaugugaaucuauaacauuagccacaggcccacuuaccacuuuaugggaaggcucacccgguaaguucuggaauacaaccauagccguuucuauggcuaacauauuuagggguaguuauuuagcgggugccggguuagcauuuucacuaaugaaaucacuaggagguggaagaagggggacgggggcacaaggugagacuuuaggugaaaaguggaagagaagacuaaaucaacuuagcaaaagugaauuuaacacuuacaagcgguccgggaucauggaaguagaccgauccgaagcaaaagaaggauuaaaacguggagagacuacuaaacacgcagucucgagaggaacagcgaaauuacguugguuuguagaacguaaccuuguaaagccggaaggcaagguaauagaucuagguuguggacguggcggaugguccuauuacugcgcagguuugaagaaagugaccgaaguuaaagguuauacuaaagguggaccaggacacgaagaaccuauuccaauggcuacuuauggauggaaucuaguaaaauuacacucggguaaagacguauucuuuauaccaccugaaaaaugcgauacacuucuuugcgacauuggagaaaguaguccgaauccaacaaucgaagaagggagaacauuaagaguauuaaaaauggucgaaccaugguuaagagguaaccaauucuguauaaagauuuuaaauccauacaugccuagugugguugaaacucuagagcaaaugcaacgaaaacauggcggaauguuaguucguaauccucuaucgcgcaauucaacacacgaaauguauuggguuuccugugguacagguaacauaguuagugcaguaaauaugacuucacgaauguuauugaaucgauucacaauggcgcacagaaaaccgacuuacgagagagauguagacuuaggcgcagguacaagacacguagcuguagagccugaaguugcaaaucucgauauaauuggucaacgaauagaaaauauuaagcaugaacacaaauccacguggcacuaugaugaagauaauccuuauaaaaccugggcuuaccauggcuccuacgaaguaaaaccgagcggaagugcuucaagcauggucaauggcguuguaaaauuacuaacaaaacccugggacguuaucccaaugguaacccaaauugccaugacagacacaacaccguuuggccaacaaagaguauuuaaagagaaaguagacacaaggaccccuaaagcgaaacgcggaaccgcccaaauuauggaagucaccgcgagaugguuguggggguuucucucucgcaauaagaaaccgagaauuuguacgagagaagaauuuacucguaaaguaagaucaaaugccgcuauaggugcaguauucauagaugaaaaucaauggaacucugcaaaagaagccguugaggaugagagauucugggaucuuguucacagagaaagggaauuacauaaacaaggaaaaugugcaacguguguauauaacaugauggggaagagggagaagaaauuaggagaguucggaaaagcaaaaggauccagagcgauaugguacauguggcuaggagccagguuucuugaguucgaggcuuuagguuucaugaacgaagaccacugguuuuccagagaaaauucauuaagcgguguagaaggugaaggacugcacaaguuggguuauauacucagggauauuucgaaaauuccaggggguaacauguaugcagaugauacugcugguugggauacgaggauaacagaggaugaccuacaaaaugaagcuaaaauaacugauauaauggaaccagaacaugcacuauuagcaaaagcuauauucaagcuaacauaucaaaauaaaguuguacggguacagcgcccagccaagaacggaacuguaauggaugugauaucccgaagagaucaaagagguucaggucagguaggaacuuacgguuuaaauacuuuuacaaauauggaagcgcaacuuauaagacaaauggagagcgaagggauuuucagcccauccgaauuagaaacaccuaacuuagcagaacggguacuggacugguuaggcaaauauggcguugaaagacuaaaaaggauggccauuagcggugaugauugcgucguaaagccaauugaugauagauuugcaacugcucuaacagcguugaaugacaugggaaaaguccgcaaggauauaccacaaugggaaccaucaaaagguuggaacgauuggcaacaagucccuuucugcucacaucacuuccaucaacuaauaaugaaggauggcagagaaauuguuguaccguguagaaaccaagacgaauuaguagguagggccaggguuucacaaggugcuggaugguccuugcgugagaccgcuugccuaggaaaaagcuaugcccaaauguggcaauuaauguauuuucaccguagagaucuaagauuagcugcaaacgcaauauguagcgcuguuccugucgauuggguaccaacgagccgaacgaccuggucaauucacgcgcaucaucaauggaugacuacagaagacauguuguccguuuggaacaggguguggaucgaggagaacccauggauggaagacaagacacauauauccaauugggaagauguaccuuaucugggaaagagagaagaccaaugguguggaagccuaauagggcuuacugcaagagcaacaugggcgacuaacauucaaguugcuauaaaccaaguucggcgucuaauaggaaaugaaaauuauuuagacuacaugacaagcaugaaaagguuuaaaaacgaaagugauccagaaggggcacuaugguag

SEQ ID NO: 22028 - RNA, 9879 nt, Artificial Sequence
  derived and/or modified CDS sequence (opt6) from DENV-1__KC692495__SS-prME
ucuguaacaauguugcuaaugcuacugcccacugcuuuggcguuucaucuuacaacuaggggaggugaaccccauaugauagugucuaaacaagaacggggaaaaucccuauuguucaaaacuucggcuggaguuaacauguguacuuuaauagcuauggaucuaggagaacuaugugaagauacaaugaccuacaaaugcccucgaauaaccgaagcggaaccagaugaugucgauuguugguguaaugcaacagauacgugggugacguacggaacauguucucaaacuggagaacaccgcagggagaaaagaagcguugccuuagcgccacacguaggauuagguuuagaaacccgaacggaaacauggauguccagugaaggagcuuggaaacaaauacaacgaguagaaacgugggccuuaaggcacccaggauuuacgguaauagcauucuuccucgcacacgccauuggaacgucuauuacacaaaaaggaauuauauuuauucucuuaaugcuaguaacgccaaguauggccaugcguugcguuggaauaggaaaucgugacuuuguagaaggauuaagcggcgcaaccuggguugacgugguguuggaacauggcucuuguguaacaacgauggcuaaaaauaaaccaacacuugauauagaauugcuaaaaaccgaaguaacuaacccugccguguugcggaaauuauguauugaagcgaaaauuaguaauacaaccacagacucucggugucccacccagggagaagcaacguugguggaagaacaagaugcuaauuuuguaugcaggagaacuuuuguagauaggggaugggggaaugguuguggacuuuuuggaaaagggagcuuacucacaugugcaaaauuuaaauguguuacuaaauuagaaggaaaaauaguccaauaugaaaauuuaaaauauucugugauuguaacagugcacacaggugaucaacaucaagugggcaaugaaaccaccgaacauggaacaaucgcaacaauaacuccgcaagcacccacauccgaaauacaauuaacugauuacggugcucugaccuuggauuguaguccgaggaccggccuagauuuuaaugaaaugguauuauuaaccaugaaagagaaaagcugguuaguacacaaacaaugguucuuagaccuuccgcuaccauggacauccggugcaucaaccucgcaagaaacauggaaucgacaggaucuauuagugacauucaaaacagcgcacgccaagaaacaggaagugguagugcuuggcucucaagaaggugcgaugcacacugcguuaacuggcgcaacagaaauacagacaucagguaccaccaccauuuucgcaggucaccuaaaaugcagauugaaaauggacaaauuaacguuaaaagguaugaguuacgucauguguacugguuccuucaaacucgaaaaagagguagcggaaacacaacacggcacgguccucguccaaguuaaauaugaaggaacggacgcaccuuguaagauuccuuuuucuacucaagaugaaaagggaguuacucaaaauggaagacucaucacugcaaauccuauaguaacagacaaagagaaaccaguuaacauagaaaccgaaccacccuuuggcgaaaguuacauaguaguaggagcuggcgaaaaggcuuuaaaacuuagcugguucaagagaggcaguucuauagguaaaauguucgaggcaacugcaagaggugcacggaggauggcgauacuaggagauacggcuugggacuucgguuccauugguggaguuuucaccaguguaggaaagcuaguccaccaagucuuuggaacugccuauggaguccucuuuucuggggugucauggacuaugaagaucgguauugggauucuauuaacguggcuugguuuaaauaguaggucaacaagucuaaguaugacuuguauagcaguuggaaugguaacauuguaccuuggaguaaugguccaggcagauaguggaugcguuauaaauuggaaagguagagaacuuaaguguggcaguggcauuuuuguaacaaaugagguucauacauggacagaacaauacaaauuccaggcagacaguccaaaacgccuuagugcagcuauaggcaaggcuugggaagaggguguaugugguauacgcuccgcaacacgacucgagaacauuauguggaaacaaauauccaaugaacuuaaucauauuuuauuagagaaugauaugaaauuuacuguagucgugggagaugcaaaugggauucucgcucagggaaagaagaugauaaggccccagcccauggagcauaaauacucuuggaagucauggggaaaggcaaaaauuauaggugccgauauacaaaacacaacauuuauuauugacggcccggacacaccagaguguccagauggacaacgcgcauggaauauuugggaagucgaggacuauggguucggaguuuucacaacuaauaucuggcucaaacuaagagauaguuacacacaaaugugugaccauagacuaaugagugcagcaaucaaagauaguaaggcaguccaugcggauaugggauacuggauugaaagugagaaaaaugaaacuuggaaacuggcaagagcuucguuuauagaaguaaaaacuuguacauggccuaaaagucauacacugugguccaacgguguacuagagagcgaaaugauuauuccaaaaauuuuuggaggaccaauaagucagcacaacuaucgcccggguuauuucacucaaacugcugggccuuggcauuuagggaaacuugaacuagauuuugaucugugcgaaggaacaacaguaguuguagacgaacauugugggaacaggggaccaucucuacgaacuacaaccguaacagggaagauuauacaugaauggugcuguagaucuugcaccuuaccuccacucagauuuagaggugaagauggguguugguacggcauggagaucagacccguuaaagagaaagaggaaaacuuaguucgauccaugguuucagcuggcucaggggaaguggauagcuucucauuggguauacuuugcgugaguauaaugauugaagaagugaugagaucaagauggucaaggaaaaugcucaugacggggacauuagcagucuuuuuguuacuaaucaugggacaacuuacuuggaaugaucucauaagacuaugcauaaugguuggggcgaacgcuucagauagaauggggauggguacuaccuaucuggcuuuaauggcgacauucaaaaugcgacccauguucgcagucggcuuacuguuuaggagauuaaccucgcgcgaaguccugcuuuuaacgaucggacuguccuuaguagcgucaguugaacuuccuaacucauuagaagaacuuggagauggacuagcuaugggaauuaugauguugaaauuauugacugaauuucagccacaccaauuauggacaacauugcuauccuuaacuuucguuaaaacaacuuuaagucuagacuaugcauggaagacgacggcaaugguauugaguauuguuucacuguucccguuaugucuaaguacgacaagucaaaagacaacgugguuaccuguucuccuuggauccuucgggugcaaaccacucacuauguuucuaauaaccgagaauaaaaucugggggaggaagucguggccacuuaaugaaggcauaauggcaaucgguauagugaguauucuucuaucuaguuuauugaaaaaugauguaccuuuggcagguccacuuauagcggguggcaugcugaucgcauguuaugugauaagcggcucauccgcagaucucagcuuagagaaagcagcagaggugaguugggaacaagaagcagagcacucuggagcaucacacaacauauuaguagaaguacaggacgauggaacaaugaaaauaaaagacgaggagcgggacgacacauuaacaauucuuuugaaagcuacucuucucgcuguaucagguguguacccaaugaguaucccugcaacacuuuuuguaugguauuuuuggcagaagaagaaacaaagaucagggguuuuaugggacacaccaucaccaccagaaguagaacgugcagugcuugaugacgguauauaucgcauacuacaaagaggccuacuuggaagaucccaaguaggaguaggaguauuccaagauggaguauuccauacgauguggcacguaacuaggggagcuguguuaauguaucaaggcaaaagacuugaaccuucaugggcaucaguaaagaaagauuuaauuaguuacggagguggcuggagguuucaaggcaguuggaauaccggagaagaaguacaaguaauagcgguagaaccagggaaaaacccgaaaaacgugcagacgacuccaggcacauucaaaacaccagagggagaagugggagcaauagcgcuggauuucaaaccaggaacgagcgguucaccaaucguaaaccgugaagggaagaucgucggacuauauggaaacggaguaguaacgacuucaggaacauacguaagugcaauagcccaagccaaagcgagucaggaaggaccuuuaccugagaucgaagaugaaguauucaagaaacggaacuugacaauaauggaucuacauccagguucuggaaaaacaagaagauaucucccagcaauaguuagggaagccauuaaaagaaaacuaagaacucucauuuuagcaccuacaaggguaguugcgagcgaaauggcugaagcccuaaaaggaaugccaaucagauaccaaacaacagccguaaaaucugaacauacaggcagggaaauuguagacuuaaugugucaugcaaccuucacaaugagauuacuaucaccagugaggguaccaaauuacaauaugauaauuauggaugaagcccauuuuacugaccccgcuucaauagcagccagaggguacauuucaacccgaguuggaaugggagaggcagcagcaauauuuaugacggcaacaccaccaggaucaguagaggcuuuuccacaaaguaaugcaguaauucaagaugaagaaagagauauuccggaacgaagcuggaauagcgguuaugauuggauaacggacuucccaggaaaaacaguaugguuugucccaaguauuaagucaggaaaugauauugccaauugccuaagaaagaacggcaaaagagucauucagcuaucgcguaagacauuugacaccgaauaccaaaagacuaaaaacaaugauugggacuacguaguaacaacagacauuagcgaaaugggagcaaacuuccgagcagacagaguuauagacccaagacgauguuugaaaccugugauacugaaagauggaccagaaagaguaauccuugcagggccaaugccugucacgguagcuucagcagcucagaggcguggucgaaucggaagaaaccagaacaaagagggggaccaauacguauauaugggacagcccuuaaacaaugacgaagaucaugcacauuggacugaagccaaaauguuacucgauaauauaaacacaccggaaggaauuaucccggcauuguuugaaccggaacgugaaaagucagcagcgauagauggggaauaccggcugagaggcgaagcaaggaaaacuuucguggaacugaugaggcgaggugaucucccagugugguugaguuauaagguagcaucugaggguuuccaauauucugaucgacgcugguguuucgauggugaaagaaacaaucaagugcuagaagaaaauauggacguagaaauauggacuaaggagggagagagaaagaagcuacgaccucgauggcuugacgcucgaacauauucagauccucuugcccugagggaguuuaaggaauuugccgcuggucgaagauccguaucgggugaucugauacuagaaaucgguaagcuaccucagcacuugacgcuaagagcucagaaugcucuagauaauuuagucaugcuacauaauagcgagcaaggcgguaaagccuacagacaugccauggaagaacugccagauacaaucgagacacuaaugcuauuagcauuaauugcaguguuaacuggcggagugacguuauucuuuuuaucuggaaaagggcuagggaaaacuucuauuggccuacuauguguaacggccagcucagcacucuuauggauggcaucaguagaaccucacuggauagcagcgucaaucauucuagaguucuuucuuauggugcuguuaaucccggagcccgaucgacaaagaacaccacaagacaaccaacuugcuuacgugguaaucggccucuuguuuaugauacugacggucgcagccaaugaaaugggucuauuggaaacgacgaagaaagacuuagguaucggauauguagcugcagaaaaucaucaacacgccacuaugcuugacguugaucuccauccugcguccgcuuggacauuguaugcaguagcaacuaccgugauuacuccuaugaugaggcauacaaucgaaaacaccacugcgaauauaagucuaacagcgauugcgaaccaggcugccauauuaaugggacuagacaagggcuggccuauuucuaaaauggacauaggcguaccacuguuagcccuaggauguuacagccaaguuaauccucuaacguuaacagcggcuguacuuauguuaguugcacacuaugccauaauaggaccaggacuccaagcaaaagcaacucgagaagcgcagaaaaggacagccgcaggaauaaugaaaaacccuacugucgacgguauuguugcuauagaucuugaucccguagucuacgaugccaaguuugaaaagcaguuaggccaaauaaugcuacuaauucuaugcaccucccaaauacuucucaugaggacaacgugggcuuugugugaaagcauaaccuuagcuacaggaccuuuaaccacacuuugggagggaaguccugguaaauucuggaauacaaccaucgcaguuucuauggcaaacauuuucagaggaaguuauuuggcgggugcuggucuugcauuuucacuaaugaaaaguuuaggaggcggcagaagagguacaggugcacaaggugaaacauugggagaaaaauggaaacgucaauuaaaucaacuuuccaaaucggaguuuaauacguauaagcgaagcggaauaauggaagucgacagaucugaagcuaaagaaggacuaaaaagaggugaaaccacaaaacaugcgguuagccgggguacagccaaguuacguugguucguugaaaggaaucuuguuaaacccgaagguaaaguaaucgacuuaggaugcggaagaggaggguggucguauuacugcgcaggccucaagaaagucacagagguaaaagguuauacuaaagguggacccggacaugaagaacccauccccauggcgacguaugguuggaacuuggucaagcuacacagcgguaaagacguuuucuucaugccaccagagaaaugugauacauuacucugugauauaggggagucgagcccaaaccccacgaucgaagaaggaagaacauugagaguacuuaaaaugguagagccuugguuaagaggaaaucaauuuuguauuaagauacuuaacccguauaugccgucaguaguggaaacccucgaacagaugcaaaggaaacacggcgguaugcuuguuagaaauccuuugagucguaauucuacucacgagauguauugggugucuuguggaacagguaauauugugucggcuguuaauaugacaaguagaaugcuacuaaauagauuuacaauggcccauagaaagccaacuuaugaacgugacguugacuugggagcaggaacgcgacauguggcugucgagccagaaguagcuaaucuagauauaaucggacaaaggauugaaaauaucaaaaaugaacauaaaaguaccuggcauuacgaugaggacaacccauauaaaacgugggcuuaucauggaucauacgagguaaagccuagcgggagugcauccaguaugguaaaugguguaguacgacuacugacgaagccaugggacgucauacccaugguaacucaaauagccaugacagacaccacucccuucggccaacaacguguauuuaaagaaaaaguagauacacgaacuccccgugcgaaacgagggacuacgcaaauaauggaagucacagcaaaguggcucuggggguuccugaguagaaacaagaaaccacgaauaugcacuagggaagaguucacuagaaagguaagaucuaaugccgcuaucggagcuguuuuuguagaugagaaccaauggaauagugccaaagaagcagucgaagacgaacgauuuugggaucuuguacaucgagaacgggagcuacacaaacaaggaaaaugcgcaacaugcguauacaauaugauggguaaaagagagaaaaaguuaggagaguucggaaaagccaaaggaaguagggcuaucugguauaugugguugggugcaagguuccuggaguucgaagcauuagguuucaugaaugaagaucacugguuuucgcgugaaaacucguuaucaggcgucgaaggggaaggacuacacaaauugggcuacauuuuaagagauauaucuaagaucccgggaggaaauauguaugcugacgacaccgccgguugggacacgagaauaacggaagacgaccuacagaacgaagcaaaaaucaccgacauuauggagccagaacacgcuuuacuugcuacgagcauauucaaacuuacauaucagaauaaaguggugcgaguccaaagaccagcuaaaaauggaacuguuauggauguaauaagccgaagggaucaacguggcagcggacaagucggaacuuauggcuuaaauacguucacgaauauggaaguacaguugauuagacaaauggagucagaaggaauuuuucugccuagcgaguuagaaacgcccaaucuagccgaaagagcucuggauuggcuggagaaacacggagcggaaagacuaaaaagaauggcgauuucuggugacgacuguguuguuaaaccuauugacgauagauucgcaacagcguuaaccgcacuuaacgacaugggaaagguccguaaagacauuccacaaugggagccaucuaaagguuggaaugacuggcaacagguaccauuuugcagccaccauuuucaucaauugauaaugaaagacggaagggaaauuguaguaccauguagaaaccaagaugaacucguaggcagagcgcgaguaucacaaggagcagguuggucacucagggaaacagcuuguuuaggcaaaucauaugcucagauguggcagcucauguauuuucaccggcgagaucugcguuuagcugccaaugcuauuugcucagcuguaccgguagauuggguaccagcuuccagaacuaccuggagcauacaugcucaccaucaauggaugacaacagaagacaugcuuucaguauggaauagaguauggauugaggaaaacccauggauggaagacaaaacacaugugaguucgugggaagaggucccauaccugggcaagagagaagaucaguggugcggcuccuuaauuggcuuaacagcucgggcaaccugggcuaccaacauccaaguggcaauaaaccaaguacgcagguuaauuggaaaugaaaacuauuuggacuauaugacaucaaugaaaagguuuaaaaacgaauccgaccccgaaggcgcccuaugguag

SEQ ID NO: 22029 - RNA, 9879 nt, Artificial Sequence
  derived and/or modified CDS sequence (opt6) from DENV-1__KC692496__SS-prME
ucaguaacaauguuguuaaugcuguuaccgacagcuuuggcauuucacuugacuacaagaggaggugaaccucacaugauagucaguaaacaagaaagaggcaaauccuuacuuuuuaaaacaagugccgguguuaauauguguacacuuaucgccauggacuuaggagaguuaugcgaggacacaaugacauauaaauguccacgcaucacugaggcugaaccugacgauguugacugcuggugcaaugcgacggauaccuggguuacauauggaacaugcagccaaacgggagaacauagaagagagaaacgcaguguagcacuggccccacauguuggauugggcuuagaaacgaggaccgaaacguggaugagcucugagggagcauggaggcaaauacaacgagucgaaacgugggcauuacgacacccagguuuuacugucauagcauucuuuuuagcacacgcaauagguacgucgauaacucaaaaaggaaucauauucauacugcucauguuagucacaccuucuauggccaugagauguguaggcauaggaaauagagauuuuguugagggucugaguggugcuacuuggguugauguuguccucgaacauggaaguugugugacgacgauggcgaaaaauaaacccacacuugacauugaacuuuugaaaacugaagugaccaacccagcuguauuacgaaaauuauguauagaagcuaaaaucaguaauaccacuacagacuccagauguccuacacaaggugaagcaacauuaguggaggaacaagacgccaacuuuguaugucgacgaacuuucguggaccgaggaugggguaauggauguggccuuuuuggaaaagggucucuucuuacuugcgcaaaauucaaauguguaacaaaacuggaaggaaaaaucguucaauaugaaaacuugaaauacucaguaauagugacgguucauacaggcgaucaacaccagguugguaaugagacaacugaacaugggacgaucgccacaauuacgccucaagcucccacaucagaaauucaauuaacugauuauggagcucuuacacuagauugcucuccucguacuggucucgacuucaaugaaaugguccuauuaacaaugaaagagaaauccugguuaguacacaaacagugguuccuggauuugccccuaccauggacaucuggagcuucuacaucccaagaaacuuggaauaggcaagaccuuuuaguaaccuuuaaaacggcacaugccaagaaacaagaagugguaguacuaggaucgcaagaaggugcaaugcacacagcucuaacaggugcgacagaaauacagacuuccggcacaacaacuauauucgccggacauuuaaaaugcaggcugaaaauggacaaauuaacccuaaaaggaaugaguuacgugauguguaccgguuccuuuaaauuagaaaaggaaguagccgaaacucaacacgggacugugcucgugcaagugaaguaugaaggaacggacgcacccuguaaaauuccguucucaacccaagacgaaaagggcguuacgcagaaugguagacuaauaaccgcaaauccgaucguuacagauaaagaaaagcccgucaauauagaaacagaaccuccuuucggagagucauacauagucguuggugcuggugaaaaagcucuaaaacuuucuugguuuaaaagggggagcuccauaggaaaaauguucgaagcaacagcucggggagcucgacggauggcgauccuaggugauacagcgugggauuuuggaucuauaggcgggguuuuuaccucgguagguaaauuaguacaccaaguguucgggacugcuuauggaguucuauuuucaggugugucauggacgaugaagauagguaucggaauuuuacuuacauggcuggguuuaaauucgcguuccacgucucuuuccaugacuugcauugcaguuggcauggucaccuuauacuuagggguuaugguucaagcugauuccgguugcgugauaaacuggaagggacgugaguuaaaaugcggguccggaauauucguaaccaaugagguacacacauggacagaacaauacaaauuccaggcagauaguccgaaaaggcuaucagcagccauaggaaaggcaugggaggaagguguuuguggaaucagaucugcuacaaggcuugaaaauauuauguggaaacagaucuccaacgaauuaaaccacauacuacuggagaaugauaugaaguuuacagucguaguaggugaugccaaugguauacuagcgcaagguaaaaagaugauacguccucaaccuauggaacauaaguacuccuggaaaucaugggguaaagcaaaaauuaucggugccgacauacaaaacacaacauuuauuauagaugguccugauacaccagaauguccugauggacaaagagccuggaauauaugggaaguggaagauuauggauuugguguuuuuacuacaaacauauggcuaaaauuacgagauucauauacccaaaugugugaucaucgucuaauguccgcagcaaucaaagauucuaaagcuguacacgccgacaugggguacuggauagaaucagagaaaaacgagacauggaaacucgcacgugcaucuuucauugagguaaaaaccugcacauggccuaagucacauacacuuuggucgaacggcguauuagagagcgaaaugauuauuccgaagauuuucgggggaccaauaucccagcauaacuauagaccgggauauuuuacucaaacagcaggcccuuggcaucuaggcaaauuagaguuggauuucgaucuaugugaagguacuacugucguugucgacgaacacuguggaaauagaggaccuaguuugagaaccacaaccgucacagguaaaaucauccaugaauggugcugcaggucuugcacucucccaccauuaagguuuaggggcgaggacggauguugguacggaauggaaauacggccaguuaaagagaaagaggaaaaucugguaagaucgauggugagugcggggaguggugaaguggacaguuucuccuuaggaauacuauguguaucuauaaugauagaagaagucaugcgaucgagguggagucggaaaaugcucaugacuggaacacuugcggucuuccuacuguugaucaugggccaauuaacauggaacgaccuaauacgccuaugcauaauggucggugcuaacgcaucagaucgaauggguauggguacaaccuaccucgcacugauggcuacauuuaaaaugcgcccuauguuugccgugggauuacuauucagaaggcuaacaucaagagagguauuauuacuuacgauuggacuaucguuaguagcaucaguagaacuuccaaauagucucgaagaauuaggagacggauuggccaugggaauuaugaugcuaaaacuguuaaccgaauuucagccccaucaacucuggacgacgcuacuaucguugacauuuguuaaaacgacacucagucucgacuaugcguggaagacgacagcuaugguacucucuauaguuucauuguucccacuaugcuuaagcacaacuagccagaaaacuacuugguuaccaguuuuauuaggcucauuugggugcaaaccuuuaacaauguuucuaauaacagagaacaaaauauggggacgcaaaaguuggccauuaaaugagggaauaauggcuaucggaauugucucaauacuacuuuccagucuacuuaaaaacgauguacccuuagcaggccccuuacucgcaggagguaugcuuaucgcauguuauguuauuucggguucgucugcagaucuaucuuuggaaaaggcagccgaaguaaguugggaacaagaagcugaacauuccggagcuagccauaauauccuaguagaagugcaagaugacgggacaaugaaaaucaaagaugaggagcgcgacgacacucuaacaaucuuauuaaaagccacacuacuagcgguaucuggaguauauccuaugucaauacccgcaacguuauucgugugguauuuuuggcagaaaaagaaacaaagaucaggaguacugugggauacgccaucaccuccagagguagagagggcggucuuggacgauggaaucuauaggauccuacagagaggauuauugggacgaucucaaguaggaguuggcguauuucaagauggcguauuucauacaauguggcaugugacucgcggagcaguauuaauguaucaaggaaaaagacuagaaccaucuugggccagugucaagaaagauuuaauaagcuacggaggcgguuggagauuccagggaucauggaacacuggggaagaaguacagguaaucgcaguggagccaggcaaaaacccuaagaauguucaaacuacaccaggcacauuuaagacuccagaaggugaaguaggagcaauagcuuuggauuucaagccaggcacaucuggaagcccgauuguaaauagagaagguaaaauaguuggcuuauaugggaauggcgucguaaccacuucaggaacguaugucucagccaucgcccaagcgaaagcgagucaagaaggaccauuaccugaaauagaagacgaggucuuuaagaaaaggaauuuaacuauaauggaccuacacccaggaucaggaaaaacaagaagauaucuacccgcaauugucagggaagcgaucaagaggaaauugcguacauugaucuuggcuccaacacguguaguggccagugagauggcggaagcccugaaagggaugcccaucagauaucaaacgacugcuguaaagagcgaacacacgggaagagaaaucgucgauuuaaugugccaugcuacauuuacaaugcgacuucucucaccuguacggguucccaauuacaauaugauaaucauggaugaagcacauuucaccgauccugcaaguauugcugccagaggguauauuaguaccagggucggcaugggggaagcugcggccaucuuuaugaccgcgacaccuccaggaaguguagaagcauucccacaauccaaugcgguuauccaagaugaggagcgagauauacccgagagaucuuggaacucaggcuaugauuggauaacugacuuuccgggaaagacagugugguucguuccaucaauuaaaucuggaaaugauauugcaaauugcuuaagaaagaacgggaaaagagucauacagcuaucgcgaaaaacuuuugacacagaauaucagaaaacuaaaaauaaugacugggacuauguugucacuaccgauauaagugaaaugggcgcuaauuuccgcgcugacagaguaauagacccacgaagaugccugaagcccguuauauuaaaagauggaccagaaaggguaauacuagccggaccaaugcccguaacuguagcuuccgccgcucagagacgcggucgaaucggacgcaaucaaaauaaagagggggaucaguacguguacaugggucaaccacugaacaaugacgaagaucacgcacauuggacugaagcaaagauguuauuagauaauauaaauacaccagaaggaauaauuccugcauuguucgaaccagaaagagaaaagucagccgcaauagacggcgaauacagauuaagaggugaagcaaggaaaacauuuguagagcuaaugcguagaggagaucuuccaguuuggcugucauacaaaguagcaucugaagguuuucaauauucugacagacgauggugcuuugauggagaaagaaauaaccaaguacuagaagaaaacauggacguagaaauuuggacuaaagagggagaacgcaagaaauuacguccucggugguuagaugcacguacauauucggacccguuagcauuaagagaauuuaaagaguucgcugccgguagacgaagugugucuggcgaucucaucuuagagauagguaaacucccccaacaucuaacucuuagagcacaaaaugccuuagacaauuuagugaugcuucauaacuccgaacaaggaggaaaggcuuacagacaugccauggaagaguuaccagauacaauagaaacauugauguuauuggcacugaucgcaguacuuacaggaggggucacacuauucuuucuaucagguaaaggucucggaaaaacaaguaucggucuuuugugcgugaccgccucaagcgcacuuuuguggauggcuaguguagaaccucauuggauagcugcgaguauaauccucgaguucuuuuugaugguccuauugauacccgaaccugacagacaaagaacgccucaagauaaccaacuugcuuauguugucauuggauugcuuuuuaugauucuuacaguagcagcaaacgaaauggguuugcuagaaacuaccaagaaagaucuaggaaucgguuacgucgcugcagaaaaucaccaacaugccacuauguuagauguggaccugcacccagcuucagcauggacccuauaugcgguugccacuacggucauaacaccgaugaugcggcauacaauugaaaacacaacagcuaauauaucucugacugcuauugccaaucaagcggcaauauugaugggauuagauaaaggcuggccuauaucaaaaauggacauaggcgugccguuacuggcccuaggcugcuacucacaaguaaauccccuaacauuaaccgccgcuguacuaaugcugguagcgcauuaugcaauaauaggaccugggcuacaagcaaaagcaacaagagaagcccaaaaacguacagcugcuggcauaaugaaaaauccgacuguagauggcauaguagccaucgaccucgacccaguaguauacgaugcgaaguucgaaaaacaauuaggacagauaauguuauugauauuauguaccucccaaauauuauugaugcguacaacuugggcacugugcgaaucuauaacucuagcaacuggaccuuuaacgacacuuugggaagggucuccagguaaguucuggaacacaacuauagcggugucgauggccaacauauuuagaggaaguuacuuagcaggcgcaggucuagccuuuucacugaugaagucccuuggcggcgggagacguggaacaggagcgcaaggagaaacauugggugagaaauggaaaagacagcuuaaucaacuaagcaaaagcgaauuuaauacuuacaaaagaucaggcauaauggagguagaucguagcgaagcaaaagaaggucuaaaaagaggugaaacaacuaagcacgcagugucacguggaacggcuaaauuaagaugguuuguagaaagaaauuuggucaaaccagaagggaaaguaauagaucuaggauguggccguggcgguuggucguauuacugcgcaggucuaaagaaagugacagaggucaaaggcuauaccaaagggggccccggacacgaagaaccgauaccaauggcaacguacggcuggaaucuggucaagcugcacuccgguaaagauguauucuuuaugccaccugaaaaaugcgacacucuauuaugcgacauaggugaaagcaguccuaauccuaccauagaagaaggacgcacacugcgaguuuuaaagaugguugaaccuuggcuaagaggaaaccaauucugcauaaagauucuuaacccuuauaugccaucuguuguagaaacacuugaacaaaugcaaagaaaacaugguggaaugcucgugagaaauccacugucaagaaauuccacgcaugaaauguauuggguuaguuguggaacuggaaacauaguuagcgcugugaauaugacgucgagaaugcuuuugaauagguuuaccauggcacaucgaaaaccgacguaugaaagagacguggacuuaggagcaggcacccgucacguggcaguggagccagaagucgccaauuuagauauuauuggacaaaggaucgaaaauauaaagaacgaacauaaaucaacauggcauuacgaugaggacaacccguauaagacaugggcguaucauggcagcuaugaaguaaaacccucagggucagcaucauccaugguuaauggaguugugcgacuguuaacaaaaccaugggacgucauuccgaugguuacacaaaucgcaaugacagacacuacuccguuuggccaacaaagaguauuuaaggagaaggucgauacuagaacucccagagcuaaaagagguacuacucaaaucauggagguaacagcgaaauggcucuggggguuuuugaguagaaauaagaaaccgcgcauuuguacgagggaggaauuuacacgaaaagucagaucuaacgcugcaauaggcgccguuuuugucgaugagaaccaauggaacucugccaaagaagcaguagaagaugagcgauuuugggaucuuguucauagagaaagagaacuacauaaacaagggaaaugugcuacauguguguauaacaugauggguaagcgagagaagaaacucggagaguuuggaaaagccaaagguagccgugcaauaugguacauguggcugggugccagauuccuugaauuugaagcucuagguuuuaugaaugaggaucacugguuuucgcgugaaaauucucuuucagggguagaaggugaaggacuacauaaacuaggauauauuuuaagggauauaaguaaaauaccaggaggaaauauguaugccgaugauaccgcagguugggauacucgcauaacagaagacgaucuacaaaacgaggcaaaaauaacggacauuauggagcccgaacaugcccuauuagcuacgucuauuuuuaaauuaacauaccaaaauaaagucguacgaguacaacguccugccaaaaaugggacaguaauggauguaauaucuagacgugaucaaagagggucugggcaaguagguacuuauggccuuaacacauucaccaauauggaaguucagcuuauaagacaaauggaaagcgaggguauuuuccuucccucagaauuagaaacaccuaaccuagcugaaagagcacuugacuggcuagagaaacacggagcugaaagacuaaaaagaauggcaauuagcggagaugauugcguagucaaaccaauagaugacagguuugcuacggcuuuaacagcacuaaacgacaugggaaaagucagaaaggauauaccgcagugggaaccauccaaaggcuggaaugauuggcagcaaguacccuucuguagucaucacuuucaccaacuaauuaugaaagacggaagagagaucguaguaccaugcaggaaucaagacgaauuaguuggccgugcgagaguaucacaaggugcaggcuggucuuuaagagaaacugcaugcuuggguaaaagcuacgcgcaaauguggcagcuuauguacuuccacaggagagacuuaagauuggcagcuaaugcuauuuguuccgccgucccugucgacuggguaccugcuaguaggacaacauggucaauacaugcacaucaccaguggaugacuacugaagauauguuaucaguuuggaacagggucuggauugaggaaaacccauggauggaggauaaaacacacgugucaucuugggaagaaguccccuaucucggaaaacgugaagaucaguggugcggcaguuugauaggauuaacugccagagccacaugggcaacaaauauucaaguugcgauuaaccaagugcggaggcucauuggcaacgaaaauuaccucgacuauaugacgucaaugaaaagauuuaaaaaugagagugauccugagggagcucuuugguaa

SEQ ID NO: 22030 - RNA, 9879 nt, Artificial Sequence
  derived and/or modified CDS sequence (opt6) from DENV-1__KC692497__SS-prME
ucagugacuaugcuacugaugcuucuaccuacagcucuugcauuccacuugacuacaagagggggugaaccucauaugauuguuaguaaacaagagcgcgggaaaucauuacuguuuaaaacgucggccggugucaacauguguacccuuauagcuauggaucuaggagaauugugcgaggacacuaugacauauaaauguccacggauaacugaagcagaaccggaugauguagacuguugguguaaugcuacagacacguggguaacguaugguacauguucacaaacaggagaacaucggagggaaaaacgaucagucgcgcuugcaccucacguuggacuaggccuugaaacuaggacggagacauggaugaguagugagggagcauggaaacaaauucaaaggguugaaacaugggcuuuacgacauccgggguucacugucauugcacuguuucuggcacaugcaauaggaacaaguauaacacaaaaaggaauuauuuucauacucuuaaugcuaguuacaccaucgauggcuaugcgaugcgucgguauugguaaucgcgacuuuguugaaggacugagcggugcaaccuggguagacgucguacucgaacaugguaguuguguaacaaccauggcuaaaaauaaaccuacacuagauauugaacuuuugaaaacagaaguaacaaauccugcuguacuuagaaaacuuugcauagaggccaaaaucaguaacacuacaacggacagucgcuguccuacgcaaggagaagcgacacuuguggaagaacaagaugcuaauuucguuuguagaagaacguuuguagaccgagguugggguaaugguugcggacucuuugggaaagggucucuccuuaccugcgcaaaauuuaaaugcguuacuaaacuugagggcaaaauaguacaauaugagaaucucaaauacagcgucauuguuacuguacacaccggcgaccaacaucaaguaggaaacgaaacaacugaacauggcaccauugcaacuauaaccccgcaagcgccuacgucagaaauacaauuaacugacuacggagcccucacguuagacugcucuccaagaaccggauuggacuucaacgaaaugguuuuacugacgaugaaagagaaaagcuggcuuguacacaaacaaugguuucucgaccuaccauuacccuggacauccggggccucaacaucccaggaaaccuggaauaggcaggacuuacugguuacauuuaaaacagcacacgcaaagaaacaggaagucguagucuuggguagucaggaaggagcaaugcauacagccuuaacaggcgcuaccgagauacagacgucaggaacuaccaccaucuuugcaggacaccuaaaaugcagacugaaaauggacaaacuaacccuaaaaggaaugucuuacguaaugugcacaggaucuuucaaacuugaaaaagagguagcagaaacccagcauggaaccguuuuaguccaaguuaaauaugaggguacagaugcgccuugcaaaauucccuuuagcacucaagaugaaaaaggaguaacucaaaaugggcgauugauuacugccaacccuauaguuacugauaaagagaaaccagucaacauugaaaccgaaccaccauuuggagagucuuacauuguaguuggggcaggagaaaaagcacuuaaacuaucuugguucaaacggggaucuaguaucggaaaaauguucgaagcaacagcuagaggggcgcggagaauggcgauuuugggcgacacugcaugggacuuugggagcauuggagggguauucacgagcgucggaaagcuaguccaccaaguauucggaacugcuuauggcguucuauucucaggaguaaguuggacaaugaaaaucggaauagggauuuuacucaccuggcugggucuuaacagccgaucuacaucuuuaucuaugacguguauagcggucggaauggucacucuuuaucuaggaguaauggugcaagcagauucuggauguguaauuaauuggaaaggccgugagcuaaagugcggaucagguauauuuguaacgaacgaaguccauacauggacagagcaguauaaauuccaggcugacucaccaaaaaggcuuagugcugcgauagggaaagcgugggaagaagguguguguggcauaagguccgcaacacgacuagaaaauauaauguggaaacaaaucaguaaugaauuaaaucauauacuauuagagaacgacaugaaauuuacaguuguaguaggggaugcaaacgguauauuagcacaagggaagaagaugauccguccacaaccgauggagcauaaauauagcuggaaaaguuggggaaaggcuaagauaauaggagccgauauccaaaauacaacguuuaucauagacgguccggauacaccagaaugucccgauggacaacgagcguggaauauaugggaaguggaagauuauggguucggugucuuuacaacgaauauuugguuaaaauuacgcgauucauacacacagaugugcgaucaccgauuaaugucagcggcaauaaaggauuccaaggcgguacacgcugauaugggcuacuggauagagagugagaaaaaugaaacguggaaacucgcacgugcaucauuuauagaaguuaagacauguacauggccuaaaucccauacauuguggucaaacggagugcuugaaucugaaaugauaauuccaaagaucuucggaggaccaaucucccaacacaauuaccgacccggguacuucacacaaacggcaggaccuuggcaccuagguaaauuggagcuagauuuugaccuuugugaagguacuaccguaguggucgacgaacacugcggaaaucgaggaccaagucuaaggacuacaacaguaacaggaaaaaucauacacgaaugguguuguagaucaugcacucuuccacccuuaagguuuagaggagaagauggauguugguauggaauggagauaaggccaguaaaggaaaaagaagaaaaucuugugaggucuaugguuucggcaggguccggcgagguggacucauuuagcuuaggaauuuuaugugugagcauaaugauugaagaaguaaugagaucuagaugguccaggaagaugcucaugacugggacacuagcuguauuuuuauuauugauuaugggacaauuaacauggaaugauuuaauucgacugugcauaauggugggagcaaaugcaucugacaggauggguacggguaccacuuacuuagcccuaauggcgacauuuaaaaugagacccauguuugcgguuggacuauuauuuagacguuugacgucuagagagguacuucuacuuacaaucggucuuagccuaguggcuucaguagaacuucccaacucauuagaggagcucggagacggacuagcgauggguaucaugaugcucaaguuacuaacugaguuucagccacaccaacuauggaccacucuauugucauuaacuuuugugaagacaacccucucucuggauuaugcuuggaaaacuacugcuaugguauuaucgauagucagccuguuuccauuaugccuaucaacaaccucacagaaaacgaccuggcuuccaguauuauuaggcucauuuggcuguaaaccauuaacaauguuuuuaaucacagagaauaagauaugggggcggaaauccuggccauuaaacgaggggauuauggcuauaggaaucguuucaaucuuacuaucuuccuuguugaaaaacgaugugccacuugcagguccauuaaucgccgguggaauguuaauugcauguuauguuauuagcggaucuuccgccgaucucucgcuggagaaggcagcagaaguuuccugggagcaggaggcugagcacuccggagcuucucauaacauccuaguagaaguacaagaugauggaacgaugaaaauaaaagaugaagaacgagacgauacccucacuauauuacucaaggcaaccuuguuagcaguaucgggcguuuauccuaugucaauuccagcuacgcuauucguaugguauuucuggcaaaagaagaaacaaagaucagguguuuuaugggauacccccucaccgccagaaguugaacgggcaguauuagaugaugggauauaccgaauauuacagaggggccuucuaggacgaagucaaguuggaguaggcguauuccaagauggagucuuucauaccauguggcacgugacacgaggcgcagugcuaauguaccaggguaaaagauuagaaccgucuugggcuucgguuaaaaaggaucucaucucauauggagguggcuggagauuucaaggcuccuggaacacaggagaagaaguacaaguaauugcugucgaaccagguaaaaaucccaaaaauguucaaacuacaccaggcacauuuaaaacuccugagggcgaaguaggugcgauugcuuuagauuuuaaaccgggaacaagcggcucaccgauuguaaaucgggagggcaagauaguaggacuauauggaaauggcguaguaacaacaagcgguacguauguaagcgcgauagcacaagcuaaagcgagccaagagggaccacugccagagauagaagaugaaguauuuaagaaaaggaaccuaacaauuauggacuuacauccggggucaggaaaaacacguagauaucugcccgcaauuguacgugaggcuauuaagagaaaacuaagaacucuaaucuuagcaccaacuagaguuguugcuagugaaauggcagaggcucuuaaaggaaugccuauuagauaccagaccacagcuguaaaauccgaacacaccggaagagaaauaguagaucuaaugugccaugcaacauuuacuaugagacuuuuaaguccgguaaggguaccaaauuacaauaugauuauaauggacgaagcccacuuuacugauccagcuagcaucgcagcaagaggguacauuucgacacgagucgguaugggcgaagcugcggcaauauuuaugaccgcaacaccgccagguucuguugaagcguucccucagucaaacgcuguuauacaggaugaggaacgagauauaccugaaagaucauggaacaguggcuacgacuggauuacugauuuuccggguaagaccgucugguuuguaccaucaauaaaaucaggcaaugauauugcaaauugccuaaggaaaaacggcaaacggguaauccaacuaucccgaaaaaccuucgauacagaauaccagaaaaccaaaaauaaugacugggauuaugugguaacaacugacauaucagagaugggugcuaauuuuagagcagaucgugugauagacccucgacgcuguuuaaaacccguaauucuaaaagaugguccagaaaggguaauccuagcggggccaaugccuguuaccguagccagugcagcacaacgaagaggccgcauaggccgcaaucaaaauaaagaaggugaccaauacgucuauaugggucagccgcuuaacaacgacgaagaucaugcucauuggacagaagccaaaaugcuauuagacaauaucaauacuccugaggggauaauacccgcacuauucgaaccagagagggagaaaucagcagcaauagauggcgaauauagacuacgcggagaggcaaggaaaacauuuguugaacuuaugcgaaggggugaucuaccaguuuggcuaucuuacaaaguagcguccgaaggauuucaauauucagaccggcgauggugcuucgacggugaaagaaauaaccaaguccucgaggaaaauauggacguagaaaucuggacaaaagaaggcgaaaggaagaaauuacguccuagauggcuagacgccaggaccuacagcgaucccuuagcccuuagggaauuuaaagaauuugcggcuggucgacggagcgugagcggagauuuaauccuagagauaggaaagcuaccccagcaucugaccuuaagggcucaaaacgcacuggacaacuuagucaugcuacauaauagugaacagggaggaaaggcuuaccgucaugcuauggaagaauuaccugauacaauagaaacucuaaugcuauuagcacugauagcgguauugacugguggaguaacauuauucuuucuaucagguaaggguuuaggcaaaacaaguauuggccuauuaugcguaacggcgucuucagcgcuacuuuggauggcuaguguggaaccucacuggaucgcagcaucgauaaucuuggaguucuuuuuaaugguauugcugauuccugaaccagauagacaaagaacaccacaagacaaccaauuagcauauguaguaauaggauuguuauuuaugauucuuacgguggcggcaaaugaaauggggcuauuagaaacuacuaagaaagaccuaggaauuggcuauguagcugcggaaaaccaccaacacgcaacgauguuggacguagacuuacauccagcgagcgcauggacacuguaugcagucgccacaaccguaauuacccccaugaugagacauacaauagaaaauacaacagccaauauaagucuaacggcuauugcuaaucaagcugcaauccuaauggggcucgacaaaggauggcccauuaguaagauggauaucggagugccauuauuagcgcuaggguguuauucacaggucaacccccuuacacuaacugcugcggugcuaauguuaguugcccacuaugcuauaauaggcccaggccuucaagcaaaggcaacgcgcgaagcacagaaaaggacagccgcuggaauaaugaagaacccaacaguagaugguauaguugcaauugaccuagauccaguaguguacgaugccaaauucgaaaaacaacugggacaaauaaugcugcuaauauuauguacaucccaaauccuauuaaugagaacuacgugggcccuuugugagaguauaacucuggcaaccggaccguugacaacacucugggaaggcagcccuggaaaauuuuggaauacaaccauagcaguaucgauggcgaauauauuccgugguucauacuuagcuggggcgggucuagcauucagucugaugaaaagucuaggaggcgggagaagggguacaggggcacaaggggaaacuuuaggcgaaaaauggaagagacaguuaaaccaauugucuaaaucggaauuuaacacauauaagcguagugguauaauggaaguugauagaagugaagcaaaagaagggcuaaagcgaggagaaacgacaaaacaugcugucucgcgcggaacugccaagcuaaggugguuuguugaaaggaaccuuguuaaacccgaaggaaaaguuauugacuugggaugcggaagaggugguuggucguauuacugugcaggacucaagaaaguaacagaagucaagggauacacuaaaggagguccaggacaugaagaaccuauacccauggcgaccuauggauggaacuuaguaaaauuacauucuggcaaagacgucuucuuuaugccgcccgagaaaugugauacuuuacuuugcgauauaggagaaaguucaccaaacccaacgaucgaggaaggucgaacucuaagaguuuuaaagaugguagaacccuggcuaagagguaaucaauucuguauaaaaauacuaaauccauacaugccaaguguagucgaaacauuagagcaaaugcagagaaaacaugguggcaugcuuguaaggaauccacugucaagaaacucuacacaugaaauguauugggucuccuguggaacaggcaacauaguuucggcagugaacaugacaucaagaaugcuauuaaacagauucacaauggcccacagaaagccaacauaugagagggacguagauuuaggagcugguacaagacauguagcgguugaacccgagguagcaaaucuagaugucaucggacaacgcauagagaauaucaaaaacgaacauaaaucaaccuggcauuacgacgaagauaauccguauaaaacaugggcuuaucacgguucguacgaagucaaaccaagcgguagcgcuucuucuaugguaaacgguguugucaggcuauuaacgaaaccuugggaugucauaccaaugguuacccagauagcgaugacagauacuacgccauucggccaacagcgagucuuuaaggaaaaagucgacacaagaacaccaagagccaaacgagguacgacacaaauaauggaaguaacagcaaagugguuauggggauuucuuucgagaaauaagaaaccuagaauuuguacaagagaagaauuuacgagaaaaguucgauccaaugcagccauaggagcuguauucgucgaugaaaaccaauggaacucagcaaaagaagcagucgaggacgaacgauuuugggacuuaguccauagggagagagaauuacauaaacagggaaaaugcgcuacuugcguguauaauaugaugggaaaaagagagaagaaauuaggcgaguucggaaaagcaaaaggcagucgugcaaucugguauaugugguuaggagcacgcuuccuagaauuugaggcacuuggauucaugaaugaagaucacugguuuuccagagaaaauaguuuaagcggaguagaaggagaaggccuccacaaacuuggguacauacuuagagacauaaguaaaauacccgguggcaauauguaugcugaugacacagcugggugggauaccaggauuacagaagaugauuuacaaaaugaagcgaagauuacagauauuauggaaccagaacaugcguuauuggcgacaaguauauucaaacucacuuaucagaacaaaguagucagaguacaacgaccugcuaagaaugggacuguaauggacgucauaucuagaagggaccagagagguaguggucagguaggaaccuauggguuaaacacuuucaccaacauggaaguucaacuuaucagacaaauggaaucagaaggcauuuuccuaccuucagaacuugaaacgccaaauuuagccgaacgugccuuagauugguuggaaaagcacggcgcugaacggcuuaaacgaauggccauauccggggaugacuguguaguuaaaccaauagaugauagguuugcaaccgcucuaacugcucuuaacgacaugggaaagguucguaaagacaucccacagugggaacccagcaaagguuggaaugauuggcagcagguucccuuuugcucucaucacuuucaucaacuaaucaugaaggauggcagagaaauagucguaccaugucggaaucaggacgaauuagucggcagagcaagggugucacagggggcaggguggagucugagagagacugcaugccuagguaagucauaugcacaaauguggcaacuaauguacuuucaucgacgagaccucagguuagcggcaaaugccauauguucugcgguuccaguagauugggugccagccucacgaacaacauggucaauacacgcccaccaucaauggaugaccacagaagauaugcucaguguauggaauaggguguggaucgaagaaaaccccuggauggaggacaagacucacguguccagcugggaggaaguaccauauuuaggcaaacgagaagaucaauggugugguuccuuaauugggcuaacugcuagagcgacaugggcaacaaacauccaaguugccauuaaccaaguaaggagauugauuggaaacgaaaacuacuuagauuauaugacaaguaugaaaagauuuaaaaacgagagcgaccccgaaggagcauuaugguaa

SEQ ID NO: 22031 - RNA, 9879 nt, Artificial Sequence
  derived and/or modified CDS sequence (opt6) from DENV-1__KC692498__SS-prME
ucggugacuauguuacucaugcugcuuccuacugcacuugcguuucauuugacuacacgaggaggugaaccucauaugauuguaaguaaacaagaaagagguaaaucgcuacuauuuaaaacgucagccgguguuaauauguguacauuaauugcaauggaucucggugaacuaugugaagauacaaugacauauaaaugcccucgaaucacagaagccgaaccggaugacguagauuguugguguaacgcaacugauacauggguuaccuacggaacuuguagucaaacaggagaacauagaagggagaaaaggaguguagcuuuggcaccccacguuggacuaggccuagaaacuaggacugaaacauggaugagcagcgaaggugcuuggaaacagauacaacgaguggaaacaugggcguuacgacauccugguuucacaguaauagcauuguuccuagcgcacgcgauugguacaucgaucacucaaaaaggcauaauuuucauucuuuuaaugcuugucacacccuccauggccaugaggugcgucggcaucggcaauagagauuuuguagaaggauugucaggagcuacguggguagacgucguucuggaacaugguaguugugucacaacgauggcuaaaaacaaacccacgcucgauauagaacuacuaaaaacagaaguuacuaauccugcugugcuacgcaaauugugcaucgaagcgaaaauaucuaauacgacgacagauucacguugcccaacucaaggugaagcgaccuuaguagaagaacaagaugcuaauuuugucugcaggaggacguucguagauagagguuggggaaaugguuguggacucuucgguaaagguucgcuacuaacaugugcuaaauuuaaaugcguaacuaaacuagaagggaaaauagugcaauaugaaaaccucaaauacaguguuauuguaacgguacauacuggagaucaacaccaagucggaaaugaaacaacagaacacgguacaauagcuacgauaacuccacaagcgccgacaucggaaauacaacuuacugauuauggcgcucuuacccuagacugcucacccagaacgggguuggacuuuaaugaaaugguuuuguugacaaugaaggaaaaauccugguuagugcacaaacaaugguuuuuggaucucccuuuaccauggacaucaggcgcaucaacaucacaagaaacuuggaaucgccaagaucuauuaguuaccuuuaaaacugcacaugcuaagaaacaggaaguaguaguucuagguagccaagaaggugcaaugcauacugcauuaacgggggcuacugagauacagacaucggggacaacaacuauauucgcugggcaccuuaagugccgacuuaagauggacaagcuaaccuuaaaggggaugaguuacguaaugugcacugguaguuuuaaacuugaaaaagaaguggccgaaacacaacauggaacgguccuaguccaaguuaaguaugaagggacugaugcuccaugcaagauaccuuuuagcacacaggaugaaaaaggaguaacucaaaaugggcgucucauaaccgccaauccaauugucaccgauaaagagaaaccuguaaacaucgaaacugaaccaccauucggcgaaaguuacauagucgugggugcuggggaaaaggcacuaaaacuuagcugguucaaaagaggaaguuccaucgggaagauguuugaagcuacugccagaggggcgaggaggauggcuauacucggcgacacagccugggauuuugguucgauuggcggaguauuuacaucgguaggcaaacuuguccaccaaguauuugggacugcguaugguguacuguucucaggagucuccuggaccaugaaaaucggaauaggaaucuuacuaaccugguuagggcuaaauucuagaaguacuucucuaucgaugaccugcauugccguagguaugguuacucuuuaccucggaguaaugguucaggcugacagcgguugcguaauaaauuggaaagggcgugaacucaagugcgggucagggauauuugucacaaaugaaguucacacuuggaccgaacaauauaaauuucaggcagauucaccaaaaaggcuaucagcagcaaucggaaaagcaugggaagaaggaguauguggaauacguagcgcaacgagacuagaaaacauaauguggaagcaaauaagcaaugaauuaaaccacauauuacuagagaacgauaugaaauucacaguuguaguuggagaugcuaacgguauccucgcacaaggcaagaaaaugauacguccccaacccauggaacacaaauauaguuggaaaucuugggggaaggcgaaaauaauaggcgcagauauccagaacacuacauuuauaauagacgguccagauacaccugaguguccugaugggcaaagagcuuggaacaucugggaaguagaagauuaugguuuugggguauucacuacuaauauauggcuaaagcuaagggauaguuauacgcaaaugugugaccaucgccuuaugagcgccgcaauuaaggauucgaaagcaguacaugcagauauggguuauuggauagagagugagaaaaaugaaacuuggaaacuggcuagagcaaguuucauagaaguuaagacuugcaccuggccuaaaagucacacauuguggucuaaugguguccuagaaucugaaaugauaauaccaaagauuuucggcggaccuaucucacagcacaauuacagaccuggauauuucacacaaaccgccggaccauggcaucuugggaagcuagaauuagacuuugauuuaugcgaagggacaacagucguuguugaugaacauugugggaauagaggaccaucuuuaagaaccacgacugucacggggaaaaucauacacgaaugguguugcaggucuugcaccuuaccuccauuaagauucagaggagaggauggcuguugguauggcauggaaauacguccaguaaaagaaaaggaagagaauuuaguacggaguaugguaucugcaggaucaggagaaguagacucguucuccuuaggcauauuauguguaucuauaaugauagaggagguuaugcgaucccgauggagcagaaaaauguugaugacaggaaccuuagcuguuuuccuauuacucauuaugggacaauuaacguggaaugaucuaauacgguuguguauaaugguuggagcgaaugcaucugauagaauggggacagguacgacauaccuagcucuuauggcaaccuuuaagaugcggccaauguucgcagugggucuucucuuuagaagacuuacgucaagagagguacuacuacuaacaaucgggcugagucuaguggccucaguggagcuaccaaauagccucgaggaauugggugauggauuagcgauggggauaaugaugcugaaauuauuaacugaauuucaaccgcaucaguuauggacaacuuuauugucacugacguuuguaaaaacaacguugucauuagauuaugcguggaagacgacggcuaugguauuaaguauugugagucuauuuccauugugucuuucgacgacaucccagaaaacgaccuggcuaccgguauugcucgggaguuuuggguguaaaccccuaacaauguuucuaauaaccgaaaauaaaauauggggccgaaagucauggcccuuaaacgaaggaauaauggcgauuggcauuguuucaauauuacugaguagcuuauugaaaaaugauguaccucuagcuggaccacuaauugcuggaggaaugcuaauagcauguuauguaauaucgggaagcucagcggaucuuaguuuggaaaaggcugcggaaguaaguugggagcaagaggccgaacauaguggugcgagucauaacauauuaguagaaguacaagaugaugguaccaugaaaaucaaggaugaggagagagacgauacuuugacgauuuuacuaaaagcuacucuccuggcgguuagcggaguauauccaaugucuaucccagcgacccuauucguaugguauuuuuggcagaagaagaaacaaagauccggagucuuaugggacacaccuucgccuccggaagucgaacgugcaguauuagaugauggaauauaucggauucuucagcgaggcuuacuugggagaagccaaguaggcgugggcguauuucaagauggugucuuccauacuauguggcaugugacucgaggugcaguuuuaauguaucaaggaaaacgguuagaaccaucaugggcaagcgugaaaaaggaucuaauuucauaugggggagguuggcgguuucaggguucuuggaauacaggagaagaaguacaaguuauagcggucgaaccagguaaaaacccgaaaaacguucaaacaacgccugguacuuucaaaacucccgaaggagaaguaggugcgauugccuuggauuuuaaaccagguacaaguggaagcccuauuguuaauagagaaggaaagauugucggacuguacgggaauggaguugugacaaccagcgguacauacguuucagccauugcccaagcaaaggcuucacaggaaggcccccuuccagaaauagaagaugaaguuuuuaaaaagcgaaauuugacuaucauggacuuacaucccggcaguggaaagacucguagguaucuaccagcgauagugagggaggcaauuaaacgaaaacuaagaacacuuauauuagcaccaacaagaguuguugcuucagagauggccgaggcguugaaagguaugccaauccgauaucaaacuacugcaguuaaaucggaacauaccgggcgugagaucguugauuugaugugccaugcaacauuuacuaugagacuguuaagcccggugagagucccgaauuauaauaugauaauaauggaugaggcacacuucacggauccagcuaguauagcagcgcguggauacauuucuacuagggucggcaugggagaagcagcagcaauauucaugacagcgacgccaccgggaagugucgaggcuuucccacaaucaaacgcaguaauccaagaugaagaaagagauauaccggagcgaucauggaacagcggauacgacuggauuacggacuuuucuggaaaaacaguaugguuuguaccaucaauaaaaucggggaaugauauagccaacugcuuaaggaaaaauggaaagagagucauacaauuaaguagaaaaaccuuugauacggaauaccagaaaacuaaaaauaacgacugggacuauguggugacuacugauauaucugaaaugggcgcuaauuuuagagcagacagagugauugauccacggaggugcuuaaaaccaguaaucuuaaaagacggaccugaaagaguaauauuggcaggaccaaugccaguuacuguugcaagugcugcacagagacgagguaggauagguagaaaccagaauaaagaaggagaccaauacguauacaugggccaaccguuaaacaaugaugaagaucaugcucacuggacggaggcgaaaauguuguuagacaauaucaauacaccagaaggaauuauacccgcuuuauucgaaccggaacgagaaaaaucagcagccauagauggagaauauagauugagaggugaagcacgaaaaacauucguggaacucaugcgaagaggcgaucugcccguauggcuaaguuauaaaguagcuucggaaggauuucaauauucggaucgacgauggugcuucgacggcgaacguaauaaccaagucuuggaagaaaauauggauguugaaauauggaccaaagaaggugaaaggaagaaacuucgaccaagauggcuagaugccaggaccuauucagauccucuagccuugagagaguucaaagaguucgccgcuggucgaagaaguguaucaggagauuuaauacuggagauagguaaacugccucaacaccuaacucuacgggcacaaaaugcacuagacaacuugguuauguuacauaauagcgaacaaggcgggaaagcauacaggcaugccauggaggaacucccagauacuauagaaacccugaugcuguuagcauuaauagcaguauuaacaggggguguuaccuuauucuuucuuagcggaaaaggauuaggcaaaacgagcauaggucuuuuguguguuacagcaucaucggcccuacuauggauggcuucuguagaaccacauuggauugccgcguccauuauccuagaguucuuccuuaugguguuacuaauaccagaaccagacaggcaaagaaccccacaggauaaucaacuagcauauguaguaaucggucuacuuuucaugauuuuaacaguugcggccaaugaaaugggccuccuugaaacuacgaagaaagauuugggaauaggguacguagcagcugaaaaccaccaacaugcgacaauguuagauguggaccuacaucccgccucagcuuggacacuguaugccguagcuaccacuguuauaacaccaaugaugcgacacacuauagaaaacacuacggcaaauauuaguuuaacagccauagcgaaccaggcagcgauucugauggguuuagacaaagguuggccgauaucuaaaauggauauuggaguaccacuucucgcacuaggcuguuacucccagguuaauccucucaccuuaacagcagcuguauuaaugcugguugcgcauuacgccauuauaggaccaggucuacaagcaaaagcaacgcgagaagcacaaaagcguacggcggcgggcauaaugaaaaauccgacagucgauggaauagucgcaauagaucuagacccugucguauacgaugccaaauuugaaaaacaacuaggccaaauaaugcuauuaauacucuguacuagccaaauauuacucaugagaacaaccugggcgcuaugcgaaucuaucacauuagcuacuggcccacugacuacucucugggagggguccccaggaaaauucuggaauacaacgaucgcagucucuauggcuaacauuuucagaggauccuacuuggcaggcgcaggauuagcauucucucugaugaaaagucuagggggaggaaggcgaggcacaggagcucaaggugaaacauugggagagaaauggaaacgucaauuaaaccagcucagcaaauccgaauuuaauacuuacaaaagaucaggaauaauggagguagauagaagugaggcuaaagaaggacuaaaacgcggcgagacgacuaaacacgccgucucuagggguacagcaaaauuaagaugguuuguggaaagaaaccuaguaaaaccugaaggaaaaguaauugauuuagguugcggcagaggaggguggagcuacuacugcgcuggauuaaagaaagugacagagguuaaagguuauacuaaggguggaccuggucaugaagaaccaauucccauggcaacguauggauggaauuuaguaaaauuacauucgggaaaagauguguucuucaugccacccgaaaaaugcgauacacuccuaugcgauauaggagagaguaguccaaauccuaccaucgaagaaggaaggacguugcgaguucuuaagaugguagagccgugguuacgaggaaaucaguuuugcauaaaaauccucaacccauacaugccuagcguuguagaaacacuagagcagaugcagagaaagcacggaggaauguuagugagaaacccguuaucaaggaauaguacacaugagauguacuggguaaguugugggacaggaaacaucgucagugcgguuaauaugaccucgcguaugcuacuaaauagauucaccauggcucaucgaaaaccgacauaugagagagauguagaucuuggagcggggacuaggcacguagcaguagaaccagaaguagcgaacuuggauguuauaggccaacgaauagagaacauuaaaaaugagcacaaaucgacuuggcacuaugaugaagacaauccguauaaaacuugggcauaccacggaucauacgaaguuaaaccuucaggauccgcaaguagcauggugaacggcguaguacguuuacugacgaaaccgugggaugucauuccuauggugacgcaaauugcgaugacggauacuacaccuuucggacaacagagaguuuuuaaagagaagguggauacgagaacaccccgagccaagagaggcacuacucaaauaauggaggugacugcaaaaugguuaugggguuuucuuucgagaaauaaaaagccacgaauauguacaagggaagaauuuacuaggaaaguccgaucaaacgcggccaucggggcaguauucguggaugagaaucaguggaacucagcuaaagaagcugucgaagacgaacgguuuugggaucuaguacauagagaacgugaguuacacaaacaaggaaaaugcgccacauguguuuacaacaugauggguaaaagggagaagaagcuaggagaguucggcaaagcaaaagggagucgagcgauaugguauauguggcucggugccagguuucuagaguucgaagcacuaggguucaugaaugaagaucacugguucagucgugaaaauucacuaucuggagucgaaggggaaggccuucauaaauuaggcuacauacuaagagacaucuccaaaauucccggaggaaauauguacgcugaugauacagcaggaugggacacuaggauaacagaagaugauuuacaaaacgaggcgaaaauuacggauauuauggagccggaacacgcucuccuagcgaccagcauauucaaauugacuuaucaaaauaagguaguacgcgugcaacgcccagcuaaaaauggaaccguuauggacguaauuucaagaagagaccagcgaggcucuggccaaguaggaacguauggucuuaacacauucaccaacauggaaguccaacuaauucgacaaauggaaagugaaggaauauucuuaccaagcgaacuagaaacaccgaacuuagcagaaagagcauuagacuggcuugagaaacacggagcagaaagacucaaacggauggcaauaagcggcgaugacuguguggugaaaccgauagacgauagauucgccaccgcauuaacugcguugaacgacaugggaaagguacgaaaagacauuccucaaugggagccaucaaaaggcuggaacgauuggcaacaagugccauucugcucccaucauuuucaucaacuaauaaugaaagauggaagggaaauaguugugccgugcagaaaucaggaugaacucguggguagagcacgugugagccagggagcgggauggucccugagagaaaccgcgugucugggaaagucauaugcccaaauguggcagcuuauguacuuucaccgacgagauuuaagauuagccgcaaacgcaauuuguagcgcagugcccguagauuggguuccugcaucacguacuacauggagcauccacgcgcaccaucaauggaugacaacugaagauaugcuaagcguauggaaccgaguauggauagaagaaaacccauggauggaagauaaaacucaugucucaaguugggaagaaguuccuuaucuagguaagagagaggaccaauggugugguucguuaauaggguuaacugccagagcgacuugggcgacaaacauucaaguagcuaucaaccaagugagaagguuaaucggaaaugaaaauuaccuggacuauaugacguccaugaaaagauuuaagaaugagagcgaccccgaaggagcauuaugguaa

SEQ ID NO: 22032 - RNA, 9879 nt, Artificial Sequence
  derived and/or modified CDS sequence (opt6) from DENV-1__KC692499__SS-prME
ucagucacuaugcuucugauguugcuaccaacagcauuagcguuucaucugacaacuagagguggagaaccacauaugauagucagcaaacaagaacguggaaaaucccuauuguuuaaaacaucugcaggagucaacaugugcacguuaauagcaauggacuugggugaacuuugugaagauacaaugacauacaaaugcccgcgcauaacagaagcagaaccugaugauguagacuguuggugcaacgccacagauacuugggugacauacgguaccuguucacaaacaggugaacaucgccgagagaaaagaucggucgcgcuagcaccucacgucgggcuaggauuagaaacccgcacggaaacguggaugucaucggaaggagcauggaaacaaauucaaagaguugaaacaugggcacugagacauccuggguucacgguuauugccuucuuucuugcgcaugcuauugguacuucgauuacgcaaaaagggauaauauuuauacuacuaauguuagucacaccaaguauggcaaugcgcugcguaggaauaggaaauagggacuucguagaaggauugucaggagcuacauggguggauguagugcuagaacauggcagcugcgucacaaccauggcgaaaaauaaacccaccuuagauauagaacugcuaaaaacugaaguuacuaacccggccguucuuaggaaauuauguaucgaagcaaaaauaucaaauaccacuacugauucgagguguccuacacaaggcgaagcuacgcugguagaagaacaagacguaaacuuugugugccgacguaccuucguagauagaggcugggguaauggcuguggacuauuugggaaaggaucauuauuaacuugcgcaaaauucaaaugugucacaaaauuggaaggaaaaauaguucaauacgaaaaccucaaauauagcguuauuguuacgguucauacaggugaccaacaucaaguagguaaugagacaacggaacacggcacuauagccacgauuacuccacaagcaccgacgagugagauacaacuaacugauuauggagcacuaacauuagacugcucaccucgaacugggcuggauuuuaacgaaauggucuuacuaacgaugaaagagaaaaguugguuaguacauaaacagugguuucuagacuuaccauuacccuggacuucaggagccagcacaagucaagaaacauggaacagacaggaucuuuugguaacguucaaaacagcgcacgccaagaaacaggaaguuguuguacuaggaagucaagagggugcgaugcacacugcacucacaggcgcaaccgagauacaaacgagugguacgacuacgauauuugcuggacauuuaaaauguagauugaagauggauaaauugaccuuaaaaggaaugucauauguuauguguacagggucauucaaacuagaaaaagaagucgcugagacacaacacgguacaguucuuguucaaguuaaauacgaaggaacggaugcaccuuguaaaauuccguuuagcacccaagacgaaaaaggcguaacacaaaaugggagauugauaacagcaaaucccaucguaaccgacaaggaaaaaccaguaaauauugagacugaaccaccuuucggcgagaguuauauaguaguuggggccggugaaaaggcccuuaaguuaaguugguuuaaaagaggaucauccauaggaaagauguucgaagcuaccgcucguggagcaaggagaauggcaauucuuggggacacagccugggauuuugggaguauagguggcgucuuuacgagcguaggcaagcuagugcaccaaguauuugggacagcuuaugggguauuauuuagcggcgucucguggacgaugaagaucgggaucggcauacuccucacuuggcucggucuaaauaguaggagcaccucgcuuagcaugacuuguauagcuguuggcaugguaacucuuuauuuaggaguuaugguucaagccgauagcggguguguaauaaacuggaaaggacgagaacuaaaguguggaagcggaauuuucgugacaaacgaaguccauacuuggacagaacaauauaaauuccaagcggacucaccaaaacgucuaagcgcugcgaucggaaaggcuugggaggaagggguauguggaauacgaucagcuacacgcuuagagaacauaauguggaagcaaauaagcaacgaacuaaaccacauuuugcuugaaaaugacaugaaauucacgguaguuguaggggaugcgaauggaauacuugcucagggcaagaaaaugauuagaccucaaccaauggaauacaaauacucauggaagucaugggggaaagcaaaaauuauuggcgccgacauucaaaauacaacuuuuaucauagauggaccugauaccccagaaugccccgauggacaaagagcauggaacauuugggaaguagaagauuacggcuuuggaguauucacgacuaacauauggcugaaacuuagggauaguuacacucaaaugugugaucaucgccugaugucagccgccauaaaagauucuaaagcaguucaugcagauaugggcuacuggauagaaucggagaaaaacgagaccuggaagcuagcaagggcguccuuuauagaagugaaaaccugcacauggccaaagagccauacguuauggagcaacggaguucuagaaagcgaaaugauaauaccuaaaauauuugguggaccuauuucgcagcacaacuacagaccuggauauuuuacacaaacugcagguccauggcauuuaggaaaauuagaacuggauuuugacuugugcgaaggcacuacaguagugguggacgagcauugugggaauagaggcccaagccuaagaacgacuacuguuacaggcaagaucauacaugagugguguuguaggagcugcacauuacccccacuaagauuucgcggggaagacggcuguugguacggaauggaaauacgaccagucaaagaaaaagaagaaaaccuuguacggucaaugguaagugcgggaagcggugaaguagacagcuucucauuaggaauuuuauguguguccauaaugauugaagaaguaaugcgaucacgauggagccgcaaaauguuaaugacuggcacuuuagcuguauuuuuauuguuaaucauggggcaacucacauggaacgaccucauaagacuauguauaaugguaggagcuaacgcuucagauagaaugggcaugggcacaacauauuuagcuuugauggcuacauuuaaaaugcgccccauguucgcaguagguuuguuguuuagacgauuaacaagucgagaaguucuguuauuaacgauaggauuaagccuaguugcuucgguagaacucccaaauaguuuagaagaauuaggagaugguuuagcgaugggaaucaugaugcuaaaacucuugacggaauuucagccccaucaauuauggacuacauugcucagcuuaaccuuugugaaaacaaccuuguccuuagauuaugcauggaaaacaacagcgaugguguugaguauagucucacuauuuccccucugccuauccacgacuucacagaagacaacauggcuaccuguacuacuggguucauuuggauguaagccucuaacuauguuccuaauuacugaaaauaagauauggggacguaagucguggccucucaaugaagguaucauggcgauagguauuguuucuauucucuuauccucuuuacucaagaacgauguaccuuuggcgggaccacucauugcuggugguaugcuuauagcuuguuacguaauaucaggaucuucugcugaccuuagcuuagaaaaggcugcugaaguuagcugggaacaagaggccgaacacucgggugcgagucauaacaucuuaguggaaguacaagacgacggaacuaugaaaauuaaagaugaggaaagggacgauacacuuacaauacuauuaaaagcaacauuguuagcaguuucagggguuuauccaaugagcauucccgcaacucuuuucguaugguauuuuuggcagaaaaagaaacaaaggucuggagucuuaugggacacaccuagcccuccggagguagaaagagccgugcuagacgacgggauauauagaaucuuacagagagguuuacuuggacgaagucaaguaggaguggguguguuccaagacggaguauuccauacaauguggcauguaacaaggggagcuguauuaauguaucaaggaaaacgacuggaacccucuugggcuagugugaagaaagauuugauaagcuauggaggcgguuggagauuccaagguucuuggaauacaggggaagaaguccaaguaaucgcgguggaacccggcaaaaacccgaaaaauguucaaacuacaccgggaaccuucaaaacaccagagggagagguuggagcaauagcucuggacuuuaaaccagggacuucagggucacccauuguaaaccgagaaggaaaaauaguuggguuauauggaaacgguguugugacgacauccggaacauacguuagcgcuauagcccaagcaaaagcgucacaagagggacccuugccagagauagaagacgaagucuuuaagaaaagaaaucuuacaauaauggauuugcacccaggaucuggaaaaacacgacgauaucuuccggccauugugagagaagcgauaaaacgaaaacuuaggacgcuaauauuggcaccaacacgaguuguugcaagugaaauggcggaagcguuaaaaggcaugcccauucguuaucaaaccacugcuguaaaaagugagcacacaggaagggagauaguagaccuuaugugucaugccacuuucacaaugagacuacuuaguccgguaagaguucccaauuauaauaugauuauuauggacgaagcccauuuuacugauccugccucgauagccgcgagagguuauauaucuacacguguuggaaugggggaagcggccgccauuuuuaugacggcuacacccccuggguccguagaagcauucccucaaaguaacgccguaauacaagaugaagagagggacauacccgaacguucauggaacucagguuaugacuggauugccgacuuuccugguaaaacugucugguuuguuccaagcaucaaaucagguaaugauauugcgaacugccucaggaaaaaugggaaacgaguaauucaauuaucaagaaaaaccuucgauaccgaauaucagaaaacuaagaauaaugacugggacuauguaguuaccaccgacauaucagaaaugggugcaaauuuuagagcagauagaguuaucgaccccagacgaugcuugaagccaguuauacuaaaggauggacccgaacgagucauacuagcaggaccaaugccagucacuguagcaagugcggcacaaaggcguggacgaauaggacgaaaccaaaauaaggaaggcgaccaguauguauauauggggcaaccguugaauaacgaugaagaucacgcccauuggacagaagccaaaaugcuacuggacaauauuaauacaccggagggaauuauaccugcauuguuugaaccagagagagagaaaagcgcagcaauagauggggaauaucggcuacgcggcgaggcucgaaaaacguuugucgaguugaugcgacgaggagauuuaccaguauggcugaguuauaagguggccucagaagguuuccaguacucggaucgacgcuggugcuuugacggggaaaggaauaaccagguucuagaagaaaacauggacguagaaauauggacaaaggaaggagaaaggaagaagcuaagacccagaugguuggacgcccgaacuuauucggacccacucgcguuaagagaauuuaaagaauuugccgcaggcagaagaucaguaucgggcgacuuaauauuagaaauaggaaaacuaccgcaacaucucacauugagagcgcaaaaugcauuagauaauuuaguaauguuacacaacucagagcaaggugggaaggcuuauagacaugccauggaagaacuucccgauacaauagaaacguugaugcugcucgcauuaauugccguauuaacuggaggaguaacauuguucuuuuuaucagggaaaggauuaggaaaaacguccaucggucugcuuugcgugacggcgagcuccgcacuuuuauggauggcuucaguugagccucacuggauugcagcaaguauaauccuugaguucuucuugaugguacuucuuauuccagaaccagauaggcagaggacuccucaagacaaccaacuagcguauguuguaauaggccuguuauucaugauuuuaacgguagcagccaaugaaaugggccugcuggaaacaaccaagaaagauuuaggcauaggauacguagcugcagagaaccaucaacacgcgaccaugcuagaugucgaucuccacccggcaucagcauggacuuuauaugcaguagcaaccacuguuauaacgccaaugaugcgucauacuauagaaaacacaacugcuaacaucucauuaacagcuauagcgaaucaggcagcgauccugaugggacuagauaaaggauggccaauuaguaaaauggauauaggugugccacuauuagcauuaggcuguuacagccaaguuaacccauuaacuuuaaccgccgcaguacuaauguuaguugcucauuaugcaauaauagguccgggccuacaagcuaaagcaaccagggaagcucagaagaggacggccgcagguauaaugaaaaauccaacuguugaugguauuguagcaauagaccuugauccaguuguauacgaugcaaaguuugaaaaacaacugggucagauuaugcuuuugauccucuguacuucucaaauauugcuuaugcgaacuacuugggcuuuaugugagucaauuacacucgcuacugguccguuaacaacgcuuugggaaggaagcccagguaaguucuggaauacaacuauugcaguaucuauggcaaauauauuccgggguagcuauuuagcuggagcaggauuagcuuuuagccuuaugaaaagccugggagguggacgacgcggaaccggagcgcaaggagaaacacuaggugaaaaauggaaacgacagcuaaaucaauuaaguaaaucugaauuuaacacauauaaaaggagugguauuauggaaguagaucguuccgaagcaaaagagggacuaaaaagaggcgaaacgacuaagcaugcuguaucgagagggacugcaaaacuucgaugguucguagagagaaauuuagucaaaccggaagguaaagugauugauuuagguuguggacgcggggguugguccuauuauugugcuggauugaagaaaguaacagaagugaaaggguauacaaaaggcggaccaggacacgaagaaccuauuccuauggcuacguauggcuggaaucuuguaaaauuacauucaggaaaagacguuuucuuuaugccaccagaaaagugugacacauuacuaugugauauuggugaaaguagcccuaacccaacaauugaggaagggaggacacuaaggguguuaaaaaugguagaaccuuggcuuaggggaaaccaauucugcauaaaaauucucaacccuuacaugccaucuguaguggagacucuugaacaaaugcaaagaaaacacgggggaaugcuaguaagaaauccacuuucuagaaauagcacccacgaaauguacuggguuucgugcggaaccggaaauauaguaucggcuguuaacaugaccaguagaauguuacuaaauagguuuaccauggcacaccgcaaaccaaccuaugagagggauguggacuuaggagccgggacgagacacgucgccguugaacccgaggucgccaaucuagacauaauuggucaaagaaucgagaacaucaaaaaugaacacaaaagcacguggcauuaugaugaagacaacccguauaaaacaugggcauaucaugguucauaugaggucaaacccaguggaagugcaucaaguauggucaacgguguugugcgccuacuaacuaaaccaugggacguaauacccaugguaacccaaauugcaaugacugauacuacaccuuuuggucagcaaagaguguuuaaggaaaaaguagacacaagaacaccuagagcaaaaagaggaacaacacaaauaauggaaguuaccgccaaaugguuaugggguuuccugagcagaaacaagaaaccacggauuugcacgcgcgaagaauuuacaagaaagguacgaagcaaugccgcgaucggggcuguuuucguagacgaaaaccaauggaacagcgcgaaagaagcaguugaagacgaaagguucugggacuuaguucaccgcgaaagagaacuacauaaacaaggaaagugcgccacuuguguuuauaacaugauggguaaacgcgagaagaaauuaggagaguuugguaaagcuaaagggucgcgagccauuugguauaugugguuaggggcucgcuuucuagaauuugaggcucucggcuuuaugaaugaagaucauugguuuucaagagaaaauaguuugucgggcguagaaggagagggacuccauaaauugggcuacauacuaagagauauaaguaaaaucccaggaggaaacauguaugcggaugacacagcagguugggauacaaggaucacugaagaugauuugcagaacgaagcuaagaucacggauauaauggaaccugaacacgcccuguuagcgacgucuaucuucaaguuaacauaccaaaacaagguaguacguguucaaagacccgccaaaaacgggacugugauggauguuauaucaagaagggaccaaagaggcaguggccaagucggaaccuauggacuaaauacauuuacaaauauggagguccagcuaauacgacaaauggaaagcgaagguauauuuuuacccagcgagcucgaaacaccuaaucuagcagagcgagcguuagacuggcuagaaaagcacggugcugaaagauugaaaaggauggccauuucaggagaugacuguguaguuaaaccuauugacgaucgauucgcaacggcacuaacugcuuuaaaugacaugggaaaaguccggaaagauauaccgcaaugggaaccuucaaaagguuggaaugauuggcagcaaguaccuuucuguucacaccauuuucaucaacuaauuaugaaagauggacgcgaaauaguaguaccaugucgaaaucaagacgagcuaguaggcagggcaagaguaucccagggggcaggguggagccuacgcgaaacugcaugcuuggggaaaucauacgcacaaauguggcaauuaauguacuuccauaggagggaucucaggcuugcagcuaaugcuaucugcagcgcgguaccuguagauuggguacccgcaaguaggacaacuugguccauacaugcucaucaucaauggaugacgacugaagacaugcuaagcguauggaaccgaguauggauugaagaaaauccuuggauggaggacaaaacgcacguauccagcugggaagaaguaccauacuuaggcaaacgggaagaucaauggugcgggucguuaauuggucucacagcacgcgcuacaugggcaacuaauauucaaguagcuauaaaucaaguacgacgccuuauaggaaacgaaaacuauuuggacuauaugacgucgaugaaacgauuuaaaaaugaaagcgacccugagggagcccuaugguag

SEQ ID NO: 22033 - RNA, 9879 nt, Artificial Sequence
  derived and/or modified CDS sequence (opt6) from DENV-1__KC692500__SS-prME
agcgugacaauguuauugauguuacuuccuacagcacuugcguuucauuuaacaaccagaggaggggaaccacacaugauagucucuaaacaagaacgaggaaaaagccuuuuauucaaaacgagcgccggugucaauauguguacacugauugcaauggaccuaggcgaacugugugaagauaccaugacauauaaguguccgagaauaacugaagcagaaccugacgaugucgauuguugguguaaugcaaccgauacuuggguuacguacggaacuugcagucagacuggagaacacaggagggagaaacgaucuguagcacuagcaccacaugucggacuaggacuagaaacaaggacugagacuuggaugucuucugagggggcuuggaaacaaauacaacgaguugagacaugggcauuacgacacccuggauucacgguuauagcauucuuucuagcacaugcuauagguacgucuauaacucagaaagguauaaucuuuauauuacuaauguuggucacaccuagcauggcgaugaggugugugggaauugguaacagagauuucguggaagguuugaguggugcaaccuggguagaugucguacucgaacauggauccugcguaacuacuauggcuaaaaauaaaccgacacuugauauagaacuuuuaaaaacggaagucacuaauccagcggucuuacgaaaauuauguauagaagcaaaaauaucaaauacaaccaccgauaguagaugcccaacacaaggagaagcaacauuaguagaagaacaggacgcuaacuucguaugcaggcgaacguucguggaccggggcugggggaacgguugcggauuguucggaaaaggaucucuacugaccugugcaaaauucaaaugugugacaaagcuagaagguaagauaguucaauacgagaaucugaaauacucgguaaucguaacuguccauacgggagaccaacaucaaguaggaaaugaaacaaccgagcacgggacaauagcuacaauuacaccccaggcaccaacuucggaaauucaauugacugauuauggagcgcucacacuggacuguaguccacggacuggucucgauuuuaacgaaaugguucuucuuacgaugaaaggaaaaucauggcuugugcacaaacagugguuccuugaccuaccgcucccauggaccaguggggcgagcaccucacaagaaacguggaauaggcaggauuuacugguuacauucaaaacggcgcacgcuaagaaacaagaaguaguaguccuaggaagucaagaaggagcgaugcacacggcauuaacaggagccacagaaauacaaacaucaggaaccacaacaauauuugccggccaucuuaaauguagacuaaaaauggauaaacugacgcugaaagguauguccuauguuaugugcacugguagcuuuaaauuagagaaagaagucgcugaaacgcaacacgggaccguucucgugcagguuaaauaugagggaacagacgcuccuuguaaaauaccauuuaguacccaagacgaaaaagguguaacccagaacggacgucuuauaacagcaaacccaauaguaacggauaaagaaaaaccggugaauauagaaacagaaccaccuuuuggugaauccuacaucguuguuggagccggugaaaaggcuuugaaacuaucuugguuuaaacgaggaaguucaaucggcaaaauguucgaagcgacagcuagaggagcgcgaagaauggcaauacuaggggauacugcaugggacuucgguaguaucggaggcguauucacuucugucggaaaauuaguucaccagguauuuggcacggcauauggcguauuauuuagugguguauccuggacaaugaaaauaggcauaggaauauugcuuacaugguuaggacuaaauagccgcaguacaucucugaguaugacguguauugcuguugguaugguaacccuguaucuaggaguaaugguacaggcugacagcggaugcguuauaaauuggaaaggaagggaacuuaaaugcggaagcggcauuuuuguuacaaacgaaguccauacauggaccgaacaauacaaauuucaagcagauagcccuaaaagacuaagcgcugcuauagguaaggcuugggaagaggguguuuguggaauccgcagugcaacaagacucgaaaauauuauguggaaacaaauaaguaaugaacuaaaucauauucuucuagaaaaugauaugaaauuuacggucgucguaggagacgccaaugggauauuagcacaagguaagaaaaugaucagaccgcaaccgauggaacauaaauauucauggaaaaguuggggcaaagccaaaauaauaggggcugacauucaaaauaccacuuuuauaauugauggacccgauacuccagagugcccugauggacagcgagcuuggaacaucugggaaguugaagauuacgguuuuggaguguuuacaacaaacauaugguuaaagcuacgcgacuccuacacucaaaugugugaucauagauuaaugagugcugcaauuaaagauaguaaagcaguucaugcagacaugggcuauuggaucgaaagcgagaaaaaugaaacuuggaaguuggcuagagccaguuucauagaaguuaaaacguguaccuggccaaaaagucacacuuugugguccaauggaguguuagaaucggaaaugauaauacccaagauauucggcggaccaauaucucaacacaauuauagaccaggauauuuuacgcaaacagcgggaccguggcaccuaggaaaauuagagcuugacuuugauuugugugaaggaacaacggucguuguugacgagcauugcgggaacagagggccaaguuugcgcacaacaacuguaacagguaagauaauucacgagugguguuguagaagcuguacgcuaccucccuugcgauuuagaggggaagauggauguugguacgguauggaaauacggccuguaaaggaaaaagaagaaaaucuggugagaucaaugguuucagcuggcuccggggagguagauaguuuuucauuaggaauuuuaugugugucaauaaugauagaagaggugaugagaagucgcuggucgcgaaagaugcuuaugacugguacacuagcuguuuuccucuuauuaauuaugggccaacuaacauggaacgauuugauccgacuuuguaucaugguaggagcuaaugcaucagacagaauggggaugggaacuacauauuuagcuuuaauggcuaccuuuaaaaugagacccauguucgccguagguuuauuauuuagacggcuaacaucucgugagguacuccucuuaacgauaggguuaucuuuaguggcuucaguagaauuaccaaacucguuggaagaauuaggagacggauuagcaaugggcaucaugaugcuaaaauuauuaacugaauuucaaccgcaucaacucuggacgacacuauuaagccuuacauucguaaaaacuacccugagcuuagauuaugcuuggaaaacuacugcaaugguucucucaauuguaucacuauucccacuauguuugucaacgaccucgcaaaagacaacauggcuaccaguauuguuggguucauuuggaugcaaaccuuuaacuauguucuuaaucaccgaaaauaagaucuggggucguaaaucuuggccgcuaaaugaaggaauaauggcaauugggauaguaaguaucuuauuaucaaguuuauugaaaaaugacguaccuuuggcugggccccugauugccggaggaauguuaauagccuguuacguuauuucggggucuucagcagaucuaagccuagaaaaagcagcugaaguuaguugggagcaggaagcggaacacagcggugcaagccauaauauuuugguugaaguucaagaugauggaacaaugaaaaucaaagaugaagagagggacgauacacucacgauucuucugaaggccacuuuacuagcaguauccgguguauauccuaugagcauuccagcaacccuuuucguuugguacuucuggcagaagaagaaacaacgaucgggaguucucugggacacaccgagucccccugagguagaaagagccguucuugacgauggaauauacagaauuuuacaaagaggucugcuuggaaggucccaaguaggaguuggaguauuccaggauggaguauuucacaccauguggcaugucacgcgaggagcuguacuuauguaccagggcaaaagauuagagccgaguugggcaucaguuaagaaagaucuaaucucauaugguggcggauggagauuuaaggggucuuggaacacuggagaagaggugcagguaauugcugucgaaccgggcaaaaauccuaaaaacguacaaaccacgccuggaacuuucaaaacaccagagggcgaggugggcgcaauugcgcuggacuuuaaaccuggaacaucuggcucaccgauagucaacagggagggcaaaauugucgggcucuauggaaauggcguuguaacaacguccgguacguauguaucagcaauugcgcaagcaaaagcaucacaagaagguccuuuaccggaaauagaggacgaaguauucaaaaagagaaaccuuacuauaauggaucugcauccuggaagugguaagacuagaagguauuuaccggcuauuguacgagaggcaaucaaaagaaaguuacgaacucuaauucuggcucccacgcguguuguggcauccgaaauggcagaagcacuuaaagguaugccuauucgguaccaaacuacggcaguaaaaagcgaacauaccgguagggaaauaguagauuuaaugugucacgcgacauuuacaaugcgucuucuguccccaguaagaguuccgaauuacaacaugauuauuauggacgaagcacacuucacggauccagcgucuauagccgcccgggguuacauaagcacaagaguagguaugggggaagccgcagcuauauuuaugacagccaccccaccaggaagugucgaagcauuuccccaaucuaacgcuguuauucaagaugaagaaagagauauacccgaaagaagcuggaacaguggguacgauuggauaacagauuuuccaggaaagaccguaugguucguacccagcaucaaaucggguaaugauauugcaaauuguuuaaggaaaaacgguaaaagaguuauucaauuaucuaggaagacuuuugauacagaauaucagaaaaccaaaaauaaugacugggauuauguaguaacaaccgauauaucugaaaugggagccaauuuuagggccgauagagucauagauccaaggagaugucuaaaaccagucauauuaaaagacggaccugaacgaguaauuuuagcgggacccaugccagucaccguggccagugcugcacaacgaagagggagaaucggucggaaucaaaacaaagaaggugaccaauaugucuauaugggccaaccguugaacaacgaugaggaccaugcucacuggaccgaggcuaaaauguuauuggauaauaucaauacuccugaaggaauaauucccgcgcuauuugaaccggaaagagagaagucggcggcaauagauggugaauauagauuacguggagaggcgaggaagacuuucguagaguuaaugcgacgaggagacuuaccaguaugguuaagcuauaaaguagcuucggaaggcuuccaguacuccgaucgaagauggugcuucgauggagaacgaaacaaucaaguccuagaagaaaauauggacguugagaucuggacuaaagagggagaaagaaagaaacuuagaccuagaugguuagaugcaaggacuuacucagacccauuagcccuacgggaguucaaagaguuugcugcaggccgaaggagcgugagcggagacuugauacuugaaauugguaaacuaccacaacaccuaacucuacgcgcucaaaaugcuuuagacaaucuaguuaugcuccacaacucagagcaaggugguaaggcuuacagacaugcaauggaagaauugccagauacaauagaaacucuuaugcucuuggcauuaauugcuguacuaaccgggggaguaacacuguucuuuuuauccggaaaagggcugggaaaaacuucaauuggucuauugugugucaccgccucaagcgcuuugcuauggauggcuucagucgaaccacacuggauugccgcaucuauaauccuagaauuuuuccugaugguauuacugaucccagaaccggauagacaacguacaccacaagauaaccaacuggcuuauguaguuauuggauuacuauuuaugauacuaacaguagcagcuaaugaaaugggucuguuagaaacaacaaagaaagaucucggcaucgguuauguugcugcagagaaccaucaacacgcaacaaugcuugauguagauuuacauccggccagugcuuggacgcuauaugccguagcaacuacaguaauaaccccaaugaugaggcauacuaucgaaaauacaaccgccaauauuagccucacggcaauugccaaccaagcggccauacuaauggguuuagauaaaggauggcccauaucaaaaauggacauuggaguaccgcuacuggcauuagguuguuauucccaggucaauccauuaacacuaaccgcugcuguauugaugcucguagcacacuacgcaaucauugguccuggcuugcaagcuaaagccacucgggaagcgcagaagaggacagcagccggaauuaugaagaauccgacaguagaugguaucgucgccauugauuuggauccaguaguguaugacgcuaaauucgaaaagcaguuagggcaaauaaugcuauugauucuaugcacaucccagauucuacucaugagaacuacgugggcuuugugcgaaucgauaacccucgcuacaggaccuuugacaaccuuaugggaagggucuccggguaaguuuuggaauacgaccauugcagugaguauggcgaacauuuuuagaggaaguuaucucgcgggagcgggucuagcauuuucauugaugaaaagucuggguggagggagacgugggaccggagcacaaggugaaacacuuggggagaaauggaaacgucaacuuaaucaauuaucgaaaagcgaauuuaacacauacaagaggagugguauaauggaaguugacagaucagaggcuaaagaaggguuaaaaagaggugagacaacgaagcacgcgguaucuagaggaacagcgaaauuaagaugguuuguagaacgaaacuuagugaagccagaaggaaaagucauagaccuaggaugugggagagggggcuggagcuacuacugugccggacuuaagaaaguuacagaagucaaaggauacacgaaaggcgguccuggacaugaagaacccauaccuauggcaacguacggauggaaccugguaaaacugcauagcggcaaggacguauuuuucaugccaccggaaaaaugugauacucuucuaugcgacauaggugaaucuucuccuaauccgacuaucgaagaggggcgcacucuucggguucugaaaaugguugaaccguggcuaaggggcaaucaguuuuguauaaagauacuaaauccauacaugccaucaguaguagaaacucuggagcagaugcagaggaaacaugguggaauguuagucagaaacccucuuagucgaaauuccacacacgagauguacuggguaucauguggaacgggcaauauuguaagugcuguaaacaugaccucccguauguuauuaaauagguuuaccauggcacaucguaagcccacguaugaaagagacguugauuuaggagcagggacaagacacguggcaguugagcccgaagucgcaaacuuggacauuaucggccagcguauugagaauaucaagaacgagcacaaaucgacauggcauuaugacgaggauaauccuuauaaaacaugggcuuaccacggaucuuacgaaguuaaaccgucagguucagcuucaaguauggugaauggaguuguacgacuuuuaacuaaaccaugggaugucaucccaaugguuacccaaauagcaaugacagauacuacuccauucggacaacaaagaguauucaaagaaaaaguugacaccaggacuccacgggccaaacggggcacgacacagauuauggaaguaacagcuaaguggcuuuggggcuuccuaaguaggaauaagaaacccagaaucugcacaagagaagaauuuacaaggaaaguaagaucgaacgcugcuauuggagcggucuuuguagaugaaaaucaauggaacucggcuaaggaagcgguagaagaugaaagauuuugggaccuuguucauagagaacgagaacuccauaaacaagguaaaugugcaacauguguauauaauaugaugggaaagagggaaaagaaacuaggugaauuugggaaggccaaaggguccagagcuauuugguacauguggcucggagcacgcuuucuagaguucgaggcccucgguuuuaugaacgaggaucauugguuuucacgagagaacagcuugagcggaguggaaggagaaggauuacauaaguuaggauauauucuccgagauauuagcaagaucccaggagggaauauguacgcugaugacacggcgggaugggauacgagaauaacggaggacgaucuacagaacgaagcuaaaauaaccgauauaauggaaccagaacacgcacuauuggcgacaucaaucuuuaaauuaacguaucagaacaagguaguaaggguucaaagaccggccaaaaauggaacaguuauggauguaaucaguagaagagaucaacgagguaguggccaagucgggacauauggguuaaauaccuucacuaauauggagguacagcucauccggcaaauggagucggaaggaaucuuccucccaucugaguuggaaacuccaaaucucgcagaacgagcucuagacuggcuagagaaacacggagcugaaaggcuuaaacgaauggcuauaaguggagacgacuguguagucaaaccgauagacgauagauucgcaacagcacugacagcacuaaaugauauggguaaaguuagaaaagauauaccucaaugggagccaucaaaaggguggaacgacuggcaacaaguccccuucuguucacaucauuuccaucaauuaaucaugaaagacggacgcgaaauagucguaccgugccguaaucaggaugaguuaguaggucgagcgcgagugucccaaggcgcaggaugguccuuacgugaaaccgcaugccugggcaaaucauacgcacaaauguggcaacuuauguauuuccaucgacgagacuuacgccuagcagcaaacgcgaucuguuccgcggugccuguagauuggguaccugcaucucgaacuacuuggucuauucaugcacaccaucaguggaugaccacggaagauauguuaucaguuuggaauagaguauggauagaagaaaauccuuggauggaagauaagacgcacguuaguucaugggaagagguaccguaucuuggaaaaagggaagaucaauggugugggagcuugauaggacuaacagccagagccacuugggccacuaauauacaaguggcaaucaaccaaguaagacgauugauaggaaaugaaaacuacuuagauuacaugacgagcaugaaaagauucaaaaaugaaucagacccugaaggcgcccuaugguga

SEQ ID NO: 22034 - RNA, 9879 nt, Artificial Sequence
  derived and/or modified CDS sequence (opt6) from DENV-1__KC692501__SS-prME
agugugacgauguuauuaauguuacuaccgacagcucucgccuuucauuuaacuacuagaggaggggaaccucauaugauaguuucuaaacaagaacgagggaaaucuuuacuguuuaaaacuucagccgguguaaauauguguacccuuauugcuauggauuugggggaacuuugugaagacacuaugacuuacaaaugcccuagaaucacagaagcagaaccugacgacguagacuguugguguaaugcaaccgacacuuggguaacauacgguacuugcagucaaaccggagaacaucgucgcgagaaaagaagcguagcacuggcaccccacguaggacucgggcuugaaacccgcacugaaacuuggaugucgucagaaggagccuggaaacaaauucaacgaguagaaacgugggcauugagacauccuggauuuacaguuauugcguucuuuuuagcacacgcuauaggcacuuccaucacucaaaaagguauaauuuuuauauuacuuaugcuugucacaccaucaauggcaaugaggugcguaggaauagguaauagggacuucguagaaggacuuagcggagcgacaugggucgacgucguauuggaacaugguagcuguguaacaacuauggcgaaaaauaaaccaacauuagauauagaacuuuuaaaaacagaaguuacaaauccagcaguucugagaaaacugugcaucgaagcaaagauaaguaacacuacaacagacuccagguguccaacacaaggagaagcaacguuaguugaagaacaagacgcaaauuuugucugcagacgaacauuuguugaccguggaugggguaacggcuguggcuuauuugguaaagggagccuucuuacaugugcaaaauucaaguguguuacuaaauuggaagguaaaauaguucaguaugaaaaccucaaauauaguguaauaguaacagugcauacaggagaccaacaucaaguggguaaugaaacgacagaacacggcacaauagcgacgauaacaccacaagccccuacaucagaaauacaacugacagacuauggagcauuaaccuuagauuguagcccucguacuggacuagauuuuaaugaaaugguccucuuaacaaugaaagaaaaguccuggcuaguucauaagcaaugguuuuuggaucucccccucccauggacaucgggcgcaucaacaucacaagaaacauggaaucggcaagaucuacucguaacuuuuaaaaccgcacaugccaagaaacaagaaguaguaguacuuggaucucaggagggcgcaaugcauacugcccuaaccggggccacagaaauacagacguccggaaccacuacgaucuucgccggacaccuaaagugcagauugaaaauggauaaacuuaccuugaaaggcaugucuuaugucaugugcacaggauccuuuaaacuugaaaaagaagucgcggagacacagcauggaacaguuuuaguccaaguuaaguaugaaggaacagaugcaccgugcaaaauaccuuucuccacucaagaugaaaagggagugacccaaaauggaaggcuaaucacugcaaacccuauuguaacugauaaagagaaaccaguaaacauagagacugaaccucccuuuggagaaucauauauuguaguaggagcaggcgaaaaggcacuaaaauuaucaugguuuaaaagagggagcucaauaggaaaaauguuugaagcuacugcuagaggggcacgccguauggccauauuaggggacacagcaugggacuucgggucuauugguggagucuuuacaagcgugggaaaacugguacaucaaguauuuggcaccgcuuauggagugcuauucucaggagugucuuggacaaugaaaauaggaauuggaauuuuacuaacauggcuuggcuuaaauagucggaguacgagucugaguaugacuugcauugcaguaggaaugguaacauuauaucugggugucaugguucaagccgauagcggauguguuauaaacuggaaaggaagagaacuaaagugugguucagguauauuuguaacaaacgagguucauacuuggacagaacaguauaaauuucaggcugacucaccaaagcgacugucugcagccauuggcaaagcaugggaggaggguguaugugguauuagaucagcaacaagacuagaaaauauuauguggaaacaaaucucuaacgaauuaaaccacaucuuauuggaaaaugauaugaaauuuacugucgucguaggcgacgcaaaugguauuuuagcccaggguaaaaagaugauuagaccacaaccaauggagcauaaguacagcuggaaaagcuggggcaaagccaaaauaauaggggcugacauucaaaauacuaccuuuaucauagaugguccagauacacccgaauguccugacgggcaaagagcauggaacauaugggaaguagaagacuacggauucggaguauuuacuacgaacauauggcuuaaacuacgugacucguauacacagaugugugaucacaggcuaaugagcgcagcuauuaaagacaguaaagcaguucaugcugauaugggauauuggauugaaagugaaaagaacgaaacuuggaaacuagcuagagcaucauucauagaagucaagacuuguacguggccuaaaucacacacgcuuuggucaaacgguguccuagagucagaaaugaucauucccaagauauucgguggacccauuucacaacauaacuauaggccaggauauuucacgcaaacggcagggcccuggcaucuuggcaaacuugaacuugacuucgacuugugcgaagggacaacuguagucguagaugagcauugcgggaauagaggccccagcuugagaacuacuacaguuacuggaaaaauuauacaugaaugguguugucguagcugcacauugccaccgcugcgguuuaggggcgaagauggauguugguaugguauggaaauacgcccuguaaaagaaaaggaggagaaucuuguacgcucgauggugagcgcagguagcggagaaguagacagcuucucauugggcauucucuguguaagcauaaugauagaagagguaaugcgaaguagguggaguaggaagauguuaaugaccgguacguuagcaguauucuuacuguuaaucaugggacaacuuacauggaacgaccugauacgacuuuguauaauggucggcgcuaaugcaucugacagaaugggaaugggaacgacguauuuagcauuaauggcuaccuuuaaaaugcgcccaauguuugcgguuggauuacuauuccggagacuuacaucucgugaaguacucuuacuuacgaucggauuaucacucgucgcgagcguugaacuaccuaauucuuuagaagaacugggugauggauuggcaaugggcauuaugaugcucaaacuacugacugaauuucaaccucaccaacuuuggacgacucuauuaucucucacuuucguaaagacuacuuuaaguuuagauuaugccuggaagacuacggcaaugguucucucgauugugaguuuauucccgcugugcuuaagcacuacaucucagaaaacaacaugguuacccguuuuacuaggcaguuuuggauguaaaccauugaccauguuucuuaucacggaaaauaaaauaugggggaggaaguccuggccguugaacgaaggaauuauggcgauuggaaucguuucaauacuguuaucaucccuuuugaaaaacgauguaccacuagcagguccucuaauagcuggaggaaugcuaauagcgugcuauguaauaagugggucaucagccgauuuaagccuugagaaagccgcagaagugucaugggaacaagaagcugaacauaguggugcaucacacaauauauuaguagaaguacaagaugacggaacaaugaagauuaaagaugaagaaagagacgacacauuaacaauauuacuaaaggcaacucuacuagccgucagcggaguauaccccaugagcauacccgccacucuauuugugugguacuuuuggcagaaaaagaaacaaagaagugguguccugugggauacaccaucaccaccagaaguggaaagggcuguuuuagaugauggaauauauagaauccuacaaagagguuuguuaggcagaagucaagucggcguugguguguuucaagauggcguauuccauacgauguggcauguaacgaggggagcugugcucauguaucaagguaaacgccucgagccgucuugggcaagugugaagaaagaucugaucucuuauggugguggguggagguuucaagguucauggaauaccggcgaagaaguucaaguuauagcagucgaaccggggaaaaauccuaaaaaugugcagaccacgccaggaacuuuuaaaacuccagaaggugagguaggagcuauagcucuugauuucaaaccagguacuuccgguaguccaaucguaaaccgugaagaaaagauagucggacuuuacggaaacgggguuguaacaacuucugguaccuauguuagcgcuauugcacaagcuaaagcaagccaagaaggaccccuaccugaaauugaagacgaaguuuuuaagaagagaaaucucacaauuauggaccuccauccugggucaggaaaaacaaggcguuauuuacccgcaaucguacgcgaagcuauaaaacgcaaauuaagaacacugauacucgcgccaacgcguguaguagcuagugaaauggcagaggcguuaaagggaaugccgauucgcuaccaaacgacugcaguuaagucggaacauacuggaagagagauaguagaucucaugugccacgcaaccuuuacuaugaggcugcuaaguccaguaagaguuccuaauuauaauaugaucauuauggaugaagcucacuucacagauccagcgaguauugcagcuagaggauauauaucaacaagaguagggaugggugaagccgcagccauauuuaugacagccacaccaccuggaucaguggaggcuuuuccgcagucaaacgcaguuauacaagaugaggaacgugauaucccagaaagaaguuggaauaguggguaugacuggaucacagacuuuccgggaaagacuguuugguuugucccguccauaaagaguggcaacgauauagcaaacugucugaggaaaaaugguaaaaggguaauacaauugagucgaaagacauuugacacagaguaccagaaaacuaaaaauaacgacugggacuauguaguaaccacugauaucucggaaaugggcgcuaauuucagagcagacagaguuauugauccaagaaggugccucaagccaguaaucuuaaaggauggaccagaacgagucauauuggcagguccaaugccuguuacuguagccucggcagcacaacgaaggggcaggauaggcagaaaccaaaauaaagaaggagaucaauauguuuauaugggucagccauuaaacaacgaugaagaccacgcccacuggacagaagccaagaugcuuuuagacaauauaaauacaccagagggaauaauaccagcauuguucgagcccgagagggaaaagagugcggccauagacggagaauauagauuaagaggggaagcaagaaaaacguuuguugagcuaaugcgaagaggagaucuaccaguuuggcuuucuuacaagguugcuucggagggauuccaauauucagacaggagaugguguuuugauggugaacgcaacaaucaaguacucgaagaaaacauggauguagaaauauggacgaaggaaggagaaaggaagaaauuaagaccgagauggcuagaugcuaggacguauagugauccacuugcacuacgugaguucaaagaguucgcagcuggacgucguagugucucgggagacuugauucucgaaauagguaagcuaccgcaacaucuaacauuacgugcucagaaugcguuggauaauuugguaaugcuacacaacucugaacaggguggaaaagcguacagacacgcaauggaagaauuacccgauacaaucgaaaccuugaugcuauuagcucuaaucgcaguacuaacaggaggagucacacuauucuuccugagcgggaaaggauuagguaaaacaucaaucggauuacuauguguuacagcaucuagugcgcuucuauggauggcaucagucgaaccacauuggauugcugcauccauuauuuuggaguucuuccuuaugguccugcuuauuccugaaccagacagacaaaggacaccucaagauaaccaacuugcauaugucguuaucgggcuuuuauuuaugauacugacaguugcagcuaaugaaaugggguuacucgagacgaccaagaaagaucuaggaauaggcuauguugcugcagagaaucaccaacacgcaaccauguuggacgucgaccuucauccagcaagugcuuggacuuuauaugcaguagcaaccacagucauuacaccaaugaugagacauacaauagaaaacacuacagcaaacaucucacucacugcuauagccaaucaagcagcaauuuuaaugggguuagauaaggguuggccuauaucgaaaauggauauuggaguaccccucuuagcauuaggauguuauucacaagugaacccucuaacccuaacagcagcuguccugaugcugguagcucacuaugcaaucauaggcccaggauugcaggcaaaagcaacacgggaagcacaaaagcgaacggcggccggaauuaugaaaaacccaaccgucgacggaauuguugcaaucgacuuagauccgguaguauacgaugcaaaauuugaaaaacaacuagggcaaauuaugcuacuaauuuuaugcacuucacaaauucuccuuaugagaacaacuugggcucucugcgaaaguauuacauuagcgaccgguccgcugacuacguugugggaggguucaccaggaaaauuuuggaauacuacgauagcaguuagcauggcuaauauauuuagagguaguuaccuugcaggcgcuggauuggccuuuucauuaaugaaaagccuugguggagggcgacgaggaacaggggcacagggagaaacccugggagagaaauggaaaagacaguuaaaucaacucaguaagagugaauuuaauacuuacaagaggaguggaaucauggagguggacaggucugaagcaaaagaaggccuaaaaagaggagagacaacaaaacaugcgguuucgcgaggaacugcuaaguuaaggugguuuguagaaagaaaucugguaaaaccggaagguaaagucauugaucuaggauguggacgggguggauggucuuacuacugcgcuggauuaaagaaaguaacugaggugaagggauacacaaagggaggaccgggacaugaagaaccaaucccgauggcaacuuauggguggaaccuaguuaagcugcacuccggcaaagauguauucuuuaugccgccugaaaagugcgauacgcuucuaugugacauaggagaaucaucuccaaauccuacuauugaagagggacgaacauugcggguucuaaagauggucgaacccugguugaggggaaaccaauuuuguauaaaaauauuaaauccguauaugcccaguguuguugaaacucucgaacagaugcaacgcaaacaugggggcaugcuagucagaaaucccuuaucuagaaauucaacucacgagauguauugggucaguuguggcacaggaaauauaguuagugcugugaauaugacgucgaggaugcuacucaaucguuuuaccauggcacaucguaaaccaacauaugaacgggauguggauuuaggcgcugguacccggcacguggcaguugaaccugaaguggccaauuuggauauuaucggacaaagaauagagaauaucaaaaacgagcacaaauccaccuggcauuacgaugaggacaauccauauaagacaugggcuuaucauggaucguacgagguuaaaccaucaggcuccgcauccucgaugguaaauggaguaguuagacucuugacgaagcccugggauguaauuccaaugguuacacagauugcgaugacggacacaaccccguucggacaacagagaguguucaaagaaaagguagacacucgaacacccagagcuaagaggggaacaacacaaauuauggaagucacggccaaaugguugugggguuuccugagccggaacaagaaaccucguauauguacacgagaagaauuuacaagaaagguccgcucuaacgcagcuauaggagcuguguucgucgaugagaaccaauggaacuccgcuaaagaggcaguagaagaugaaagauuuugggaucuaguucauagagaaagagaacugcacaagcaggguaaaugugcaaccugcgucuacaauaugauggggaagagagagaagaaauugggggaguucggaaaggcgaagggcucucgggccauaugguacaugugguuaggagcaagguuucuagaguucgaggcucuaggcuucaugaacgaggaucacugguucagcagagagaauagucuaaguggaguagagggagaggggcugcacaaacuugguuauauacuucgcgacauaaguaaaauuccuggaggcaauauguaugcugaugacacugccgguugggacaccagaauaacagaagacgaccuucaaaacgaagcgaaaauaacggacauaauggaaccugaacacgccuugcuagcaacaucuauauucaaacuaacauaccaaaauaagguaguaagagugcaacgaccggcgaaaaaugguacagugauggacgucauuucgaggagagaucaaagaggaucaggacaaguaggaacguaugguuuaaauacauuuacaaauauggaaguccaacuaaucaggcaaauggaaucugaaggaauauuuuuacccagcgaauuggaaaccccgaacuuggcagagagggcauuggauuggcuugaaaaacauggcgccgaaagauuaaaaagaauggcuauuucaggagaugauuguguaguaaaaccaauagacgaccgauucgcaacugcgcuuacagcuuuaaaugauauggguaagguacgcaaggauauuccacaaugggaaccauccaaaggauggaaugacuggcaacagguacccuucuguucacaccauuuucaccagcuaauaaugaaagacgggagagagaucguuguaccaugcaggaaccaagacgaacuuguaggucgagcgcggguuagucaaggggcaggauggucacuuagagaaaccgcuugcuugggaaaaucauacgcacagauguggcaacugauguauuuucauaggagggaucuacgauuagccgcaaacgcaauuuguagugcagucccaguugauuggguuccagcaucgagaacgacuuggaguauucaugcacaucaccaguggaugacaacagaagauauguugucgguauggaaccgaguauggauugaagagaaucccuggauggaagauaaaacacauguuucaaguugggaagaaguaccauaccucggcaaaagagaagaucaauggugcgggucgcuaauaggauuaacggcaagagccaccugggccacuaacauacaaguagcaauuaaucagguucgacggcucauuggaaaugaaaacuacuuagacuacaugacuucaaugaaacguuuuaaaaaugaaagcgauccugaaggugcauugugguaa

SEQ ID NO: 22035 - RNA, 9879 nt, Artificial Sequence
  derived and/or modified CDS sequence (opt6) from DENV-1__KC692502__SS-prME
aguguaacaauguugcuaauguuacuaccaacggcacuagcuuuucaccugacaacaagagggggugaaccucacaugauuguuaguaaacaagaaaggggaaaaagccuacuuuuuaaaaccucugcggggguuaauauguguacauuaauagcaauggauuuaggggaauuaugugaagacacaaugacguauaaaugcccgcggaucacggaagccgaaccagacgaugucgauuguuggugcaaugcgacggacacuuggguaacauauggaacauguucccaaacaggugaacauaggcgcgagaaaagaucugucgcauuagcaccucauguggggcuaggauuagaaacucguaccgagacauggaugaguucagagggugcauggaaacaaauucaacgagucgaaacaugggcauuaagacauccaggcuuuacgguaauagcauuuuuccuagcacaugcuauuggaacaagcauuacucaaaaaggaauuauauuuauacuguugaugcuuguaacgccgagcauggccaugagaugcguuggcauugguaauagagacuuugucgaaggucuaaguggagcuaccuggguugacgugguuuuagagcaugguuccugcguaacaacaauggcuaaaaauaaacccacacuugauauagaacuacugaaaacagaggugacaaauccagcaguauugagaaaacuauguauagaggcgaaaauaucaaacacaacaacugauucgcgaugucccacccaaggugaagcaacguuaguagaggaacaagaugcuaacuuugucugccggaggacuuucguagacagaggauggggcaacggcugcggccuuuucggaaaagguucuuuauuaacuugugccaaauuuaagugcguuaccaagcuagaaggaaaaauuguacaauacgaaaaucuaaaauacucuguaauugucacaguccauacaggugaccaacaucaaguugggaacgagacaacagaacauggaacaaucgcgacaauaacaccacaagcuccaacaucggagauacagcucacagauuauggugcccucacauuggacuguagcccacggacggggcuagauuucaacgagaugguauuacuuaccaugaaagagaaaagcugguuaguacauaaacagugguuucuagaucuaccacuaccauggacuucgggugcaagcacgagccaagaaacauggaacagacaagaccuccugguaacauucaaaacugcgcaugcuaagaaacaggaagugguaguacucgggucgcaagagggagcgaugcacaccgcgcuuacaggugcuacggaaauacagacgagugggacaacaaccauauuugcuggccauuuaaaaugccgacuaaaaauggacaaacugacgcuaaaagguguaaguuacguuauguguacugggagcuucaaacuagaaaaagaaguugccgaaacucaacauggcacaguccuaguucaggucaaauacgaagguaccgacgccccuuguaaaauccccuucucaacacaggaugaaaaaggaguuacgcaaaacggaaggcuaaucacagcaaacccaauaguaacagacaaggaaaagcccgucaauauugaaacagaaccuccauuuggagaaagcuauaucguaguaggcgccggagagaaggcucuuaaauugucaugguucaaaagaggguccaguauuggaaaaauguuugaagcaaccgcaagaggagcaagaagaauggcaauccuuggugauacugcaugggacuuugggucaaucggagguguuuuuacaaguguuggaaagcuaguucaucagguuuuuggaacugcuuacggaguacuauuuaguggaguaaguuggacaaugaaaauuggaauugguauacuucuaaccuggcuaggacuaaauucucgauccaccucacuuucgaugaccuguauagcugucgguaugguaacguuauauuuaggggucaugguucaagcagauagugguugcguuaucaauuggaaggguagagagcugaagugcgggagcgggaucuuugugacgaaugaaguucacacauggacagagcaauauaaguuccaggcugauaguccaaagagacuaagcgccgcuaucggaaaagcgugggaggaggguguauguggaauuagaucagcuacaaggcuagaaaauaucauguggaagcaaauaagcaaugaacucaaucauauacuacuggaaaaugauaugaaguucacaguagugguuggcgaugcaaacgguauuuuagcccaagguaagaaaaugaucaggccccaaccuauggagcauaaauauaguuggaagucaugggggaaagcuaagaucauuggggccgacauccaaaacaccacauuuauaauugauggaccagauacuccugaauguccagaugggcaaagggcauggaacauuugggaaguagaggauuaugguuucgggguguuuaccacuaacauauggcucaaauuaagagauagcuacacucaaaugugcgaccaucgacugaugucggcggccaucaaggacuccaaggcggugcacgcagacaugggcuauuggaucgaaucagagaaaaaugaaacauggaagcucgcccgcgcaucauucauugaggugaaaacaugcacuuggccuaagucucauacauuauggagcaauggcguauuagagagcgaaaugauaauuccgaaaaucuucggagggccaauuucccaacacaacuaccgcccuggauacuuuacccaaacugcgggaccuuggcauuuagguaaauuggaauuagacuuugauuuaugugaaggaacgaccgugguaguagacgaacauuguggaaauagagguccaaguuuaagaacgacaacaguaacaggcaaaauuauccacgaaugguguuguagaucgugcacauuacccccacuacgguuccgaggugaagacggaugcugguacggaauggaaauaagaccaguaaaggaaaaggaagagaauuugguucguucgauggugagugcaggcucuggagaaguagauucuuucucauuaggaauuuuguguguauccauaaugauagaggaagucaugagaucaagauggagcaggaaaaugcuaaugaccggaacacuggcaguauuuuugcuguuaauuaugggacaauuaacauggaacgauuuaaucagauuaugcaucauggucggagccaacgcaagcgaucgcaugggaaugggaacuacguaucuugcgcucauggcuacauucaagaugagacccauguuugcgguuggacuauuauuccguagguuaacuucaagagaaguacuucuauugacaauaggacuaagucuaguugccaguguagaacuaccuaauucacuagaagaauuaggagauggacuggcgauggguauuaugauguuaaaacuauugaccgaauuucaaccucaccaauuauggacaacucuacuaucauuaaccuuuguucgaaccacacuaucauuagauuaugcauggaaaacaacugcaaugguacuguccauugucaguuuauuuccacuuuguuuauccaccacgagccagaaaacaacuuggcuccccguacugcugggaaguuuuggaugcaagccccuaacuauguuuuuaauuacagaaaacaagaucuggggacguaagagcuggccgcuaaaugaagguauaauggcaauugggauaguaaguauuuuacuaagcucauugcuuaaaaaugacguaccucucgcagguccuuuaauugccggggguaugcucauagcuugcuacguuauauccgguagcucagcagauuugucuuuagagaaagcugcugaagucagcugggaacaagaagcagaacauucuggcgccucucacaacauucuuguagaaguccaggaugaugguacaaugaaaauaaaggaugaagagagggacgacacccuaacgauacuucuaaaggccaccuugcuagcgguaucuggaguauauccuaugaguauuccugcaacacucuucguaugguacuucuggcagaaaaagaaacaaagaagugguguucuuugggauaccccaucuccuccagaaauggaacgugccgucuuggaugauggcauuuaucgaauacuacaacguggccuauugggaagaagucaggucggcguaggaguuuuccaggacggcguuuuccauaccauguggcauguuacuaggggagcuguuuugauguaucaagggaaaagguuagagccuaguugggcaagugucaagaaagaucucauaaguuacggcggugguuggcgguuccaaggaucguggaauacaggagaagaaguacagguaauagcuguagaacccgguaaaaaucccaagaauguccagacuacuccuggaacuuuuaagacaccugagggagaaguuggagcuauugcacuggauuucaaaccaggaacgaguggcucaccuaucgugaacagggaaggcaagauugugggguuguacggcaacgguguugugacuaccucuggaacguacgucucagcuauugcacaagcaaaagcaucgcaggaaggaccacuuccugagauugaggaugaaguauucaagaaaaggaacuuaacaauuauggacuugcacccuggaucugggaaaacccgaagauauuuaccugccauagucagagaagccauaaaaagaaaauuacguacauuaauccuagcgcccacaagggugguagcgagugaaauggcagaagcacucaaaggaaugcccauaagguaucaaacgacagcuguaaaaagcgaacauaccgggagagaaauuguagauuuaaugugccaugcaacauuuacaaugagacucuugucuccuguccguguuccaaauuauaauaugauuaucauggaugaagcccacuuuacggauccagcuucaauugcugcccgagguuacauaucuacccgaguggggaugggggaagcggccgcaauuuucaugacagcaacgccaccagguucaguugaagcauucccucaaucuaacgccguaauacaagacgaggaacgagauauucccgagaggagcuggaacucagguuacgacuggauaacggacuuuccuggaaaaacaguuugguuuguaccaagcauaaaaagcggcaacgauauagcaaauugucuuaggaaaaauggaaaacggguaauacaguuaucucgaaagacauucgacaccgaguaccagaagaccaaaaauaaugacugggauuauguuguuacuacagacaucucugaaaugggcgcuaacuuucgagcagauagaguaauagauccgcgucgaugucucaaaccgguuauauuaaaagauggaccugaaagaguaauuuuagcaggcccaaugccaguaacagucgcaagcgcggcacaacggaggggaaggauagguaggaaucaaaauaaagagggugaucaguauguuuauaugggacagccuuuaaauaacgacgaggaccacgcacauuggacggaagcgaaaaugcuacuagauaacaucaacacccccgaagguauuauaccagcucucuuugaaccggaaagagagaaaagugcagcuauagacggggaguaccgucuacggggugaagcuagaaagacguuuguagaauuaaugcguagaggagacuugcccguauggcugaguuacaaaguggccucggaagguuuucaguacagcgauaggaggugguguuucgacggcgaaagaaauaaccagguacuagaagaaaauauggauguagaaauuuggacaaaagaaggugaaaggaagaagcugaggccaagauggcuagaugccagaacauacagcgauccauuagcuuugcgugaguuuaaggaguuugcugcgggaaggagauccgucuccggggauuuaauucuagaaauaggaaaacuaccucaacaucuuacguugcgugcacagaaugcucuagauaaucuaguaauguuacauaacagugaacaaggaggaaaggcuuacagacaugcgauggaagaguuaccugacacuauagaaacacugauguuauuagcacugauagcagugcuaacaggugguguuacguuauucuuucuaaguggcaagggguuagggaaaacuagcaucggauuacuauguguaaccgcuucgucugcacugcuauggauggcuucgguagaaccacauuggauagcagcgucgauuauacucgaguucuuucugaugguacugcuuauaccagaaccggaucgucagagaaccccgcaagacaaccagcuggcauacgucguuaucggacuacuauuuaugauacuaaccgucgcagcaaaugaaaugggucuucuagaaacaaccaagaaggaccugggaauaggauaugucgcagcagaaaaccaucaacaugccacuauguuagacguggacuugcauccagcaucugcguggacacucuacgcaguagccacaacaguuaucaccccgaugaugagacacacgauugagaauaccacugcaaacauuucuuuaacagccauugcaaaucaagcagcuauuuugaugggacuugacaaaggguggccgauuucuaaaauggauauaggaguuccgcucuuagcacuugguugcuacucucaaguaaauccgcuuacacucacugcugcaguuuuaauguuaguugcacauuaugcaauuauagguccagggcugcaagcaaaagccacuagagaagcacagaaaagaacagcugccggaauuaugaaaaaccccaccguagauggcaucguugcgauagacuuagauccaguuguauacgacgcuaaauucgaaaagcaacucggacaaauaaugcuccuuaucuuaugcacaucgcaaauacugcuuaugcgaaccacaugggcacuaugugaaucuauaacgcucgcuacagguccccuaacaacguugugggaagguagucccggcaaguuuuggaauacuacaauagcaguuucaauggcuaauauuuuuagaggcagcuaucuagcaggcgcgggacucgcuuuuagcuuaaugaaaucauuaggcggaggaaggaggggaacaggagcccaaggagaaacguuaggcgagaaauggaaaagacaacugaaccaauugucuaaaagugaauuuaacacauauaagagaagcggcauaauggagguagaccgaagugaagcuaaagaaggauuaaaaagaggugagacaacgaaacaugcaguuagccgcgguacggcgaagcugcgaugguuuguugaaagaaacuuggucaaaccugaaggaaagguaaucgauuuagguuguggacguggaggauggagcuacuacugcgcaggauuaaagaaaguaacugaaguaaaaggcuacacuaaaggaggaccgggccacgaagaacccauuccuauggcaaccuaugguuggaaucuggucaagcugcauaguggaaaggauguauucuucaugccuccagaaaagugugauacccuccugugcgauauuggugaaaguagucccaacccaaccaucgaggaagggagaacuuuaagaguucucaaaaugguggagccauggcugagggguaaucaauuuuguauaaagauucuaaacccauauaugcccucaguaguugaaacauuagaacagaugcaacggaaacacgggggaauguuggucagaaaccccuuaucuagaaauaguacacacgaaauguauuggguaucgugcgggacugguaacauaguauccgcaguaaauaugacgaguagaaugcuuuuaaaucgauucaccauggcccaucguaaacccacauacgaaagagauguagacuuaggagccggaacacgacauguagcgguagaaccggagguugcaaaccuugacauaauuggucaaagaauagaaaauauuaaaaaugaacauaagucuaccuggcacuacgaugaagacaauccauauaaaaccugggcuuaucacgggaguuacgagguuaaaccauccggaucagcaagcucaaugguuaauggaguuguuagacuauuaacgaaaccaugggaugucauaccaaugguaacgcaaauugcaaugacagauacgaccccguucgggcaacagagagucuucaaagaaaaaguugauacucguacgccaagagcaaaaagagggacuacacagaucauggaagugacagcuaaauggcuuuggggcuuucuuucaagaaacaagaaaccacguaucuguacucgugaggaguucacaagaaaagugcguucaaaugcggcaauaggggcaguauuuguugaugaaaaucaauggaacuccgcaaaagaagcgguugaagaugagagguuuugggaucuaguucaucgagaaagagaacuacauaaacaggguaagugugccacaugcguuuauaauaugauggggaaaagagagaagaaauuaggcgaauuugguaaagccaaaggaagcagggcaauuugguauaugugguugggagcacgauucuuagaauuugaggcacucggguucaugaaugaggaucauugguucagucgagaaaauucuuuaagugggguagaaggagagggcuuacauaaacucggcuauauccuucgcgauauaaguaagauuccaggaggaaacauguaugcagaugauaccgcagguugggauacccguauaacggaagacgauuugcagaaugaagccaaaauuacggauaucauggaaccagaacaugcauuacuagccaugucuauauucaaauugacuuaucagaauaaggucgucagggugcagagacccgccaaaaauggaaccguaauggacguaauaucgaggcgggaccaacgagguuccggucaaguaggaacauacggauuaaacaccuuuacuaacauggaaguucaacucauaaggcaaauggaaucagaaggaauauucuuaccaagcgaauuagaaacaccuaacuuagcagaaagggcgcuagacugguuagaaaagcacggugcggaacgccugaaacgaauggccaucaguggcgaugacugcguaguaaaaccaaucgaugaccguuucgcaaccgcauuaaccgcgcuaaaugauaugggaaaaguaagaaaggauauuccacaaugggaaccauccaaggguuggaaugauuggcagcaaguaccauuuuguucccaccacuuccaucaacuuauuaugaaagaugguagagagauaguugucccuuguagaaaucaagaugaacuuguaggcagggcaagaguuucucaaggagcaggauggagucuaagagagacagccuguuuagguaaaucauaugcccaaauguggcaauugauguauuuccaucgucgugaucugcguuuggcugcaaaugcgauaugcucugcagucccaguagacuggguuccagcauccagaaccacauggaguauacaugcacaucaucaauggaugacaacagaggauaugcuuucaguauggaacaggguguggauugaggaaaacccuuggauggaagauaagacacaugucaguucaugggaagaaguucccuaucuaggaaaaagggaagaucaaugguguggaucgcuuaucgguuugaccgcgagagcaacaugggcaacgaacauccaagucgcaauaucacaaguaaggagauugauaggaaaugagaauuaccuugacuauaugacaagcaugaagcguuucaaaaacgaaucugauccugagggcgcacucugguag

SEQ ID NO: 22036 - RNA, 9879 nt, Artificial Sequence
  derived and/or modified CDS sequence (opt6) from DENV-1__KC692503__SS-prME
agugucacuaugcuacugauguuguuaccuacagcauuagccuuccaccuuacuacgcgaggaggugaaccucacaugauagucucuaaacaagaaagaggaaaaucuuuacuauuuaaaacgucagcagggguaaacaugugcacacuaauagccauggacuuaggagaauugugugaagauacuaugacauauaaaugcccacggauaacugaagcggaaccagacgauguagauugcugguguaaugcuacagacacguggguaaccuauggaacuuguagucaaacaggagaacaucgcagagagaaaagaaguguugcgcuugcaccacauguaggauuaggcuuagaaacuagaacagaaacguggaugaguucggaaggcgccuggaaacaaauucaaagaguagaaacaugggcuuuaaggcauccuggauuuacaguaauugcauucuuuuuggcacaugccaucggaacgagcauuacacaaaaaggcauaaucuuuauacuuuuaaugcucgucaccccuagcauggcuaugagaugugugggcauagguaauagagacuuuguugaagggcuuucaggagcaaccuggguagauguaguacuagaacaugguaguuguguaaccacuauggccaaaaacaaacccacacuugacauagaacuucuaaaaacagaaguaacuaauccagcgguauuaaggaaacuuuguauagaagcuaaaauauccaacacgacaaccgacaguagaugcccaacucagggcgaagcaacuuuaguagaagaacaagacgcuaauuucguuugucguaggaccuucguugauagagggugggguaacggauguggacuuuuugggaaaggaucguuacucacaugugcuaaguucaaaugcgugacaaaauuagagggcaaaauaguccaauaugaaaaucuaaaguacagugugauuguuacuguucacacaggggaucaacaccaaguaggcaaugaaacgacugaacaugggacgauagcaaccauuacgccccaggcuccaacuucugaaauucaacuuacugauuauggagcuuuaacccuagauugcaguccucgaaccgggcuagauuuuaaugagaugguauuacucacuaugaaagaaaaauccugguuaguacauaaacaaugguuccuggaccuaccccucccuuggacaucuggugcaucuacaucacaagaaaccuggaauaggcaagaucuauuaguuacguucaaaacagcucaugcgaagaaacaagaaguagucguacuaggaagucaggaaggcgcaaugcacacagcgcuaacgggagcuacugaaauacaaacuagcgguacgacaacuauauucgccgggcaucugaaauguaggcugaagauggauagauuaacuuugaaagggaugucauaugucaugugcacaggaucguuuaaauuagaaaaagaagucgcggaaacacagcauggaacuguuuugguccaaguaaaguaugagggcaccgaugccccaugcaaaauucccuuuagcacgcaagaugagaagggaguaacucaaaacggucgauuaaucacagcaaauccaauuguaacagauaaagagaaaccaguaaauauugaaacggaaccaccguucggagaaaguuauauugugguuggugcaggggagaaagcccuuaaguuaagcugguuuaagagaggcaguagcauaggaaaaauguucgaagcaaccgcgcgaggcgcgaggagaauggccauuuuaggagacacagcaugggacuuugggucuauaggcggaguauucacuucuguggggaaguuaguacaucaaguauuugggacagcauacggaguauuguuuucgggaguaagcuggacaaugaaaauuggcauagggauuuuauuaacuuggcucggauuaaacaguaggucaacaaguuugucuaugacaugcaucgcaguuggaauggucacacuuuaucuaggcguaaugguucaagcagauucgggcugcguaaucaauuggaagggcagagaguugaagugugguucuggaaucuuugucacgaacgagguacauacguggaccgagcaauauaaauuucaagcagauagcccgaaacgucuaucagcagccauagguaaagccugggaagaaggcguuuguggaauaagaagugcaacccgacuagaaaauauaauguggaaacaaauuucaaacgaacuuaaucauauccuuuuagaaaacgacaugaaguuuacagucguagugggugacgcaaauggaauauuggcacaaggcaagaaaaugauaaggccacaaccaauggaacacaaauauucuuggaaaaguuggggaaaagcuaaaauuauuggggcagauauacaaaacaccacguucauuauugacggcccagacacaccggaguguccugauggacaaagagcauggaacauaugggagguggaggauuaugguuucggaguguuuacaacuaauauauggcuaaaacuuagagauucauauacucagauaugugaucaucgacugaugucagcagccauuaaagacaguaaagcuguccaugcggauaugggauacuggauagaaagugagaaaaaugaaaccuggaaacuugcccgagcuaguuuuauagaagugaagacuuguacuuggccaaagagccauacuuuauggucaaaugguguauuagaaagcgaaaugauaauaccaaagauauuuggcggucccaucucacaacauaacuauagaccuggauauuucacccaaacagcaggaccauggcaccuagggaagcuagagcucgacuuugauuuaugcgaagggacaacugucgucguggaugaacauugcgggaaucgggguccuucauuacgaacaacaacuguaacuggcaaaauaauacaugagugguguuguaggucaugcacccuaccgccccuaagauuccgcggagaagaugguuguugguacggaauggaaauccguccugucaaagaaaaagaagagaauuuaguaaggaguaugguaucagcagguucaggugaagucgauucuuuuagccuggggauauuguguguaucgauuaugauagaggaggucaugagaagucgguggucuagaaaaaugcuuaugauagguacacuagcuguguuuuuguuauuaaucauggggcaguugacauggaaugauuuaauccgauuaugcauuaugguaggagcaaacgccagugauagaauggggaugggaacgacauaucucgcauuaauggcuacauucaaaaugaggccaauguuugcuguaggacucuuguucaggagacugacaagucgcgaagugcuguugcuaaccauuggccuaucuuuaguggccagcguagaguugccaaauuccuuggaagaguuaggagauggccuagcuaugggaauaaugaugcucaaauuacuaacagaauuucaaccgcaccaguuauggaccacacuguugaguuuaacauuuguaaaaaccacacuaagccucgauuaugcauggaaaaccacugcgauggugcuaagcauuguaagccuuuuuccauugugccugucaacaacaagccaaaagacuaccugguuaccaguccuucuagguucguuuggcuguaaaccguuaacaauguuucucauaaccgaaaacaaaaucugggguaggaaaucauggccguugaacgaaggaauaauggcuauugggauugucucgauauugcucucaucauuacuaaagaacgaugugccacuugcagggccauuaauugcggguggaauguuaaucgcauguuacgucauuucuggcagcagcgcugaccuaagucuugaaaaagcagcagaagugucgugggaacaagaagccgaacauucaggggcaucucacaauauuuuagucgagguacaagaugauggcacaaugaaaaucaaagaugaagaaagagaugauacacuuacuauauuacucaaagcaacucuguuggccguguccggcguauacccaaugaguauaccagccacuuuauuugucugguacuuuuggcagaaaaagaaacagcgaagcggagugcuaugggacacuccuucuccaccggagguugaaagagcggugcuagacgacggaauauacagaauacuucaacguggucuacuaggcagaagccaggucgguguuggaguauuccaagacggggucuuucauaccauguggcacguuacaaggggagcaguccuaauguaccaagggaaaagacuagagccaucgugggcuucugucaagaaagauuugauaaguuacgggggagguuggcguuuccaggguaguuggaauacgggggaagagguacaagucaucgcuguagaaccuggcaaaaauccuaaaaacguccaaacuacaccaggaacauucaaaacaccugaaggcgaggucggugcuauagcgcuagacuuuaaaccaggcacaagugguagcccaauuguaaauagggaagagaaaauaguuggacuauacggaaauggaguagucaccacaucaggaacauaugugucagcgauugcucaagcuaaagcuagucaagaagguccauugccagaaauugaagaugaaguuuucaagaaacgaaauuugacaauuauggauuuacauccugggucaggaaaaacacggagauaccuacccgcgauaguucgcgaagcgauaaagagaaaacuuagaacuuuaauccuugcuccaacaagaguuguagcgagugaaauggccgaagcauuaaaaggcaugccuauucgauaucagacaacagcuguaaaaucagaacauacgggacgagaaauaguagaccuuaugugccaugcuacauucacuaugagauuguugucgccaguucgaguuccuaauuauaauaugauaauuauggaugaggcgcauuucacugaucccgccucuauagcugccagaggauauaucucuacccggguggguaugggagaggcagccgcaaucuucaugacugcuacaccuccagggaguguagaagccuucccacaaagcaacgcggugauucaggaugaagagagagauauaccggaacggaguuggaacagugguuacgacuggauaaccgauuucccaggaaagacaguuugguucgucccuagcaucaaaucggguaacgauauagcaaacuguuuaaggaaaaacgguaaaagaguaauacaauuaucacguaagacguuugacacagaguaccaaaagacgaaaaauaacgauugggacuaugucgucacaaccgauauaucagaaaugggagcgaauuuccgagcggaccgagucaucgacccaagaagauguuuaaaacccguuauacucaaagaugguccugagagagugauacuagcaggaccuaugcccgugacgguagcaucagcugcucaacggagagggcgaauaggcagaaaucaaaauaaagaaggugaucaauacguauacauggggcagccacuuaauaaugaugaggaucacgcucauuggacagaggcuaaaauguuacuugauaacaucaauacaccagaagguauaauaccagcacuuuucgagccagaaagggagaaaagugcagcaaucgacggagaauacagguuaaggggcgaagcucguaaaacguucguagaauuaaugcggagaggggauuugccaguaugguuguccuauaaagucgcaagugaaggauuccaauacagugaccgaagguggugcuuugauggugagcgaaacaaccaaguuuuggaagagaacauggacgucgaaaucuggacuaaggaaggagaacggaagaaauuaaggccaagauggcuagaugcgcgaaccuacuccgacccuuuagcguuaagggaauuuaaggaauuugcggcgggaaggcguucaguaagcggagauuuaauuuuagaaauaggcaaacuuccacagcauuuaacuuuaagagcacaaaacgcauuagacaacuuagugaugcuccacaauucggaacaaggagguaaggcauauaggcacgccauggaagaacuaccugacacuaucgaaacauuaaugcugcuggcuuuaauugcugugcuuacagguggcgugacuuuauucuuucuaucaggaaaaggacuuggaaaaacgucuaucgguuuguuauguguuacugcgucaucugcucuuuuauggauggcuucggucgaaccacacuggaucgccgcuuccauuauacuugaguuuuucuuaaugguauuauuaauccccgaaccugaucgucaacgaacaccacaggacaaucaacuggcauacgugguaauagguuugcuauuuaugauacuaacaguggcagcaaacgaaaugggauuauuggaaacuacuaagaaagauuuggggauaggauauguagcagcugagaaccaucagcaugcaaccaugcuagacguagacuuacacccugcaucagcauggacauuguacgcaguagcuacaacugugauaacaccuaugaugagacauacgauugaaaauacgacagcuaauauaagccuaacagcuauagccaaucaagcagccauucuaaugggauuagauaaaggauggccaauuuccaaaauggacauaggagugccccucuuagcucuggggugcuacucgcaaguaaauccauuaacccuaaccgcugcagugcucaugcuaguugcucauuaugcgauaauagggccuggacuucaagcuaaggcaacuagagaagcgcaaaaacgaacagccgcagggauaaugaaaaaucccacuguagacggaauagucgcuauugaucuugauccagucguauacgacgcaaaguuugagaagcaacugggccagaucaugcugcugauuuuauguacuucucaaauacucuugaugcggacuacaugggcauuaugcgagucuauaacauuagccacugguccccuuacuacucuaugggaaggcaguccuggaaaguucuggaauacaacuauugcuguuagcauggcaaacauauucaggggaucauacuuagcuggugcuggauuagcguucucacuaaugaagucauugggcggagguaggcgagggaccggagcucaaggagagaccuuaggcgaaaaguggaagagacaauuaaaucaauuaucaaagagugaguucaacacauacaaacgcucuggaauaauggagguagacagaucagaagcaaaagagggucuuaaacgaggagagacgacaaaacaugcaguaagcagaggaacugcgaaacuaagaugguuuguagaaagaaaucugguaaagccggaagguaaaguaauugacuuggguuguggucgcggugguuggagcuacuacugcgcuggucuuaagaaaguuacugaaguuaaaggauauacgaaaggcggaccaggucacgaagaaccaauucccauggccacauauggcuggaauuugguuaaguuacacagcggaaaagacguauuuuucaugccaccagagaaaugugauacauuacucugcgacauaggagagaguucaccaaacccaacaauugaagaaggcagaacacucagagucuuaaagaugguagaaccuuggcuacgaggaaaucaauucuguaucaaaaucuugaaccccuacaugcccaguguaguggagacucuugaacagaugcaacgcaaacacggugggaugcuaguucggaauccauuaagccgcaacucgacacaugagauguacuggguaucauguggcacagguaacauaguaucugcaguuaauaugacgucuaggauguuauuaaaccgauucacaauggcacacagaaaaccaacauaugaacgagaugucgacuuaggcgcagguacaaggcauguggcaguggaaccggaaguagcaaaucuagacaucauaggacaaaggauagagaacaucaaaaaugaacauaaaaguaccuggcacuaugacgaggauaauccuuauaagacaugggccuaucauggaucuuacgaagucaaaccgucaggaagcgcaucauccauggucaauggaguaguacgacucuuaacaaaaccgugggauguaaucccgaugguuacgcagauagcuaugacugauacaaccccauuuggacaacaacggguauucaaagaaaagguggauaccaggacaccucgagcuaagcguggcacuacgcagauaauggaaguuacagcuaaauggcuguggggauuucugagucgaaauaagaaaccacguauuuguacucgugaagaauuuacaaggaaagugagauccaaugcugcaauuggagcuguauuuguugacgaaaaccaauggaacucagcuaaggaggcaguugaggaugagcgauucugggaccuaguucacagagaaagggaguuacauaagcaagggaaaugugcuacaugugucuacaacaugaugggaaaacgagagaagaaacucggagaauuugggaaagccaaaggaagcagagcuauuugguacaugugguuaggcgcaagauuccuagaguucgaagcccugggcuuuaugaaugaagaccacugguucagccgggaaaauagcuugagcggaguugaaggugaaggccuacacaaacucggguacauauuacgagacaucucuaaaauccccggcgguaauauguacgcggacgacaccgccggaugggauacacggauuaccgaagacgaucugcaaaaugaagcaaaaauaacagauauaauggaaccugaacacgcccuguuggcgacgucaauauuuaaguugaccuaccaaaauaaaguuguucguguccagagaccugcaaagaacgggacggugauggauguaaucucaagacgcgaucagagagguuccggucagguuggaacauacggauuaaauacguuuacaaacauggaagugcagcucauaaggcagauggaauccgaaggcauuuuccuaccuucagaacuggaaacaccuaaccuggcagaacgagcacuugauuggcuagaaaaacacggggcagaaagauugaaaagaauggcaauaucaggugaugauugcguuguaaaaccuauugacgauagauuugcgacugcauugacagcucuaaaugauaugggaaaagucaggaaagauaucccccaaugggaaccaucaaaggguuggaaugacuggcaacaaguuccguuuuguucacaccacuuucaucaguugaucaugaaagaugggagagaaaucguuguuccgugcagaaaucaggacgaauugguuggacgagcaagagucagccagggggcaggcuggagccuaagggaaacggcauguuuagguaagucguacgcacaaauguggcaacugauguauuuccacagacgugacuuaagauuggccgcuaacgcuaucugcagugcuguucccguagauugggugcccgcaagccgaacaacuuggagcauacacgcucaucaucaauggaugacaacggaagauaugcuaagcguuuggaacagaguguggauagaggaaaaucccuggauggaggacaagacacauguguccagcugggaagaagucccguauuuaggcaagcgcgaagaccagugguguggaaguuugauaggacuuacagccagggcuaccugggcgacuaauauacaaguugcgauaaaucaaguuagaaggcuaauuggcaacgaaaacuaucuugauuauaugacuagcaugaaaagauuuaaaaaugaaagugacccagaaggggcacuaugguag

SEQ ID NO: 22037 - RNA, 9879 nt, Artificial Sequence
  derived and/or modified CDS sequence (opt6) from DENV-1__KC692504__SS-prME
ucuguaacaaugcuacucaugcucuugccuacagcacuagcguuucaccucacuacaaggggaggugaaccgcauaugauugucucuaaacaagaaagggggaaaagccuacuauucaaaacauccgcgggaguuaacaugugcacauuaauagcaauggaucuuggggaacucugcgaagauacaaugacauacaaaugcccucgaauuacagaagcagaacccgaugaugucgacuguuggugcaacgcaacagacacauggguuacuuacgguacauguucacaaacuggagaacaucggagagaaaaacguucgguagcucuagcaccacauguuggauuaggucucgaaacccggacagaaacauggaugucgucagaaggagccuggagacaaauccaacguguagaaacaugggcucucagacauccaggcuucaccgucauugccuuuuuccuagcucaugcuauaggaacaucaauaacucaaaaaggaauuauauuuauauuacugaugcucgugacgccaagcauggcgaugagauguguaggcauugggaaucgcgauuucgucgaaggauuauccggagcaacguggguggaugucguuuuagagcauggcucaugcguuacaaccauggccaaaaauaaaccuacccuagauauugaauuauuaaaaacagaaguaaugaauccugcgguacuucggaaacuauguauagaagcaaaaauuucuaauacaaccacugacucaagauguccaacucaaggagaagcuaccuuaguagaagaacaggaugccaacuuugucuguaggcgcacauuuguagauagaggauggggcaacggcuguggccuauuuggaaaagggucauuauuaacaugugcgaaauuuaaauguguuacaaaauuagaaggaaaaauaguucaauaugagaauuuaaaauacaguguaaucgugacuguucacacaggagaucaacaucaaguuggcaaugaaacaacagagcacgguacaauagccacaaucacuccucaagcuccgaccucugaaauacaacucaccgauuacggugcuuuaacguuggauuguucacccagaaccggccuagauuuuaacgagaugguuuugcuuacuaugaaagaaaaguccugguuagugcacaagcaaugguuuuuagaccugccucucccguggacaaguggagccucuacaucucaagagaccuggaaccgacaggaccuucuaguaacuuucaaaacagcucaugcuaagaaacaagaaguaguuguuuuaggaagccaagaaggugcaaugcauaccgcccuuacaggcgcuacugaaauacaaacguccggaaccacgacaaucuucgcgggccacuugaaaugucgauuaaaaauggauaaacugacauuaaaagguaugaguuaugucaugugcacuggaucguucaaacuagagaaggaaguagcagaaacccaacauggaacgguauuaguacaagucaaauaugaaggaaccgaugcaccauguaaaauaccauuuucuacccaagacgaaaaaggaguaacacaaaacggacgacucauuacugcuaauccuauugugacagacaaagagaagccaguaaacaucgaaacagaaccacccuucggcgaaagcuauauaguuguaggugcuggagaaaaggcuuuaaaacucuccugguucaaaagaggauccuccauaggcaaaauguucgaagcaaccgcacggggugcaagacggauggcaauucugggugauacagcuugggauuucgggucaauugguggaguguucacaucuguugguaaacuuguccaucaaguauucgguacagcauauggaguacuuuucaguggggucaguuggacuaugaaaauugggauugggauacuccugaccugguuaggucugaauagucgaaguacaagccugaguaugacgugcauagcaguuggaauggugacuuuguaucugggaguaaugguacaggcugacaguggauguguaauuaacuggaagggaagggaacuaaaauguggcucuggcauauuuguaacaaaugaaguccauacauggacggaacaauauaaguuccaagcagacucuccaaaacgucugagugccgcgaucggcaaagcaugggaagagggaguuugugggauaagaucugcuacccgacucgaaaauauuauguggaagcaaauaagcaaugaacuuaaccauauucuucuagagaacgauaugaaguuuacaguuguugucggagacgccaaugggauauuagcacaaggcaaaaagaugauacgcccgcagcccauggagcacaaauauaguuggaaaucgugggguaaagcaaaaauuaucggagcugauauacaaaauacaacauuuaucaucgacgguccugauacgccugaauguccagauggccaaagagccuggaauaucugggagguggaggacuauggcuuuggugucuucacaacuaauauuugguuaaaauuacgugacucauacacucaaaugugcgaucaucguuuaaugucagcugcaauaaaggauucaaaggcuguacaugcagauaugggguacuggauugagucagaaaagaaugagacguggaaacuugcccgcgcuaguuuuauagaaguaaaaacaugcacauggccuaaaucacacacgcucuggucgaaugguguacuugaaagcgaaaugaucauaccgaaaauuuuuggaggcccaauuucucagcauaauuauagaccggguuacuuuacgcagaccgcaggaccauggcaucuagguaaacuggaacuggacuucgaucuuugcgaaggcacuacaguuguuguugaugagcacugcggaaaccgaggcccgaguuugagaacaacaacuguuacugggaaaaucauucacgaaugguguuguagaagcuguacgcuaccacccuugcguuuucgaggugaggacgguuguugguauggcauggagauccgaccgguaaaagaaaaagaggagaaccuuguacggaguaugguuuccgcaggcaguggagaaguagauaguuuuucacuaggcaucuuaugcguauccaucaugauugaagagguaaugagauccagguggaguaggaaaaugcugaugacggggacuuuggcgguguuuuuacugcuuaucaugggacaauuaacauggaacgacuuaauccgacugugcauaauggugggggcaaaugcaucugauaggaugggcauggguacgaccuacuuagcguuaauggcuacuuucaagaugagaccgauguuugcaguuggucuccucuucagacguuuaacaucaagagaaguucuauuauuaaccaucggccuuagccuaguugcuucaguugaguuacccaacuccuuagaagaacucggggauggccuagcgaugggaauaaugaugcucaaacuucuuacagaauuucagccacaccaauuauggacuacgcuacuuucucuaacuuuugugaaaacaacuuuaucucuagacuacgcauggaaaacaacagcuaugguauuaaguauagugagccuauuuccguugugccugucaacgacaucacagaaaacuacuuggcuacccgugcuauuaggauccuuuggauguaaaccguugaccauguuucuaauaacugagaacaaaauauggggccguaaauccuggccauuaaaugaggguauaauggcgauaggcauugucagcauuuuauuauccucacuucuaaagaacgacguaccccuagcaggaccacucauugccgguggaauguugauagccuguuacgugauauccggcucuagcgccgauuuaaguuuagaaaaagcggccgaaguaucgugggaacaagaagcagaacauuccggugcaucucauaauauuuuaguugaaguucaagaugaugguacuaugaaaaucaaggaugaagaacgagacgauacauuaacuauuuuauuaaaagcaacauuauuggcuguauccggaguuuacccuaugaguauaccugcuacauuauucguaugguauuucuggcagaagaagaaacaaaggaguggugugcugugggacacaccaucuccacccgaaguugaacgugcuguacuagacgauggcauauaucggauacugcaacgagguuuacuaggaagaucccaaguagguguaggagucuuccaagacggagucuuccauacaauguggcauguaacuagaggggcgguacuuauguaccaaggaaagcgacucgaaccaucuugggcaaguguuaagaaagaccuuauaaguuacggaggaggcuggagauuucaaggaagcuggaauaccggugaagaaguucaaguuauagcagucgagccaggcaaaaauccuaaaaauguacagaccacgccgggaacuuuuaaaacuccugaaggugaaguaggggcaauagcuuuagauuuuaaaccagguacaucaggaagucccauaguaaaccgggaaggcaaaaucguaggauuauauggcaacggagugguuacuacaucuggcaccuaugucucagccauugcccaagccaaagcuagccaagaagggcccuugccagaaauugaagaugaaguuuuuaagaaaagaaaccuaacuaucauggacuuacacccagguuccggaaagacaagacgauaucuaccugcaauagucagagaagccauuaaaagaaaauuacgaacucuaauauuagcaccgaccagaguagucgcuuccgaaauggcagaggcgcuaaaagguaugccuauuagguaucaaacaacggcuguuaagagcgaacauacaggaagggaaauaguggaccuaaugugucacgcaacuuucacaaugagauuauuaaguccuguucgaguuccaaauuauaauaugauaauaauggaugaagcacacuucacagauccugcuuccauagcugcucgaggguauaucucuacgaggguaggaaugggagaagcggccgcgauuuucaugacggccacgccaccaggcuccgucgaggcuuuuccgcaaucuaacgcaguaauucaagaugaggaacgagauauucccgagagguccuggaacucaggauaugacuggauaacagauuuccccggcaaaacuguuugguuuguuccuucaauaaagaguggaaaugauaucgccaacugccuuaggaaaaaugguaaacgugucauacaauugaguagaaaaacguuugauacagaauaccagaaaacuaaaaauaaugauugggauuauguaguaacaaccgacaucucagaaaugggugcgaauuuuagagcagaucguguaauagaucccagacgaugucuuaaaccuguuauacucaaagacggaccagaacggguuauauuagcgggaccaaugcccguaacuguagcuucagcugcacaacgaaggggacgaauugggaggaaucaaaacaaagaaggagaccaauacguuuauaugggucaaccgcuaaauaacgacgaggaccaugcgcacuggaccgaagccaagaugcuucuagacaauauaaauacuccugaaggaauuauacccgcauuauuugaaccagagcgagaaaaaucagcugcaaucgauggugaguaucgucuucggggagaagccagaaagacguucguagaauuaaugcggagaggagaucugccaguaugguugucuuacaaagucgcaucugaaggauuucaauacucugauagacgauggugcuuugacggugaacgaaauaaucaaguucucgaggaaaacauggauguugaaaucuggacaaaagaaggagaacguaagaaacucagaccaagaugguuagaugccagaacguauucagacccauuggcacuaagagaauuuaaagaauuugcagcaggacgaagaaguguuagcggggaccuaauucuagagauaggcaaguuaccccaacacuuaacucuccgggcccaaaaugcacucgauaaucuugugauguugcauaauucagaacaaggagguaaggcuuauaggcaugccauggaagaacuaccugauacgauagaaacucuaauguugcuagcccucaucgcgguuuuaacugggggaguaacauuauucuucuugaguggcaagggccuggggaaaacaaguauuggucucuuauguguaacugccuccagcgcacuccuuuggauggcuucuguagaaccucacuggaucgcagcaucuauaauccuagaguucuuucucaugguauuguugauaccagaacccgauagacaaagaacaccacaagacaaucaacuagcauauguaguaauugguuuacuauuuaugauacuuacaguggcagcuaacgagauggguuuguuagagacaaccaagaaagauuuagguaucgguuauguggcugcagaaaaccaucaacaugcuaccaugcucgauguugacuuacacccagccucggcguggacuuuauacgcaguagcaacuaccguuauaacuccuaugaugcgucacaccauugagaauacgacagcaaacauuagccuaacagcuauugcuaaucaagcagcaauacuaauggggcuugauaagggguggccaaucucaaaaauggauauaggagugccacugcuugcuuuaggcuguuauagucaaguuaauccuuugaccuugaccgccgcuguucuaaugcuuguagcacacuaugcgauaauuggaccaggguugcaagcaaaagcaacuagagaggcccagaaaagaacagcagcuggaauaaugaaaaaucccacaguagauggaauagucgcgauugaucuugacccaguagucuacgaugcaaaguucgagaaacaacugggucaaauuauguuacuuauccuguguacaagucaaauacucuuaaugcguacaacaugggcuuuaugcgaaucuauaacuuuagcaaccggaccgcucacgacacuaugggaagguucacccggcaaguuuuggaacaccacuauagcaguaagcauggcuaacguauuccggggcaguuaucuugcgggggcaggguuagccuucagucuaaugaaaucacuuggaggcgggcgccgaggaacaggugcacaaggagaaacacucggugaaaaauggaaaagacaguuaaaccaguuaucuaaaagcgaguucaauaccuauaagagguccggaauuauggaagucgacagaucagaagcuaaggaaggauugaagcgcggugaaaccacaaaacacgcaguaagcagagggacggcgaaacuacgaugguuuguagaaagaaaccucguuaaacccgaagguaagguaauagauuuaggcugcggcagagguggguggucauacuauugcgccggguuaaagaaaguaacagagguuaaaggauacaccaaaggagggccugggcaugaagaacccauaccaauggcgaccuauggcuggaauuuggugaaauuacauaguggcaaagacguauucuuuaugccuccagaaaaaugugacacauuacucugcgacauaggagaaaguucuccuaauccuacaauugaagagggaaggacacuacgcguacuaaaaaugguagagcccuggcugagagguaaucaauuuuguauuaagauucuaaaucccuauaugcccucuguaguagagacacuugagcaaaugcagcguaagcacggcggcaugcugguucgcaacccccuaucaagaaauaguacccaugaaauguacuggguaucuugcggcacaggaaauauaguuagcgccguaaauaugacgucaaggaugcuucucaauagauuuacgauggcacaucgaaaaccgacguaugaaagggaugucgaccuuggcgcuggaacacggcacguagcagucgaaccugaaguagcuaauuuagacauaauaggucagaggauugagaacauuaaaaacgagcacaagaguacuuggcacuacgaugaagauaaucccuauaaaacaugggcauaucacggaucauaugaagucaaacccucuggaagugcaaguucaauggucaacggcguaguaaggcuucucacaaaaccuugggacguaauaccuaugguuacccaaauagcuaugacggauaccacuccauucggacagcaaagaguuuuuaaagaaaaaguagacacacguaccccacgugcuaaaagagguacgacacaaauaauggaaguaaccgcgaaaugguuauggggguuccuaagucguaacaagaaaccaaggauauguacccgagaagaguucacucgaaagguucguucaaacgccgcuaucggcgccguauuuguagacgaaaaucaauggaacucggcaaaagaagcaguugaagacgaacgcuuuugggaucuuguacaucgggaaagagaauuacauaaacaaggcaaaugcgcaacguguguauacaauaugaugggaaaacgcgagaagaaacuuggagaguuuggcaaagcaaaaggcaguagggcaauuugguauauguggcuaggagcgagguucuuggaauuugaggcacuugguuuuaugaaugaggaucauugguuuucaagagaaaacagccugucaggaguggaaggagaaggguuacauaaacuaggcuauauuuuaagagauauaaguaagauacccggugggaacauguacgcagaugacacugcugggugggacacgcguauaaccgaagaugacuugcaaaacgaagccaaaauuacugauauaauggaaccugagcacgcccuacucgcgacaaguauuuucaaauuaacuuaccaaaauaaaguuguccgcguucaaagaccggcgaaaaacggaacaguaauggauguuauaucaagaagagaucagcgcggaucaggacaagugggaacuuacggucugaauacauuuacaaauauggagguucaauuaauccgacaaauggaguccgaaggaauauuuuugccuuccgaauuagagacaccaaaucuugcugaacgugcuuuagauugguuagaaaaacacggagcggaaagauuaaaaaggauggcgaucucaggugaugacugcguaguaaagccgaucgacgauagauucgcuacugcauuaaccgcucuaaacgauaugggcaaaguaaggaaggauaucccccaaugggagccaucuaaaggguggaacgacuggcaacaagugccguuuuguagucaucauuuucaucaacuuauuaugaaggauggacgagagauaguagucccuugucgaaaccaagaugaauugguaggucgagcccgaguaagucaaggagcgggcuggucuuuacgcgagacagcgugucuaggaaaaagcuacgcgcagauguggcaauuaauguauuuccauagacgugaccuuagacuagccgcuaaugcuauuugcucugcuguaccaguagauuggguaccggcaaguagaacaacauggagcauacacgcccaccaucaguggaugacgacugaggacauguugucagucuggaauaggguuuggauugaggaaaacccuuggauggaagauaaaacucaugugaguaguugggaagaaguaccauauuugggaaagagggaggaccaaugguguggaucacuaauaggauugacugcucgagcuacaugggcaacaaacauucaaguggcaauuaaucagguuaggcgauugaucgguaaugaaaauuacuuagauuauaugacgucuaugaaacgcuuuaaaaacgaguccgauccugaaggggcacuaugguaa

SEQ ID NO: 22038 - RNA, 9879 nt, Artificial Sequence
  derived and/or modified CDS sequence (opt6) from DENV-1__KC692508__SS-prME
aguguaacaaugcuauugaugcuuuuaccaacagcguuggcauuucacuuaacaacucgagguggugaaccucauaugauaguaucuaaacaagaacguggaaaaucgcuuuuauucaaaacaucagcggguguaaauauguguacguugauugcaauggauuuaggugaacucugcgaagauacaaugacuuauaaauguccucgaauaacagaagcagaacccgacgacguagauuguuggugcaaugcaaccgauacgugggucacuuauggaacguguagccaaacaggagaacacagaagagagaaaagaucuguugcauuagcaccucacgucggauuaggacuagaaacgagaacugaaacguggaugaguucggaaggagccuggaaacaaauucaaagaguagaaaccugggcauuacggcauccuggauuuacgguuauagcguucuuucuugcucacgcaauagggacaucaauaacucaaaaagguauuaucuucauacuacuuauguuggucacuccauccauggcaaugcguuguguagguauugggaacagagauuuuguugaagguuugucaggagcgaccuggguagaugugguuuuagaacacggaucaugugugacaaccauggccaaaaauaaaccgacgcuagacauugaauugcucaaaacugaagugacaaacccagcuguauugcgaaaacuuugcaucgaagcaaaaauaucgaacacaacgacggauucacgaugcccuacgcagggggaagcaacacugguugaagaacaagaugcuaauuuuguaugccggcgaacuuuugucgaucggggauggggcaacgguugcgguuuguuuggcaaaggaucacucuuaacgugcgcuaaauuuaaaugcguuacuaaauuagaagggaaaauuguucaauaugaaaacuugaaguauagcguaauuguuacuguucauaccggcgaccagcaucaagugggaaaugagacaacugaacacggcacaauagcgacaauaacuccacaagcgccgaccagugagauccaauugacugauuacggagcccuaacacuagauuguuccccuagaacaggguuggauuuuaaugaaaugguuuuauuaacuaugaaagagaaaaguuggcuaguucacaaacaaugguuccuagauuugccuuuaccauggacguccggagcuagcacaagucaagaaacuuggaaucgccaagaccuacuugugacauucaaaacugcacacgcgaagaaacaagaagugguaguacucgggucacaggaaggcgcgaugcauacugcucuuacgggagcaacugagauccaaacuucaggaacuacaacaauauuugcuggacaccuaaaguguagacuaaaaauggauaaguuaacuuugaagggaaugaguuacguaauguguacuggaaguuuuaaacuugaaaaagaaguugccgagacucaacauggaacaguuuuaguacaaguaaaguaugaaggcacugacgcaccaugcaaaauacccuuuaguacacaagacgagaaaggugucacucaaaauggacguuuaauuacagcuaauccaauagugacagauaaagaaaaaccaguaaauauugaaacagaaccaccguucggugaaucuuauauagucguaggagcuggcgaaaaagcucugaaguuaucgugguuuaaacgagguagcaguauaggaaaaauguuugaagcuaccgcacgcggugcccgaagaauggcgauacuuggugacacagcaugggauuuugggaguaucggaggcguguuuaccuccguugguaaacuuguucaccaaguguucgggaccgccuauggaguacuauuuucaggcgugucuuggacuaugaaaauagguaucggaauauuacuuacauggcuaggccuuaauucacggagcaccucacuaucaaugacauguauagcaguggguauggucacauuauauuuaggggugaugguucaggcugauagcggcuguguaaucaacuggaaaggaagagagcuuaaaugcggcagugguauuuuuguaacuaaugagguccacacuuggacagaacaauauaaauuccaagcggauagcccaaaacgcuuaagugccgcaaucggaaaggcuugggaggagggaguuugcgguauuagaagugcaacaagauuagaaaacauaauguggaagcaaauaagcaacgagcuaaaucauauacuacuagagaaugacaugaaauucacuguaguaguaggagaugccaaugguauauuagcacagggcaagaaaaugauacguccccaaccuauggagcauaaauacucauggaaaucuuggggaaaagccaaaauaaucggagcagacauccaaaacaccacauucauaauugacggaccggacacgccugagugcccagaugggcaacgcgcuuggaauauaugggaaguagaagauuacggguuuggagucuucaccacaaauaucugguuaaagcuacgagacaguuauacccaaaugugugaccaucgacuuaugagcgcagcgauaaaagacaguaaggccguacacgcagauaugggauacuggauugaaucugagaaaaaugaaacguggaaauuggcaagagcuucauuuauagaaguuaagacaugcacuuggccuaagagucauacucuuuggucaaauggcguauuggagucugaaaugauaauaccgaaaauauucggaggaccaauuagucaacauaauuaucggccugguuacuucacucaaacggcaggcccuuggcaucuggggaaauuagaacuagacuuugaucuaugugagggaacaacggucguuguagaugaacauugcggaaaccgggguccuagucuacgcacuacaacaguaacugguaagauaauacacgaauggugcuguagaucaugcacucucccucccuuaagauuucggggugaagacggcuguugguaugguauggagauuaggccgguuaaagagaaagaagaaaauuuaguacgcucgauggucucugcagggucuggagagguagauucauuuagccuaggaauacuaugugugucgauaaugauugaggaaguaaugaggucacgauggaguagaaaaaugcuuaugacgggcaccuuagccguuuucuuauugcuuauaauggggcaacuaacauggaaugaccuaaucagacucugcaucauggugggagcaaaugcgagcgaccgaaugggcaugggcacuacauauuuagcccuuauggcuacauuuaaaaugcgcccaauguucgcgguagggcuucuguucagaagacuuaccucgagagagguccuucuucuaacgauugggcucagucuggucgcauccguagaauuaccuaacuccuuagaagaacuuggagauggucuagcuaugggcauaaugauguuaaaacuacuaacugaauuucaaccacaccaacuuuggaccacacucuugucgcuaacuuucgugaagaccacucuuucuuuagacuacgcauggaaaacaacagcaaugguacuaaguauugucaguuuauuuccucuuugucuauccacgacaucacagaaaaccacauggcugccuguguuacuaggaucauuuggauguaagccguuaaccauguuccuaauaacagagaacaaaauauggggcagaaaaagcuggccacuuaaugaagguauaauggcaauugggauaguaaguauccuacucaguucccuccuaaagaaugacguuccucuagccggaccucuuauagcuggugggaugcuaauagcauguuauguuauaaguggaaguucggcagaucucagcuuggagaaggcagcugaggucaguugggaacaagaagccgaacacucuggugcaucgcauaauauuuuaguagaaguacaggaugaugggacuaugaaaaucaaagaugaagaacgugacgauacauuaaccauucuauuaaaggcaaccuuacuagcaguaaguggaguguauccgaugucuauaccagcuacacuguuuguuugguauuuuuggcagaaaaagaagcaacgaagcggugucuuaugggacacgccaagucccccugaagucgaaagagcaguauuagaugaugguauuuaccguauacuacaaagggguuuacuagggcgaagccaaguaggcguaggaguauuucaagauggaguauuucauacuauguggcacguaaccagaggagcuguacuuauguaucaaggcaaacgccuagagccgaguugggcaucagucaagaaagacuuaauaaguuacggcggugguuggagauuucagggcucauggaauacuggagaagaaguacaaguuauagcaguagaaccugggaaaaaucccaaaaauguacaaacgacaccagguacauuuaaaacuccagaaggggaaguuggagcgauagcacucgauuucaaaccagguacuagcggauccccuauaguuaauagagaaggaaagauaguaggauuauauggcaacggaguuguaaccacaaguggcacauauguuagcgcaauagcgcaagcaaaagcgagccaagagggcccguuaccugaaaucgaagacgagguuuuuaagaaacgaaaucugacaauaauggauuuacaucccggcucaggcaaaacaagacgcuaucuucccgccaucguacgggaggcuauuaaacguaaguuaagaacucuaauauuagccccaacccgcgugguagcauccgaaauggcggaagcucuaaagggaaugccuauuagauaucaaacaacggcaguuaaaucggaacauaccggaagagaaauaguagauuuaaugugucaugcgacauuuacaaugagguugcuuucgcccguucggguaccgaacuacaacaugauaaucauggaugaagcucacuuuaccgauccagcgagcauugcagcucgagguuauauuuccaccagggugggaaugggagaggcggcagcuauuuucaugaccgccaccccgccaggcuccguugaggcauuuccacagaguaaugcaguaauucaagaugaagaacgagauaucccagaacguucuuggaacagugguuacgacuggauaacagacuuuccugguaaaacugucugguuuguuccaucuauuaaaagugguaacgauauagcuaacugucucaggaaaaauggcaaacguguaauccaacuaagucguaaaacuuuugacaccgaauaucagaaaacuaaaaauaaugauugggauuauguaguaacgacugauauaagugaaaugggcgccaacuucagggcagauagagucauagauccgcgaaggugcuugaagccuguaauuuugaaagaugggccggaaaggguaauauuagcuggacccaugcccguaaccguggcuucggccgcucaaaggcgagguagaaucggucgaaaucaaaauaaggaaggugaucaauauguauauaugggccaaccuuuaaauaaugacgaagaacacgcucacuggacagaggcaaagauguugcucgauaauaucaacacacccgaagggauaauuccagccuuauucgagcccgaacgcgagaaaagcgcagcuaucgauggggaauacagauuaagaggagaggcacgaaaaacuuucguagaauuaaugaggcguggagaccuaccuguaugguugucguauaaaguagcuucagaaggauuucaauacucagaccgcagauggugcuucgauggcgaacguaauaaccaagucuuagaagaaaauauggacgucgagauauggaccaaagaaggugaaaggaagaaacuaaggccgagaugguuagaugcaagaacauauagcgauccucuagcacugagagaguucaaagaauuugcggcgggcagacgcuccguguccggggaccuaaucuuagagauagguaaauuaccacaacaccuuacacuaagagcgcaaaaugcccuggauaaucuuguaaugcuacacaacuccgaacaaggagguaaagcauaucgacaugcaauggaagaacuaccggacacgauagagacguuaaugcuacuagcacucaucgcaguauuaacaggugggguuacuuuguucuucuuauccgguaagggcuuaggcaaaaccucaauuggguuacuauguguaacugcaucuagcgcguuauuauggauggcuucaguggaaccucauuggauugcagcuagcauuauucuugaguucuuccuuaugguguuacucauuccagagccagacagacaacguacgccccaagacaaucaacuagcuuacguagucauaggucuuuuguucaugaucuugacaguugcagcaaacgaaaugggauugcucgaaacuaccaagaaagaucucgggaucgguuacguugcagcggaaaaucaucagcaugcgacaaugcucgacguagaccuacauccugcgagugcuuggacucuguaugcuguggcaacaacaguuauaaccccaaugaugaggcauacaaucgaaaauaccacagcaaacauuaguuugacugcaauugcaaaucaagcagcuauauuaaugggacuagauaagggauggcccauuuccaaaauggauaucggaguaccucuucucgcauuaggauguuacucgcaagucaauccguugacguugacggcagcgguucuaauguuaguagcucacuacgcaaucauaggaccgggucugcaagcaaaagcaacgagagaagcacagaaaagaacagcagcuggcaucaugaaaaaucccaccguugaugggauuguugcaauagauuuagaucccguaguguaugacgcaaaguuugagaagcaacuaggucaaaucaugcuguuaauauuguguaccucccaaauccuguuaaugagaacgacaugggcuuuaugugaaucuauaacacuugcaaccggaccacugacaacauuaugggagggcaguccaggcaaauuuuggaauacaacaauagcugugagcauggcgaauauauucagagggaguuaucuugccggugcaggguuggcuuucagcuugaugaaaucacuggguggaggucgucgggggacaggcgcucaaggcgaaacucuuggcgaaaaauggaaaagacagcuuaaccaacuauccaaaucugaguucaacacguacaaaagaagcggaauaauggaaguagauagguccgaagcaaaagagggauugaaacgaggugaaacgacgaaacaugcggucucuagaggaacugccaaguuaaggugguucgucgagaggaaccucgucaagccagagggaaaaguaauugaccuugguuguggaagaggugguuggagcuauuauugcgccgguuugaagaaggucacagaagucaaaggcuauacaaaaggcggacccggucacgaagaacccauuccaauggccaccuacggcuggaaucuaguaaaguuacauucuggaaaggacguguuuuucaugccacccgaaaaaugugauacauuguuaugugacauaggggagaguucuccaaauccuacaauagaggaaggacgaacuuuaaggguauugaaaaugguagaaccauggcuuagagguaaucaauuuuguaucaaaauacuaaauccguauaugccuagcguaguggagacguuagaacagaugcagcgaaagcacggagguaugcuagucaggaacccgcugagccgaaauaguacccaugaaauguauuggguaucauguggaaccgguaauauuguuagugcaguuaauaugaccucaagaauguuacuaaaucguuuuaccauggcacacaggaaaccaacguaugaacgugacguagacuuaggagcugguacucgacauguagcaguugaaccugaggucgcgaaccuagacaucauaggucaaagaauugaaaauaucaaaaaugaacauaaaagcacguggcauuaugacgaagauaacccauauaaaacaugggcauaccacgguucauacgagguaaaaccguccggaagugcuuccucuaugguaaauggaguaguaagauugcuaacaaagccaugggacguaauacccauggugacacaaauugcaaugacagacacuacaccuuuuggucaacaaaggguuuucaaagagaaaguugacacgcgaacaccccgagcuaaacgagggacaacucagauaauggaagugacagcaaaaugguuguggucguucuuaagucguaauaagaaaccuagaaucugcacaagagaagaguucacacggaaaguucgcucaaaugcagcuauaggugcaguauucguggaugaaaaucaguggaacuccgcgaaagaagccguugaagacgagagauuuugggauuuaguacaucgagaaagggagcuacacaaacaagguaagugcgccacgugcguuuauaacaugaugggaaaaagggagaagaaacuaggggaauuugggaaagccaaaggaagccgggcaauaugguacauguggcuaggugcacgauucuuagaauuugaggcguugggauuuaugaaugaggaucauugguuuagcagagaaaacagcuuaucaggaguugaaggcgagggacuccauaaguuggguuauauuuuaagagauaucagcaagauaccuggcgguaauauguacgcagaugauacggcgggaugggauacccggauaacagaagaugauuuacaaaaugaagcaaaaauaacagacauaauggaacccgaacacgcauuauuagcaacaaguauauucaaacucacauaccaaaauaaaguagucagaguacaaagacccgccaaaaacggaacgguuauggauguaauaagucgacgagaucagagagguucuggucaagucgguacauacggauugaacacuuuuacaaauauggagguccaguuaaucagacagauggagucggagggaauauuucucccaagugaacuggaaaccccuaauuuggcagaaagagcauuggauugguuggaaaaacauggcgcggaaagacucaagcgaauggcaaucucaggggaugauuguguaguuaagccuauugacgauagauuugcaacagcacucaccgcuuugaaugauauggguaaagucagaaaggauauaccccagugggaaccuucuaaaggauggaaugauuggcagcagguaccauucugcucccaucauuuucaucaacuaauaaugaaggacggcagagaaauuguaguaccgugccggaaucaagaugaauuaguaggacgagcacguguaagccaaggagcggguugguccuuaagagaaaccgccuguuuagguaaaaguuacgcacaaauguggcaacugauguauuuucacaggcgcgacuuacgguuggcagcaaaugccauaugcagugcuguaccaguggauuggguaccagcaucgaggaccacuuggaguauccacgcucaccaccaauggaugacaacggaagacaugcucucaguuuggaacagaguauggauugaagaaaaucccuggauggaagacaaaacacacguaagcucaugggaagaaguaccguacuuagggaaacgagaggaucaaugguguggaucacuuauaggacugaccgcuagagcaacgugggccacaaauauacaagucgcuauaaaucagguaagaagacuaauagguaaugaaaauuaucuggacuauaugacuagcaugaaaagauuuaaaaaugagagcgauccugaaggcgcgcuaugguag

SEQ ID NO: 22039 - RNA, 9879 nt, Artificial Sequence
  derived and/or modified CDS sequence (opt6) from DENV-1__KC692509__SS-prME
aguguaacuauguuacugauguuacuuccaacugcacuugcuuuucaccuaacuacucgaggaggugaaccacacaugaucguaucuaaacaagaaagagggaaaucacuauuauuuaaaacaagugcaggaguuaauauguguacacuuauagcaauggacuuaggagaauugugugaagauacaaugacauauaaaugcccaagaauuaccgaagcagaaccagaugacgucgauuguuggugcaaugccacagauacauggguuaccuauggaacauguucucagacaggcgaacaccgaagagagaaacgaucgguggcacuggccccucauguuggacucggacuagaaacacguacugaaacauggauguccucugaaggagcguggaaacaaauacaacgaguagaaacgugggcauuaaggcauccaggguucacggugauugccuuuuucuuagcacacgcgauuggaacuucaaucacacaaaaaggaauaauuuuuauacuccuaauguuagucaccccaagcauggccaugaggugcguuggaaucgggaauagagauuucguagagggccucuccggagcgacuuggguagauguaguuuuagaacauggauccugcguaacuacgauggccaaaaauaagccaacguuagauauugaacucuuaaaaacugaggugacuaauccggccguacucaggaaacuuuguauagaagcgaaaauaucaaauaccacaacugauucaaggugucccacacaaggggaagcgaccuugguugaggaacaagacgcaaauuucguaugccgaagaaccuucguagauagaggauggggcaaugguuguggcuuauuuggaaaaggcucccuguugacaugcgcuaaauucaaaugcguaacgaaauuggagggcaagaucguucaauaugaaaaccuaaaauacagugugaucgugaccguccacacaggugaccaacaccaaguuggaaaugaaacaacagaacacggaacaaucgcaacaaucacaccacaagcaccaacaagugaaauacaacugacagauuauggcgcauuaacacuggauuguagcccccgcacagguuuagacuuuaacgaaaugguccuacuaaccaugaaagaaaagaguugguuaguacacaagcaaugguuuuuagauuugccacuaccuuggaccucaggagccucgacaagucaggaaaccuggaacagacaagaucuccucguaacuuuuaagacagcucaugccaaaaagcaggaaguaguuguccuaggaucacaagagggggccaugcauacagcacuaacgggugcaaccgaaauacaaacauccgguaccacuacaauuuucgcaggacaucuuaagugccgacuuaaaauggauaaguuaacucucaagggagucagcuaugucauguguacgggcucauuuaaacuagagaaagaaguagccgaaacucaacauggaacuguccuaguacaagucaaguacgaagggacugacgcuccauguaaaauuccauuuucuacacaagacgaaaaaggcguuacucaaaacggaagauuaaucacugcuaauccaauaguaacagauaaagaaaagccaguaaauauugaaacugaaccaccauucggggaaucuuauauuguaguuggcgcuggggagaaggcacuaaaacuauccugguucaaaagagguucaaguaucggaaaaauguucgaagccacggcacgaggugcucggcgaauggcuauacuaggagacacugcaugggauuucgguuccauaggaggaguauuuacuucuguuggaaaacucguucaucagguguucggaacagcauacgguguguuauuuagcggaguaaguuggaccaugaagauaggaaucggaauauuacuaacgugguuagguuuaaacucacgaucaacuucuuugucaaugacauguauagcagucggaaugguaacucuauaccuuggugugaugguccaggcugauucggggugcguaauaaacuggaaaggacgugagcucaaaugugguaguggaauauucguuacaaacgagguucacacauggacugagcaguauaaauuccaagcggacaguccuaaacgucuuucugcggcuauaggaaaagcgugggaagaaggagucuguggaauccguagugccaccagauuagaaaauauuauguggaaacagauaucaaaugaauugaaucauauuuugcuagaaaaugacaugaaguucacuguugugguaggagaugcaaaugguauacuugcccaaggaaagaaaaugauccgaccacaaccaauggaacauaaauauagcuggaaaagcuggggaaaagcgaagaucauaggcgcugauauacaaaacacaacauuuaucaucgauggaccugauacaccagaauguccagacggucaaagagcauggaauauaugggaagucgaagauuacgguuuuggaguauuuacuacuaauauauggcuaaagcugagggauaguuauacacagaugugcgaucacagauuaaugucggcugcuauaaaagacaguaaagcgguacacgcggauaugggguacuggauagaaagugaaaagaacgagacuuggaaacuagccagagcgagcuuuaucgaggucaagaccuguacauggccgaaaucgcauacguuauggaguaacggaguguuagagucagagaugauuauuccgaagaucuuuggugggccaauuucacaacauaauuacagaccuggguauuuuacacagacagcaggaccauggcaucuaggaaaauuggaguuagauuuugauuuaugugaaggcacgacaguugucguugaugagcacugugguaaccgaggaccaagccugcgaacuacaacgguaacugguaaaauaauacaugaauggugcugccgaucuugcacauuaccaccccuucgguuccgcggagaagacggcuguugguauggaauggagauaaggccaguuaaagaaaaagaagagaauuuggugagaucaauggugagugccgguaguggggaaguugauagcuuuagccugggaaucuuauguguuucaauaaugauagaagaagucaugcguucaagguggagccgaaaaaugcugaugacagggacuuuagcaguauuucuacuauugauuaugggacaauuaacauggaaugaucuuauaaggcuaugcaucaugguaggggcgaacgcuucugacagaaugggaauggguacgaccuaucucgcguuaauggcaacauucaaaaugcgcccaauguucgccguuggucugcuauuuagaaggcuaaccagcagggaaguucuacuguugacuauaggucugagcuuaguugcaaguguugaacuaccaaacucacuugaagaauuaggggauggccuugcuaugggaauuaugaugcucaaguuacuuacagaguuccaaccucaucaguuauggacgacuuuauugucccuaaccuuuguacgaacaacgcucagcuuagacuaugcauggaaaacaacugcaauggucuuaucuaucguuucacuauuuccauuaugucuuucgacaacgucacagaaaacuacauggcuaccugugcuacuuggcucuuucgguuguaaaccauugacaauguuucuaaucacugaaaauaaaaucuggggaaggaaaaguuggccuuuaaaugaaggaauaauggcuaucggcauagucucgauacuccucucauccuuacucaaaaaugacgugccauuagcaggaccgcuaauagccgguggaaugcuaauagcguguuacgugauuucagguaguucggcagauuuaaguuuagaaaaagccgcagaaguaucaugggaacaagaagcggaacacuccggcgcaucacacaauauuuuaguugaagugcaggaugacggaacaaugaaaaucaaagacgaggaaagagacgacacacugacuauucuccuaaaagcaacauuauuggcaguuucgggaguauauccaaugucaauaccagcuaccuuauuugucugguauuuuuggcagaagaagaaacaaagauccggcguccuaugggacacuccaagcccaccagaaauggagagagcaguacuugacgacggaauuuacagaauuuugcaaagagguuuacuuggaagaucucaagugggugucggaguauuucaagacggugucuuucauacaauguggcaugucaccagaggagcgguucuaauguaucaaggaaaacguuuagaaccuucgugggcuucgguuaagaaagacuuaauaucauauggagggggauggagguuccaagggucguggaauacaggcgaagaaguccaaguaauugcaguagaaccgggcaaaaaucccaaaaauguucaaaccacaccugggacauuuaaaacccccgaaggcgagguuggagccaucgcauuagacuucaaaccgggaaccucagguucaccaauaguaaaccgcgaaggaaaaauagucggccucuauggaaauggugugguuacuacaaguggaacuuacguauccgcuauagcccaagcaaaagcgucucaagaaggaccguuaccggaaauagaagaugaggucuucaaaaagagaaacuuaacaaucauggaucuucaucccggaagcggaaagacacgacgauaccucccggcuauaguaagagaagcaauaaaaagaaaacuaagaaccuuaauacuugcaccaacaaggguaguugcaagugaaauggccgaagcauuaaaaggaaugccaauacgguaucaaacaacugcagugaaaagugaacauacuggccgagaaauaguugaucuaaugugccacgccacguuuacaaugagauuauugucucccgugagagugcccaacuacaauaugauaauaauggaugaagcgcauuucaccgauccagccucgauugcggcccgcggauauauuucuacgcgaguagguaugggggaagcugcugcuauauuuaugaccgcaaccccuccagggucaguagaagccuuuccucaaucaaacgccguuauccaggacgaggaacgugauauaccugagagaucauggaacucuggcuaugauuggauaacugauuucccaggcaagacggugugguucguaccaaguauuaaaucuggcaaugauaucgcuaacugcuuaaggaaaaauggaaaaagaguaauccaacugucuagaaaaacuuucgauacagaguaucagaaaacuaaaaacaaugauugggauuacgucguuaccacagauaucuccgaaaugggcgcaaauuuuagagcugaucgugucaucgauccacggcgauguuuaaagccaguuauacucaaggacggaccugaacgaguaauacuagccggaccuaugccaguaacggucgcaucugccgcacaaagaagaggcagaaucggcaggaaucaaaacaaagaaggggaucaauauguauacaugggccagccauuaaacaaugaugaggaucaugcacacuggacugaagcaaaaauguugcuagauaauauuaauacuccagaagguaucauuccggcucuuuuugaaccagagagggaaaagagcgcugcuauugacggagaauaccguuuaaggggagaagcaagaaagacauuuguugaauugaugcgaagaggugaucuuccuguaugguuaaguuauaaagucgccagcgaaggguuucaguauagcgaccgaagauggugcuuugacggggagagaaacaaccaagugcucgaagagaauauggacguagagauauggacaaaggaaggagaaaggaaaaagcuccguccuagguggcucgacgcacguacguacagcgacccacuagcauugcgagaauuuaaagaguucgccgcaggucgaagaucagucucuggagaccuaauuuuggagaucgguaaacuaccgcagcacuuaacuuuaagagcucaaaaugcucuugauaaccuaguaaugcuccauaauagcgaacaagguggaaaggcauaccgacaugcaauggaggaacuuccggacacaauugaaaccuuaaugcugcuagcauuaauugcaguacugaccggagguguaacccuauuuuuccuaucuggaaaaggauugggcaaaacaagcauuggacuuuuaugcguaacugccucgagcgcauuguuauggauggcgucaguagaaccacauuggauagccgcuucaauaauauuagaguucuuuuugauggucuuacucaucccagaaccugaccgacaacgaacgccgcaagacaaucagcuugcauauguugugauuggacuacuuuuuaugaucuuaacuguugcagcuaaugaaauggggcuacuugagacgacaaagaaagaccucgggauaggcuauguagccgcugaaaaucaucaacaugcaacuaugcuagauguugauuugcacccugcgucagcuuggacauuauacgcaguagcgacaaccgugaucacaccuaugaugcgacauacaauagaaaauaccaccgccaauauaagucuaacagcaauugccaaucaagcagcuauuuuaauggggcucgauaaagguuggccaauaaguaaaauggacauagggguuccacucuuggcacucggauguuauucgcaaguuaauccucuuacgcuaacagcagcagugcugauguuaguagcacacuacgcaauuauaggacccggcuuacaagcaaaagccacacgugaagcucagaagagaacggcagcugggaucaugaagaaucccacugucgacgggaucguggccauagacuuagauccgguaguuuacgacgcaaaauuugaaaaacaacuaggacaaauuauguugcuaauccuaugcacgucacaaauucuucucaugcgaacaacaugggcacuaugcgaaaguauuacacuggcaaccggaccacuuacaacgcugugggaaggaaguccuggcaaauucuggaacacaaccauugcaguuuccauggcaaacauuuucagaggaucauaccuugcaggagccggcuuagccuuuucccuuaugaaaucguuggguggcggcaggagagggacaggugcacaaggagaaacguuaggugaaaaauggaagcgacaguugaaucaacuuaguaaaucagaauuuaacacguauaaacguagcgggauaauggaaguugaccguucugaagccaaagaaggccugaaacguggagagacuaccaaacaugcugugucacgcggaacugcaaagcuaagaugguuuguugaacgaaacuuagucaaaccugaaggaaaaguuauugaucuaggguguggccgcggggguuggucguacuauugugcgggacuaaagaaaguaacagaaguaaaaggauauacaaaaggagggccaggacaugaggaaccaauacccauggcgacguacggcuggaaucuagugaaacuucauucuggaaaagacguauuuuucaugccaccugaaaaaugugacacccuuuugugcgauauaggugaauccaguccaaauccuaccauugaagaaggccgaacccuaagaguacuuaaaaugguagaaccuuggcuucgugguaaucaauuuugcauuaaaaucuugaaucccuacaugccuucuguaguggaaacguuagagcagaugcaaagaaagcacggugguauguugguaaggaauccucuaagucggaauagcacacaugaaauguauuggguuaguuguggaacaggaaauauuguuucggcagugaauaugaccucacguaugcuucugaauagguuuacgauggcucauagaaaacccacguaugaacgagauguagaucuuggagcgggaacaagacauguagcgguggaaccggaaguagcuaaccuagauaucaucgggcaacgaauugaaaauauuaagaacgaacauaagucaacuuggcacuacgaugaggauaaucccuauaaaacaugggcguaccauggauccuaugagguaaagccaaguggcagugcgucuaguaugguaaauggggucguacgguuguuaaccaagcccugggauguuauaccuauggugacucaaauugcgaugacagacacuaccccuuuuggccaacagagagucuucaaagaaaaaguagacacccggacgccucgagcaaagagaggaaccacacaaauaauggaagugacagcaaagugguuauggggauucuuaucacgaaacaaaaagccacggauauguacgagagaagaguucacacguaagguacggucgaacgcugcuauaggagccguauuuguagacgaaaaucaauggaacuccgcgaaggaagcgguagaagacgagagguuuugggauuuaguccaucgagaaagagaauuacauaaacaagguaaaugcgcaacaugcgucuauaauaugaugggaaagcgugaaaagaaacuaggagaguucgggaaagcuaaaggaagccgagccauuugguacauguggcucggugcucgauuccuagaauuugaagcacuugguuuuaugaacgaagaccauugguuuucaagagaaaauucucuuagugggguagaaggugaaggccuacauaaguuaggauauauucuccgagacauuagcaagauaccagguggaaacauguaugcagaugauacagcggguugggacaccagaauaacugaagacgauuugcaaaaugaagcgaaaauaacagacauaauggaaccugaacaugccuuguuagcaacuagcaucuucaaacucaccuaucaaaacaaagucguaagaguacaaagaccagcuaaaaaugguacuguaauggauguaauaucaaggagagaucagcgcgguucaggacaaguuggaacauauggcuugaauacauucaccaacauggaaguacaacuaauccgccagauggaauccgagggaaucuucuuaccaagcgaacuugaaacgccaaaccuagcagagagagccuuagauugguuagaaaaacauggugcagagcguuuaaagagaauggccaucucaggggaugauugcgucguaaaaccaauugaugaucgauuugcaacagcccuaacggcauuaaacgacaugggaaaaguaaggaaagacaucccccaaugggagccgaguaaaggauggaacgauuggcaacaagugccuuucuguagucaucacuuucaccaacuuauaaugaaagacggaagggaaaucguaguucccugccggaaccaggacgagcuaguuggacgagcucguguuagucaaggugccggcuggagucuaagagaaaccgcauguuuaggaaaguccuaugcccaaauguggcaauuaauguauuuucauaggcgagacuugcgucuugcagcaaaugcaauuugcucugcgguuccuguggacuggguaccugcaucgagaacaacguggagcauccacgcacaucaucaauggaugacaacugaagacauguuaagcguauggaaccgaguauggauagaggaaaauccauggauggaagauaagacucacguaucaaguugggaagaaguuccuuauuuggggaagcgagaagaucaauggugugguagcuuaaucggacugacugcccgugcaacuugggcaaccaacauacagguagcuauaagucaaguuagacgacuaaucggaaaugagaauuauuuagacuauaugacaucgaugaaacgauuuaaaaacgaguccgacccagagggggcauuaugguaa

SEQ ID NO: 22040 - RNA, 9879 nt, Artificial Sequence
  derived and/or modified CDS sequence (opt6) from DENV-1__KC692510__SS-prME
uccgugaccaugcuucuaaugcuacuaccuacagcucuggcuuuucaccuaacgaccagagguggagaaccacacaugauaguaagcaaacaagaacggggaaaauccuugcucuuuaaaacgagcgccgguguuaauaugugcaccuuaauugcaauggaucugggagaauuaugugaagauacuaugacauauaaguguccgaggauaacugaagcugaaccagaugauguugacugcugguguaacgcaacugauaccuggguaacuuacggaacguguagucaaacaggggaacaccgacgagaaaaacgaagcguagcacuagcaccucauguggguuuaggauuagaaacacggacggagaccuggauguccagcgaaggugcauggagacaaauucaacgcguugaaacaugggcuuugagacacccaggauucacaguuauugcguucuuucucgcccaugcgauaggaaccucuauaacacaaaaaggaauuaucuucauacuguuaauguuaguuacucccagcauggcaaugagguguguagggauaggaaaucgagauuuuguugaagggcuaucaggagcaaccuggguagacgugguacuugaacacggaucguguguaacaacgauggcaaagaauaaaccuacguuggauauagaauuacuaaaaacugaaguaacgaacccagcuguauuacgaaaauuguguauagaagcgaaaauaucuaauacuaccacugacucccguuguccaacucaaggcgaagcuacccugguugaagaacaagacgcgaauuucguguguagaagaacauuuguagaccguggaugggggaacgggugcggauuauuuggaaagggaucacuuuuaacaugugccaaauucaaauguguaacaaaauuagaaggaaaaaucguucaauaugaaaaucuuaaauacucuguaauuguaacggugcauacaggagaucaacaucaaguaggcaacgagacaacagaacacggaacuauagccacaaucacaccacaggcucccaccagcgaaauucaacuuacagauuauggcgccuuaacgcucgauuguagcccacguaccggcuuagacuuuaaugagaugguauugcuuacaaugaaagaaaaaucgugguugguacauaaacaaugguuucuugacuuaccuuuacccuggacguccggugcuucuacuagccaggaaacauggaauagacaagacuuacucguaacauuuaaaaccgcgcacgccaagaaacaagagguaguaguucuugguagucaggaaggagcuaugcacacagcacuaacuggggcaacugaaauucaaaccucaggaacgaccacaauuuuugcaggacaucuaaaauguagguuaaaaauggauaaacuaacauuaaaagggaugaguuaugugauguguaccgggaguuuuaaacuugaaaaggaggucgcggagacacaacaugguacgguccuagugcaagucaaguaugaggguaccgaugcgccuuguaaaauaccauuuaguacucaggacgagaagggagucacacaaaauggacgccucauaacagcaaacccaauaguuacagauaaagaaaagccuguaaauauugaaacugagccuccguucggugagaguuacaucguggucggggcaggagaaaaagccuuaaagcucagcugguucaagagaggaucaucgauuggaaaaauguucgaagcaacagcgagaggggcaaggcgaauggcuauauuaggugauacugcaugggacuuuggaucuauuggcgguguuuuuacuucagucggcaaacucguucaccaaguauuugggaccgccuacgguguguuauuuagcggaguaaguuggacaaugaagauagggauuggcauacuucuaacauggcucggcuugaacagcaggucaacuucuuuaagcaugacuuguauagcaguugggaugguaacacuguaucuaggaguaaugguucaggcugauagcggauguguuauaaacuggaagggucgagaguuaaaaugcgggucggguaucuucgugacaaaugaaguccauacuuggaccgaacaauauaaauuucaagcagauucgcccaaaagacuaagugcagccauuggcaaagcaugggaagaggggguaugcggaauaagaucugcaacaagauuggagaauauuauguggaaacaaauaucaaacgaauuaaaccauauucuauuagagaacgauaugaaauuuaccguaguggugggcgacgcuaacgggaucuuggcacagggcaagaagaugauacguccacagcccauggaacacaaauacaguuggaaaagcugggggaaggcaaaaauuauaggcgcagacauacaaaauacuacauuuauuauagacggaccggauacaccugagugcccagauggccaacgggccuggaauauaugggaagucgaagacuacggguuugguguuuuuacaacaaauaucuggcuaaaauuaagggauuccuauacacaaaugugugaucaccgacucaugucagcagcaauaaaggauagcaaggcaguucaugcagacaugggcuauuggaucgaaagugagaaaaacgaaacauggaaacuugcaagggcaucguucauugaaguaaagacauguacguggccaaaaucacauacuuuauggagcaauggcguucuggagucggaaaugaucaucccaaaaaucuucggcggaccaauaucccagcauaauuacaggccaggauacuucacucagacagcaggaccuuggcacuuaggcaaacuugaauuagauuuugaucuuugugaggggaccacaguaguaguagaugaacacugcggaaaccgagggccaucuuuaagaacuacaacgguuacaggaaaaaucauacaugaaugguguuguagaaguugcacacugccaccauuacguuucaggggugaagacgguugcugguaugguauggagauuagaccuguuaaggaaaaagaagaaaaucuaguacggucgaugguaucagcaggaucgggagaaguggacaguuuuagcuuagggauuuuaugcguuucaauaaugauugaggagguuaugagaucgagauggaguagaaaaaugcuuaugacugguacacuagcaguuuuucuacuacuuauuaugggacaguuaacuuggaacgauuuaauccgacuauguauaaugguaggagcaaaugcuagugaucgcaugggaauggguacgacuuaccuagcuuuaauggcaacuuuuaaaaugagacccauguuugccgucggacuacuguuccgucgauuaacaucaagggagguccucuuauuaaccauuggcuuaaguuuaguagcgucuguagaacuccccaacagcuuagaagaauugggagacggccuagcaaugggaauuaugaugcuuaaacuauuaacugaauuucagccgcaccaacucuggacaacuuuguugucacuaacauucguaaagacuacauuaaguuuagacuaugccuggaaaaccacagcuaugguucuaagcaucgucucauuauuuccauuauguuugaguacgacuucacaaaagacuacauggcuaccaguguuacuugggucuuucggauguaaaccuuuaacaauguuuuugaucacggaaaauaagaucugggggcguaagucauggccacuaaaugaaggaauaauggcgauaggaauuguuucuauauuacuuucuucauuacuaaagaacgacguuccacuagccggaccgcuaaucgcuggugguaugcuaaucgccuguuauguaauaucaggauccagugcggacuuaucauuagagaaggcagcugaaguaucaugggaacaagaagcagaacacaguggagcaucucacaauauacugguagagguucaagaugacggaacaaugaagauaaaagaugaagaaagagacgacacacuaacaaucuugcuaaaagccacucuauuagcaguaucuggcgucuacccaaugucaauuccugcaacucuuuuugugugguauuuuuggcagaagaagaaacaacgaaguggaguauuaugggauacaccaucuccgccugagguugaaagggcuguuuuagaugauggaauauauagaauuuuacaaagaggacuuuuaggaagaucacaagucggugucggagucuuucaagauggaguauuucauacuauguggcaugucacuagaggcgccgugcuaauguaucagggaaagaggcuagagccaagcugggcaucugucaagaaagacuuaaucaguuacggcgggggcuggcgcuuccaggggucauggaacacaggggaagagguucaagucaucgcgguagagccaggcaaaaauccaaagaacguacagacaacuccaggaacauuuaaaacacccgaaggugaaguaggagcuauagcucuugacuucaaacccggaacaaguggguccccuaucguuaauagagaaggaaaaauaguaggccuuuacggaaauggcguugugaccacgaguggcacuuacgucucggcaaucgcccaagcaaaagccagucaagaggggccauuaccggagauagaagaugaaguauucaagaaaaggaauuugacgauuauggaccugcauccagggagcggcaaaacccgacgauaucuccccgccaucgugcgcgaggcgauaaagaggaaacuucgaacauugauuuuagcaccgacaagaguuguggccagugaaauggcugaagcauuaaaggguaugccuauaagguaccaaacuacugcgguaaaaucagaacauacggguagagaaauuguagaccuuaugugucacgcgacauuuaccaugagauuauuaucacccguacgaguaccaaacuauaauaugauuauaauggacgaggcacacuucacagauccugcaagcauagcagcccgaggcuauauaucgacacggguaggcaugggugaagccgcagcuauauucaugacagcgacaccuccuggaucaguggaagcauucccacaaucaaacgcugugauacaagaugaagaaagagacauuccagagcguaguuggaacagcgguuaugauuggauaacagauuuucccgguaaaacugucugguuuguaccaucuauuaaaucaggaaacgauaucgcuaauugccugaggaaaaacgggaaacgugucauacaauugaguagaaagacuuucgauaccgaauaccagaaaacgaaaaauaacgauugggacuacguaguaacuacugacauaucggaaaugggugcaaacuucagagcugauagaguuauagauccucguagaugccuaaagccagucauacuaaaggacgggccagagcgaguuauucuggcgggaccaaugccggucacaguggcuuccgcugcucaacgaagagguagaauaggaaggaaucaaaauaaagaaggagaucaauauguuuauaugggucaaccuuuaaacaaugaugaagaucacgcacacuggacugaggccaaaaugcucuuagauaauauuaauacgccugaagguauaauuccggcacuauuugaaccggaaagagagaaaucggcugcgauagacggagaauauagauuaagaggugaagcacgcaaaacuuuuguagaguugaugagacgaggagaucuuccuguaugguuaucauacaaagucgcgucggaaggauuucaauauagugauagaagauggugcuucgauggcgaaaggaacaaccaaguacuggaggaaaauauggauguugaaauauggacaaaagaaggugaacggaaaaaguuaaggccgagaugguuagacgcucgaacguauucagauccacucgcguugcgugaauuuaaggaguucgccgcugguagacgaagcguaucgggcgauuuaauacuagaaaucgggaaauuaccacaacacuuaacacuacgggcucaaaacgcauuagacaauuuaguuaugcuacauaauagcgaacagggugguaaggcuuacaggcaugcuauggaagaacuaccagauacgauagaaacgcuaaugcuauuggcgcuaauagcgguacucacuggaggagucacuuuauucuuucugucugggaaaggucugggaaaaacauccauaggacuuuuaugcguaaccgcuucuagugccuuacuguggauggcaucuguugaaccucacuggaucgccgcgaguauaauccuagaauuuuuccuaaugguauuacuuauuccugaacccgaccgacaaagaacaccgcaagacaaccaauuagcguacguaguaauaggacuacucuucaugauucuaacuguggcugcaaacgaaaugggucuauuagagaccacuaaaaaggauuuagggauuggauauguagccgccgaaaaucaccagcacgcuacaauguuggauguggacuuacauccagcaucugcauggacccuguacgcaguggcaaccacaguaauuacuccuaugaugaggcauacuauagaaaacacgacggcuaauaucucacuuacggccauugcaaaccaggcagccauucuuaugggacuugacaaaggauggccgaucucgaaaauggauauaggaguuccacuccuagcucugggcuguuacucgcaagugaauccucuaacguuaacagcagccguauuaaugcucguagcgcauuacgccauaauugguccaggacuacaagcgaaagccacacgugaagcacaaaagaggacagcagcagguauaaugaaaaacccaacaguugacgguauaguggcaauugaccuagauccuguaguuuacgacgcgaaauucgaaaagcagcuaggacaaauaaugcuacuaaucuuauguacaagucaaauucuacuaaugaggaccacuugggcauuaugugaguccauuacucuugcaacagguccuuuaaccacccuaugggaagggucaccuggcaaauuuuggaacacuacaauugcagugucuauggcgaauauuuucagaggaucauaccuugcaggagcgggucuggcauucagucuaaugaaaucauuagggggagguagacgagguacuggugcacaaggagaaaccuugggcgagaaauggaaacgucaacuuaaccagcuuaguaaauccgaauuuaauaccuacaaacguucuggaauaauggagguagacagaucagaggcaaaagaaggacugaagcgaggagagaccacuaaacacgcagucucgcgaggcacugcaaaacuccguugguucguagagaggaauuuagucaagccggaggguaaggucauugaucuuggcugugguaggggaggauggagcuacuauugugcuggauugaagaaagucacugaaguaaaaggauauacaaaaggaggaccagggcaugaagaaccaauacccauggcaacguauggguggaacuugguaaagcuacauucaggcaaggaugucuucuucaugcccccugaaaaaugugauacacuccuaugcgauauuggagaaucuaguccgaauccaacuauagaagaaggaagaacccugcgaguguuaaaaaugguagaaccuuggcuacgcgggaaucaauuuugcauaaaaauauugaaccccuauaugccaagugucguugaaacacuugaacagaugcaacgaaaacauggcggcaugcuagucaggaauccauuaagucgaaacaguacgcaugagauguacugggugucuugcgguaccgguaauaucguuucagccguaaauaugaccucaagaauguuacuuaaccgcuucaccauggcgcaccgaaagccuacguacgagcgcgauguugaccugggcgcuggaacucgacacguagccguagaaccagaaguggcaaaccuagauauaauuggacaacgaauagaaaauaucaaaaaugagcacaagaguacguggcauuaugaugaggauaauccuuauaaaacaugggcauaucacgguucauaugagguuaaaccaucuggaucagccucuuccaugguaaauggaguaguucgucuacuuacgaaaccaugggauguaauaccaaugguaacacagauugcaaugaccgauacuaccccuuuuggacaacaaaggguauuuaaggaaaagguagauacacguaccccacgugcuaaaaggggcacaacacaaauuauggaaguuacagcuaaauggcugugggguuuccuuucucgaaacaagaaaccaaggauuugcacucgagaggaguucacacggaaagugagaagcaacgcagcaauaggggccguauucgucgaugaaaaccaauggaacucagccaaggaagcaguagaggaugaaagauuuugggacuuaguacauagggaaagagagcuccauaaacaagggaaaugugcaacaugcguauacaacaugauggggaaaagagagaagaaacuuggugaguucggcaaagccaaaggaucuagagcgaucugguacaugugguuaggugcaagauucuuagaguucgaggcucuugguuucaugaaugaagaccauugguucagucgcgaaaauucuuuaagcggcguagaaggugaaggucugcauaagcuaggauauauacuaagagauauaucuaaaauucccgggggaaauauguacgcggaugauacugcugguugggacacccggauaacggaagacgacuuacaaaacgaagcaaaaaucacugacaucauggaaccugagcaugcucucuuagccacaaguauauucaaacuuaccuaucagaauaaagucgugaggguacaaagaccagccaaaaacggaacuguaauggaugucauuucgagacgugaccaacgaggauccgggcaaguagggacauauggccuaaacacauucacaaauauggaaguacaauuaauucgccaaauggaaagcgaggggauauuccuccccagcgaauuagaaacacccaacuuagccgaaagagcauuagacugguuggaaaaacacggugcagagagauuaaagagaauggcgauaaguggggacgauuguguuguuaagccaaucgacgauagguucgcgacagcucucacagcgcucaacgauauggggaagguuagaaaggauauuccucaaugggaaccaucuaaaggguggaaugauuggcaacagguaccuuucugcagccaucauuuccaucaacuuauaaugaaggacgguagggaaauaguuguuccaugucgaaaccaggaugagcuagugggacgagcgagaguaucacaaggugcaggauggucauuacgggaaacggcaugccuugguaagagcuaugcacaaauguggcaauuaauguacuuucacagaagggaccuaaggcuugccgcgaacgcuauuugcucugcaguaccaguagauuggguacccgcaucgagaacuacguggucuauucaugcccaucaucaguggaugaccacugaggauaugcucucuguuuggaaucgaguuuggauagaagaaaauccguggauggaagauaaaacccacgucucaucaugggaagaaguaccauacuuggguaaacgagaagaucaauggugcggaucucuuaucggauugacggcgcgugcgaccugggcaacgaauauucaagucgcuauaaaucaaguaagacggcucauagguaacgaaaacuacuuagauuauaugacuuccaugaaaagauuuaagaacgagucggacccagaaggagcccuuugguaa

SEQ ID NO: 22041 - RNA, 9879 nt, Artificial Sequence
  derived and/or modified CDS sequence (opt6) from DENV-1__KC692511__SS-prME
ucuguaacaaugcuccugaugcuacuccccacggcuuuggcauuccaucucacuacacgagggggugaaccccauaugaucguaucaaaacaagaaagagggaaaagucuucuauucaaaacuucaguaggaguuaacauguguacccuuaucgcgauggauuugggagaauuaugcgaagacacaaugacauacaaaugcccccggauaacagaagcggaacccgacgacguagauuguuggugcaaugcaacagacacauggguaacauauggcacgugcucccaaacaggugaacaccgaagagacaaacgaucggucgcacuugcaccccauguaggauuaggucuagaaacgcguacugaaaccuggaugucguccgaaggggcuuggaaacaaauacaaaaaguugaaaacugggcacucagacaccccggcuucacgguaauagcauuauuucuagcacaugccauugguacgucaauaacacagaaagggauuauuuuuauuuugcugauguuaguaacaccuagcauggcaaugagaugugucgguauaggaaauagagauuuuguagaagggcuauccggugcuacauggguugacguagugcuugaacacggaucgugcguaaccacaauggccaaaaacaaaccaacacuagacauagaacuuuuaaaaacagaagugacaaacccagcgguucuuagaaaauugugcauugaagcuaaaauaagcaauacuaccacugacaguagaugcccaacgcaaggugaagcgacauuaguugaagaacaagaugcgaauuucguuugucgucggacuuuuguggacagaggaugggguaacggaugcggcuuguucgggaaaggcagucuauugacuugcgcgaaauucaaaugcgucacaaaauuagaaggcaaaauagugcaauaugaaaauuugaaauauucagugauagucacagugcauacaggggaucagcaccaaguggguaacgaaacuacagaacauggaacaauugcuacaauaacuccacaagccccaacuucugaaauucaacugaccgauuauggggcgcuuacacuugacuguagcccacgcacaggucuugacuucaaugaaaugguccuuuuaacuaugaaagagaaaucaugguugguccacaaacaaugguuccuagaucuaccacuuccguggaccuccggugcguccacaucacaggagacuuggaaccgacaagauuuauugguaacguuuaaaacagcucaugccaagaaacaggaagucgugguauuagguagccaagaaggagcuaugcauacagcucugacgggagcgacggaaauucaaacaucagguacaaccacuauauuugcgggacauuugaaaugcagauuaaaaauggauaaauuaacauuaaaaggaaugucguaugugaugugcaccgggagcuucaaauuggaaaaagaaguggcagaaacucagcauggaaccguccuuguucaaguuaaauaugaaggcaccgacgcaccauguaaaauaccauuccuaacucaggacgaaaaaggaguaacucagaaugggcguuuaauaacugcaaacccaauaguuaccgauaaagagaaaccaguaaauauagaaacugaaccuccauuuggagaaucauauaucguuguuggcgcaggagaaaaagcucugaaauuaucuugguucaagaaagguucuagcauuggaaagauguuugaagcgacggcaagaggggcacgccgaauggccauuuugggggauaccgcuugggacuuuggcagcaucgguggucuauuuacaucaguaggaaaacuuauucaucaaaucuuuggaaccgcguauggcguacuauucaguggugucaguuggaccaugaaaauagggaucggaauauuacuaacuuggcuaggauuaaacucaaggaguacaucgcugucuaugacuugcaucgcgguagguaugguuacacuauaucuaggaguuaugguacaagcagauucuggcugcguuaucaauuggaagggaagagaacuuaaaugugggucaggaauuuucgucacuaaugagguucacacauggaccgagcaauacaaauuccaagccgacucaccuaagagauugagugcagccaucgguaaggcaugggaggaaggaguaugugguauacguagugcaaccagacuagaaaauauaauguggaaacaaaucucuaacgaauuaaacuacauacugcuagaaaacgacaugaaauuuaccguuguuguaggggauauuaacggcauucuagcucaagguaagaaaaugauaagaccucaaccaauggaacacaaauauucguggaaaucauggggcaaagcgaaaauuauaggagcugauauucaaaauacuacguuuauuauagaugguccagacacgcccgaaugcccuaacgaucaaagggcuuggaauauaugggaaguagaagacuauggcuuuggaauauucacaacaaauauaugguugaaacuacgugacagucacacucaaaugugugaucauagacuaaugucagcugcaauaaaagacucuaaagcaguccaugcugauaugggguauuggauagaaagcgaaaagaacgaaacauggaaauuagcaagagccaguuuuaucgaaguaaaaacuugcauauggcccaaaucacauacauuauggucuaacggaguccuugaaucggagaugguaauacccaaaauuuacggaggucccauaucacaacacaauuauagaccgggcuauuucacacaaacugcaggaccauggcaucugggaaaauuggaauuggauuuugaucuuugcgaaggaaccacuguaguaguggacgaacacuguggauauagggguccgucucucagaacgacaacaguuaccgggaaaauuauccacgaauggugcuguagaaguugcacccuaccuccccuuagguucagaggcgaagauggaugcugguacgggauggaaauuaggccuguaaaggaaaaagaggaaaaccucguacgaucaaugguuucugcugguuccggugaaguagacucauuuaguuuagggaucuuauguguaucuauuuuaauagaggaagugaugcgaaguagauggucuagaaaaaugcuaaugaccgguacguuagcaguauuccuauuacuuauuaugggucaauugaccuggaacgaccugauuagacuuuguauaauggucggagcaaacgcuagcgaccgaauggggauggggacgaccuaccucgcucuuauggcgaccuucaagaugagaccaauguuugcuguagguuuauuauuucggcgucuaacaagccgagaaguacuuuuacuaacaguugguuugucucugguugcgagugucgaauuaccuaauucucuagaggaacucggagauggccuagcuaugggaauuaugaugcuaaaauuacugacugauuuucaaccucaccaauuauggaccacccuacugagucuuacuuuuauucgaacuucauuaagucucgauuaugcauggaagacaauggcaauggcauuaucaauugugucguuauuccccuugugccuaagcacaacaucucagaaaacaacuugguuaccgguacuacuaggaaguuucgguuguaagccucugacaauguuucuuaucacugaaaauaagauauggggcaggaaauccuggccaauaaaugaggguauuauggcaguugggauaguaucuauuuuauuaucaagccuacucaagaacgauguaccguuagcaggcccauuaauagcuggugggauguuaauagcauguuacgucauaucaggaucaucagcagacuuaucgcuugagaaagcagcggaaguaaguugggaagaggaggcggagcacuccggaaccucacacaauauacuuguagaaguccaggaugacggaacaaugaaaauaaaagaugaggaaagagaugauacccugacuauacuguugaaagcaacacucuuagcugucucggggguuuaucccaugagcauuccugcuacauuauucguuugguacuuuuggcagaaaaagaaacaaagaagcgggguuuuaugggacacaccgucuccgccggaaguugaacgagcgguacuugaugacggaauauaccggauucugcaaagagggcuacucggcagaucacaagucggcgugggaguauuucaagaugguguauuucacacgauguggcacguuacuagaggagcaguacuuauguaucaaggaaaaagguuagaaccaucaugggcgagcgucaagaaagauuuaauuaguuaugggggaggguggagguuucagggcucauggaacacaggagaagaagugcaaguaauugccguggaaccugguaaaaauccuaaaaacgugcaaacgacaccaggaacauuuaaaacuccagagggagaaguaggagcaauagcgcuagacuuuaaaccuggaacaucaggaaguccgauugucaacagagaagguaaaaucgucggucuuuacggaaaugggguggugacuaccucuggcacauauguuagugcaauagcucaagcuaaagcaacacaagaagguccuuuaccagaaauugaagaugaaguuuuuaagaaacgaaaccucaccauuauggaccuacauccgggaagcgguaaaacccguagauaccugccugcgaucgugcgugaggcaaucaaacguaagcugcguacauuaauucucgcaccaacccgcguaguggcuuccgaaauggccgaggcuuuaaaagguaugcccauucgauaucaaacuaccgcugucaaaagugaacauacaggacgggaaaucguugaucuaaugugccaugcaacauuuacgaugcgauuacuuuccccaguccgcguaccgaacuauaauaugaucaucauggacgaagcucauuuuaccgauccugcuagcaucgcugcucggggcuacauuuccacacgcguagguaugggcgaagcggcagcaauauuuaugaccgcuacaccacccgguuccguugaagccuuuccgcaaaguaaugcaguaauacaagaugaagaaagggauauccccgaaaggucuuggaauagugguuaugauuggaucacagauuuccccgguaaaacgguuugguuugugccguccaucaaauccggaaaugauauagcaaauuguuuaaggaaaaaugggaaaagagugauacaacugagccgaaagacauucgacacagaauaccagaagaccaaaaauaaugauugggauuacguaguaacaacugauauaagugaaaugggagcuaauuuucgggcagaucguguaauagauccccgaagauguuuaaagccaguuauuuugaaggaagguccagaaagaguaauucucgcggggcccaugccaguaaccguggcgagugccgcgcaaagacggggacgaauugguagaaaccaaaacaaagagggagaccaauauauuuauaugggccaaccacuaaacaacgaugaagaucacgcccauuggacagaagcgaaaauguuauuagacaauauaaauacuccagaggguauaauaccagcgcuauucgagccggaacgcgaaaagagcgccgcaauugacggagaauauagauuaaggggagaagcacgaaaaacauucguugaguugaugagaaggggugacuugccaguuuggcuuaguuacaagguagccuccgaggguuuucaauauuccgaucggcgauggugcuuugauggggaacgaaauaaucaagucuuagaggagaauauggacguagaaauauggacgaaggaaggagaaaggaagaaacuucguccaagauggcuagaugcacgaaccuacucggacccgcuagcgcuacgagaauuuaaagaguuugcagcgggaagaagaucugucucaggugaccucauacuggaaauagggaaauuaccucaacaccugacacugcgugcacagaaugcguuggauaacuugguaauguugcauaauuccgaacagggcgggaaggccuaucgccacgccauggaggaacuuccagauacaauagaaacacuuauguuguuggcacuaauagcuguuuugacgggagguguaacguuauucuuucuaucaggaaaaggauugggaaagacaucaauagguuuauuauguguaauggcgagcucagcgcugcuuuggauggccagcguggaaccacacuggaucgccgcaucaaucauucuggaguucuuccuaaugguacucuuaauucccgagccagacagacaacgaacuccucaggauaaccaacuagcauauguuguaauaggauuauuauuuaugauauuaacaguagccgcuaacgaaaugggacuacuugaaaccaccaagaaagaccucggaauaggucacguggcaguggaaaaccaccaucacgcuacuaugcuugauguugacuugcgcccagcgagugcauggacccuauacgcaguggcuaccacgguaaucacgcccaugaugcgccacacaauagaaaacacuaccgcaaauaucucacugacagcaauagcuaaccaagcggcaauauugaugggguuagauaaggguuggccaauuucaaaaauggauauugggguaccccuuuuagcacuaggauguuauucacaaguaaauccucugacauuaacugccgcuguauugaugcuagucgcccauuacgcuauaaucggaccuggauuacaggcaaaagcuacaagagaggcacaaaaacgaacugccgccgguauuaugaagaauccgaccguagacgggauagucacaaucgauuuagacccaguugucuaugaugccaaauucgaaaagcaacuaggacagauaaugcuucuaauucuauguacaagccagauucuacuaaugcgaacaacuugggcauuaugcgagaguaucacguuagcuaccgguccucugacaacuuuaugggaaggcuccccagguaaguuuuggaacacaaccauagccguuucuauggcuaauaucuuuagaggaucauaccuagccggagcaggcuuagcuuuuaguuuaaugaaaagucuaggcgguggccgaagaggcacaggggcccaaggagaaacauuaggugaaaaauggaaaaggcaauugaaucaacuaagcaaaagugaguucaacacuuauaagaaauccgguaucauggagguugauagaagugaagcaaaagaaggacuaaaaagaggagagacaaccaagcaugcggucagccgcgguacugcaaaauuacgaugguuuguagaacguaaccuaguuaaaccagaagggaagguaaucgaucuuggcugugguagggguggcuggaguuacuauugugcaggauugaagaaagugacagaagucaaaggauauacuaaaggaggacccggucaugaggaaccaauuccgauggcaacauauggauggaaucuaguuaaacuacauuccgguaaagauguauuuuucacuccuccggaaaaaugcgacacgcuacuaugugacauuggagaauccaguccaaacccaacaaucgaagaaggccguacccugagaguucuaaaaaugguggaacccuggcuaagagguaaucaauuuugcauaaaaauuuuaaacccauauaugccuucgguaguagaaaccuuagaacaaaugcaaaggaagcacggaggaauguuaguaagaaacccucuaagucguaauucuacucaugagauguauuggguaaguugcgguacagguaacauaguauccgcggucaacaugacuucuagaaugcuucuaaaucguuucacaauggcacaucggaagccuacauaugaacgagauguugaccucggugccgggacaagacaugucgcuguugaaccagaagucgcuaauuuagauaucaucgggcaacgcaucgaaaacauuaaaaaugagcacaaauccacauggcacuacgaugaagauaauccauauaagaccugggcauaccacgggaguuaugagguaaaaccuuccggaagugcaucuagcaugguaaacggggucgugagguuacuaacaaagccaugggauguaauuccgaugguuacacaaauugcaaugacugauacuacgcccuucggacaacagagaguguuuaaagagaaaguggauacacguacaccucgggcuaaaagaggcaccgcacagaucauggaaguuacggcgaaaugguuauggggguucuugagucggaacaagaaacccagaauuuguacgagagaggaguuuacuagaaaaguucguuccaacgcagccaucggagcaguauucguagaugaaaaccaguggaacagugcaaaagaagcagucgaagaugaaagauuuugggaccuaguccaucgagaacgagaauuacauaaacagggaaaaugugccacuugcguauauaauaugauggguaaacgugaaaagaaauuaggagaguucggaaaggcgaagggaucacgagccauaugguauauguggcuaggggcaagauuucuagaguuugaagcacuagguuucaugaaugaagaucauugguuuucacgugagaacucauuaagcgggguagaaggggaaggacugcacaagcuagguuauauccuaagagauauauccaaaauccccggagguaauauguaugcagaugauacagcaggaugggacacgaggauaacugaagaugaucuacaaaaugaagcgaaaaucacugacaucauggagccugaacaugcacuucuggcuacaagcauauuuaaacuaaccuaucagaauaaagucguacgugugcaaagaccagcgaaaaguggaaccgucauggacguaaucucacguagggaucagaggggaucuggucaaguagggacuuacggacuaaauacguuuaccaacauggaaguacagcuaauaagacagauggagagugaagguaucuuuagucccuccgaauuagaaacaccuaaucucgccaagaaagucuuagauuggcucgaaaaacauggagcugaacgauuaaaaagaauggcgauuagcggagaugauugcguaguuaaacccauagacgaucgauucgcuacagcauugacugcacuaaacgacauggguaagguaagaaaggacauuccgcaaugggaacccaguaaaggcuggaaugacuggcaacaaguuccauuuugcucgcaucacuuucaucaacugauaaugaaggacggaagagaaaucguaguaccauguagaaaucaagaugaauuaguaggaagggcgagaguaucucagggagcaggguggagucucagagaaaccgccugccuagggaaauccuacgcucagauguggcaacucauguacuuucaccgaagagacuugaggcuugcugcaaacgcaauuuguucagcaguaccgguagacugggucccuacuucuagaacaacguggaguauucaugcacaucaucaauggaugacaaccgaagacauguuaucaguauggaacagagucuggaucgaggaaaacccauggauggaagauaaaacccauguuucuaguugggaagaagucccauacuuaggaaagagggaagaccaauggugcgggucacuaauuggacugacagcacgagcuacaugggcuaccaacauucagguagccaucaaucaaguacgccgauugaucgguaaugaaaauuaucuugauuauaugaccucaaugaaaagauucaaaaaugagucugacccagaaggggcucuuugguaa

SEQ ID NO: 22042 - RNA, 9879 nt, Artificial Sequence
  derived and/or modified CDS sequence (opt6) from DENV-1__KC692512__SS-prME
ucaguuacuauguuguugauguuauuacccacagcucuagcauuccaucuuacgacaagagggggagaaccucauaugauaguuuccaaacaagaaaggggaaaaucgcugcuauucaaaacaucagcuggagucaauauguguacgcucauagcaauggauuugggggaauugugugaagauacuaugacguacaaaugcccaagaaucacagaggcugaaccagaugacguugauugcugguguaaugcaacagauacaugggucacauacgguacuuguagucaaacaggcgaacauagacgugaaaaacgaucaguugcccuagcuccacacgugggccugggguuagaaaccagaacugaaacuuggaugaguucugaaggagccuggaaacaaauacaaagaguagagacaugggcauuacggcaccccggauuuacaguaauagcucuuuuucuugcucaugcuauaggaacaagcaucacacaaaaaggaauuaucuuuauacuauugaugcuaguuacaccuagcauggcaaugagaugcgugggaauaggcaaccgggauuuuguagaaggguugagcggugcuaccuggguagaugucguacuggaacaugggucauguguaacaacaauggccaaaaauaaaccaacauuagauaucgaacuucugaaaacggaagucacuaauccagcaguucucagaaaacuuugcauugaggcuaaaauauccaacacaacgacugacucccgauguccaacacaaggagaagcaaccuuaguggaggaacaagaugcuaacuucguaugucgccguacauuuguagaucguggaugggguaaugguugcgggcucuuuggaaaaggcaguuuacuaacuugcgcaaaauuuaaauguguuacaaaacuagaaggcaaaauaguacaauaugaaaaucuuaaauauucaguaauugucacuguucacacuggcgaucaacaccaagucgguaaugaaacaacagaacauggcacuaucgccacaauaacaccacaagcaccgacaagugaaauccaacuuacugacuacggggcgcucacgcucgauuguucaccuagaacagguuuagacuuuaaugaaaugguuuuacucacuaugaaagaaaaaucauggcuuguacacaaacaaugguuuuuggaucuuccuuuaccauggacaucgggcgcguccacuucgcaagaaacauggaaccggcaagaucugcuaguaaccuuuaaaacugcgcaugcgaagaaacaggagguuguagugcuagguagccaggaaggagcaaugcacaccgcauuaacaggcgccacagaaauacagacuucaggaacgacgacaauauuugcuggacacuuaaaaugccguuuaaaaauggacaaacuaacacuuaaaggcaugucauacguuauguguaccggaaguuuuaagcuagaaaaagagguggccgaaacccaacacgguacaguacucguccaaguaaaauaugaagguacagaugcacccugcaaaauacccuuuucuacucaggacgaaaagggagugacccaaaaugggcgucugauaaccgcaaacccaaucguaacagacaaggaaaaacccguuaauauagaaacagaaccaccauuuggcgagucauacaucguuguuggagcuggagaaaaagcgcuaaaacuuagcugguuuaaacgcggaucgucgauugggaaaauguuugaagcuacagcaagaggcgcaagacggauggcaauuuuaggggauacagcgugggacuuugggucaauagggggagucuuuacuucuguuggaaagcuagugcaucaaguauuugguacugcuuacgguguucucuuuuccgggguaucguggaccaugaaaaucgggauagggauucuguuaacauggcuuggacuuaauucaagguccaccagcuugucaaugacauguaucgcagugggcaugguaacauuguaucugggcgucauggugcaggcggauucuggcugcgucaucaauuggaaaggaagagaacuuaaguguggaucuggaauauuuguuacaaacgagguccauacauggacagaacaguacaaguuucaagcagauucaccaaaaaggcuaagugcagcuauaggcaaggcuugggaagaaggcguuugcggcauaagaucggcaacaaggcuugaaaacauaauguggaaacaaauuaguaaugagcuaaaccauauacuucuggaaaacgacaugaaauucacgguaguugucggggaugccaaugggauuuuagcccaaggaaagaagaugauacggccucaaccaauggaacauaaauacaguuggaaaucguggggcaaagcuaagauaaucggagcggauauccaaaacacgacuuuuauuaucgacggaccagauacaccagaaugcccagauggacaacgagccuggaacauuugggaaguagaagauuauggauucggaguauucacaacgaacauuuggcuuaaauuaagagauuccuacacccaaaugugcgaccauagauuaaugagugcagcgauuaaggacaguaaagcgguucacgcugauaugggguauuggauagaaucagagaaaaaugaaacuuggaaguuagcucgagcuucauuuaucgaaguaaagacguguacuuggccaaagucacacacgcuauggagcaacggaguuuuagaguccgaaaugauaauacccaaaaucuucggcgggccgauaucacaacacaauuauagacccggcuacuucacacagaccgcagguccguggcaccucgggaaauuagaacuggacuuugacuuaugcgaagggaccacggugguaguugaugaacacuguggcaaccgggguccgagcuugagaacuacaacgguaacagguaaaauuauacaugaaugguguugcagaucuugcacucuuccaccuuuaagauuuagaggagaagacggcuguugguauggaauggaaauucggccaguaaaggagaaggaggagaauuugguacgaaguaugguuagcgcuggguccggugaaguugauaguuuuaguuuggggauacuguguguaagcauaaugauugaggaagucaugcguucgagauggucuagaaaaauguugaugacaggaacauuagcaguauuccuccuuuuaaucaugggucagcuaacuuggaacgaucucauucgccuauguauuaugguuggagcuaaugcaucggauagaaugggcaugggaacuacauauuuagcacugauggccacauuuaaaaugagaccaauguucgcuguaggucuauuguuucggaggcuaacuagcagagagguccuccuacuaaccaucggccuaaguuugguugccucgguagaauuaccgaacaguuuggaagaacuuggcgacggccucgcgaugggaauaaugaugcucaaauugcucacugaauuucagccacaucaacuguggacaacauuauuaagccuaacauucguaaagacaacauuaucacuagauuacgcauggaaaacuacagcaaugguuuuaucuauagugucacuauucccauuauguuuaaguaccacuucgcagaaaacaacaugguuaccugucuuacuagguucauuuggcuguaagccauuaacaauguucuugauuacagaaaacaagaucugggguagaaaaucuuggccuuugaacgaaggaauuauggccauugguaucguaaguaucuuacuaucaucauuguuaaagaaugacguaccguuggcgggaccauuaaucgcuggaggcauguugauugccuguuauguaauuaguggcagcucugcagauuuaucuuuagagaaagcggccgaaguaucuugggaacaagaggccgaacacaguggugcuucacacaauauccuagucgaaguacaagaugacggcaccaugaaaauuaaagacgaggaacgggacgacacauuaaccauucuauuaaaagcaacccuauuagcggucucagguguauaucccaugucuauuccagcuacucucuuuguaugguacuuuuggcagaagaagaaacagagaagcggaguuuuaugggauacuccaucucccccugaaguagaaagggcaguucuugaugauggcauuuaucgaauccuacaaagggguuuguuaggaagaucucaaguaggagugggaguauuucaagauggggucuuccauacaauguggcacguaacgagaggcgcaguguugauguaccaggggaaacgucuggaacccagcugggccagugugaagaaggauuuaauaaguuauggaggugguuggcguuuucaagguucauggaauacgggagaagaaguacaagugaucgccguagagccaggcaaaaaucccaaaaauguacaaaccacuccuggaacuuucaaaacaccagaaggagaagugggggccauugcucuagacuuuaaaccagggaccucgggcagccccauaguuaaucgagaagagaagauaguuggauuguacgggaacgguguaguaacaacuucaggaacauauguaucagcgauagcacaggccaaagcuagucaagaaggaccgcugccggagauagaagaugaaguauucaagaaaagaaaccuaacaauuauggaccuccauccuggaagugguaaaaccagaagauauuuaccagccauagucagagaggcuauaaaaaggaaacuaagaaccuugauauuggcaccgacccgggucguagcgucagaaauggcagaagcauuaaaaggaaugccuauuagauaucaaacuacugccgugaagucugagcacacggggcgagaaauaguagauuuaaugugucaugcaacauuuaccaugcgucuacucaguccaguacgggugccaaacuauaauaugauuaucauggacgaagcacauuuuacugauccagcuaguauagcagcgagagguuauauuagcacuagggucgguaugggagaagcugccgcuauuuuuaugacggcuacuccgccagguuccguugaagccuucccgcaaucuaacgccguuauacaagaugaagaacgagacauaccggaacgcaguuggaacucggguuacgacuggauuacggacuuucccggcaagacgguaugguucguaccaucaauuaaaagcggaaacgauauagcaaauugucuuagaaagaauggaaagagaguuauacaacuuucaagaaaaacuuucgauacugaguaucagaaaacaaagaauaaugauugggauuauguuguuacaacagauauaucugaaaugggggcuaacuucagagcggaccgaguaauugacccacgucgcugucuuaaacccguaauauuaaaggacggaccugaaaggguaauccuugcggguccaaugccaguaacgguggcaagcgcagcucaacgucgcggucguauuggacgcaaccagaacaaagaaggagaccaauaugucuacauggggcaaccacuaaauaacgacgaggaucaugcucauuggaccgaggcgaaaauguugcuagacaacauuaauacuccagagggaauuaucccagcccuauucgaaccagagagagaaaagagugccgcuauagauggagaauauagacuacggggcgaagcgagaaaaacauuuguggaacuaaugcgaagaggugaucugccugucuggcugucauauaaaguagcuucugaggguuuccaguauagugauagaagaugguguuuugauggugaaagaaauaaucaaguucuagaagagaauauggauguugaaauauggacaaaggagggagagaggaagaaacuccgcccgcgaugguuggaugcgagaaccuauagugaccccuuggcacuaagagaauuuaaagaguuugcagcagggcgacggagcguaucaggugaucuaauuuuagaaaucggaaaacuuccacaacauuuaacauuacgcgcccagaaugccuuagauaaccucguaauguugcacaauagcgaacaaggagggaaggcuuaccgacacgccauggaagaauuaccagauacaauugagacguuaaugcuacuagcguugaucgcaguacugacaggggguguaacuuuauucuuuuuaucaggaaaaggacucggaaaaacaucaauugggcuccuuugcguuacagcauccagcgcgcuacuuuggauggccucagucgaaccccacuggaucgccgccucuauaaucuuagaguucuuccuaaugguauuacuaauuccagaaccagacagacaaagaacgccucaggauaaccaauuagcuuaugucguaauaggauuauuauucaugauauugacgguugcugcaaacgaaauggguuuacuagagacuacuaaaaaggacuugggaaucggacauguugcagcagaaaaucaucaacauucaacaaugcucgauguagaucuacacccagcaucugcguggacacuauacgcaguagcaacaacagucauaacgccuaugaugcgacauaccauagaaaauacaacagcaaauauuucucuaacugcgauagcaaaucaagcggcaaucuuaaugggucucgauaaaggcuggccaauaucuaagauggauauaggggucccauuacuugcccuuggcuguuacucccaaguaaauccccuuaccuuaacagcagcaguuuuaaugcuuguagcucauuacgcaauaauugguccuggacuacaggcaaaagcuacgagagaagcacagaaaaggacagcagcagggauaaugaaaaauccgacuguugacggaauuguugccauagaucuugauccaguaguauaugaugcgaaauucgaaaaacagcuaggacaaauaaugcugcucauauuguguacaucgcaaauacuauuaaugcgcaccacaugggcccuuugugagaguauaacacuugccacagguccacuaacaacauugugggaaggaagccccggaaaauuuuggaauaccacgauugccgugucgauggccaauauuuuucgagguucuuaucuugcuggagcaggacucgcauuuaguuuaaugaaaucauuaggugguggccgucgcgguacaggggcucagggagagacguuaggggaaaaauggaaacgacaauugaaccaacuguccaagagcgaauuuaauacauacaaacggagcgguaucauggagguagacagaagugaagcaaaagaaggguuaaaacggggagaaacuacaaaacaugcaguaucgagaggaacugcaaaacuaaggugguuuguugaacguaaccuaguaaaaccggaagguaaaguuauugaucuagggugcggaagaggcgguuggagcuacuacugugcgggauuaaagaaaguaacggaaguaaaaggauacacaaaaggagguccagggcaugaagaaccaauucccauggcaacauacggcuggaaccuaguuaaacugcauucaggaaaagacguguucuuuaugccacccgaaaaaugugacacguuauuaugugauauaggcgaaaguucuccuaaucccacgaucgaggaaggcagaacucucagaguucuaaaaaugguagaaccaugguuacgaggaaaucaauuuugcauuaaaauacuaaacccauauaugccuucaguaguugaaacucuugagcagaugcaaagaaaacacggaggaauguugguuagaaacccauugucucguaauucuacacaugaaauguacuggguuaguugcggcacaggaaacauagugucugcgguaaauaugacuucaagaauguugcuaaauagauuuacaauggcacacagaaaaccaacguaugaacgagauguugauuuaggugcugguacaaggcauguagcaguagaaccggagguggcaaaucucgauauaaucggucaacguauagaaaacauuaagaacgagcauaggagcacauggcacuaugaugaagauaauccuuacaaaacuugggcguaccaugggucguaugaagugaaaccaagcgggucggcgucaucaauggucaacggcguaguccgacuucuaacaaaaccuugggacguaauacccauggucacucaaauugcaaugacagacacaacacccuuuggccagcaacguguguuuaaggaaaaaguagauacacgaacaccgcgugcuaagcgaggcacuacccagaucauggaggugacggcaaaauggcuauggggauuucuaucaagaaauaagaaacccagaauauguacaagagaagaguucaccagaaaaguucggucgaacgcagcaauuggugcaguauuuguagacgaaaaccaauggaacucggcuaaagaagcugucgaagaugaacguuuuugggaucuuguacaucgagagagagaguuacacaagcaagguaagugugcaacguguguguacaauaugaugggcaaacgagagaagaaacugggagaauuuggaaaagcaaaggguucucgagcuauaugguauauguggcuaggagcaagauucuuagaguuugaagcauugggcuuuaugaacgaagaucacugguucucucgugaaaauucacugucuggaguggaaggugaagggcuacacaaacuuggauacauacuacgcgauaucagcaagauuccugggggcaacauguacgccgaugacacugcagguugggauacgcggauuacggaagaugacuuacagaaugaagccaaaauaacggacaucauggagccagaacacgccuuauuggcgacgagcauuuucaaauuaacauaucaaaacaaaguuguacgaguacaacgaccagcuaagaacgguaccgugauggacguaauaagcagaagggaucaacguggcucuggccaaguaggaacguauggcuuaaauaccuuuacgaauauggaaguucaauuaauaagacaaauggaaagcgaagggauauuuuuaccaucagaacuagaaacaccuaaucuagccgaacgagccuuagauugguuggaaaagcauggugcagaacgcuuaaagcgaauggcaaucucaggggaugauugcgucguaaaaccgaucgaugaccgauuugcuacggcacuaacagcgcucaacgacauggggaaaguacguaaagauaucccucagugggaaccaagcaaaggauggaacgauuggcaacaagucccauuuugcucgcaucauuuccaccaacuaauaaugaaggacggucgagaaauaguagugccauguagaaaccaagacgaacugguaggacgagcacgcguuagucaaggcgcaggcuggagcuuacgggaaacugcauguuugggcaaaagcuaugcucaaauguggcaacuaauguauuuucaccguagagauuugagauuagcugcuaacgcaauaugcucugcggucccggucgauuggguaccggcaagccgaacuacaugguccauacaugcucaccaucaguggaugacaaccgaggacauguuaucaguauggaaccguguauggaucgaagaaaauccuuggauggaggacaagacucacgugucaagcugggaggaaguaccauauuuagggaaacgcgaagaccaaugguguggcucauugauaggccucacugcucgugccacaugggcaacuaauauacaaguggcuauaaaccaaguuaggaggcuaauuggaaacgagaacuaccucgacuauaugacuucgaugaaaagauuuaaaaaugagucagacccagaaggagccuuaugguaa

SEQ ID NO: 22043 - RNA, 9879 nt, Artificial Sequence
  derived and/or modified CDS sequence (opt6) from DENV-1__KC692513__SS-prME
ucgguuacuaugcuauuaaugcuacuuccaacggcucuugcauuucaucuaacgacuaggggaggggaaccucacaugauuguauccaaacaagaacgcgggaaaucucuauuguuuaaaacaucugucggaguuaauauguguacuuuaauugcuauggacuuaggagaauugugugaagauacgaugaccuauaaauguccuagaauaacggaagcggaacccgaugacguagauugcugguguaaugcgacggacacauggguaacuuacgguacauguucucaaacaggugaacaucggagggauaaacgaaguguugcccuagcaccccacguugguuuaggacuagaaacucgaacagaaaccuggauguccagugagggugcguggaaacaaauucaaaaaguugaaaccugggcccuuaggcaucccggauuuacgguaauagcuuuauuucuagcacaugccauagguaccaguauaacgcaaaaagguaucauauuuauauuauugauguuaguaacaccaagcauggcgaugagaugcguaggaauugguaauagggacuuuguugaaggacuaucuggugcaacguggguagauguagugcuggaacacgguucaugcguaacgacaauggcuaaaaauaaaccaacacuugacauugagcuuuugaaaacagaaguuacaaauccagcgguauuaagaaaacuauguaucgaagcuaaaauauccaacacgacaacggauucuagguguccuacccaaggggaagccacccuaguggaagaacaggaugcaaauuucgucugcagacgaacuuuuguggauaggggguggggaaacggauguggauuguucgguaaagguucauuauuaacgugugccaaauuuaaguguguaacuaaauuagaaggaaaaaucguucaguacgaaaaccugaaauauucuguaaucguaaccguccacaccggcgaucaacaucaaguugggaaugagacuaccgaacaugguacaaucgccacaauuacaccacaggcgccgacauccgaaauucagcuaaccgacuacggcgcauuaacacuugauugcucgcccagaacgggguuagacuuuaacgaaauggucuuacuaaccaugaaagaaaaaucaugguuaguucauaagcagugguuuuuggaccuuccguuacccuggacaucuggagcaucuacaccacaagaaacauggaauagacaagaucuccucguaacauucaaaacagcgcacgccaagaaacaggaaguaguuguccuuggaagucaagaaggggcuaugcacaccgcguuaacgggagccacagaaauccaaacaagcggaacuacuacaauuuucgcuggacaccuuaaauguaggcuaaaaauggauaaauuaacauuaaagggaauguccuauguuaugugcacggguaguuucaaacucgaaaaagaagucgcggaaacgcaacacgggacgguccuaguucaaguuaaauacgaagguaccgaugcuccauguaaaauaccauucuuaacacaagaugaaaaaggugugacccaaaacggucgauuaaucacggcaaauccaauagucaccgacaaggagaaaccuguaaacauagagacugaaccuccauuuggggaguccuauauagucguuggggcuggugaaaaggcauuaaaauuaucaugguuuaaaaagggaaguuccauugggaaaauguucgaagccacagcaagaggagccaggcgaauggcaauauuaggagacacggcaugggacuucggaucaauaggagguuuguuuaccucugucggaaaacucauacaucaaguauuuggaaccgcuuauggggugcuuuucucugguguaaguuggacuaugaaaaucgggauagggauacucuuaacuugguuaggguuaaauucaagaucuacaagccugaguaugacaugcaucgcugucggaaugguaacguuauaccucggugucaugguacaagccgauuccgggugugugauuaauuggaaaggaagggaauuaaagugcgggucgggaauauucguaacaaaugaagugcauacauggacugaacaauauaaauuucaggcggauagcccaaaaaggcuguccgcagcaauaggaaaagccugggaagaaggcguaugugguaucagaagugccacgagacuggaaaacauuauguggaaacaaauaaguaaugaacuaaauuauauacuccuugaaaaugauaugaaauuuacaguaguagugggggacauaaaugguauccuugcucaaggcaagaaaaugauaagaccacagccgauggaacauaaauacuccuggaaaucgugggguaaagccaaaauuauaggugcugauauacaaaauacgacuuuuauuauagaugggccagauaccccggaguguccagacgaucagcgagcauggaacaucugggaaguagaagauuacggcuuuggaauuuucacgacaaauauauggcuaaaacuuagggauagucauacacaaaugugcgaccaucgacuaaugagcgcagcaauaaaagacucuaaagcuguucaugcagauaugggcuacuggaucgagucggagaaaaaugaaaccuggaaacuagcaagggcuucuuuuaucgaaguaaagacuuguauauggccaaaaagucauacuuuaugguccaauggaguucuugaaucagaaauggucauuccaaaaauauauggggguccaauaucccaacacaacuacagaccaggauauuuuacucaaaccgcgggacccuggcaucuagguaaacuugagcuggauuuugauuugugcgaaggaaccacaguaguuguagaugaacauuguggcuaucguggucccagucuucguacaacgacgguaacaggaaaaauaauacacgaguggugcugcagaucaugcacuuuaccuccauuaagauuuagaggagaagauggauguugguaugggauggaaauaagaccaguaaaagagaaggaagaaaauuuaguucgaucaaugguaucagcaggcucuggagagguugauaguuucagccuggguauccucugcguuucuauucuaauagaagaaguaaugcguagccgguggagccggaaaaugcuuaugaccgguacacuagcaguguuuuuauuauuaauuaugggacaacuuacuuggaacgacuuaauaaggcuauguaucaugguuggagcgaaugcaagugaccgcauggggaugggaacgacauacuuagcguuaauggcuacauucaagaugagaccuauguucgcuguggguuuacuauuucggcgcuuaacaagucgugaaguucuauugcuuaccgugggacucucuuuaguagcaucaguugagcuaccuaauucacuugaggagcuaggugauggcuuagcuauggguauuaugauguugaaacuuuuaaccgacuuucagccucaccaacuuuggacaacauuguugaguuugacuuuuauaaggaccagucugaguuuggacuacgcauggaaaacuauggcaauggcuuugaguauaguaucauuauuuccucuauguuuguccacaacgagccagaaaacgacguggcuucccguacuauuaggguccuucgguugcaagccacugaccauguuccuaauaacagaaaauaaaauauggggacguaagaguuggccaauaaaugaggguauuauggcugugggaaucguaucaauauugcugagcaguuugcugaagaaugaugugcccuuagcggguccccugaucgcaggaggcauguuaauugcuuguuacguaauuucuggaaguucagcagaucuuucucuugaaaaggcugccgagguuuccugggaagaagaagcagaacacagugguacgucccauaauauccuaguagaaguccaggacgacggaacuaugaaaauaaaggacgaagaacgugaugacacauuaacgauccuacugaaggccacacuauuagcaguuucagggguauauccgaugaguauuccggccacguuauuuguaugguauuuuuggcagaagaagaaacagcgaaguggugucuuaugggauacacccucaccacccgaaguggaaagagcuguacuugacgacgggauauaccguauccuacagcgcggacuauuaggacguagucaaguuggaguggguguauuucaggaugguguauuucacacaauguggcaugucacaagaggagcaguacucauguaccaagguaaacgauuggaaccauccugggccaguguuaagaaagauuugauaucuuacggcggagguuggcguuuccaaggaucauggaauacaggggaggaaguccaagugauagcaguugaaccaggcaaaaauccgaaaaacguucaaacaacacccgggacuuuuaaaacaccugaaggugaaguuggagcuauugcauuagacuuuaaaccuggcaccucgggaucuccaaucguuaauagggaagguaaaauuguaggauuauacgggaauggugugguuacuacaaguggaacguauguaagugccauugcacaagcgaaggcaacucaagaaggaccucuaccagaaauagaagaugaagucuuuaaaaagagaaaucucacaaucauggaccuucauccagguaguggaaagacgaggcguuaucucccggcuauugugagagaagcaauuaaaagaaaauuaagaacuuuaauccuagcuccaacuagaguaguugcuagcgaaauggcagaagcacugaagggcaugccaauucgauaccaaacaacagcgguuaaaucagagcauaccggaagagaaauagucgacuuaaugugccacgcuacauuuacaaugcgcuuacugaguccgguaaggguuccuaauuauaauaugauaauaauggaugaggcucauuucacagauccagcgucgauugcugcgcgagguuacauaucuacuagaguaggcaugggagaagcugcagcaauauuuaugacugcaacucccccaggcucaguggaggcuuuuccucaaaguaaugccguaauacaagaugaagaaagggauauaccagagagaaguuggaacucaggguacgacuggauuacugauuucccaggaaaaaccgugugguucgugcccagcauaaagagcggaaaugauauugcgaauugccuacgcaaaaacgguaaaaggguaauccaauuaucaagaaaaacauuugauacugaauaucagaaaacuaaaaauaaugacugggauuauguaguuacaaccgauauaagugagaugggggcaaacuuuagggcagacagaguuauagauccuaggagaugucuaaaaccaguaauucucaaggaagguccagagcgagucauacuugcugggccaaugcccguaacuguugcuucagccgcccagaggcgugggcguaucgguagaaaucaaaauaaggaaggagaccaauacauauauaugggacaaccuuuaaauaacgaugaagaucaugcacauuggacagaagccaaaauguugcuugacaauaucaacacaccugaagggaucauaccagcauuauuugaacccgaaagagaaaagucggcagcaaucgauggggaguacagguuaaggggagaggccagaaaaacguucgucgaacugaugcgaaggggugacuuaccaguuuggcuaucauacaaaguggcaucugaaggauuccaauacagcgauagacgguggugcuuugauggugaacguaacaaucagguguuagaggaaaauauggauguagaaauauggacuaaagaaggugagagaaagaaacugagaccucguuggcuugaugcaagaaccuauucugacccacuagcauuacgggaauuuaaagaguuugcagcaggccgucggaguguaucaggagaccugauacuagagauaggaaaauugccgcaacaccugacauuaagggcucaaaaugcgcuugacaaucuuguuaugcuacauaacucugaacaaggugguaaggcauaucgacaugcuauggaagaacuaccggauacaauagagaccuugaugcugcuagcucuaaucgcgguccuaacgggaggagucacccuauucuuucuaucgggcaaaggcuuaggaaaaacuucaauuggguuguuguguguaauggcaucaagugcacuacuguggauggcgagugucgaaccucacuggauagcagcaucaauaauauuagaguucuuuuuaauggucuuacucauaccagaaccggaucgacaaagaacuccccaagauaaccaacuugcuuacgucgugaucggacuauuguucaugauauuaaccgucgcagcaaaugaaauggguuuauuagaaaccacuaagaaagaucugggaauuggccauguagcggucgaaaaccaccaccaugcaacaauguuagacguagauuuaagaccugcauccgcauggacauuauaugcugucgcaaccacaguuauaacuccgaugaugagacauacaauagaaaauacuacagcgaacauaucacucacggcuaucgcaaaucaggccgcuaucuugaugggacuugacaaaggcuggccgauaaguaaaauggauauuggaguuccguuauuggcacuagguugcuacagucaaguaaaucccuugacccuaaccgccgcaguucucaugcugguggcacauuaugcaauuauaggaccaggccuacaagccaaagcgacccgugaagcgcagaaaaggacagcagccgguauuaugaagaauccaaccgucgauggaauagugacaaucgaccuagauccgguagucuaugacgcaaaguuugaaaaacaacuaggccagauaauguuauuaauacuaugcacaagucagauacuuuuaaugcguacuacuugggcacucugcgagucaauuacauuagcaacgggaccguugaccaccuuaugggaaggaaguccaggaaaguuuuggaauaccacuauagcugucagcauggcgaauauauuuagagguucguaucucgcaggagcuggccucgcguucagucuaaugaaaagucuuggaggaggucggagaggaaccggggcucaaggugaaacguuaggcgagaaauggaagagacaacuuaaccagcucucuaaaagugaauuuaauacauauaagaaaucaggaauaauggaaguagacaggagugaagcaaaggagggucuuaaacgaggagaaacaacgaaacacgccgucaguaggggcacagccaaauugcgaugguucguagaacguaacuuaguaaaaccagaagguaaaguaauugauuugggauguggaagaggaggauggagcuacuauugugcaggguugaaaaagguaacugaaguuaaggguuauacaaaaggcggaccaggucaugaggaaccuauaccaauggcuacauauggguggaauuugguaaaacuacauaguggaaaggauguauucuuuacuccacccgaaaaaugugauacucuguuaugugacauaggagaaagcaguccgaaucccacaaucgaagaaggcagaacccuuagaguucuaaagaugguugaaccgugguuaagagguaaucaauucuguauaaaaauucuaaauccauauaugccuucuguaguugaaacacuagaacagaugcaaaggaagcauggaggaaugcucgugagaaauccauugucucgcaauaguacucacgaaauguacuggguuucuuguggaacagguaacauaguaagugcugugaacaugacaagucgaauguuacugaaucgauuuaccauggcucauagaaaaccuaccuaugaaagagauguagacuuaggagcuggcacaagacacguggcaguagaaccagaaguagccaaucuagacauaauugggcaacgaauagaaaauaucaaaaaugaacacaagucgacuuggcauuacgacgaggacaauccguacaaaacuugggcauaucacggcucauaugaaguaaaaccaucggguucagcgagcucgaugguaaacggagucguacgauuguugacgaagccuugggacgucaucccaaugguaacacaaaucgcuaugacagacacaacuccguucggucagcagaggguuuucaaggaaaagguggacacuagaacaccaagggcaaaacgcgggaccgcucaaauaauggaaguaacagcgaaguggcuauggggauuucuaucgaggaauaagaaacccagaauaugcacaagggaagaauuuaccaggaaagucagaagcaacgccgcaauaggagcgguuuuugucgacgaaaaccaauggaacuccgcuaaggaggcagucgaggaugaaagguucugggaucucgugcaccgugagagagaauuacauaagcaaggaaaaugcgcuacuuguguguacaacaugaugggaaaaagagagaagaaacugggugaauuuggaaaggcuaaagggucucgugccauuugguacauguggcucggagccagguuuuuagaguucgaagcauuggguuuuaugaaugaagaucacugguuuaguagagaaaauagucuaucaggaguggaaggcgagggccuacacaaauugggauauauacuaagggacauauccaagauaccuggugguaacauguaugcugaugacacggccgguugggacacacgaauaacagaggacgaucuacaaaacgaagcgaaaauuacggauauuauggagccugaacacgcgcuguuggccacaucaauuuuuaaacuaacuuaucaaaauaaagucguacgcguacaacgacccgcuaaaucaggaacuguaauggaugucaucaguagaagggaucaacgaggaaguggucaaguaggaacuuacggccuuaacacauucacuaacauggaaguacaacugaucagacaaauggaaucagaaggaaucuucagucccucagaauuggaaacgccgaaucuugccaagaaagugcuagacugguuagagaaacauggugcagaaaggcuaaaacguauggccaucagcggugaugauugugugguuaaaccuaucgacgaucgcuuugcuacggcacuuaccgcucuaaaugauauggggaaaguuaggaaagauauaccucagugggaaccuucgaaaggauggaaugauuggcaacaaguccccuuuuguucucaucacuuucaucaguuaauaaugaaggauggaagagagauaguaguaccauguaggaaucaagacgaauuaguaggacgagcgagaguaagccaaggugcaggauggucauuacgugagaccgcaugucuagguaaaagcuaugcucaaauguggcagcuuauguauuuccacaggagagauuuaagacuggcagcaaacgcaauuugcucagcugugcccguagacuggguaccaacaagucguaccaccuggucuauucacgcacaccaccaauggaugacaacggaagacauguuaucaguuuggaauaggguuuggauagaagaaaauccauggauggaagacaagacacauguaagcucaugggaagaaguaccuuacuuaggaaagagagaagaucaaugguguggcaguuuaauuggguuaacugcccgcgcaaccugggcaaccaacauacaaguagcaauaaaucagguuagaaggcucauaggaucagaaaacuaucuagacuacaugaccucaaugaaaagguucaagaaugaaagugauccagaaggugcguuaugguaa

SEQ ID NO: 22044 - RNA, 9879 nt, Artificial Sequence
  derived and/or modified CDS sequence (opt6) from DENV-1__KC692514__SS-prME
ucagucacgauguugcuaauguuacugccaacagcauuggcauuucacuuaacuacgagaggaggugaaccccauaugauuguaagcaaacaagagagaggaaaaucuuuauuauuuaaaacaagcgcuggugugaauaugugcacacuaaucgcaauggauuuaggagaauugugcgaagacaccaugacuuacaaaugcccacgcauaacugaagcagagccggaugaugucgacuguugguguaaugcaacagauaccuggguaacauauggaaccugcucacaaacaggagaacaccgaagggaaaaacgaaguguagcguuagcaccacauguugguuugggauuagaaacccgaacagagacguggaugagcucggaaggagcuuggcgacaaauacaaaggguagaaacuugggcuuuacggcauccgggauucacaguaauagccuuuuucuuagcucacgcaauugguacaucaauaacacaaaaaggaauuauauucauuuugcugauguugguaacgccaucaauggcaaugcguuguguuggaauuggaaauagagauuucguagaaggauuaagcggugcaacguggguagaugucgucuuagagcauggaucauguguuacuacuauggcgaaaaauaaaccuacacuugauauugaauuauugaaaacugaaguuacaaacccagcgguacuuagaaaacuuuguauagaggcuaaaauaucaaauaccacuacugauagccguugcccaacacaaggagaagcuacccucguugaagaacaagaugcuaauuucguuugucguagaacauuuguugaucgaggaugggggaacggauguggauuauuugggaaaggaagccuuuuaacaugugccaaauuuaagugcguuacaaagcuggaaggcaaaauugugcaauacgaaaacuuaaaauauaguguaauaguaacugugcauacaggugaccaacaccaaguaggaaacgagacaaccgaacauggcaccaucgcaacaaucacgccacaagcacccacaucagagauccaauuaacagacuauggagcacuuacucuugauuguucuccuagaacggguuuggauuucaaugagaugguccuacugacuaugaaggagaaaagcugguuaguacacaaacaaugguuuuuagaucuaccacuaccuuggacaaguggcgcaaguacaucacaagaaacuuggaacagacaagaccuauuaguuacuuucaaaacagcucacgcgaagaaacaagaagucgucguuuuggguucucaagaaggagcaaugcauacugcucugacaggagcaacagaaauacaaaccuccggaacaaccacaauauuugccggacaucuuaagugucgccucaagauggauaaauugacacuaaaagguaugucauaugugauguguacagggucauuuaaacuugaaaaagagguagcugaaacacaacaugguacuguccuuguucaagugaaauaugaagggacagaugcuccauguaaaauaccauuuucaacacaagaugaaaaaggaguuacacaaaacggacggcuuaucacagcaaauccaauagucacagacaaagagaaaccaguaaauauugaaacagaaccuccauucggugagagcuauauuguagucggugccggugaaaaggcuuuaaagcucucaugguucaaaagaggaucuucuauugggaagauguuugaggcaacagcgagaggugcucgacgaauggcaauccugggggauacugcaugggauuucggaaguauaggcggaguauuuacgagcguaggcaaacuuguucaccaaguguucggaacagcuuaugguguacuauucucgggaguuaguuggacuaugaagauaggcauaggaauauuauugacgugguuaggucucaauaguagauccacuucauuaagcaugacauguaucgccguugggauggugacuuuauacuugggcgugaugguacaagcagauaguggaugcgugauuaauuggaaggguagagaacuaaaauguggcucuggaauuuuugucacuaacgaagugcauacauggacagaacaauacaaauuucaagccgauucaccaaaaagauuaucugcggcuauaggaaaagccugggaagaaggaguuuguggcauucguucugccacacgucuugagaacaucauguggaaacagauauccaaugaacuuaaccauauucugcuggaaaacgacaugaaauucacaguaguuguaggagacgcaaacggaauuuuggcccagggcaagaaaaugauaagaccucaaccaauggaacauaaauauucauggaaauccuggggcaaggcuaaaaucauuggggcagacauucaaaauacuacauucauuauagaugguccugauacgccugaaugcccagauggucaacgcgcauggaacauaugggaaguugaagacuaugguuucgggguuuucacaacuaacauaugguuaaaacuaagggauagcuauacacaaaugugugaccaccgauuaaugucagcugcuauaaaagacucaaaagcaguacaugcggauaugggauauuggauugaguccgagaaaaaugagaccuggaaauuagcccgagcuuccuucauugaaguaaaaaccuguacauggccaaaaucucauacacuauggaguaacggcgucuuagaauccgaaaugauaauaccaaaaauuuucggcgggccaauaucucaacauaauuaucgaccaggauauuuuacacaaacagcuggcccauggcaucucgggaaacuagaacuagauuucgaucugugcgaaggaacuacuguaguaguugaugaacauugcgggaaucgaggaccuagucuaagaaccacaacggucacagguaaaauaauucacgaauggugcuguagaucuuguacccugccaccguuacgauuuaggggugaagauggaugcugguacgggauggaaauacgaccagucaaagaaaaagaagagaaccuuguacguaguauggugagugcugggaguggagagguagauuccuuuagcuugggcauauuguguguaagcauaaugauagaagaaguaaugagaucaagaugguccagaaaaaugcuuaugacaggaacauuagcaguguuuuuguuauuaaucaugggacaauugacauggaaugaucuuaucagauuguguaucauggugggugcaaacgccucagaccgcauggggauggguacuaccuaucuggcuuuaauggccacauucaagaugagaccaauguucgcaguaggacuacucuuucguagguuaaccucaagggaaguuuuauuacuaaccauagggcuaucccuuguagcgagcguagaacugccaaacucacuugaagaguuaggagacgguuuagcgaugggcauaaugaugcugaaauugcuuacagaauuucaaccccaucaauuguggaccacacugcugucucuuaccuuugucaaaacaacucuuagcuuagacuacgcuuggaaaacuacggcgaugguucugagcauaguaucacuguuuccauugugcuuaucuacaacuucccagaaaacuacauggcugccuguacuauuaggcucuuuuggguguaaaccguugacuauguuucugauaacagagaauaaaauauggggacgaaaaucuuggccucuuaacgaagggauuauggcaaucgguauaguaaguauacuucucaguagucuauugaaaaaugauguaccuuuggcaggaccuuugauagcuggcgguauguuaauagcaugcuauguaauuucaggaucgucagcagacuuaucuuuagagaaagcugcagaagugaguugggagcaagaagccgaacacucuggcgcaagucacaauauacuuguggagguccaagaugaugggacaaugaaaauuaaagacgaagaaagggaugauacacuaaccauacuccuuaaggcaacgcuccuagcuguuagcggcguguacccaaugagcauuccugccacucuauuuguaugguacuuuuggcagaaaaagaagcagagaucaggugucuuaugggacacuccgucacccccugaaguagaacgcgccguauuagaugauggaauuuaccggauacuucagagaggucuucucgggcguucacaaguggggguuggaguguuucaagauggcguguuucauacaauguggcacgucacgcgaggagcaguauuaauguaucagggaaaacgccucgaacccagcugggcaucugugaagaaagaucucauaaguuacggagguggcuggagauuucagggaaguuggaacaccggagaagaaguucaagugauagcaguugagccaggaaagaacccuaagaacguucaaacaacaccaggaacauuuaaaacuccugaaggagaagucggagcaauagcacuagacuuuaagccaggcacuagcgguucgccuauugugaacagagagggcaaaauuguagguuuauacgguaauggaguaguaacaacgagugggacuuacgucucagccauagcacaagcaaaaacuucacaggaaggaccacuucccgaaauugaagaugaaguguuuaagaaaagaaauuugacaauaauggaucuacaccccggaagcgggaaaacgagaagauaccuuccggcuauuguacgagaagcuauaaaacguaaguuacggacgcuaauauuagcaccaacuaggguaguugcuucugaaauggccgaggcucucaaggguaugcccauacguuaccaaacuacugcaguuaaaagugaacauacuggaagggaaaucguugaucugaugugucacgccacauucacaaugagacuauuaagcccaguuagaguaccaaauuacaacaugauuauaauggacgaagcacacuuuacggauccugcgucaauugcugccagagguuacaucucaacgcggguugggaugggggaagccgcggcgauuuuuaugacggccaccccucccgguucugucgaggcguuuccucaaucaaacgcugugauucaagacgaagaacgagacauaccagagagaucauggaacagcggauacgauuggaucacggauuuuccugguaaaacagucugguuuguaccuucgauaaaaucaggaaacgauauugcuaacuguuuaaggaagaauggaaaaagagucauacaauugagccguaagacauucgauaccgaauaucagaaaaccaaaaacaaugauugggacuacguugucacaacagauauaucugaaaugggagcuaacuucagagccgaccgugucauugauccaaggagaugucucaagccuguaaucuuaaaagaugggccugaacgaguuauacucgccggacccaugcccguaacuguugcaagugcagcacagagacguggccguauaggaagaaaucagaacaaggaaggcgaucaauacguauacauggggcagccacuaaacaaugacgaggaucaugcccauuggaccgaagcgaaaaugcuccuugauaauauuaauacaccggaaggcauaauuccagcuuuauucgagccagaacgagaaaaaucagcugcgauagauggagaguacagacucagaggggaagcuaggaaaacguuuguggaacuuaugcggagaggcgaucugccuguauggcucaguuauaaaguagcuucugagggauuccaauauucugaucgacgauggugcuuugauggugaacggaauaaucaaguguuggaagagaauauggacguagaaauuuggaccaaagaaggggaaagaaagaaauuacgaccucgauggcuagacgcuagaacauacucagacccguuagcacugcgugaauuuaaagaauuugccgcaggccgaagaagcguaucgggagaccugauauuggaaaucggcaaauuaccucagcacuuaacucuacgagcucaaaaugcuuuggauaaucuaguuaugcuacauaauucagagcaaggugggaaagccuaucgacacgcuauggaagaauuaccggauacaaucgaaacccuaauguuauuggcucuaauagcagugcuaacuggcgggguuacguuauucuuuuugaguggcaaaggccugggcaaaaccucaauaggcuuacuauguguaacagcgucuagcgccuuauuauggauggcauccguggaaccgcacuggaucgcggcuagcaucauucuagaauuuuuccuaaugguucuccucaucccagagccagauagacagaggacaccacaagauaaccaacuagcuuauguuguaaucggcuuguuauuuaugauuuuaacuguugcagcgaaugaaauggguuuguuagaaacuaccaaaaaggaucuggggaucggauacgucgcagcggaaaaucaucaacaugccacuaugcuagaugucgacuuacauccggcaucggcauggacuuuguacgcaguugcgaccacaguuauaacuccaaugaugcggcauacuauagaaaacaccacagcaaacauaucacuaaccgcaaucgcaaaccaagccgccauccuaaugggucucgacaaagguuggccaauauccaaaauggacauuggcguaccauuauuagcacuaggguguuauagucaaguaaaccccuugacauugacugcugcuguguuaaugcugguagcacacuaugcgaucauuggaccaggacuucaggccaaagcgaccagggaagcacagaaaaggacagcagccggaauaaugaaaaacccaacaguggauggaaucguagccauugacuuagauccuguaguauacgaugcaaaauuugaaaaacaacucggucagauaauguuacuaauccuauguacaucacagauuuugcuaaugaggacaacuugggcucuuugugaauccauuacacuagcaacagguccauugacgacuuugugggaggguaguccugguaaguuuuggaacacuacaauagcgguaucaauggcuaacauauuucgcgguaguuaucuagcuggcgcuggucuugcauuuagccuuaugaaauccuuaggaggcggcagacgagguacaggggcccagggagagacgcuaggcgaaaaauggaaacgucaauugaaccaauuaucaaaaagcgaauuuaauaccuauaaaagaagugggauaauggaagucgacagaucagaggcuaaggagggucuaaagcgaggggaaacaaccaaacaugcaguaucaagaggcacagcaaaacuacggugguuuguagaaagaaaccuagugaaacccgaagggaaagugaucgaucuaggcuguggacgagggggauggaguuauuauugcgcaggccuaaagaaaguuacugaaguaaaaggguauacaaaaggggguccggggcaugaagaaccaauaccgauggcuacuuauggauggaaccuaguaaaguuacacucaggaaaggacguauucuuuaugccucccgagaaaugugacacauuauugugcgacauuggagaaucaucaccgaacccgacaaucgaggagggacguacucuaagaguauuaaaaaugguugaaccauggcuaagaggaaaucaguuuugcauaaaaauauuaaacccguauaugccaucugugguggaaacucucgaacagaugcaacguaagcacggugggauguuaguacguaacccauuaucacgaaacagcacacaugaaauguacugggugagcugugguacuggaaauauaguauccgccguuaauaugacaagccguaugcuccucaauagguucacuauggcacauagaaaaccaacuuaugagagagacguagaccuaggcgccggcacaagacauguagcgguagagccugagguagcaaaccuagauauaauuggucagagaauagagaauauuaaaaacgaacauaaaucuacauggcauuacgacgaagauaauccuuacaaaacuugggcauaucacggcuccuacgaaguaaaacccuccgguucugccucaaguauggucaaugguguugugcgauuacuaacuaaaccuugggacguaaucccaauggugacacaaauugcaaugacagauacaacaccguucggccaacagcgaguauucaaggagaaaguggacacuagaacgccaagagcgaaacguggcaccacacaaauaauggaaguaacugccaagugguuauggggguucuuaucgcgaaauaagaaaccacgaauaugcacccgcgaagaguucacuagaaaagugcgaucuaacgcagcuaucggugcuguuuucguagacgaaaaucaauggaauagcgcaaaagaagcaguagaagacgaaagauucugggauuuggugcacagagaaagggaacuccauaagcaagguaaaugugcgaccuguguguacaauaugauggggaaacgugagaagaaauugggugaauuuggcaaagcaaaagguagcagagcaaucugguauauguggcuaggagcacgauuuuuagaguuugaagcauugggauucaugaacgaagaccacugguuuuccagagaaaacagccuuucuggagucgaaggugaaggauugcauaaauuggguuacauauugagagacaucagcaaaauuccaggaggcaauauguaugcugacgauacggcuggaugggauacuagaauaacagaagaugauuuacagaacgaagccaaaauaacugauauaauggaaccugagcacgccuuacuugcuacuucaauauuuaaacuaaccuaccaaaauaaaguuguuagaguacaaaggccugccaaaaauggcacgguuauggacgugauuaguagacgagaccaacgggguucuggucaaguagguacauaugguuugaauacuuucacgaacauggagguacagcuaauaagacagauggagucugagggaauauuucuaccaagugaauuagaaacaccuaauuuagcagaacgugcucuugauugguuggaaaagcacggcgcugagagauugaagcgcauggcgaucuccggcgaugauugcguagucaaaccaauugaugaccgguuugcgacagcguuaaccgcacucaaugauauggggaaagugagaaaggauaucccucagugggaaccaucaaaaggcuggaaugauuggcaacaaguaccuuucuguagucaucauuuccaucagcugauuaugaaagaugguagagaaauaguaguacccugucgaaaccaggaugaguuaguaggcagagcuagagugucacaaggugcuggauggucucugagggaaaccgcuugcuuaggaaaaucauaugcucaaauguggcagcuaauguauuuccaucgaagagauuugcgucuugcugcuaacgccauauguagcgcaguuccagucgauuggguuccugcuagccguacuacauggaguauucacgcacaucaccaauggaugacgacagaagauaugcucaguguuuggaaccgaguauggauagaagaaaacccuuggauggaagacaaaacccauguaucauccugggaagaaguucccuaucugggaaaaagagaggaccaauggugugguagcuuaauaggacuaacagcgcgugcuaccugggcaacaaacauacaagucgcuauaaaucaagugagaagauuaaucggaaaugaaaacuaccuggauuauaugaccagcaugaaacguuuuaagaacgaaagugauccugaaggagcucucugguaa

SEQ ID NO: 22045 - RNA, 9879 nt, Artificial Sequence
  derived and/or modified CDS sequence (opt6) from DENV-1__KC692515__SS-prME
uccguuacgaugcuacuuauguugcuaccaacagcuuuagcuuuccaucuaacaacucgagggggagaaccacauaugauuguuucaaaacaagaacgaggcaaaagccuacucuucaaaacgagcgcaggagugaacauguguacguugauugcaauggacuuaggagagcuuugcgaagauacuaugacguacaaauguccacggaucacagaggcagaaccagacgaugucgacuguuggugcaaugcgacagauacauggguuacguauggaacaugcagucaaacuggcgaacaucguagggaaaaaagaucugucgcauuagcaccucauguaggauuaggguuagagacgagaacagaaacauggaugucgucagaaggagcuuggaaacaaauccaaagagucgaaaccugggcucuacgucauccuggcuucacugugauagcacuguucuuggcucacgcaauaggcacuucaauuacucaaaaaggaauuauauuuauucucuuaaugcuugugacgcccucgauggcuaugcggugcguugggauagguaauagagacuuuguggaaggacugaguggugcaacauggguugauguaguguuagagcauggcucuugugucacaaccauggcaaaaaauaaaccaacccuagacaucgaauuguugaaaacagaaguuacaaacccugcgguacuacgaaaacuauguaucgaagcaaagauaagcaacaccaccaccgacagucgcugcccaacacagggcgaggcaacauuaguagaagaacaagacgcaaacuucguaugccgaaggaccuucguugaucgagguugggguaacggauguggauuguuugggaagggaagcuuacuaaccugcgccaaauuuaaaugugugaccaaauuagagggaaaaauaguacaauaugaaaacuuaaaauauagugucauaguuacuguccauacgggcgaccaacaccaagucggcaacgaaacgacugaacauggaacuauagcuaccauaacgccucaagcccccacaucggaaauacaacuuaccgauuauggagcacugacccuagauugcucuccaagaacgggccuagacuucaaugaaaugguacuucuuacaaugaaagaaaagucguggcuaguucauaagcaaugguuucuggaucucccacuaccauggacuucgggagcaucaacaagccaagaaacguggaacagacaagacuugcuuguaacuuuuaaaaccgcccaugcuaaaaaacaagaaguggugguuuuaggaagucaagaaggagcaaugcauaccgcacuuacuggggcaacagaaauucagacuagcggaacaacuacaaucuuugcuggacauuuaaaaugcagacuuaaaauggacaaauuaacgcuaaaaggaaugucuuacguaaugugcacgggaaguuucaaacucgaaaaggagguggccgaaacgcaacauggaacuguguugguucagguuaaguaugaaggcaccgaugccccguguaaaauaccauuuagcacgcaggaugagaaaggagucacucaaaacggacgucuaauuacagccaacccaaucguuacggacaaggaaaaaccuguaaacaucgaaacagaaccaccauucggugaaucuuauaucguagucggcgcaggugguaaagcguuaaagcucucaugguuuaagcguggaucuucgauaggcaagauguuugaggccacagcucggggagcacgacguauggccauauuaggagacacggcaugggauuucgggaguaucggaggaguauucacaucagucggaaaacucguucaccaaguguuugguacagcauacggcguacucuucucaggggugucuuggacuaugaagaucgguauagguauccuucuaacauggcuaggucuaaacucgagaucaacuaguuuauccaugacaugcaucgcaguaggaaugguaacucucuauuuaggagugaugguccaggcagauagcggaugugugauaaauuggaaaggaagagaauugaaaugcggcagugggauuuuuguuacgaacgaaguacauacauggaccgaacaauacaaguuucaggcugauucaccaaaacguuugucugcugcaauugggaaggcaugggaagaggggguuugcggaauaaggucugccaccagauuagagaauauaauguggaaacaaauuucgaaugaauuaaaucauauauuacuugaaaacgauaugaaauuuacagucgugguaggagacgcaaaugguauuuuagcgcaaggaaaaaaaaugauacguccacaaccaauggaacauaaauacucauggaaaagcuggggaaaagcaaaaauaaucggagcagauauccaaaauacaacauucauuauugacgggccagacacaccagaaugcccugaugggcagcgagcauggaauauuugggaagucgaagacuacggauuuggugucuucacaacuaauauaugguuaaaguugagggauucauauacacaaaugugcgaucaccgcuuaaugagugcagcaauaaaagacaguaaggccguacaugcugacauggguuacuggauagaaucagaaaaaaacgagacauggaaacuagcucgagccaguuuuauagaagucaaaacgugcacauggccaaaaucacacacacuuuggucaaaugguguacuagaguccgaaaugauuauucccaaaauauucggcggacccauaucccaacauaauuaucguccgggguacuucacacaaacagcgggaccauggcaccuggguaaacuggagcuagauuuugaccuaugugagggaacaacagucguaguugaugaacacugcggcaauagagggccuaguuuaaggacgacaacaguaacaggaaagauaauacaugaguggugcugcaggagcuguacguugccaccauuaagauuucggggagaagacgguugcugguauggaauggaaauacgcccaguaaaagagaaagaggaaaacuuaguaaggagcauggucucugcuggaucaggugaggucgauagcuucucauuaggaauauuaugcguuagcauaaugauugaggaagucaugagaucccgauggucaagaaaaaugcugaugacuggaacacuugcagucuucuuacuucugaucaugggacaauuaaccuggaacgaccuuaucagacuauguauaauggugggugcuaacgcaagugaccguaugggaauggggacaacauacuuggcccucauggcuaccuuuaaaaugagaccuauguuugcagugggacuuuuauuucgacguuugacgucgcgugaaguacuacuccucacgauaggacuaucguuaguggcauccgucgaauuaccgaauagucuugaagaguuaggugacggacuugcgaugggaauuaugaugcuuaaauugcucacggaauuucaaccacaucagcuuuggacaacacuauuaucacuaacauucguuaaaacaacuuuaucacuugauuaugcguggaagaccacugcuauggucuugucaauaguaaguuuauuuccccuaugccuuucaacuacaagccagaaaaccaccugguuaccaguuuuacucgguucuuuuggcugcaagccuuuaacuauguuucuaauaacugagaacaagauuuggggaaggaagucuuggccguuaaaugaaggaaucauggcuauaggaauuguuucaauauuauugucuucacuauugaaaaaugauguuccgcuagcaggcccucuuauugcaggagguauguuaauagcauguuacguaauuaguggauccagugcugaucuuaguuuagaaaaagcggccgaaguaucaugggaacaagaagcugaacacucaggagcuucccacaauauauuaguggaaguacaggaugacgguacaaugaaaauaaaggacgaggagagggacgauacauuaacuauuuugcuuaaagcaacgcuccuugcggugagugggguauacccaaugucaaucccugcaacacuauuuguuugguauuucuggcagaagaagaaacagaggucgggcguacuaugggacaccccaagcccaccagagguugaacgugcuguacucgaugacggaauuuauagaauucuccaacggggauuacuagggcguagccaaguuggaguaggagucuuucaagacggcguuuuucauacuauguggcacguuacaagaggggcgguauugauguaucaaggcaaacguuuagaaccaucuugggccagugucaagaaagacuugauuaguuauggaggaggauggcgcuuucaagguucauggaacacgggugaggaaguccaaguaaucgcuguugagccuggcaaaaacccaaaaaauguacaaacaaccccaggcacguuuaaaacuccagaaggagaagugggugcuauugcccuagacuucaaaccaggaacaagcggaaguccaauuguaaauagagaagaaaaaauuguggggcuguacgggaauggagucguuacaacuucgggcacauauguaagugcuauugcacaagccaaagccagucaagaaggcccccuaccugaaauugaggacgaagucuuuaagaaacgaaacuuaacgauaauggauuuacacccuggaaguggaaaaacacgcagauauuuaccagcuauuguccgugaagcaauaaaaaggaaacuaagaacuuuaauauuagcucccacacgaguuguagcuagugaaauggcugaggcccucaaagguaugccaauucgauaccaaacaacugcugucaaaucagagcauacaggacgagaaauuguagauuuaaugugucacgcuaccuucacaaugaggcuguuaaguccaguacgugugccaaacuacaauaugauuauuauggaugaagcccacuuuacagacccagcuuccauugcggcacgaggguacauaucaaccagagugggcaugggugaggcggcggccauuuucaugacagcaacaccaccagggucgguggaagccuuuccucaaagcaaugcaguuauucaagaugaagagcgcgacaucccggaaaggaguuggaauagcgguuaugacuggaucacugauuuccccggaaaaacuguuugguuuguaccgucaaucaaaagugguaacgauauagcaaauuguuuacggaaaaauggaaaaaggguuauucaacuuucucggaaaacauucgauaccgaauaucagaagacgaaaaacaaugacugggacuauguugugacuacagauauuagcgaaaugggagccaauuucagagcggaccgcgucauugauccgcgucggugccuaaaaccugucauccucaaagauggaccagaaagaguaauauuggcaggacccaugccgguuacuguagcaagcgcagcccaaagaagaggaagaauaggccguaaucaaaauaaggagggggaccaauacguguauaugggccaaccguugaauaaugaugaagaccacgcacauuggaccgaagcgaaaaugcuguuagauaacauuaauacaccagaagggauuauucccgcccuguuugagcccgaaagagagaagagugcagcaauagauggagaauaccgccuuaggggagaagcgaggaaaacguuuguagagcuaaugagacguggggauuuacccguauggcucaguuauaaaguagcuucugaagguuuucaguauucugacaggaggugguguuuugacggagaaaggaacaaucagguauuggaggagaauauggaugucgaaaucuggacaaaggaaggugagagaaagaaauuaagacccagaugguuggaugcacguacguauucagauccccucgcauugagggaauuuaaggaauuugcugcaggacgaagaagcguaaguggcgauuuaauacuagaaauaggaaaguugccacaacauuuaacgcuacgagcacagaaugcuuuggauaauuugguaauguuacacaauagugagcaaggaggaaaagcauacaggcacgcuauggaagaacuccccgauacaauugaaacacuuauguuguuggcacuaaucgcaguacuaacgggaggggucacuuuauuuuuucugucagguaaaggauugggaaaaacaucgauuggucuauuguguguaacagcuucaucggcucuuuuauggauggcaagcguggaaccucacuggauugcagcgaguauuauauuagaauucuuccucaugguacuucuuauaccggaaccagaucgccaaagaacuccccaagauaaucaauuagcguauguaguuauaggacuguuguuuaugauccuuacaguugcagcuaacgaaaugggguuacuagaaacaacgaaaaaggauuuaggaauaggacauguugcagcggaaaaucaucaacauucaacaaugcuagaugucgaccuacauccagcaucagccuggacucuguaugccgucgcaaccacgguaauuaccccaaugaugcgccauacuauagagaacacaacagccaacaucaguuuaacugcaauagccaaccaagccgcaauacugaugggccucgauaagggcuggccaauauccaaaauggauauugguguaccacuacucgcuuuaggcuguuauucacaggugaacccauuaacauuaacagcugcaguguuaaugcuaguagcacauuaugcuauaauagguccugguuugcaggcaaaagcaacaagagaagcucaaaaaagaacagcggcugguauuaugaaaaacccgacaguugauggaaucguagcaauugaucucgacccagugguguaugaugcaaaauucgaaaaacaacuuggacagauaauguuauuaauucuauguacaagccaaaucuugcuuaugcgcacuacaugggcauugugugagucgauuacacuggcaacaggaccacucacaacgcugugggaagguucgccagguaaguuuuggaauacuacaauagcgguaucaauggcuaauauuuuucgcggaucuuacuuagcaggggcugggcuugcauuuucucuaaugaaaucguuaggaggagggcgucguggaacuggugcacaaggagaaacccuaggagagaaguggaaacgacaacuuaaucaacuaucaaaaucagaguucaacacauacaaacguaguggcauuauggagguugaccguuccgaagcgaaagaaggacucaaacguggggaaacgacgaagcacgcagugucuagaggaacagcaaaacugcgaugguuuguugaacgaaacuugguuaaaccagagggaaaaguuauagaccucggcuguggucgcgguggguggagcuacuacugcgcaggacugaaaaaagugaccgaagugaagggcuacacaaaagggggaccaggucaugaagaaccgauaccuauggccacguacggauggaacuuggugaagcuacauucagggaaagacguuuuuuuuaugccaccugaaaaaugugauacacuguuaugcgauaucggugaaaguaguccaaauccaacgauagaggaggguagaacucuaaggguauugaagaugguagagccauggcuaagaggaaaucaauuuuguauaaaaauccuaaauccguacaugccauccgucguagaaacgcuugagcagaugcagagaaaacauggcggaauguuaguaagaaauccauuaaguaggaacuccacucaugaaauguauuggguaagcugcggcacagguaacauugucucagcaguaaauaugacaucacgaauguuacuaaauagauuuacaauggcacacagaaaaccuacauacgaacgagacguagaccucggcgcuggcacgaggcacguagccguagagccagaaguugcaaauuuagacaucauuggucaaagaauugaaaauauuaaaaaugaacacagauccaccuggcauuacgacgaggauaacccauauaaaacaugggcguaccacggaaguuacgaaguaaagccaagugguucggcaucaucaauggugaauggcguaguaagauuauugacaaaaccgugggacguaauuccgaugguuacacaaauagcaaugacagauaccacuccguuuggacagcaacgaguauuuaaggaaaaaguugauacaaggacgccuagggcuaaacgaggcacuacgcaaaucauggaagugacagcuaaaugguuauggggauuccuaagcagaaauaaaaagccaaggauuugcacaagggaagaguuuacaaggaaagugagaagcaaugcagcaauaggagcugucuuuguagaugaaaaucaauggaacagcgcaaaagaagcuguagaagaugagagauuuugggacuugguacauagggaaagggaacuacacaagcaaggaaaaugcgcaaccuguguauacaauaugauggguaaacgcgaaaaaaaauugggggaguuugguaaagccaaggggagcagagcaaucugguauauguggcuaggagcaagauuuuuagaauuugaagcuuuagguuuuaugaacgaagaucauugguuuagcagagaaaauagucuaagcggaguugaaggugaaggauuacacaagcuagguuauauucuuagagauauaaguaaaauacccgggggaaauauguaugcugaugauaccgcgggcugggauacacgaauaacggaggaugaucugcagaacgaagcaaaaaucaccgauauaauggagccagagcacgcguuacucgcuacaagcauauucaaguuaacguaucagaauaaaguaguccguguacaaagacccgcgaagaauggaacaguaauggacguaauaucucgccgcgaccagaggggaagcgggcaaguuggcacauauggguugaacacuuuuacuaauauggagguacaguuaauuagacaaauggaaucugaaggcauauuuuugcccagcgaacuagaaaccccaaaucuagcagagagagcuuuagauuggcucgaaaaacauggggcggaacgccucaaacgcauggcaauaagcggagaugacugcguaguuaaaccaauagaugaucgguucgcaacagcuuugacggcuuuaaaugacauggggaaaguuagaaaggacauuccucaaugggagccaucgaaaggauggaaugauuggcaacaagugcccuuuuguucccaccauuuucaccaauuaaucaugaaagacggacgagaaaucguaguaccaugucgcaaccaggacgaacuagugggacgcgccagaguuagucagggagcgggcuggagccucagagaaacugcaugucugggaaaguccuaugcccaaauguggcaacugauguacuuucauagaagagaccuucguuuagcugcaaacgcaauauguucugccgugccgguggacugggugccggcaucgcgcacaaccuggagcauucaugcacaccaccaauggaugaccacagaagacaugcuuaguguuuggaacagaguguggauugaagaaaaccccuggauggaagauaaaacccauguaucaagcugggaagaaguacccuaccuaggcaaacgugaagaucaguggugugguagccucauaggucuuacugcgcgggcaacaugggcgaccaacauucaaguugcuauaaaucaagugagaagacuuauuggcaaugaaaacuauuuagauuauaugaccucuaugaagcgguucaaaaacgaaagcgacccagaaggagcccuaugguaa

SEQ ID NO: 22046 - RNA, 9879 nt, Artificial Sequence
  derived and/or modified CDS sequence (opt6) from DENV-1__KC692516__SS-prME
agcguaacgaugcuucuaauguuauuacccacugcccuugcuuuucaucuaacaacucguggaggggaaccacacaugauagugucaaaacaagaaagaggaaaaucguugcuuuuuaaaacgucggcgggaguaaauauguguacauuaauagccauggaucuaggagaauuaugugaagacacuaugaccuacaaaugucccaggauuacagaagcugaaccagaugaugucgauugcuggugcaacgcuaccgauacuuggguuacauacggaacaugcagucaaacaggugaacauagaagagagaaacgaagcguagcccuagcaccccauguagguuuaggucuagaaacuaggacggaaacuuggaugagcagugaaggagcguggaaacaaauucaacguguugaaaccugggcucuuagacacccgggauuuacagucauagcauucuucuuggcgcaugcuauuggaacaaguauaacccagaaaggcauaauauuuauuuuacuaaugcuuguaaccccaucaauggcaaugagaugugucgguauagggaauagagauuucguagaagguuuaaguggagccacauggguagauguaguucuagaacacgguucaugcguaacuaccauggcgaaaaauaaaccuacacuggacauagaauugcuaaaaacagaaguuacgaauccagccgugcuacgaaaacuuuguauagaagcaaaaauaucgaauacuacgacugauucucgcugucccacucaaggggaagcaacacuuguagaagaacaagacgcuaauuuugucuguagaagaaccuuuguagauagagggugggggaacggcugcgggcuauuuggcaaagggucucuauuaacaugcgcaaaauuuaaguguguuacuaaauuggaaggaaaaauaguacaauaugaaaaccucaaauauagugugauaguuacagugcauacuggagaucaacaucagguuggaaaugagacaacggaacaugggaccauagcaacgauuacgccgcaagcaccaacuucagaaauucaacuaaccgauuauggagcccuaacauuggauugcucgccuaggacaggauuagauuuuaaugaaaugguauugcuuacgaugaaagagaaaagcuggcugguacauaaacaaugguuuuuggauuuaccccuuccauggacuagcggagcuaguacaucacaagaaaccuggaaucggcaagaucuguuaguuacauuuaaaacagcucaugcaaagaaacaagaaguaguuguacuaggaucacaagaaggcgccaugcauacggcuuugacaggcgcaacggaaauucagacaucagggacaacuacgauauuugcuggacaucugaaaugcagacuaaaaauggauaaauuaaccuugaaagguaugaguuacguaauguguacaggaaguuuuaaauuagagaaagaaguugcggaaacucagcacggaacagugcuggugcaaguaaaguaugaagguacagaugcaccuuguaaaauacccuucuccacacaagaugaaaaaggaguaacacaaaauggaagacucauaacagcgaauccuauagucacagacaaagaaaaaccaguaaauauugagacagaaccacccuucggugaaucuuacaucgugguuggagcuggcgagaaagcguugaaauuaucaugguucaaacgagggagcaguauaggaaaaauguuugaagcaacagcuagaggagccagacguauggcuauucuuggagauacggccugggauuucgguagcaucggaggcguuuucacaaguguagguaaacugguucaucagguguuugggacggccuauggaguauuguuuagugguguaucauggacaaugaagauagguauaggcauucuucuaacgugguugggcuuaaauucgcgauccaccagucuaagcaugacuugcauagccguuggaauggugacuuuauacuugggggucaugguacaagcggacucuggaugcguaaucaauuggaagggucgagaacugaagugcggguccggcaucuucguaacgaacgagguacauacuuggacugaacaauacaaauuccaagcugacucaccaaaaagacucuccgcggcaauaggaaaggcuugggaagaaggaguaugcgggauacgaucggcaacaagacuagaaaauaucauguggaagcaaauaucaaacgagcucaaucauauuuugcuggaaaaugauaugaaauuuacaguaguaguuggggaugccaacggcauauuagcacaagguaagaaaaugauaagaccucagccgauggagcauaaguacucauggaaaagcugggguaaagcaaagauaauaggugcugacauacagaauacaacuuucauuauagacggaccagacacaccggaguguccugacggacaacgggcauggaauauaugggaggucgaggacuaugguuuuggcaucuucacuacaaauauauggcuuaaguuacgugauagcuacacacaaaugugugaucaccgacuuaugagcgcagcgauaaaagauaguaaagcaguucaugcggacauggguuauuggauagaaucagaaaagaaugaaacauggaaacuggcacgagcaaguuucauagaaguaaagacauguacguggccaaaaucacauacgcucuggucgaauggaguuuuagaaucugagaugauaaucccgaaaauuuacggaggaccuauaagucaacauaacuaucgaccuggguacuuuacucaaacagccgggccauggcacuuggggaaauuagagcuagauuuugaccuuugugaaggcacgacaguugucguugacgagcauugcggcaaucgcggaccuagcuuaaggacuacuacuguaacagggaaaaucauacacgaguggugcugucggucauguacccuaccgccucuacgauuucguggggaggacggcugcugguacgggauggagauuagaccaguaaaagaaaaagaagaaaauuuaguuaggaguauggugagugccggcuccggagaaguagauaauuucagccuugguauacucuguguaagcaucaugauagaagaagugaugagaucucguuggucacguaagaugcuuaugacagguacauuagcggucuucuuauuauuaauaaugggacaauugacauggaacgaccuaauacgacuuugcauaauggucggugcaaaugcaagugauagaaugggaaugggaacuacauauuuagccuuaauggccacuuucaagaugagaccaauguucgcagucggacugcuguuucgcagauuaaccuccagggaaguuuuauuacucacgaucggucuaucgcugguagcuagccuugaauuaccaaacucgcuugaagaauuaggugauggucuugcuaugggaauuaugaugcugaaacuauuaacugaauuucaaccucaccaacucuggacaacacugcucucgcuuacguuuguaaaaaccacacucagcuuagauuaugcauggaaaacgacagcgauggugcuaaguaucguaaguuuauuccccuugugccugucgacaacgucacagaaaacaacaugguugccuguacuauuaggaucauuugguuguaagccauugacaauguuucuuauaacagaaaauaaaaucuggggaagaaaaucuuggccacuaaaugaaggaauuauggcuaucggaauuguaagcauacuauuaucuucguuacuuaaaaacgauguaccauuggccgguccgcuuauagcaggagggauguuaauagcuuguuacguaaucaguggauccagugccgauuuaagucucgaaaaagcugcugaagucuccugggaacaagaagcggaacauaguggggcuagccacaauauucuugucgaaguacaagaugacggaacuaugaaaauuaaagaugaagaacgggacgauacauugaccauccuacuuaaggcuacuuuauuggcgguaaguggcguauauccaauguccauaccagcgacacuauuugucugguacuucuggcagaagaagaaacaacgaucaggagugcucugggauacgccgucgccgcccgaagucgaaagggcuguguuagaugauggaauauaccgaauauugcaaagaggacuuuugggacgaagccaggucggaguagguguauuccaggaugguguuuuccauacaauguggcauguuacgcgcggggcgguauuaauguaccaagguaaacgucuugaaccaucuugggcaugugugaaaaaggaucugauaagcuacggcgguggauggagauuucaaggacuauggaacacuggcgaagagguccaaguaauugcagucgaaccagguaaaaauccuaagaauguccagacaacuccugguaccuuuaaaacaccugagggugaaguuggcgcaaucgcauuagacuuuaaaccuggaacaagcggaagcccuaucguuaaccgagaaggaaaaauuguagguuuauacggaaacggaguuguuacaacuuccgggacauauguaucugcuauagcucaagcaaaggcuucacaagaagggccuuuaccagaaauugaagacgaaguauuuaagaaaagaaaucuaacgauuauggaucuucauccagguuccgguaaaacucgcagguaccucccagccauaguucgagaagcaauuaaaagaaaguuaaggacuuuaauauuggcaccaacaagagucgucgcaagcgaaauggcagaagcucugaaaggcaugcccauaagguaccaaacaacugccguuaagagcgaacauacaggucgugaaauuguugaccucaugugucacgcgacauuuacaaugagguugcucucgcccgucagagucccgaauuacaauaugaucauuauggaugaagcacacuucacagauccagcaagcaucgcagcaagaggguacauaaguacucgagugggcaugggugaggcagcagccaucuucaugacagcaaccccgccaggaucgguugaggcauuuccacagucgaaugcagugauucaagaugaagaacgagauauuccagaacggaguuggaacucagguuaugacuggauuacggauuuucccggaaagaccguaugguuuguccccaguaucaaaucgggaaacgauauugcgaauugccuacggaaaaaugguaagagaguuauacaacugucgagaaaaacuuucgacacggaguaucagaaaaccaaaaauaaugacugggacuacguaguuacuacggacauuucggaaaugggagcuaauuuuagagcugacagaguaauagacccacgccguugucuaaagccuguaauacuuaaagacggcccagaaagaguuauauuagcagguccaaugccgguaacaguggcaagcgcagcgcaaagacguggcagaauaggacgaaaucaaaacaaagaaggugaucaguacgucuauaugggucaaccauuaaacaaugacgaagaccaugcucacuggacagaagccaaaauguuacuagauaauauuaauacucccgaagggauuauaccagcccuuuucgagccagaacgugaaaagagcgcugccauugauggagaguauaggcugcgaggugaagcacggaaaacuuucguugaauuaaugcgcagaggggaccucccggugugguuauccuauaagguugcaucagagggguuccaauauagugaccguaggugguguuuugacggagaaaggaacaaccagguuuuagaagaaaacauggauguggaaaucuggacaaaggaaggcgaacgcaagaaauuaagaccaagaugguuagacgcgcggacauauucagauccuuuagcucugcgagaauuuaaagaguucgccgcaggaaggcguuccguuuccggagaucugauuuuagaaauuggaaaacuaccacaacaccugacgcuucgcgcacagaaugcauuagauaaccuagugaugcuacacaacagcgagcagggcgggaaagcauauagacacgcuauggaggagcuaccugacacuauagagacauugauguuacuugcacucauagcgguucuuaccggcggugucacacuguucuuucuaucugggaaaggcuuagggaaaacaucuauaggguuacugugcgucacagcgucaagugcacuucuguggauggcguccguagaaccucacuggaucgcggcuaguauaauucuggaguucuuucuuaugguauugcuaauuccugaacccgauagacagcgaacaccucaagauaaucagcuagccuauguuguaaucggccugcuguuuaugauauugacgguugccgcaaacgagauggguuuacuagaaaccaccaagaaagaucucggaauugggcacguggcagcagaaaaucaccaacaugcaacuauguuagacguagauuugcauccagcuucagcauggacgcucuacgcuguugcaacuacggucaucacucccaugaugagacacacuauugaaaauacaacagcaaacaucagccuaacagcaauagcuaaucaagcggcuauacuaaugggccuagauaaagguuggccaauaucaaagauggauauuggagucccuuuacuugcccugggauguuauucacaaguuaacccauuaacauuaacagcagccguuuuaauguuaguugcacauuacgcuauaaucgguccuggccuucaagcgaaagcgaccagagaagcacaaaaacggacagcagcugggauuaugaagaauccaacggucgauggaauaguagccauugaucuugacccuguaguauacgaugcaaaauuugaaaaacaauuaggccaaauaaugcuucuuauauuguguacuucacaaaucuuacuaaugaggacaacuugggcgcucugugaaucuauuacucuagcuacaggcccacugacaacuuuaugggaagguaguccaggcaaauuuuggaacacaacaauagcaguaaguauggcaaauauauuuagggguucauauuuagcuggcgcgggccucgccuuuaguuuaaugaaaagucuugggggcgguagaagggggacuggcgcucaaggggagacgcuaggggaaaaauggaaaagacaauuaaaccaacucaguaaauccgaauuuaacacuuacaaaagaucggguauaauggaaguggauagaucagaagccaaagagggacuuaaaaggggagaaacaacgaagcacgccguuagucgaggaacugcaaaacuacgaugguucguagaacgcaaucuuguuaagccagaagguaaggucauugacuuaggcuguggaaggggcggguggucauacuauugugcuggacucaagaaaguaacagaagucaaaggauacacaaaaggcgguccugggcaugaagaaccuauuccuauggcgacauauggcuggaaccuaguuaaguuacauagcgggaaagacguauucuuuaugcccccagaaaaaugugauacuuuguuaugugauaucggugaaaguucaccaaacccgacgauagaagaagguagaacgcuacgcguacuaaagaugguggaaccauggcucagagguaaccaauuuugcauaaaaauuuuaaauccguacaugccauccgugguugaaacuuuagaacaaaugcagaggaaacacgguggaauguuggucagaaaccccuugucgcgaaauuccacgcaugagauguacuggguuagcagagguaccggaaacaucguaagcgccgucaacaugacaucuagaaugcuauuaaacagguuuaccauggcacauaggaaaccuacauaugagagagacguggaucucggagcugguacgcgacauguagccguagaaccagaaguggcaaaucuagacauaauaggacaaagaauagaaaacaucaaaaaugaacauaaaucgacguggcauuacgacgaagacaauccuuauaagacuugggcguaucauggaaguuacgaaguaaagccgucaggauccgccucgucgaugguuaaugguguagugagguuacucacaaagccgugggacgucauuccgaugguaacucagauagcaaugaccgauacuacacccuucggucaacagcgcgucuucaaagagaaaguagauacaaggacgccacgagcuaagcgagggacaacacagaucauggaaguaacagcgaaaugguuauggggauuuuuaagcaggaauaagaaaccaaggauauguacuagagaagaguuuacaagaaaaguaagaucuaaugccgcaauuggagcgguauucguagacgaaaagcaguggaacagcgcgaaagaggcaguagaagaugaaagguuuugggacuugguucacagggaaagagaauuacacaaacaaggaaagugcgccacauguguauauaauaugauggguaagcgagagaagaaauugggagaguuuggcaaggcaaagggcucacgggccauaugguauaugugguuaggagcgagauuccuagaguucgaagcccucggauuuaugaaugaagaccauugguucagcagggaaaauucacuaucagggguggaaggggaagguuuacacaaguugggcuacauucuccgagacauaucgaaaauaccaggagguaauauguacgcagacgauacagcagguugggacaccagaaucacugaggaugaucuccagaaugaagcaaaaauaaccgauauaauggagccagaacacgcuuuacuugcuaccucgauauuuaaacuuacuuaccaaaauaaggucguuagaguacaaaggccagcgaaaaacgguaccguuauggauguaauaucuagacgagaucaacguggcucagggcaaguuggcaccuacggauuaaacacauucacuaauauggagguucaauuaauaagacaaauggagagugaaggcauauucuuaccguccgaauuggaaacgccgaaucuagcagagcgaguacuugacugguuagagaaacauggggccgaaagacuuaagaggauggcgauuagcggagaugacugcgugguuaaaccaaucgacgaccgguucgcuacagcguuaaccgcacugaacgauauggguaaaguaaggaaagacauuccgcaaugggaaccguccaaaggauggaacgauuggcaacaaguaccguuuuguagccaccauuuucaucagcuuauaaugaaggacggucgcgagaucguggucccgugccgcaaccaagaugagcuuguuggcagagcacgaguaucacaaggagcaggguggucuuugcgagagacagcaugccuaggaaaguccuacgcgcaaauguggcaguuaauguauuuccauagaagagacuuaagauuagcagcuaacgcuauaugcucagcagugccaguagauuggguaccuacaagcagaacaacguggucaauucaugcccaucaucaguggaugacaacagaagacauguuaucuguauggaacaggguauggauugaagagaauccauggauggaagauaagacucacguuagcuccugggaggaaguuccauaucuagguaaacgcgaggaucaaugguguggcagcuugauuggcuugacagcuagagcaaccugggccacgaauauacaggucgcaauaaaucagguuagacgauuaauagggaaugaaaacuaucuagacuauaugacaucgaugaaaagauuuaagaaugaaucagaucccgaaggagcuuuaugguaa

SEQ ID NO: 22047 - RNA, 9879 nt, Artificial Sequence
  derived and/or modified CDS sequence (opt6) from DENV-1__KC692517__SS-prME
ucuguaacaauguuacuuauguuacuccccaccgcuuuagcguuucacuuaacgaccagaggaggggaaccucauaugauagugagcaaacaagaacgagggaaaucacuuuuauucaaaaccagugcaggagucaauauguguacccucauagcgauggaccugggagaauugugcgaagauaccaugacauauaaaugcccucguauaacggaagcugaaccugacgauguggauuguuggugcaaugcuacagauacauggguaacguauggaacauguagucaaaccggagaacaccgaagggauaaacgaucaguagcauuagcaccccacguugguuuaggauuagaaacuagaacggagacauggaugaguagugaaggugccuggaaacagauacaacguguugagacgugggcuuuacgacauccaggauucacgguaauugcgcuauuucuagcccaugcaauuggcacgagcaucacacaaaaaggcauaauauuuauucucuugauguuaguuacaccgucuauggcaaugcgaugcgucgggauaggcaaucgagauuuugucgaaggacuuucgggugccacauggguagauguaguauuagaacacgguucuugcguuacaacgauggcgaaaaacaaaccaacacuagacauagaauuguuaaaaacagagguuacaaauccugcggugcugagaaaacuuugcauagaagcgaaaauauccaauacaacuaccgauagcagaugcccgacacagggcgaagccacacugguagaagaacaagacgcgaauuuuguuuguagaagaacauuuguagauagagguuggggaaacggaugcgguuuguuuggaaaaggaaguuuauugaccugugcuaaauuuaaaugcgucacuaaauuagaagguaaaauaguacaauaugaaaaccuaaaauauucaguuauuguaacuguacacacaggugaucaacaucagguuggaaaugaaaccauagaacauggaacgauagcuacaauaacuccucaagcacccacgucagaaauucaauugacggauuacggugcauuaaccuuagauuguucaccaagaacgggucuagauuucaaugaaaugguacuucucacaaugaaagaaaaaucguggcuaguucauaaacaaugguuucucgaccuuccccuuccauggacgagcggagcaagcaccccucaagagacuuggaaccgacaagauuuguuaguaaccuuuaaaacggcccaugcgaagaaacaggaagucguuguauuaggaagccaagaaggugcaaugcacacagcuuugacuggcgcaaccgaaauacagaccucgggaacgacuacgaucuucgccggacauuugaaaugucgucucaaaauggauaaacuuacgcuaaaaggaaugucauacguaaugugcacaggguccuucaaacuagagaaagaagucgcggaaacacaacacgggacaguauugguacaaguaaaauacgaagguacugaugcuccuugcaaaaucccauucucaacacaagaugaaaaaggcgucacgcaaaauggcaggcugauaacagccaauccaauagucacagacaaggagaaaagcguaaauaucgaaacugaacccccauucggggaaaguuacauagucguuggugugggagaaaaagcacucaaacucucuugguucaaaaagggauccucaaucggcaagauguuugaagcuacagcaagaggagcaagaagaauggcaauccuaggagauacugcgugggacuuuggaucaaucggcggcguguuuacgucagugggaaaacugguacaucagguauuugggacagcuuacggugucuuauuuagcggaguuaguuggacgaugaaaauugggauagguauacuuuuaacuuggcugggccuaaauucgagaaguaccaguuuaucuaugacuuguaucgccguagggaugguaacacucuaucuaggagugauggugcaagcggacaguggaugcguaauaaauuggaaagggcgugaauugaagugugguuccgggauauucgucacaaacgagguacacaccuggacggaacaauacaaauuccaagcugacaguccaaagcgacuaucggcagccauagguaaggcuugggaggaaggaguaugugggauaaggucugcaacaagacuagaaaauauaauguggaaacagaucaguaacgaacucaaccacaucuuauuagaaaaugacaugaaauucacuguaguaguaggcgaugcaaacggaauacuugcucaggguaagaaaaugauacgaccucaacccauggagcauaaauauucguggaaguccugggguaaagcaaaaauuaucggugcagacauacaaaacacaacauuuauuauagacgggcccgauacaccggaguguccagauggccaaagggcguggaacauaugggaaguugaggauuauggcuucggcauauucacaacaaauauuuggcuaaaguugagggacaguuacacucaaaugugcgaccacagguuaaugagcgcagcgauaaaagauagcaaagcuguccaugcagauaugggguauuggauagaguccgagaaaaacgaaacauggaaacuugcuagagcuagcuucaucgaaguaaaaacauguaccuggccaaaaucgcauacauuauggucuaacggcguacuugaauccgaaaugauaauacccaagauuuauggaggaccaauuucgcagcacaauuacagaccaggcuacuuuacccaaacagccgggccguggcauuuggggaaauuagaacuggauuuugacuuaugugagggaacuacaguaguagucgaugagcacuguggaaauagaggucccagccuacguacgacgacugucaccgggaagauaauacaugaaugguguugccgcaguuguacucugccaccucucagauuccguggugaagacgguuguugguauggcauggaaauacggccagugaaagagaaggaagaaaacuuaguccggaguauggucagugcgggcucuggggaagucgacucguuuucucuaggcaucuuaugcguaucaauuaugauagaggaaguaaugagaucacgauggucaagaaagaugcuuaugacuggcacucuagccguauuccuucuauuaauaaugggacaacugacauggaacgauuuaaucaggcucuguaucauggucggagcgaaugccucggauaggaugggcaugggaaccacauauuuagcacuaauggcuacauucaagaugagaccuauguuugcgguaggacuacuuuuucgaagguugacaagccgcgaaguuuuacuauuaaccaucggccuaagucucgucgcuucugucgaacucccaaauucccuagaagaacuuggcgauggguuggcaaugggaauaaugaugcugaaauuauuaacugaauuucaaccacaccaauuauggacaacuuuauuaucacuuacauuuguaaaaacaacucuaucauuagauuaugccuggaaaacuacugcaaugguacuaagcauaguaucgcuguuuccacuauguuuaucgacuacaagccaaaagaccacuuggcucccgguauugcucggaucauucggguguaauccauugacuauguuccucauaacggaaaacaaaaucuggggcagaaaaucuuggccguuaaaugaaggcauaauggcuaucggaaucguuucuauucuuuuaucuucauuauuaaagaaugacguuccucucgcagguccgcugauagcaggcggaauguugaucgcguguuauguaaucagcggaucuucagccgaucucuccuuagagaaagccgcagaaguaagcugggaacaagaagcagaacacucgggcgcaucucacaacauccugguugaaguucaagacgacgggaccaugaaaauaaaagaugaagaaagagaugauacauuaacaauauuacuaaaagcuacuuuauuagccguuucuggagucuaucccaugaguauaccagcgacauuguucgugugguacuuuuggcagaagaagaaacaaagaucggggguucuaugggauaccccaaguccacccaaaguagaaagggccgucuuagacgauggcauauaccguauucuccagagaggguuacugggaagaucgcaaguagguguuggaguguuucaagauggaguuuuccauacgauguggcacguuacucgaggggcuguucugauguaccagggcaagagacuugagccuaguugggcgaguguuaagaaagacuuaauaucauaugguggaggguggagauuucaaggaaguuggaauacaggugaggaaguucaaguuauugccguagaaccuggcaaaaauccuaaaaacguacaaaccacgccaggaaccuuuaaaacaccagagggugaaguaggugccauagcacuggauuucaaaccgggaacaucggguuccccgaucgugaaccgggaagguaaaauaguaggacucuacggcaauggaguugugaccaccucggguacauacguaagcgccauugcucaagcaaaggcaucucaagagggacccuuaccagaaauagaagaugagguguucaagaaaagaaauuuaacuaucauggaccugcacccagguagugguaagacgagacgauauuuaccugcuauaguacgugaagcaauaaagcgcaaacuacgcacauuaauuuuagccccaacuagaguuguugccucggaaauggcagaggcuuugaagggcaugccaauuagauaucaaacaacagcaguuaaauccgaacacacaggcagagaaauuguagaucucaugugucacgcaacuuuuacaaugagauuacuuuccccaguuaggguaccaaacuacaauaugauaauuauggacgaagcccacuuuacagaucccgcaagcauagcagcaagaggcuauauaucaacuagggucggaaugggcgaggcagccgcuauuuuuaugacagcaacucccccgggaucuguagaggccuuuccucaaaguaaugcaguaauacaagaugaagaacgugauauacccgaaagauccuggaacucaggauacgauuggauaacugauuucccuggaaagaccgugugguuuguaccuaguauaaaaaguggaaacgauauagcaaauugucuacguaaaaauggaaagagggucauucaacuaucaagaaagacguuugacacugaauaucagaaaaccaaaaauaaugauugggacuacguugucacaacagauauaagugagaugggagcaaacuucagggcggacagaguaauagauccgcgacggugucuuaaaccaguaauccuaaaagauggaccggagagaguuauauuagcgggacccaugccuguaaccguagcgucagcagcucagcgucguggucgaauugggcguaaucaaaauaaagaaggggaucaauauguuuacauggggcaaccucucaacaaugacgaggaccacgcccauuggacagaggcgaaaaugcuucucgauaauauuaacacaccagaagguauaauaccagcauuauucgaacccgaacgcgaaaagucagccgcaauugacggggaauaccguuuaaggggagaagcuagaaaaacuuucguugaacuuaugcgaagaggugauuugccaguauggcuaagcuacaaaguugcgagcgaagguuuccaauauucugauagaaggugguguuuugacggggagcggaauaaucaaguguuagaagaaaacauggauguagaaauuuggacuaaagagggcgaaaggaagaaacuaagaccaagauggcuagacgcacgaaccuauagcgacccacuggccuuaagagaauuuaaagaguuugcagcaggucggaggaguguaucgggagauuuaauauuagaaaucggaaaauuaccgcagcauuuaacgcugcgcgcccaaaaugcauuagauaaucugguuaugcuccauaacagugaacaaggagguaaggcuuaccgccaugccauggaagaguuaccggauacgaucgagacuuuaauguuguuagcuuugauagcgguucuaacaggagggguaacacuauucuuuuuaagcggaaaaggucuuggcaaaacaagcauuggguugcuaugugucaccgccucuuccgcauuauuauggauggcaaguguugaaccgcacuggauagcugcuucuauuauauuagaauuuuuccuuaugguucuguugauccccgaaccagauagacaaagaaccccacaagacaaucaauuggcauaugucgugauaggacuguuauuuaugaucuuaacaguggcggcgaaugaaauggguuuacuagaaacaacuaaaaaggacuuagggaucggguauguggcugcggaaaaccaucaacaugcgacuaugcuggacguugauuuaaggcccgcuagcgcuuggacacuguacgccgucgcgacuacgguaaucacaccaaugaugagacacaccauugaaaauacaacggcuaauauaucacuaaccgcaaucgcaaaucaagccgcgauucucaugggucuggauaaaggauggccaauaagcaagauggauauaggaguaccgcuguuagcucuaggauguuauagucaagucaauccucuaacuuuaacggcagccguguuaaugcuaguugcacauuaugcaauuaucggcccuggauuacaagcaaaggcaacucgggaagcucaaaaacguacagcugcugguauaaugaagaacccuacuguggaugguauaguagcgauugaucuggauccaguaguuuaugacgcaaaauuugaaaaacaacuaggccaaauaauguugcuuauacucuguaccucgcaaauauuacuuaugagaacuacuugggcuuuaugcgaaagcauuacauuggccacaggaccacuaacuaccuugugggaagggagccccggaaaguucuggaacacgacaauagcaguaaguauggcaaauauauuuaggggaucuuauuuggcaggagcaggccucgcuuuuucgcuuaugaagucuuuaggaggugguagaaggggaacaggugcucagggcgaaacacuuggugagaaauggaaacggcaauuaaaccaauugagcaagucugaauuuaauacauauaagaggagcggaaucauggaaguggaucggagcgaagcgaaggaagggcucaagcgcggcgaaacuacaaaacaugcggugucgagagggacugcgaaacuacggugguuuguagaacguaauuugguuaaaccugaaggaaaagucaucgaccuaggauguggucgcggugguuggaguuauuacugugccggccuuaaaaagguuaccgaggucaaagguuauacaaaaggcgguccggggcacgaagaaccgauaccaauggcgacauaugguuggaaccuagugaaacuccauucgggcaaagacguauucuucaugccgcccgaaaaaugcgauacuuuauuaugcgacauaggugagaguucaccgaauccaacuaucgaggaaggacggacacuucgagugcuaaaaaugguagaaccauggcuaagaggaaaucaguuuuguaucaaaauucucaacccauacaugcccagcguaguggagacuuuggaacaaaugcaaagaaaacauggcggaaugcuaguucgaaauccuuuaagucgaaauucaacacaugagauguacuggguguccugcggaacuggaaauauugucuccgcuguaaauaugacaucucggaugcuacuaaauagauuuacaauggcccauagaaagccaaccuaugaaagggacguagauuugggggcugggacgagacauguagcaguggaaccugaaguagcuaaccuagauauuauaggccaaagaauugagaauauaaagaaugaacacaaguccacuuggcauuaugaugaggacaaucccuauaaaacgugggcuuaucauggguccuacgaggucaaaccaagugguagugccaguaguaugguuaauggagugguaagauuacucacuaaaccaugggacguuauucccaugguaacucaaauagcaaugacagauacgacaccauuuggacaacagcgggucuucaaagaaaaaguagauacgcgaacaccccgagcaaaaagaggaacuacucaaauaauggaagucacggcgaaauggcuauggggauucuuaagccguaacaaaaagccgcguauaugcacccgugaagaguuuacacgcaaaguaagaucaaaugcugcuauuggcgcaguguucgucgaugaaaaucaauggaacucagcgaaagaagcgguugaagacgaacguuuuugggaccucguacauagagaaagagaacuccauaaacaagguaaaugugcuacaugcguuuacaacaugaugggaaaacgagagaagaaauugggagaguuuggcaaggcaaagggaagccgggcaaucugguauauguggcuaggugcacgguuucuagaguucgaggcuuuaggauuuaugaaugaagaccauugguucaguagggaaaauucgcuaucaggaguagagggagaaggguugcauaaacuugguuauauauuacgagacauaucuaaaauaccuggggguaacauguaugcggaugacacugcgggcugggacacacguauuaccgaagacgauuuacaaaacgaagcuaaaaucacugauauaauggaaccagaacacgcucuccuagccaccucaaucuucaaacucacuuaccagaacaagguaguacgcguacagcggccugccaaaaauggcaccguuauggauguaauauccaggcgugaucaacgcggaagcggccaaguuggaacauacggccuaaauacauucacgaauauggagguccaacugguucgucaaauggaaagcgaaggcauuuuucugccauccgaacuugagaccccaaaucuagcagaacguguauuagauuggcuagaaaaacacgguguugaaagacuaaagagaauggcaauuaguggagaugacuguguaguaaaaccuauagaugauagauucgcaacggcgcucacugcacuaaaugauauggguaagguaagaaaagacauaccgcagugggaaccuuccaagggauggaaugauuggcaacaagucccuuuuugcagucaccacuuucaccaacuaauaaugaaggacggaagagaaaucguuguucccuguagaaaccaagaugaacuuguuggacgggcaaggguaagucaaggggccggcuggagcuuaagagaaacugcuugccuugguaagaguuacgcacagauguggcaauuaauguacuuucaucgaagggauuuacgguuagcggcuaaugcaauauguagugcugugccaguagauugggugccgaccucuagaacaacuugguccauacacgcucaucaccaguggaugacaacagaagacauguuaucuguuuggaaucgaguuuggauagaggaaaauccuuggauggaagacaaaacgcaugucagcagcugggaggaggugccuuaccuaggcaaaagagaagaccaauggugugguucacuaaucggucuaacggcaagggccacaugggccacuaauauucaagucgcaauaaaucaaguacggcgacugaucggaaaugaaaacuauuuagauuacaugacaucaaugaaacguuucaagaacgaaucagauccagaaggcgcguuaugguaa

SEQ ID NO: 22048 - RNA, 9879 nt, Artificial Sequence
  derived and/or modified CDS sequence (opt6) from DENV-1__KC762649__SS-prME
agcgugacaauguuauugauguugaugccuaccgcgcuagcuuuucauuuaacuaccaggggaggggaaccccacaugauuguaaguaaacaagaaaggggaaaaucacugcuguucaaaacaucagcuggcgugaauaugugcacguuaaucgcgauggacuuaggugaauugugcgaagauacucugacguauaaauguccaagaauuaccgaagcugaaccugaugacguugauuguugguguaacgcaaccgacacauggguuacauaugggacauguagucaaacaggggaacaucgcagagauaaacgcucuguugcacuagccccucaugucggucuaggacuagaaacucgaaccgaaacauggaugucaagugaaggagccuggaagcaaauucagaggguugaaacgugggcucugagacauccaggauuuacgguuauugcucuuuuccuagcucacgcuauuggagcaaguaucacgcaaaagggcaucauuuuuauucuccuaauguuaguaacacccucuauggcaaugagaugcgugggcauuggcagcagggacuucguggaagguuugaguggagccacguggguugaugugguccucgaacacgguucauguguuacaacaauggccaaggauaaacccacacuagacauugaacuccuaaagacagaaguuacgaacccugcagucuuacgaaagcuaugcaucgaagccaagauaagcaacacuacaacagauucccgauguccgacgcagggugaagcaacauuaguagaagaacaagaugcaaacuuugugugccgcagaacguuuguugaucguggauggggaaacggauguggcuuauuuggcaaaggaucccuaauuacaugugcaaaguuuaaaugcguuagcaaauuggaaggaaagauagugcaguaugaaaaucugaaauauuccguaauaguaacagugcauacaggagaucagcaccagguaggaaacgaguccacugaacaugguacaaccgcgaccauuacaccacaagcgccuacaacagaaauacaauuaacugauuauggagcgcuuacacuugacugcuccccgcgaacuggucucgacuucaaugaaaugguacuuuuaaccaugaaagagaagucuuggcuggugcacaagcaaugguuucuagaucuuccacuucccuggacaaguggcgcuucaacaucacaagagacuuggaaucgucaagaccucuuaguuacuuuuaaaacagcacaugccaagaaacaagaaguugucguacuaggaagccaagagggagcaaugcacacugcacuaacaggggcaacagaaauacaaaccuccgggacgacaacgauuuuugcgggacauuuaaaaugccgacuaaagauggauaaauuaacacuuaagggcaugucauacguaauguguacaggcucauuuaaauuagaaaaagagguugcagagacccaacauggaacagugcuugugcaaaucaaauacgaagguacugaugcgccauguaaaauuccauuuucuacccaagacgagaaaggcguuacccaaaacgggagauugaucaccgccaaucccaucgugacagauaaagagaaaccggucaauaucgaagcugaaccaccguucggugaaucguauauagucaucggagcaggcgaaaaagccuugaaacuaucaugguuuaagaaaggaagcucaaucggcaaaauguucgaagcuacugcccguggagcacgacgaauggcgauauuaggugacacggcaugggacuucgguucuauaggagggguauuuacaagugugggcaaauuaguucaccaaauuuuugggacggcuuacgggguauuauuuagcgggguaucauggaccaugaaaauaggcaucgguguacuucugacuugguuagguuuaaauucaagaucaacaucucuuaguaugacuuguauagcaguaggcuugguuacguuauauuuaggaguaauggugcaagcggauucaggguguguuaucaauuggaaagggcgagaguugaaauguggaucaggcaucuuuguaacaaacgaaguacauaccuggaccgaacaguauaaauuccaagcagauucaccuaagagauuauccgcggcuauagggaaagcaugggaggaaggugucugcggaauacggucagcaacgagacuggaaaauauuauguggaaacagaucagcaaugaacucaaucauauuuuauuggaaaaugauaugaaauucacgguaguaguuggagacguagcagguaucuuagcacaagggaaaaagaugauccggccgcaacccauggagcacaaguauagcuggaaaucuuggggcaaggcuaaaauuauaggcgcagacguacaaaauacgaccuuuauaauagauggaccgaauacuccggaaugcccagaugaucagagagcauggaauauaugggaaguagaagacuaugguuucgguaucuuuacaacgaacauaugguuaaaacuaagagauuccuacacucaagucugcgaucaucgucuaaugagcgcggcaauaaaagacucuaaggcgguucaugccgacaugggauauuggauagaaagcgagaaaaaugagacguggaaguuagcuagggcuucauucauugaaguaaaaacuugcauuuggcccaaaagccacacacuauggaguaauggaguuuuggaaagcgaaaugaucauaccaaagauuuauggaggaccgaucagucaacacaauuauaggccaggauauuuuacacagacggcgggcccuuggcaucuuggcaaauuggaguuagauuuugaccucugcgaaggaacaaccguugucguagaugaacacuguggcaacagaggacccucucucaggacaacuacagucacagggaagaucauacaugaauggugcuguagaucuuguacauuaccaccacuccguuuuaggggagaagauggcugcugguauggcauggaaauaaggccggugaaagaaaaagaggaaaaccuaguuaaaagcaugguaucagcuggaucuggcgaaguugauucauuuagcuuaggauuauuauguauuucaauaaugauagaagagguuaugagaucucguuggagccgaaaaaugcuaaugacugggacauuggcuguauucuuuuuguuaaucaugggucaacuaacguggaaugacuuaauaagacucuguauaauggucggagcgaacgcgucugacagaaugggcauggguacgaccuauuuagcccuaauggcaacuuucaaaaugaggccgauguuugcaguugggcuacucuucagacgguuaacgaguagagaggugcuucuuuuaacaaucggguugagcuuaguugcaagugucgaauugccuaacucccuggaagaauuaggagauggccuagcaauggguaucaugauacuaaaguuacuuacagauuuccaaucacaucaauugugggcuacuuuacuaucucuaacuuuuauuaagacuacguuuuccuuacacuacgcguggaaaacuauggcgaugguuuuaagcauuguaucccuauucccccugugccuauccaccacaagucagaaaacuacuuggcuaccaguccuuuuaggaagucucggaugcaaaccucuaacgauguuccugauugccgagaauaagauaugggggagaaaaagcuggccacuaaaugagggaauuauggcagugggcauaguuucuauucuucucucaucauuacucaaaaaugacguaccgcuagcugguccccuaaucgccggugggauguuaaucgcauguuaugugauaucaggaucaagugcagaucuaagucuagagaaagcugcugaagugagcugggaagaagaagcggaacauuccggugcaucgcauaacaucuuggucgaaguucaagacgauggcaccaugaaaauuaaggacgaggaaagagaugauacuuuaacuauauuauuaaaagccacacuuuuagccguaagugggguauacccccucaguauuccagcuacuuuauucgucugguauuuuuggcagaaaaagaaacaaagaucuggaguacugugggacacaccuaguccuccggagguagaacgagcagucuuagaugauggaauauacagaauaaugcaacgcggacuauuaggacgaucgcaaguaggaguuggugucuuccaggaaaauguauuccauaccauguggcaugugacuaggggugcgguguuaauguaucaagguaagcgcuuagagccaucaugggcgucugucaagaaagauuugauaucguacggagggggauggcgauuacaaggaaguuggaacacgggagaagaagugcaagucauagcaguagagccagguaagaaucccaaaaacgugcaaacagcucccgguauuuucaaaacacccgaaggcgaaguaggagcgauagcacuagauuucaaaccgggaacaucgggaagucccauaguaaacagagaaggcaaaaucguuggauuauaugggaauggaguuguaacaaccaguggaacuuauguaagugcuauagcucaagcaaaagcaagccaagaaggaccccuucccgaaauagaagaugaaguguuccguaaacgaaaucuaacuauuauggaucuacaccccggaagugguaaaacuagacguuacuuaccugcuauugucagggaggcgauaaaacguaaauuaagaaccuugauucuugcgccgacucggguugucgcuagcgaaauggcagaagcauugaagggaaugcccauccgauaccaaacuacggcgguuaaaucugaacacacugguaaggaaauaguugaucuuaugugucaugcaacauuuaccaugagguugcuaucaccaguuagaguccccaauuauaacaugauaaucauggacgaagcccacuucacagauccaaguucaauugcugcacgaggauauaucaguacgagaguggguaugggcgaggcagcagcuauauuuaugacggcuacaccacccgguuccguagaagcauucccucaaaguaacgcgguaauacaagacgaagaaagggacauacccgaaagaucauggaacucaggauacgaauggauaacagacuuuccaggaaaaacuguaugguucguuccuaguaucaaaucugggaaugacauugcgaauugcuuacguaaaaauggcaaacgagucauacaacuaaguagaaaaacauucgacaccgaguaccaaaagacuaaaaauaacgacugggauuacgucgugacuacggacauauccgaaaugggggcaaauuuccgggccgacaggguuauagauccaagacguuguuuaaaaccgguaauauuaaaagacgggcccgaaagggugaucuuagcaggaccuaugccggugaccguagcuagugcagcacagaggagagggcgugucgggagaaaucacaauaaagaaggagaucaguauauauauaugggucagccauuaaauaaugacgaggaucaugcccacuggacggaagccaagauguugcuagauaauauuaauacuccagaaggcauaauaccagcguuauucgagcccgagcgcgagaagucggcagcaauugauggcgaauaccgauugagaggugaagcacguaagacauuuguggaauugaugcggaggggagaucugcccguauggcuuucauauaaaguagccagcgaaggauuucaauauucugaccggagauggugcuuugauggggaaaggaauaaccaaguacucgaggaaaacauggauguagaaauauggacgaaagaaggugaaaggaagaaacuacgaccaagaugguuagaugcaagaacuuauuccgacccacuagcuuuaagagaauuuaaagaauuugccgcgggacggcguucaguuaguggagacuuaauauuagaaauaggaaaacuaccacaacaccuuacccaacgagcacagaacgcuuuagauaaucucgugauguuacacaacagugaacagggcggcagagcauauaggcacgcgauggaggagcuuccagacacaauugaaacuuuaauguugcucgccuuaauugcagugcugacuggagguguaacauuauucuuccucagcggaagagggcuagguaaaaccucaauagggcuuuuauguguaauggcaagcagcguucuuuuauggauggcaagcguugagccucauuggauagcugcaucgauaauauuagaguucuuuuugaugguacucuuaauaccagagccagacagacaaaggacuccacaggauaaucaacucgcauauguaguuauugggcuauuguucaugauacuaacaguugcagcaaacgaaauggguuuacuagaaacaacaaagaaagacuuaggaauuggacauguagccguugaaaaucaccaucaugcggccaugcuggauguggaccuccauccugcgagcgcauggacucucuacgcuguagcaacuacaauuauuacgccaaugaugcgccauacgauagaaaauaccacggcaaauauuagcuuaacagcuauugcaaaccaagcagccauucucauggggcuagauaaaggguggccuaucagcaaaauggauauuggaguaccacuccuugcccuggguugcuauagucagguaaacccauuaacccuaacugccgcaguauugauguuaguagcacauuacgcaauaauagguccaggauuacaagccaaagcuacuagggaagcacagaaaagaaccgcggcaggaauaaugaagaaucccacaguagaugguauaguugccauagacuuagauccagugguuuaugacgcgaaauucgaaaaacagcucggacaaauaauguuauugauucuguguacaucccaaauuuugcuuaugagaacuacuugggcacuaugugaaaguaucaccuuagcgacaggcccuuuaacaacuuuaugggaagguagcccggguaaauucuggaauacuacgaucgcgguauccauggccaauauauuucgcggcagcuaucuagcaggagcaggacuugcguucagccuuaugaaaagucucggagggggcagacguggaaccggugcacaaggagaaacgcuuggagaaaaauggaaaaggcagcucaaccaauugucuaagagugaguucaauacuuacaaaagaucgggaauaauggaaguagauagaucugaggcgaaagaaggauuaaaaaggggugagacaaccaaacaugccguaagcaggggaacugcuaaacucagaugguucguagaacgaaacuuaguaaaaccugaagggaaaguaauagacuuaggaugugguagagguggcuggagcuauuacugcgcaggacuaaagaaaguaaccgaagugaaaggguauaccaagggcggucccgggcacgaagaaccaauaccgauggccacguacggauggaacuuaguaaaauuacacucaggaaaagauguguucuucauuccaccugagaagugcgauacucuacuaugcgacaucggcgaauccagucccaauccaacaauagaagaggguaggacauugcguguauuaaaaaugguggaaccaugguuaagaggaaaccaauuuuguauuaaaauauuaaacccauauaugcccuccguuguugaaacgcuugagcaaaugcagagaaaacaugguggcaugcuaguuaggaauccucucucacguaauucuacccaugaaauguauuggguaagcugugguacaggaaacauugucucugcgguaaauaugacuucuagaaugcuuuuaaacagauuuacaauggcacauagaaaaccuacguacgaaagagauguggacuuaggugcagggacgcggcaugucgccguggaaccugaaguagcuaacuuggauauuauagggcaacgcauugaaaacauuaaacaugaacacaaaagcacauggcacuacgaugaagacaauccguauaaaacuugggcauaucauggcaguuaugagguuaaaccaagcgggucugcuucaagcaugguaaauggcguagucaaacucuuaacuaaaccaugggacgucauaccgaugguuacacagauugcaaugacagauacuacacccuucggucagcaaagaguauuuaaagaaaaaguagacacgaggacucccaaagcuaaacgagguacaacgcaaaucauggagguuaccgccagaugguuguggggauuucuaaguaggaacaaaaagcccagaauaugcacgagagaggaauuuacuagaaaagucagauccaaugccgcaauaggcgcaguauucguagaugaaaaccaauggaacagugcgaaggaagcaguugaagaugaacgauuuugggacuuaguucaucgggaaagagaguuacacaaacaaggaaaaugugcuaccuguguauauaauaugauggguaaacgugagaagaaacuuggugaauuuggaaaagcaaaagguucaagagcuauaugguacauguggcuaggcgccagguuucucgaguucgaggcuuuagguuucaugaacgaagaucacugguuuaguagagaaaauucuuuaucaggcgucgaaggggaaggacuacauaaauuaggcuauauacuuagagacauuucaaaaaucccagguggaaacauguaugcggacgauacagcuggaugggauacaagaauaacggaagaugaccuacagaaugaagcaaaaauaaccgauaucauggaaccggaacaugcacuguuagcuaaagcaaucuuuaagcucacauaccaaaauaagguuguucggguacaaagaccagccaaaaauggcaccguaauggauguuauaucacgcagggaccaaagggguucaggacaaguuggaacauaugguuuaaauaccuucacaaauauggaagcucaguugauucgccaaauggaaucagaaggaauauuuucaccaagugaguuagaaacaccaaaucuugccgaacggguucuagacuggcuugaaaaguauggaguggaaagguugaaaaggauggccauuucuggagaugauuguguagugaaaccaauagaugauagauucgcaacugcccugacugcacuaaacgacaugggaaaggucagaaaagauauuccucaaugggaaccaucaaaagguuggaacgacuggcagcaaguuccuuuuugcucacaccacuuucaucaguuaauuaugaaggauggaagagaaauaguugugccgugucgaaaccaagaugaauuagucggacgcgcacgagucucucaaggcgcgggauggucccuacgugaaacagcaugccuaggaaaaagcuacgcccagauguggcaauuaauguauuuucauaggagagaucuacgacuagcugcuaaugcgauauguagcgcuguuccgguagauuggguucccacgucgagaacuacuugguccauacaugcacaucaucaauggaugacuacugaagacaugcuaucaguuuggaacagaguauggauagaagaaaauccauggauggaagacaaaacccacauuaguuccugggaagacguaccauacuuaggaaagagagaagaucaguggugugguagccuaauaggacuaacugcaagagcuacuugggcaaccaacauacaaguggcaaucaaucagguaagacguuuaauaggaaacgaaaauuauuuagauuacaugaccucaaugaaacgauucaagaaugaaucagauccggaaggugcucucugguaa

SEQ ID NO: 22049 - RNA, 9879 nt, Artificial Sequence
  derived and/or modified CDS sequence (opt6) from DENV-1__KC762625__SS-prME
agcguuacgauguugcuaaugcuaaugccuacugcacuugcauuucacuuaacuacucgaggaggagaaccacauaugauaguauccaaacaagaacgagggaaaucguugcuauuuaaaacaucagccgggguaaauauguguacacuaauagcuauggaccuuggagaacugugugaagacacacuaacguauaaaugcccuaggauuacggaagcugaaccggaugacguagacuguugguguaaugcaacugauacauggguuacguacggaaccuguucccaaacgggagagcaucgaagggauaaaaggucaguagcacuagcuccacauguuggauuaggacucgaaacuaggaccgaaacuuggaugucgucagaaggcgccuggaaacaaauucagaggguagagacuugggcauugcgucauccagguuucacaguaauagcauuguuccucgcccacgcaauaggcacaucaauuacgcaaaaagggaucauauuuauuuuauuaaugcuuguaacaccaucaauggcgaugcgauguguugggauagggagucgcgacuuuguugaaggauuaagcggagcgacguggguggaugugguauuagaacacgggucuuguguuacaacuauggcaaaagacaaaccgacccuagauauagaauuacuaaaaacggaaguaacaaacccggccgugcuacgaaaacugugcauugaggcuaaaauuucgaauacgacuacagauucacguugccccacacagggagaagcaacguugguagaagaacaggacgcuaacuucgucugccgacguacuuuuguagacagaggaugggggaauggaugcggcuuguucggaaaagguucacuuauaaccugcgcgaaauucaaaugcguuagcaaguuagaaggaaaaauaguucaauacgagaauuugaaauacucagucauuguaacaguacauacuggcgaccaacaucagguaggaaaugagaguaccgaacauggaacuacagcuacaauaacaccacaggcaccaacuacagaaauacaacuaacugacuauggugcacucacacuugacuguagcccaagaacgggacuugacuuuaacgagaugguacuacuaacaaugaaggaaaaaucauggcugguacauaaacaaugguuuuuagauuugcccuuaccauggacaagcggagcuucgacuucacaagaaacauggaacagacaagaucuccuuguuacuuuuaaaacugcucaugcaaagaaacaggaagucguuguccuuggaucacaagagggagcgaugcauacagcgcuaacuggcgcuacagaaauacaaacgucaggcacaacuaccauuuucgccggacaccuuaaaugccgguugaagauggauaaauuaaccuuaaaaggaaugaguuacgucauguguaccgguucguucaaauuggaaaaagagguugccgaaacucaacacgguacagugcuaguucagauaaaauaugaaggcacggacgcaccuuguaagauacccuuuuccacacaagacgaaaaaggugugacacaaaacggaagauuaauaacagccaacccuauaguaacugauaaagaaaaaccaguaaauaucgaagcagagccuccauucggcgaaucauacauaguaauaggagcuggggaaaaagcacugaaauuaucaugguuuaagaaaggcuccucaauuggaaaaauguucgaagcgacagccagaggcgcaagaagaauggcgauauuaggggauaccgcaugggauuuuggcucaauaggggguguauucacaagcguuggcaaguuaguacaucaaauauuuggaaccgcguacgggguucuauuuucgggaguaucauggacaaugaaaauaggaauaggagucuuacucacaugguuagggcuaaacucuagaaguaccucauuauccaugacguguauagcaguaggccuuguaacuuuauaucuaggugugaugguacaagcggacucagggugugucauuaacuggaagggaagagaacucaaauguggaucggguauauuugugacaaaugaagugcacacguggacggaacaauauaaguuccaagcagauucaccuaaaagacuaucagcagccauagggaaagccugggaagaaggaguuuguggaaucagaagcgcgacuaggcuagagaauauuauguggaaacaaauuucuaacgaacuaaaucacauccuauuagaaaaugauaugaaauuuacgguagucguaggugacguagcaggcauucuugcucaaggaaagaaaaugauaagaccacagccaauggaacacaaguacagcuggaaaaguugggguaaagcgaaaauuauaggagccgauguacaaaauacaacauucauaauugacgguccuaauacuccugaauguccagacgaucaacgcgcuuggaacaucugggaaguagaggauuacggcuucggcauuuuuaccacgaacauuuggcuaaaacuuagagauaguuauacccaagugugcgaucauagguuaaugucagccgcgauaaaagauucgaaggcaguacacgcugacaugggcuauuggaucgaaagcgagaaaaacgagaccuggaaguuagccagggcaaguuuuauagaaguaaaaucauguaucuggccgaaaagccacaccuuauggucaaaugguguguuagaguccgaaaugauuauuccaaaaaucuauggaggccccaucucgcaacauaacuaccgacccggauauuucacgcaaacagcuggaccauggcaucuagguaaacuugagcuagacuuugauuuaugugaaggaacaaccguaguaguugaugagcauugcggaaaccgcggccccagccugaggaccacgacgguuacugggaaaaucauacaugaaugguguugccguaguuguacauuaccaccucuucgauucagaggugaagacggaugcugguauggcauggagauccgaccuguaaaggaaaaggaagagaaccucgucaaauccaugguaucugcgggcucaggagaaguugauuccuucucauuaggacuauuauguauuagcauaaugauugaagaaguuaugagaucuagauggucccggaaaaugcuuaugacuggcacauuagcuguuuucuuucuccuuauaauggggcaauugacauggaacgaccucauaagauuguguauaauggucggugcaaaugcaagugaucgaauggguauggggacaacguauuuagcuuugauggcgacguucaaaaugcggccaauguucgcuguaggauugcuauuuagaagauuaacgucuagggaaguacuauuacucacaaucggguuaucuuugguugcuucaguugaauuaccaaacagucuggaggaauugggggauggguuggcaaugggaauaaugauacuuaaauuacuaaccgacuuucagagccaucaacuuugggcaacuuuauugaguuuaacuuucauaaaaacuaccuuuucacuccacuaugcauggaaaacuauggccaugguuuugagcaucguaaguuuauucccacuguguuuaucuacuacgucccaaaagaccacauggcuuccaguucuacucggcagcuuaggaugcaaaccacuaaccauguuuuugauagccgaaaauaaaauaugggggaggaaaucauggccacuaaacgaagggauaauggccguggggaucgucucuauacuccuuucaucacuucuuaaaaacgacguuccacuagcaggaccucuaauugccggugggauguugauugcaugcuacgugauaagcggaucuagugcggauuugucacuggagaaagcagcagaagucaguugggaggaagaagccgaacacuccggagcaucacacaauauucugguagaaguacaagacgacggaacaaugaaaaucaaggaugaggaacgggaugauaccuuaaccauauuauuaaaagccacacuacucgcuguuucgggcguuuauccacucucaauacccgcaacucucuucguuugguacuucuggcaaaagaagaaacaaagguccggcguuuuaugggauacuccgaguccuccagagguagaaagagcaguuuuagaugauggaauauacaggauuaugcaaagaggcuuguuaggcagaucucaagucggaguaggaguauuucaggagaauguauuccacacaauguggcacguaacaagaggggcagugcuaauguaccaaggaaaacgccuagagccaucaugggcaaguguaaagaaggaccugauuucguacgggggcggcuggagacugcaagguuccuggaauacaggggaagaaguacaaguaaucgccguugaaccuggcaaaaaucccaaaaauguucaaacagcgccggguacauuuaagacacccgaaggagaaguaggggcaauugcacuagacuucaaaccugguacaucggguucgcccauaguaaauagagaaggcaaaauaguaggccuuuacgggaacggagucgugacuacaucagguacauacguuagcgcaauagcgcaagcaaaagccucgcaagaaggcccgcugccggaaauagaagaugaggucuuucgaaagcggaaccuaacaauaauggacuuacauccuggaagcggaaagacacgcagauaccuuccagcaauagucagggaagcaauuaaaagaaaacuaagaacucuuauuuuggcgcccacacguguagucgcguccgaaauggcggaagccuuaaaggggaugcccauccgauaccaaacgacagcaguaaaaucagaacacacuggaaaagaaauaguugaccuuaugugccaugcuacauuuaccaugagauuacuuagcccuguuaggguaccuaauuacaauaugauaauaauggacgaagcgcacuuuacugacccgucaaguaucgcagcacggggauauaucagcacucggguagguaugggagaggccgcagcgauauuuaugacagcgacacccccagguucaguugaggcuuuuccacaaucuaaugcuguaauucaagacgaggaacgcgacauacccgagcguaguuggaauagugguuaugaauggauaacagauuucccugguaagaccguaugguuugucccaucaauuaagaguggcaaugacauugcaaacuguuugcggaaaaaugguaaaagaguaauacagcuaagucguaagacauucgacacugaguaccagaagaccaagaacaaugauugggauuauguaguaaccacagauauaagugaaaugggggcaaauuuccgcgcugaucgaguaaucgacccuagacggugucuaaagccugucauucucaaggaugggcccgaaagaguuauucuugcgggaccaaugccugucacaguagcaagugcagcacaaagacguggaagaguuggcagaaaccauaauaaggaaggugaucaauacauauauauggggcagccauuaaauaaugacgaggaucaugcgcacuggacagaagcaaaaaugcugcuugacaauauaaauacaccagagggaaucauaccggcccuguuugagccagagagagagaaaagcgcugcuauagacggagaguaccguuuaaggggugaagcuaggaagacauucguagaauuaaugaggcgaggugaucuuccugucugguuguccuauaaagucgccucagaggguuuucaguauucagaccgaagauggugcuuugauggugagagaaacaaucaaguacucgaagaaaauauggauguagaaauauggacaaaggagggugaaagaaagaaacuccguccccgauggcucgacgcaagaacuuauuccgauccgcuggcacuucgcgaguucaaagaauuugcggcaggacggagaaguguaucgggggacuuaauucuggaaauuggaaaacuuccgcaacaucucacccagagagcucaaaacgcucuagacaaucucgucaugcuucacaauuccgaacaaggaggacgagcauauaggcaugcaauggaagaauuaccggauacuauagaaaccuugaugcuucuagcccuuauagcuguuuugacagguggaguaacauuauucuuuuuaagugguaggggauuggggaaaacaagcaucggucuguuauguguuauggcaaguaguguccuuuuauggauggcuuccguagaaccccauuggauagccgcuucaauaauuuuagaauuuuuccuuaugguauuauugauaccggaacccgaccgccaacgaaccccgcaagauaaucaauuagcauauguuguuauaggccugcuguucaugauauuaacugucgcugcaaacgaaaugggccuuuuagaaaccaccaagaaagaccuggguauaggucacguagcaguggaaaaucaccaucacgccgcuaugcuggacguugaccuacacccugcgucggccuggacauuauaugcaguggcuacaacuauaauuacgccgaugaugcgucauacgauugaaaauacaacggccaauauuucccuaacggcaaucgcaaaucaagcggcaauucuaaugggucuugacaaaggauggccaaucagcaaaauggauauuggaguaccacucuuagcauuaggauguuacucacaagugaauccauugacccuaaccgcggcaguuuuaaugcuuguugcucauuaugcaauaaucggucccgggcuacaagcgaaagcuaccagagaggcucaaaaacgaacagccgcggguauaaugaagaauccaaccgucgaugguauaguugccaucgacuuagauccagucguuuacgaugccaaauuugaaaaacaacuaggucaaauaaugcuauugauacuauguacuucccaaauauuauuaaugcguacaacaugggcguuaugugaaucaauuacuuuagcaacggguccauuaaccacgcuuugggagggaucaccaggcaaauuuuggaauacuacuaucgccgugucaauggcuaauauuuuccgugguucauauuuagcaggggcgggccucgcauucucucugaugaagaguuuaggaggagguagaaggggaaccggcgcacaaggagaaacauuaggagagaaguggaaacgucagcucaaucaacucagcaaaagcgaauuuaauacguauaaaagaagcggaauuauggagguggaccguuccgaagccaaagaaggucuaaaacggggagaaacgacgaaacaugcuguuagucgagguacagccaaguuaagaugguuugucgaaagaaacuuaguaaaaccugagggcaagguaauagauuuaggguguggaagagggggcuggucguacuauugcgcugguuugaagaaaguuacugagguuaaaggcuacacaaaaggggguccaggacaugaagaacccauacccauggcuacguacggguggaauuuagucaaauugcauucuggaaaggacguuuucuucauacccccugaaaaaugcgauacacuacuuugugacauuggcgaaucuagcccgaacccuacuauugaagagggacguacuuuaagaguuuuaaaaaugguagaaccuuggcuaagggguaaucaauucugcauaaaaauacuuaauccauauaugccaucaguuguagaaacacuggagcaaaugcaaagaaaacacgguggcauguuaguaagaaacccacucucucgaaauucaacucacgaaauguauugggucuccuguggcaccgggaauauagugucggcaguaaauaugaccaguagaaugcucuuaaaccgauucaccauggcccauagaaaacccaccuacgaaagggacgucgauuuaggagcagguacucgucauguggcuguagaacccgaaguugcuaaccuugacauaauaggacaacgcauugaaaacauaaaacaugaacacaaaaguaccuggcacuacgaugaagacaacccauauaaaacgugggcauaccaugguucuuacgaggugaaaccuagcggcagcgccaguaguaugguaaauggaguggucaaacuucuaacaaaaccaugggauguaauaccaaugguuacucaaauugcuaugacugauacgaccccauuuggucagcaacguguguuuaaagaaaaaguagacacuaggacacccaaagcuaaacgggguacgacacaaaucauggaggugacugcccgaugguuguggggcuuucuaaguaggaacaaaaagccgagaauauguacgcgugaagaguuuacaagaaaggucaggaguaacgcagcaauuggugcuguauuuguagaugagaaucaauggaacagugcaaaagaagcaguugaagaugaacgguucugggaucuuguacauagagagagagagcuccauaaacaaggcaaaugugcuacauguguuuacaacaugaugggcaaacgugagaagaaacucggcgaauuuggaaaagcaaaagguucaagggcaauuugguacauguggcuaggugcgcguuucuuagaauuugaagcauuaggauuuaugaacgaagaucauugguuuucgagggaaaauagccuuagcggaguagaaggagaaggauuacauaaacucggcuauauauuacgcgauaucagcaaaauacccggcggaaauauguaugcagaugacacagcgggaugggacacaagaaucacagaagaugauuugcaaaaugaagcaaagaucaccgauauaauggaaccagaacacgcauuauuagcgaaagcgauuuuuaagcucacuuaccaaaauaaaguaguaagaguacaacgaccagcaaagaacgguaccguaauggauguuauuagucggagagaucaacgcggcagugggcaagucgggacuuacggucucaauacuuuuacaaauauggaagcucaacuaauuagacagauggaaucggaaggaauuuucuccccgagcgaacucgaaacuccaaauuuggcagaaaggguucuagauuggcucgagaaauauggcguagaaagguugaagcgaauggcaauaaguggagaugauuguguggucaaaccaauagacgaucgguuugcuacagcacugacugcauuaaacgacaugggcaaaguacgaaaagacauaccacaaugggaaccgaguaaagguuggaacgacuggcaacaagugccauuuuguucucaccauuuucaccaacuaauuaugaaagauggucgagaaauaguagugccaugccgcaaucaagaugaauugguaggacgggcgagaguuagucaaggugcaggguggucucuuagagaaaccgcaugucucgggaagucguaugcacaaauguggcaacuuauguacuuucacagacgagaucucagacuagcugcaaacgcaauaugcucagcuguaccaguagauuggguaccaacuucuagaacaacuuggucaauacacgcccaccaccaauggaugaccacagaggauauguugucaguuuggaauaggguguggauagaagaaaacccguggauggaggacaagacacauaucaguuccugggaagauguaccauaucucggaaagagagaggaccaguggugcgguagucuuaucggucuaacagcgcgugcaaccugggcaacgaauauacaaguagcgauuaaucaaguaagacgccuaauugggaacgaaaauuaucuugauuauaugacaucuaugaagcgauucaaaaaugaauccgauccggaaggagcauuaugguaa

SEQ ID NO: 22050 - RNA, 9879 nt, Artificial Sequence
  derived and/or modified CDS sequence (opt6) from DENV-1__KC762635__SS-prME
ucuguuacuauguugcuaauguuaaugccgacagcacuggcauuccauuuaacuacacgugggggugaaccgcauaugaucguuuccaaacaagaaagggggaaauccuuauuguucaaaacaagcgcagggguaaauaugugcacacuuauugcuauggauuuaggggaacucugugaagauacauuaacauauaaauguccgcgaauuacagaagcagaaccagaugauguagauuguugguguaaugcaaccgauacauggguaacauauggaacaugcagccaaacuggagaacaucggcgagauaaaaggagcguagcucuugcaccucacguagggcucggacuugaaacaagaacggaaacuuggaugaguagugaaggugcuuggcgacaaauucaaagaguagaaacaugggcauuacggcacccuggguuuacuguaaucgccuuauuccuagcucacgcgauagguacguccauaacgcaaaaaggcauaaucuucaucuuauugauguuagugacaccgagcauggcuaugagaugugugggaaucggcagucgcgacuuugucgagggacuuaguggugcaacuuggguugauguaguuuuagaacaugguucuugcguuacaacaauggccaaagauaaaccaacccuugacauugagcuuuugaaaacagaaguaacuaacccggcaguccuuagaaaacugugcauugaagcgaaaauuucaaauacaacaacggacaguagauguccuacucaaggagaggcuacauugguagaagaacaagaugccaacuuuguuugcagacggacauucgucgaucgagguuggggaaaugguugcggacuauucggaaaagguucucuaaucacaugcgcaaaguuuaaguguguuacuaaacuugaagggaaaauuguacaauaugaaaaucuaaaauauucagucauugugaccguacacacaggagaccaacaccaagucggaaacgaauccacagaacacggcacaacagcgacuauuacaccacaagcuccuacuacugaaauacaacucacugacuacggagcucugacccuagacuguagcccgaggacuggauuggauuuuaaugaaaugguucuacuuacgaugaaggagaagucauggcuuguccacaaacagugguuuuuggacuuaccucugccuuggacaagcggagcuucuaccucucaggaaacguggaauagacaagauuuacuuguaaccuuuaaaacagcucaugccaagaaacaggaagugguaguucuggguucucaagaaggagcgaugcacacagcacuaacaggugcuacugagauccaaacaaguggaaccacgacaauauuugcgggucaucuuaagugucguuuaaagauggacaaauuaacacucaagggaauguccuaugugauguguacugguucguuuaaacuugagaaggagguagcagaaacccagcacgguaccguauuaguucaaauuaaguaugaaggcacugaugcaccauguaaaauaccguuuucaacccaagaugaaaaaggcguaacucaaaacgguagacuuauaacagcuaaucccauaguaacagauaaagaaaaaccuguuaauauugaggcugaaccacccuuuggugaaucuuacaucguaaucggcgcaggagaaaaggcacuaaaguuaaguugguucaagaagggcuccucaauugguaaaauguuugaagcaacagcaagaggugcgcgaaggauggcaauucuuggagacacugcaugggacuuugguuccauuggaggugucuuuacuagcguaggaaaacugguccaucagaucuucggaacggcauauggcgucuuauucucugguguaagcuggacgaugaaaauaggcauaggcguucuucucacuuggcuuggccuaaacucaagaaguacaucauugucaaugacaugcauagcuguuggguuaguaaccuuauaccuaggagucaugguacaagcggauucaggcugugugauaaauuggaaagggcgugaguuaaaaugugguuccggaauuuucguaacuaaugaaguucacacuuggacugaacaauacaaauuccaagcggauaguccuaaaagauuaucagcugcuauagguaaagcaugggaagaagggguaugcggaauaagaagugcgacccgauuagaaaauauaauguggaaacaaauuucaaacgaacuaaaucauauacuccucgaaaaugacaugaaauucacaguaguagucggugauguagcugggauucucgcucaagggaagaaaaugauuagaccacaaccaauggagcacaaauauaguuggaaaaguuggggaaaagcaaagauuauuggcgcugacguccaaaauacaacauucauuauagacggaccaaacacuccagaaugcccagaugaccagcgugcauggaauauuugggaaguggaggauuauggauuugguauauuuacgacaaauauuugguugaagcuccgagacucuuauacacaagugugugaccaucgacuaaugucagcagcaaucaaggauuccaaagcuguacacgcagauaugggauacuggauagaaucggagaaaaaugaaacauggaaauuggcaagagcuucuuucauugaaguaaaaacuuguaucuggccaaaaagucauacacuauggucaaaugguguccuagaauccgagaugauaauaccuaaaauauauggaggaccaauuucacaacacaacuaucgaccugguuauuuuacgcaaacagcgggaccauggcauuuagguaaacuugaacuugacuuuaaccuaugcgaaggcaccacaguaguaguugaugaacauugcggaaauaggggcccaagccucaggaccacgacgguaacgggaaagauaauccaugaaugguguugccgaagcugcacucugccaccacuacgauuuagaggagaagacgguuguugguacggaauggaaauucguccuguaaaggaaaaagaagaaaaccuuguuaaaucaaugguguccgcgggaucaggagaaguagacucauucagucuugggcuguuauguauaucaaucaugauugaagaggucaugagaucgagauggucaagaaaaauguuaaugacaggcacauuagcagucuucuuuuuguugaucaugggacaacuaacuuggaaugaucugauaagacuaugcauuaugguaggugcgaacgcaagugauagaaugggcauggguacaacauauuuggcuuuaauggccaccuucaaaaugaggccaauguucgcaguagggcuuuuauuucgcagauugacgagucgagaaguguuauugcuaacuauaggauuaaguuuaguagcauccgucgaauugccaaauucauuagaagaauuaggagauggacuagcgauggggauaaugauauuaaagcuguugacagauuuccaaucccaucaauuaugggcaaccuuauugucacuaacguuuauaaaaacaacuuucucucugcauuaugcauggaagacaauggcaaugguacucagcaucguaucucuguucccuuuaugucucucuacgacuucccagaaaacuacauggcuaccaguuuugcuuggaucccucggaugcaaaccacuuacuauguuuuuaauagcagaaaauaagauuuggggaaggaaaucuuggccauuaaacgaagguaucauggcaguugggauaguguccauuuuacuaucuaguuugcugaaaaaugauguuccucuugcaggacccuuaaucgcaggagguauguuaaucgccugcuacguaauaaguggauccagugcagaccuaucgcuugagaaagcagcggagguaucuugggaggaagaagcagaacacaguggggcgucacacaauauuuugguugagguucaagaugaugguacaaugaagaucaaagaugaagaaagagacgauacacuaaccauacuccugaaagcaacguugcucgccguaucugguguuuacccacugagcauuccagcuacacuuuuuguaugguacuucuggcagaagaagaaacaacgaagcggaguccuuugggacacaccaucgccacccgaaguggagagggcuguacuggaugaugguauuuacaggauaaugcaacggggguuacucggaagaucucaagucgguguaggaguuuuucaagaaaauguauuucacacaauguggcacguaacuaggggagcaguuuuaauguaccaagggaagcgguuagaaccaucaugggcgucgguuaagaaggauuugauaaguuacggcggaggauggcggcuucaaggaucauggaauacuggugaagagguacaaguuauugcaguugaacccggcaaaaaucccaaaaauguacaaaccgccccggggacauuuaaaacaccagaaggagagguaggagcuauagcgcuugacuucaaaccagguacaucgggaaguccgaucguaaauagagagggaaaaaucguugguuuauacgggaacggcguugucacgacuucggggaccuauguaucugcuauagcccaggcuaaagcaagucaagagggacccuuaccugaaauugaagacgaaguuuuucgcaagaggaaucuuacuauuauggacuuacacccuggaaguggaaaaacucgacguuacuugccugcuauaguacgggaagcuauaaagcggaaacuaagaacacuaaucuuagcaccgacucggguaguagcaagugaaauggcugaagcacuaaaaggcaugccaauuagauaucaaacuacugcagucaaaagugagcacacgggaaaagagauagucgaccuaaugugccaugcuacauuuacaaugcgauuacuaucaccuguaagggucccaaauuacaauaugauaauuauggacgaagcgcauuuuacagacccaagcaguaucgcggcaagaggcuauauuucaacgcguguaggaaugggagaagccgcagcuauauuuaugacggcgacaccucccggaagcguugaagcauuuccacagucuaacgcuguuauacaagaugaagagagagacauccccgaacguucauggaacucuggauacgaauggauaacggauuuucccggaaaaacaguuugguuuguaccuucaauaaaaucagggaaugauaucgcgaacuguuuaaggaaaaacgguaaacgaguuauccaacuuucucgcaaaacauucgauacugaauaucagaagacuaaaaauaaugauugggacuacguagucacuacugacauuucagaaaugggcgcaaauuuucgagcugaucgaguuauugauccaagacgcugcuugaaaccggugauacuaaaagauggaccagaacgggucauccuggcagggccaaugcccgucacagucgcuagcgcagcucaacgaaggggaagaguaggaagaaaccacaauaaggaaggcgaucaauacauauauaugggucaaccucuuaauaacgaugaagaucaugcacacuggacagaagcaaaaauguuacuagauaacauuaauacacccgaagggauuauuccugcucuguucgaaccugaaagagaaaaaucagcugcaaucgauggggaguauagauugagaggggaggcucgaaaaacuuuuguggaacuuaugagacgcggagauuuaccuguaugguuaagcuauaaaguagcaucagaggguuuucaauauucugauaggagguggugcuuugacggugaaaggaacaaucaaguccuagaggaaaacauggacguagaaaucuggaccaaagaaggagaaaggaagaaacuacggccgagguggcuugaugcucgaacguauucggauccccucgcacugagagaguuuaaagaguuugcggcuggcagaagaaguguuucaggggauuuaauucucgagauuggaaaauuaccucagcauuugacacagcgugcccaaaaugcacuagauaaucuuguaauguugcauaauagugaacaaggcggccgugccuaccgccaugcgauggaggaauugccugauacgauagagacucuaaugcuauuagccuugauagcaguguuaacaggaggcgugacucuauucuuucucucaggucgcggacuuggaaaaacaucaaucggauugcucugugugauggcuaguagcguauuacucuggauggcuucgguugagccucauuggauagcagcaucaauaauuuuagaauuuuuccugaugguacuacuuauccccgaacccgauagacaacgcacuccacaagacaaucagcucgcuuacgugguaauaggauuauuauuuaugauucucaccguugcugcaaaugaaaugggacuccuugaaacaacgaagaaagauuuagggauuggccauguagcuguagaaaaucaucaccacgcagcaaugcuggauguagaucuccacccggcaagcgcauggacacuuuacgccguggcaacgacuauaauuacacccaugaugcggcacacaauagagaauacaaccgcaaauauaagccucacagccauagcaaaccaagcagccauauuaaugggauuagacaaagguuggccuaucucaaaaauggauauaggggugccgcuacucgcauuggguuguuauucccaggugaauccauugacauugacagcagcuguacucauguuaguugcucauuaugcaauaauuggcccuggauugcaagcaaaggcaacucgagaggcccagaaaagaacggcggccggaauaaugaaaaacccuaccguagauggcauaguggcaauagaucuagaccccguaguguaugaugccaaauuugagaaacaacuaggacaaauaauguuauuaauuuuauguacgagucagauauuacuuaugagaacuacuugggcauugugugaguccauaacucucgcaaccgggccucuaacaacucuaugggaagguucccccgguaaauucuggaacacaacuauugcagucaguauggcgaauauauuuagaggaucauacuuagcgggugcaggcuuagcauuuagucugaugaaaucucuaggagguggcagaagagguacgggagcccagggagaaacccugggagaaaaauggaaaaggcaauuaaaccaauugaguaaaucagaguuuaauacuuauaagcguucaggaauuauggaaguagauaggagcgaagccaaggaaggauuaaaaagaggggaaaccaccaagcacgccguaucacgaggcacagccaaauugcgcugguucguugaaagaaaucuaguaaaaccagaaggcaaaguaauugauuuaggaugugggagaggaggguggucuuacuacugugcaggauuaaagaaaguuacagagguaaaaggcuacacgaaaggaggaccaggacacgaagaaccgauaccaauggcaacauacggcuggaaucuaguaaagcuacauucuggcaaagauguuuucuucauacccccugaaaaaugugacacauuacucugugauauaggcgagaguaguccaaauccgacuauagaagaaggcaggacgcuccgugugcuaaaaaugguugaaccgugguugcgagggaaccaauuuuguauuaaaauauugaauccauacaugccaagcgugguagaaacacuugaacaaaugcaaagaaaacauggagggauguuaguucgaaauccacuauccaggaacagcacgcaugagauguauuggguuaguugugguacagggaacauagucuccgcaguaaauaugacuucuagaauguugcucaaccguuuuacaauggcacaucgaaaaccgaccuaugaacgagauguugaucuaggcgcuggaacuagacacguugcugucgaaccggaaguugcaaaccucgauauuauaggccaaagaauugaaaauauaaaacaugaacacaagucaacauggcacuacgaugaagacaacccuuacaagacuugggcuuaccacggcuccuacgagguaaaaccuucaggguccgcuagcaguauggugaacggagucgucaaacuucuaaccaaacccugggaugucauuccuaugguuacacaaauagccaugacugauacuacgccuuuuggacaacagaggguauucaaagagaaaguagauaccagaaccccuaaggcgaaaagagggaccacacaaauaauggaggugaccgcaagguggcuuuggggauuucuaagcagaaacaaaaagccuagaaucuguacgagggaagaauuuacgagaaaaguacgcuccaacgcagcaaucggggcggucuuuguggaugaaaaucaauggaauagcgcaaaagaggcuguagaggaugaacgauucugggaucucguacaucgagaaagagaauuacauaagcaaggaaaaugcgcgacaugcguuuacaauaugaugggaaaaagagagaagaaauuaggagaguucgggaaagccaaagggagucgggcaauaugguauauguggcuaggcgccagauuccucgaguucgaggcacuaggauuuaugaaugaggaucacugguucaguagggaaaauagccugaguggaguggaaggagaaggauugcacaaacucggcuauauacuccgagacauaaguaaaauaccuggagguaauauguaugccgaugacacugcaggaugggauacacguaucacagaggaugaucuacagaaugaagcuaaaauaacagacauuauggaaccggaacacgcacuauuggcaaaggcgauuuuuaaacucacauaucaaaauaaagugguuagagugcaaaggccagcgaaaaacgguacuguaauggacgugauaucgagaagagaccaaagagggaguggucaagugggaaccuauggguuaaauacuuucaccaacauggaagcgcaauuaauaagacaaauggagagugaggguauauuuuccccaucagaacuggaaaccccgaaucucgccgaacgaguauuggacugguuagaaaaauacggcguggaaagauuaaaaagaauggcaauuaguggggaugacugcguaguaaaaccaauagacgauagguuugcgacugcacuaacugcucugaacgacaugggaaagguuaggaaagauauuccucaaugggaacccagcaaaggauggaacgauuggcaacaagugccuuucuguucccaucacuuucaucaacuaaucaugaaagaugguagagagaucguuguaccauguagaaaucaagaugaauuaguaggacgugcuagagucagucaaggggcagguuggaguuugagagaaacagccugccuuggaaaaaguuaugcucagauguggcaauugauguauuuucauagacgagaccucagauuagcagcgaacgccauuuguucagcugucccugucgacugggugccgacaucgagaaccacuuggaguauucaugcacaccaucaauggaugacuacggaagauauguuaaguguuuggaauaggguauggaucgaggaaaacccguggauggaagauaagacacauauaaguaguugggaagauguccccuacuuagguaaaagggaggaccaauggugcgguagucugauuggauuaaccgcaagagcgaccugggccacaaauauucaaguagccauaaaccaaguaagaagauuaauaggaaacgaaaauuacuuagauuacaugacaucaaugaagagauuuaagaaugaaagcgaccccgagggugcacuaugguaa

SEQ ID NO: 22051 - RNA, 9879 nt, Artificial Sequence
  derived and/or modified CDS sequence (opt6) from DENV-1__KC762650__SS-prME
ucaguaacuaugcuguuaauguuaaugccuacagcauuagcauuucaccucacuacacguggaggagaaccacauaugauuguaucuaaacaagagagaggaaaaagccuauuguuuaaaacaagugcagggguuaauauguguacacuuauugcaauggaucuuggagaacuuugcgaagacacacuuacguacaaaugcccaaggauaacagaagcagaaccugacgauguggauugcuggugcaacgccacugauacauggguaacuuacggaacaugcagucagacgggagaacaccggagggauaaaagaucgguagcacucgcuccacaugugggacuuggacuagaaaccagaacugaaacuuggaugucauccgaaggugcuuggcgacaaauucagcgaguugaaacgugggcucuccgacauccugguuuuacgguuauagcauuauucuuagcgcacgcaauaggaacaaguaucacacaaaaagguauuauauuuauccuauuaaugcuugugacuccuucuauggcaaugcgauguguagguauagggucacgagauuuuguggaaggacuuucaggagcuaccuggguagacguaguauuagaacaugggucuuguguaacaacaauggcuaaagauaaacccacguuagauauagaguugcugaaaacagagguaacuaauccugcaguguugcggaaauuaugcauagaagcuaaaauuucaaauaccacaacagauagucgcugucccacucaaggcgaggcaacucuaguugaggaacaagacgcaaauuucguauguaggagaacguuuguugaccgcggaugggguaauggguguggcuuauuuggaaaaggaucacuuauuacaugugcgaaauucaaaugcguuacgaaauuggaaggaaaaauuguacaauacgagaauuuaaaauacagcguaauaguaacaguacauacaggagaucaacaucaaguugguaacgaauccacugaacauggaaccaccgcaacuaucacuccccaagcuccuacaacagaaauacaauuaacagacuauggcgcauuaacgcuggauuguucuccaaggacgggccuagauuuuaaugaaauggugcuacucacuaugaaagagaaaucaugguuaguucauaaacagugguuucuagacuuaccacuaccguggacaucuggcgcuagcacuucacaagagacuuggaacaggcaagaucuauuaguuacauucaaaacggcgcacgccaagaaacaagaaguuguuguauuaggaucacaagaaggagcuaugcacaccgcuuugacuggcgcgacugaaauacaaacaucaggcacaacaacaauauucgcuggucauuugaaaugucgccucaaaauggauaaacucacauugaagggcaugucuuauguaaugugcacagguagcuucaaacuugaaaaggaaguagccgaaacacagcacgggacagucuuggugcagauaaaguacgaagguacugacgcgccuuguaaaauaccauucuccacacaggaugaaaaagguguaacucaaaauggaaggcuuauaacugcaaauccaauaguaacagauaaagagaagccagucaauauugaagcugaaccuccauuuggagagucuuacauaguuauuggagcgggagaaaaagcacuaaaauuaaguugguuuaaaaagggcuccucaauagguaaaauguuugaggcaacggcgaggggagcucggcgaauggcgauuuuaggcgacacugcuugggauuucgggaguaucggagggguauucacuucaguaggaaaauuaguucaccaaauauucgggacagcuuauggcguguuauuuuccggagucaguuggacaaugaagauaggaauuggcguucuacuaacaugguugggacuaaauagccgaagcacgucacuuagcaugacuuguauugcuguaggacucguaacauuauacuuaggagugaugguucaagcugauucaggaugugugauaaauuggaaaggaagggaauuaaagugcggaucagggauauuuguaacaaacgaagugcauacauggacagaacaauauaaauuccaagcugacucgccaaaaagauuauccgcagcaaucgguaaagcgugggaagaggguguaugugguaucagaucugcgacgcgacucgaaaacauaauguggaaacagauaaguaaugagcuaaaucauauacuccuugaaaacgauaugaaauuuacuguuguuguuggcgacguugcggggauacuagcgcaaggcaagaaaaugauuagaccccagcccauggaacauaaauauaguuggaagucauggggaaaggcaaagaucauuggcgcugacguucaaaauaccacguucauuauagauggcccuaauacacccgaaugccccgaugaucagcgugccuggaauauaugggaaguagaagacuauggguucgguauuuucaccacaaacauauggcuuaaacucagggacucuuauacucagguuugcgaccaucgucuuaugagcgcugcaauaaaagauagcaaagcaguacacgcggacaugggguacuggauagagagcgagaaaaaugaaacguggaaguuagcacgggccaguuuuaucgaaguuaaaacuugcauuuggcccaaaagucacacacuguggucaaaugggguucuggaaagugaaaugauaauuccaaaaauauauggaggaccaauaucucaacauaauuauaggccaggcuauuucacgcaaacagccgguccuuggcaccuugggaaguuagaauuagauuuuaacuugugcgaaggaacuacgguuguggucgacgagcauuguggaaaucgcgguccuagcuuacggacuacaacaguuacugggaaaauuauacacgaauggugcugcagaagcugcacucugccuccacuacguuuuagaggcgaagacggcuguugguacgguauggagauacgaccugucaaagaaaaggaagaaaaccuagucaagucaauggucucggcgggaaguggagagguagacucuuuuucgcuugguuuacuaugcauuaguauuaugauagaggaaguuaugcguucaagguggaguagaaaaauguuaaugacuggcacacuagcagucuuuuucuuacuaauaaugggacaacugacuuggaaugauuuaauuagauuauguaucaugguuggcgccaacgcaagugacagaauggggaugggaaccacauaccucgcacuuauggcgacuuucaagaugaggccuauguuugcgguaggacuccuguucaggcgacuaaccucucgagaaguccuccuauuaaccaucgguuugagccugguagcaaguguagaacuuccgaacucauuggaagaauuaggagaugggcuagccaugggaauaaugauacuaaaguuguugacagauuuucaaagccaccaguuaugggcuacacuacugaguuuaacuuucaucaagacuacauuuucacuccacuaugcuuggaaaacaauggcaauggucuugucaaucguuucccuauucccuuuauguuuaucuacuacaagucaaaagacuacaugguuaccaguacuguuagguucacuuggguguaagccacuaaccauguuuuuaauugcagaaaauaaaauaugggguagaaaaucauggccucuuaaugaagguauaauggcaguuggcauagugucaaucuuguugaguagcuuauuaaagaaugauguaccacuagcuggucccuuaauagcgggaggcauguuaauagcuuguuauguaauaucuggcucgucggccgauuugucguuagaaaaagcggcugaggugucaugggaggaagaggcagaacacaguggcgcuagucauaauauauugguagaaguacaagaugacgggaccaugaagauuaaagaugaagaaagggaugacacacuaacuauccuacucaaagcaacacuccucgccgucaguggaguauacccccuaagcaucccggcaaccuuguucgugugguacuuuuggcagaagaagaaacagagaucagguguucucugggacaccccaucaccaccagaaguagaaagagccgucuuggaugauggaauauauagaaucaugcaaagaggccuacucggaagaagccaaguugggguuggcguguuucaagaaaacguguuucauacgauguggcauguaaccagaggcgccguccuaauguaucaaggaaaaaggcuugaaccaucuugggcuuccgucaagaaagaucuuauaucuuacggugggggauggcgucuucagggaucauggaauacaggugaagaagugcagguaauagcgguagaaccaggcaaaaacccgaaaaauguccaaacugcgccagguacauuuaaaacuccggagggggaaguaggggcuauugcucuagauuuuaagccagguacaagcgguucuccgauaguaaaccgggaaggaaagauuguuggguuauacgggaacggggugguaacuacgagcgguacguaugugucagcaaucgcacaagcgaaggcuucacaagaagguccuuuaccggaaauagaagaugaggucuuuagaaaaagaaacuugacaauaauggaucuccauccaggcuccggaaaaacccggagguauuuaccagcaauaguacgagaagcgauaaaaaggaaauuaagaacucuaauucuggcaccuacacgugucguagcuucagaaauggcagaagcucuuaaagggaugccuauaagauaucagaccacagcagugaagagugaacauacaggcaaagaaauuguggauuuaaugugccaugccacuuuuacaaugagguuacuuagcccaguacggguaccuaauuauaacaugaucauuauggacgaagcacacuuuacugauccgagcucaauagcagcaagaggauauauaaguacacgaguagggaugggcgaggccgccgcaauuuuuaugacggcaaccccuccaggaaguguagaagccuuuccgcagagcaaugcaguuauacaagaugaagaacgagacauaccagagcggucuuggaacuccggguaugaauggauaacugauuuuccaggaaaaacggugugguuuguaccaaguauaaaaagcgggaacgauauagcaaauugcuugaggaagaacgguaagagaguaauacaacuaucaagaaaaacguuugauacugaguaccagaaaacuaagaacaacgauugggauuauguagugacaaccgauauauccgaaaugggugcaaauuuuagggccgauaggguuauagacccaagacggugcuugaaaccgguaauacuaaaagacggaccagaacgaguuauucuggccggaccaaugccaguaacaguagcuucggcggcccaaaggcgaggaagaguaggacggaaucauaauaaggaaggcgaccaauacaucuacauggggcaaccucucaauaaugacgaggaccacgcacacuggacugaggcuaagaugcugcuagauaauauaaauaccccugaagguauaauaccugcucuauuugaaccagaacgggaaaagucugcggcaauagauggugaauauagguuacggggcgaagcaagaaagacguuugucgaauuaaugcgucgaggcgacuuaccugugugguuaaguuauaaaguugcuagcgagggauuccaauacuccgaucggcgaugguguuuugacggugagcgaaauaaccaagugcuggaagaaaacauggauguugaaauuuggacaaaagaaggagaacgcaagaaacugagaccucguugguuagacgcucguacuuacucggauccuuuagcccugagggaauuuaaagaauuugcggcagguagaagaucaguaaguggggauuuaauucuugaaauuggaaaauugccccagcauuuaacucaaagggcucagaaugcgcuagauaaccuagugaugcuucacaacucggaacaagggggcagagcuuacagacacgcuauagaggagcuuccugauaccauagagacauuaaugcuucuagcauuaaucgccguauuaacaggagguguaacguuauucuuucuaucagggagaggauuagguaagacuucaauuggccuucucugcguuauggccucgagcguacuuuuguggauggcuuccgucgaaccucacuggauagccgccagcauaauauuagaguucuuucugauggugcuuuuaauacccgaaccugaccggcagagaacgccucaagacaaccaacuagcuuauguuguaauaggguuacuuuuuaugauacucacuguagccgcaaaugaaaugggccuccuugaaaccacuaagaaagaucuaggcauaggccauguagccgucgaaaaccaucaccaugccgcuaugcuagauguggaucugcacccagcaucagcuuggacauuguaugccguagcaacgacuaucauaaccccuaugaugaggcacacuaucgaaaacacaacugcuaacauaucucuuacagcaauagcuaaccaagcagccauauugaugggacuagauaaaggcuggccaauaucgaagauggacauuggaguaccguuacuggcuuuagggugcuauagccagguaaacccacugaccuuaaccgcagcgguacuaauguugguagcucacuaugccauaauaggucccggguuacaagcaaaagccacaagagaggcucagaagagaacagcggcagggauaaugaaaaacccgacuguagacggaauuguagcuaucgaccuugauccaguaguauaugaugcaaaauuugaaaaacaacugggacaaauaauguuguuaauuuuauguacgagucaaauucuccuuaugcgaacgaccugggcauuaugcgaaucaauuacauuagcgacugguccauugacgacguugugggaagguaguccagggaaauucuggaauacuacaauagcggucucaauggcuaauauuuuucgcgggaguuaucuggccggagcaggucuagcguuuucguuaaugaagucacuagggggagggagacgagguacaggcgcacagggugaaacgcuaggugagaaauggaaacgacaauuaaaucaauuaaguaaaagugaauuuaacacuuacaaaagauccgguauaauggaaguugaucgaagcgaagcgaaagaggguuuaaagaggggugaaacaacaaagcaugcggugucacgcggaacagcaaaacuucgaugguuugucgaacgaaaccuuguaaagccagaaggaaagguuauagauuuggggugugggagaggaggguggucauacuacugugcagguuuaaagaaaguaacagaaguuaaaggcuacacgaaaggaggaccaggacacgaagaaccaauaccgauggcuacauauggcuggaaucuagugaaacuucauagcggcaaagauguauuuuucauuccacccgaaaaaugugauaccuuauugugugauaucggagagaguaguccuaauccaacuauagaagaaggucgaacacuaaggguacuaaaaaugguugaaccauggcucagagggaaucaguucugcaucaagauuuuaaaucccuacaugccaucaguaguugaaacuuuagagcaaaugcagagaaaacauggaggaaugcucgucagaaauccucugagucggaauagcacccaugaaauguauugggugucuuguggaacuggaaauauaguaagcgcagugaauaugacgucaagaaugcuauuaaaccgauucaccauggcacaccgaaagccuacauaugaaagagacguugaucucggugcaggaaccagacacguugcggucgagccagaaguggcgaacuuagauauaaucggccagcggauagagaauauaaaacacgagcauaaaaguaccuggcacuacgaugaagacaauccauauaaaacaugggcauaccauggaaguuaugaggucaaaccaagcggcucugcuaguuccaugguuaacggaguagugaaacuguugaccaagccaugggaugucauaccaaugguaacucaaauagccaugacugauacuacuccuuuuggccaacaacguguuuucaaagagaaaguagacacgcgaacucccaaggcgaaaagggguacaacacagauuauggaggugacugcaagauggcuauggggauuuuuaagucgaaauaaaaagccgagaauauguacuagggaggaauuuacaagaaaaguacgcucgaaugcagcaauaggagccguauuuguugaugaaaaccaauggaauagugcaaaagaagcuguggaagaugaacgauucugggauuuaguacaccgagagagggaauuacauaaacaaggcaaaugugcgacaugcguauacaauaugaugggaaaaagggagaagaaacuaggagaauuugguaaggcgaaagggucacgagcaaucugguacauguggcugggagcccgauuccuagaauuugaagccuugggguuuaugaaugaagaccacugguuuagccgagaaaauuccuuaucaggaguugagggcgagggauugcauaaauuggguuauauuuuacgagauaucucuaaaauaccgggugggaauauguaugcagacgauacggcgggcugggauacacguauaacagaagacgauuugcaaaaugaagccaaaauuacagacauuauggaaccagaacaugcgcuacuagcgaaagccauuuuuaaauuaacauaucaaaacaaagucguacgcgugcagagacccgccaaaaauggaacuguaauggaugucauauccaggagagaucagagaggcucugggcaagugggaacauauggcuuaaauacauucacgaacauggaagcccaguuaauuagacaaauggaaucugaagggauauuuucaccaagcgaacuggaaacaccaaaucuagcugaaagagugcuugauuggcuagaaaaauaugggguagaaagacuaaagcgcauggcaauuucaggagaugauuguguggucaagccgauagaugaccgguucgcuacugcacucacagcccucaaugacaugggaaagguacgaaaagauauuccgcaaugggaaccuucuaaaggauggaaugacuggcaacagguaccguuuuguagucaccauuuccaucaauugaucaugaaggauggaagagaaauaguagugccguguaggaaccaggacgaauuggucggacgugcgagagucagucaaggugcgggauggucacucagagaaacggccugcuuaggaaaaucauaugcucaaauguggcaguuaauguauuuucaccguagagacuugagacuagcugcgaaugcuauauguucugcaguucccguugauuggguuccuacuucacggacgacauggaguauacacgcacaccaucaauggaugacgacugaggacaugcuuagcguuuggaaucgugucuggauagaagaaaacccauggauggaagacaagacacacauaucgagcugggaagaugugccuuauuuaggaaaaagagaagaucaaugguguggauccuuaauuggcuugacugcgagggcaacaugggcuacaaauauacaaguggccauaaaucaagugcgcagauuaauaggaaaugaaaauuaccuugauuauaugacaucgaugaaaagguucaaaaaugagucagauccagaaggagcccuaugguaa

SEQ ID NO: 22052 - RNA, 9879 nt, Artificial Sequence
  derived and/or modified CDS sequence (opt6) from DENV-1__KC762623__SS-prME
ucuguaacuauguuguugaugcucaugccuacagcuuuagcauuucaucuuacgacgagagguggggaaccacacaugauaguaucaaaacaagaaagagguaaaucacuguuguucaaaaccagugcggguguuaauauguguacucuuauugcaauggaccuaggagaacugugcgaagauacacuuacguauaaauguccgaggauaacagaagcggaaccagaugauguagauuguuggugcaaugcuacagauacauggguaacuuauggaacauguagucaaacaggagaacauaggagggacaaaaggaguguagcucucgcaccacacgucggacugggucuggaaacacgaacagaaaccuggaugucgucagaaggagcauggaaacaaauacaacgaguagaaacuugggcacuuaggcacccggguuucacaguuauagcauuguuuuuggcucacgcuaucggcacaucaauuacccaaaaagggaucauauucauacuacuuaugcuuguuacuccuagcauggcuaugcguuguguuggcauuggcucacgcgacuucguagaaggauuaucaggagcaacguggguugaugugguccuggaacacggaucaugcguaacaacuauggcaaaagauaaaccaacuuuggacauagaacuguuaaaaacggaagucacaaauccagccguacugaggaaacuguguauagaagcuaaaaucagcaauacuacaacggauucaagaugcccgacacagggagaagcaacucuugucgaagaacaggacgcuaauuuuguauguagaagaacauuuguagacaggggaugggguaauggauguggacuuuuuggaaaaggaaguuugauaacuugugcuaaauucaaaugcguaaguaaacuagaagggaaaauaguacaguaugaaaauuuaaaguacucaguaaucgugacgguucauacaggagaucagcaccaggucgguaacgaaagcacugagcauggcaccacagccacuauuacuccccaagccccgaccacugaaauucaauuaacagacuauggagcacucacauuagacugcagucccagaaccgguuuagacuucaaugaaaugguccuucucacaaugaaagagaaaagcuggcuugugcacaaacaaugguuucuggaucugccauuaccuuggacuagcggggccucuacaagucaagaaacauggaauagacaggacuuacuuguuacuuuuaaaacugcgcaugccaagaaacaagaaguuguagugcucggaagucaggaaggugcaaugcauacugcacuaacgggagcaacagaaauacagacuucuggaaccacuacuauauuugcagggcaucugaaaugcagauuaaaaauggauaaauugacacuuaagggaaugucauauguaauguguacugguaguuuuaagcuggaaaaagaaguugcagaaacacaacacgguacaguacuuguccagauaaaauaugaggguacagaugccccauguaaaauacccuuuuccacucaagacgaaaagggagugacucaaaauggaagauugauaaccgcaaaccccaucguuacggauaaagagaaaccggugaauauagaagccgagccacccuucggagaaaguuauauugucauuggcgcuggugagaaagcguuaaaguugaguugguuuaaaaagggcuccagcaucgggaagauguucgaggcaacugcaaggggcgcucggcgaauggcuauacucggagauacugcaugggacuuugguaguauuggcggggucuuuacaucagugggaaaacucguacaccaaauuuuugguacggcauauggaguuuuauuuucgggagugucauggacaaugaaaaucgggauaggggucuuacuuacaugguuaggauuaaauagccguuccacuagcuuaagcaugacgugcauagcagugggccuagugacauuauacuuaggugucaugguccaagcggauuccgguugcgucauaaauuggaaggguagagaauuaaaauguggaucaggcauuuuuguaacuaacgagguucauaccuggacagaacaauauaaauuucaagcagacucaccuaaaagacuuucggcggcgauaggaaaagcaugggaagagggcguauguggcauccgaagcgcgacucgguuagaaaauauaauguggaagcagauuucuaaugaauuaaaccauauccugcucgaaaaugauaugaaauuuacgguuguagugggugacgucgcuggcauacuugcccagggcaagaaaaugauuagaccacaacccauggagcacaaauauucguggaaaucaugggggaaagcgaaaauaauaggagccgacguccaaaauacaaccuuuauaauagaugggccaaauacacccgaaugcccggacgaccagagagccuggaacauuugggaaguagaagauuauggauuugggauuuuuacgacaaacauuuggcuuaaguuacgcgauucuuacacccaaguaugcgaccaucgucugaugagugcugcaaucaaggauucaaaggcaguacacgcagauauggguuauuggauagaaucugagaaaaaugaaacauggaaacuggcuagggcaucauuuauagaaguaaaaaguuguauauggccgaagagucauacuuuauggucaaauggugugcuggaaagugagaugauuauaccgaaaauauauggaggaccaauuucucaacauaacuaucgucccgguuauuuuacacagaccgcuggaccuuggcaucuaggcaaacuggaacuggauuucgauuuaugugaagguacuacuguugugguugaugaacauugcgggaaucgcgguccuucuuugcguacgacaacugucaccggaaaaauaauacacgagugguguugucgaucauguacguugcccccguugcguuuuagaggugaagauggauguugguaugguauggaaauaagaccaguuaaagaaaaagaggaaaaucucguaaaguccaugguaucagcuggaucaggagaaguagacuccuuuucucuuggacucuuauguauuucuauaaugauugaagaaguuaugcguuccagauggucgagaaaaaugcuuaugacgggaacacuggccguauuuuuccuccuaauaaugggccaauuaacuuggaaugacuuaauaagauuauguauuaugguaggugcaaaugcaucugaccguauggguauggguacaacguaucuagcguuaauggcuacguucaaaaugaggccaauguuugccguggggcuucuauuuagaagacuuacgagcagggaaguccucuuacuaaccauugguuuaagccuuguagcgaguguugaauuacccaauagucuagaagaauuaggcgacggccuugcuaugggaauaaugaucuuaaaacuauugacagacuuucaaucucaccaacugugggcgaccuuauuaucucuuaccuuuauuaaaacuacguucaguuuacacuaugcauggaagacaauggcaaugguuuugucaaucguaagccuauuccccuuaugccucuccacaacaagucaaaagaccacuuggcuaccaguacuacuagggucgcucggauguaaaccucuaacuauguuuuugauugcagaaaacaaaaucugggguagaaaaucuuggccgcuaaaugagggaauaauggcgguugggauagugucaauucuccugaguagccuuuuaaagaaugaugugccacucgcggguccauugauagcaggagguaugcucauagcauguuauguuauuucgggguccucagcagaucuaucccuagagaaggcugcugaaguuucuugggaggaggaggcagagcauaguggugcuagucauaacauucuugucgaaguacaggaugaugggacgaugaagauaaaggacgaagaacgcgaugacacauugacgauauuacugaaagccacccuacuagcaguuucagggguuuauccauuaucgauuccagcaacuuuauucuuaugguacuuuuggcagaagaagaaacaaaggagcggaguuuuaugggauacccccucaccaccugagguagaacgagccguucuagacgacggcauuuaucguaucaugcagcguggacuccuaggacguucccaaguagguguaggcgucuuccaggagaacguauuccacacaauguggcauguuacaaggggcgcaguauugauguaucaagggaaacgacuagaacccucuugggcaucggucaagaaagaucucaucagcuaugggggaggcuggagguugcaaggcucauggaacacaggugaagaaguccaggugaucgcaguugaaccuggcaaaaauccgaagaauguccaaacugcuccuggaacuuuuaagacgccagaaggugaaguaggagcgauagcacucgauuuuaaaccaggaacguccgguucaccuauaguaaaucgugaagggaagauaguaggauuauaugguaauggugugguaacuacaucggguacguacguguccgcuauugcacaagcuaaggcaucucaggagggaccgcuaccagaaauagaagacgagguuuuucgaaaaaggaaucuaacaaucauggacuuacauccaggaucggggaaaacucgacgcuaucuaccugcaauaguccgagaagcuauaaaaagaaaauuacgaacuuuaaucuuagccccaacgcgaguuguggcgucagagauggcugaggcuuuaaaaggcaugccuauacgguaccaaacaacagcaguuaaaucggaacauacuggaaaagagauuguagaucuuaugugucaugccacauuuacgaugagacuauuaucccccguaagagucccaaauuauaacaugauuauaauggaugaagcccacuuuacugacccaaguaguauugccgcgagagguuauauaucaacccgcgucgguaugggugaggcagcugcuaucuuuaugacugccacuccaccuggcucaguagaagccuuuccucaaaguaacgcuguaauccaggaugaagagagagacaucccagagaggucauggaacucaggguacgaauggauaacugauuucccuggaaaaacagucugguucgucccaucaauaaaaucagguaaugauauugcaaauuguuuacguaagaaugggaaacgcguaauacaacuuagucgaaagaccuucgauacugaauaucagaaaacuaagaauaacgauugggacuauguagugaccacggacaucagugaaaugggagcgaauuuuagagccgauagagucauugauccaagaagaugcuuaaagccgguaauucuuaaagauggaccagagagagugauucucgcuggaccgaugccugucacuguugcuucagcugcucaaaggagggguagaguagggagaaaucauaauaaagaaggcgaucaauauauauauaugggacaaccauugaauaaugacgaggaccaugcucauuggacugaagcuaaaaugcuauuagauaacauuaacacacccgaaggaauuauaccagcauuauucgaaccggaaagagagaaaagugcugcgauagauggagaauacagauuacgcggugaagccagaaaaacuuuuguagaguugaugcggcgaggggauuuaccagucugguuaagcuacaaaguagcaagcgaaggguuccaguauagcgauagaagaugguguuucgauggugaaagaaauaaccaagucuuagaggaaaauauggacguagagauauggacuaaagaaggcgaacguaaaaaguuaagaccaagauggcuugacgcucgaacuuauucugauccacuugcacuacgagaguucaaagaauuugcagcuggacguagaagugugucgggagacuuaaucuuagagauuggcaaacuaccucaacaccuaacacagcgggcacaaaaugcucuagauaaucuuguaauguuacauaacagugaacaaggaggaagggcuuauagacaugcuauggaagaacucccagacacaauugagaccuuaaugcuccuagcguuaauagcaguccuaacaggaggugugaccuuauuuuuccuuagcggacgcggucuaggaaaaacaaguaucggcuuauuguguguuauggccagcagcgucuugcuuuggauggcaucaguagaaccacauuggauagcggcaucaauaauccuggaguucuuucucaugguccuguugauaccagaaccagacagacagcgcacaccacaagacaaucaacuggcauacguaguaauaggcuugcuguuuaugauacugacugucgcagcgaaugaaaugggucuauuagagacuacaaagaaagacuuaggaauaggacacgucgcuguugaaaaccaccaucaugcagcgaugcucgacguagauuugcacccagcuuccgcguggaccuuguaugcuguugcuaccacuauuauaacaccaaugaugaggcacacaauagaaaauacaaccgcgaacauaaguuuaaccgccauagcuaaucaagcugcaauccuaaugggacuagacaaaggauggccaauaucuaaaauggauaucggcgucccucucuuagcauugggaugcuauucucaaguaaacccguugacuuugacagccgcugucuuaaugcuuguagcgcacuaugcaauuauagguccaggauuacaagcaaaggcgaccagagaagcacagaaaaggacagcagcuggaaucaugaaaaacccgacgguagauggcaucguggcuauugaccuggauccaguaguauacgaugcaaaauuugaaaaacaauugggacagauuaugcuacuuauauugugcacgucgcaaaucuuauuaaugcgaaccaccugggcucuaugugaaagcauuacuuuagcaacuggcccauuaaccacacuaugggaagguucaccugggaaauuuuggaacacuacgauagcugugaguauggcaaauauauucagaggcagcuauuuagccggugcaggccuugcuuucaguuuaaugaaaaguuuagguggagggcgaagagguaccggcgcucaaggagaaacauuaggagagaaauggaaaagacaauuaaaccaacucaguaaaagcgaguucaauacuuauaaaagaucuggaaucauggagguagacaggucagaagccaaggagggauuaaaaagaggagaaaccacaaaacaugcaguuucaagagguacugcaaaauugcgaugguuuguagaaaggaaucuuguaaagccagaagguaagguaauugauuuaggcuguggacgggguggauggaguuacuacugugcuggacuuaagaaagugacagagguuaaaggauacacaaaaggcgguccggggcacgaggaacccauuccaauggcgacauaugguuggaaucuagugaaauugcauagcgguaaggacguauucuucaucccaccagaaaaaugugauacacuacucugugauauuggagagaguaguccuaauccaacgauagaagaaggaagaacacugcggguucuuaaaauggucgaaccaugguuacgugguaaucaauucuguauuaaaauauuaaauccuuauaugccuucaguuguggaaacccuugaacaaaugcagcgcaaacauggggguaugcuaguacgaaauccguuauccagaaacagcacucacgaaauguacugggucucauguggaacagggaauauuguguccgcaguuaauaugacaucuagaauguuauugaauagauucacaauggcccauaggaaaccaaccuacgaaagggacguugaucuaggugcagggacuaggcaugucgcaguagaaccugaaguugcuaaucucgauauaaucggacagaggauagaaaacauaaaacaugaacacaagucuacguggcauuaugacgaagacaauccauacaagaccugggcauaucauggauccuacgaggucaagccgucgggauccgccucuaguaugguuaauggaguugucaaguuguuaacuaagccuugggauguaaucccgauggugacccaaauagccaugacagauaccaccccauuugggcaacagaggguguuuaaagaaaaaguugauacuaggaccccgaaagcaaaaagagggacaacgcaaauaauggaggucacugcgagaugguuauggggauuuuuaagcagaaauaaaaagccacgaauuugcaccagagaggaauuuacacgcaaagugcgaaguaacgccgcgaucggcgcaguguuuguggacgaaaaccaguggaacucagcuaaagaagcggucgaagacgaacgauuuugggaucuaguucauagagaaagagaacuacauaaacaggguaagugugcaaccugugucuacaacaugaugggaaaaagagaaaagaagcucggugaguucggaaaagcaaaggguagccgagcaauaugguauaugugguugggagcucgguucuuagaguuugaggccuuaggauucaugaaugaagaucauugguuuucacgagaaaacucuuuaagcggaguugaaggagaagggcuccauaaauugggauacauauuaagagauaucucaaaaaucccugggggaaauauguacgccgaugacaccgcaggaugggauacgagaauuaccgaagacgaucuccaaaaugaagcgaagauuacugauauuauggagccggagcaugcccuacuugcaaaggcaauauuuaaacuuacguaucaaaauaaaguaguaagggugcaaagacccgcgaaaaaugguacgguuauggauguaauuagcagacgggaucagaggggaaguggacaagucggaacuuacggacuaaauacauucacaaacauggaggcacaauuaauaagacaaauggagagugaaggaaucuuuucacccucagaacuagaaacuccuaacuuagcugagcgagucuuagauugguuggaaaaauacgggguugagagacucaaaagaauggcaauaucuggagacgacugcguagugaaaccaaucgacgacagguuugcuacagcauugacugcccugaacgauaugggaaaaguccgaaaggacauaccgcaaugggaaccaucaaaagguuggaaugacuggcaacaaguaccauuuuguagucaccacuuccaucaguugauuaugaaagaugggcgagaaauugugguaccuuguagaaaucaagaugaguugguaggcagggcgagaguaucgcagggagcuggguggagcuuaagagaaaccgccugucucggcaaauccuacgcacaaauguggcaauuaauguacuuccaucggagagauuugagacuggcugcgaaugcuauauguagcgccguacccguagauuggguacccaccucucggacaacuuggucaauucaugcucaucaucaauggaugacaacagaggacaugcucaguguauggaaccggguguggauugaagagaauccuuggauggaggacaaaacacauauuucaucaugggaggauguuccuuauuuaggcaagagagaagaccaauggugcggaucacugauugggcuaacagcaagagcaacgugggcaacaaacauacaaguugcaauaaaccaaguaagacgucugauagguaaugaaaacuaucuagauuacaugacaucaaugaagagauucaaaaaugaaagugauccagaaggagcccuaugguaa

SEQ ID NO: 22053 - RNA, 9879 nt, Artificial Sequence
  derived and/or modified CDS sequence (opt6) from DENV-1__KC762632__SS-prME
ucuguaacuauguuacuuauguuaaugccaacagcucucgcauuucacuuaaccaccaggggaggugaaccccauaugauagucucuaaacaggaaagggguaaaagccuuuuauuuaaaacuucagcuggaguaaacaugugcacucucauagccauggaucuaggagaacugugcgaagauacacuuacuuacaaaugucccaggauuacggaagcggaaccagaugacguugacugcugguguaacgcaacggacacauggguaacauaugggaccuguagucaaacgggugaacaucggcgggauaaacguaguguugcauuggcuccgcacgugggacuaggauuagaaacgcgaacagaaaccuggaugucaagcgaaggagcauggcgucaaaugcaaagaguagaaacuugggcgcugagacacccagguuuuacagugauugcucucuuuuuagcgcacgcgauuggcaccucgauuacgcaaaaagggauaaucuucauauuauuaaugcucguaacuccuucuauggcuaugaggugcguaggcauaggaucucgagauuuuguagaaggauuauccggagccacauggguagauguuguucuggaacaugguuccugugucaccacaauggcaaaggauaaaccuacucucgauauagaguuacuaaaaaccgaagugacaaacccagccguuuuaaggaaacuuuguauugaagcaaaaauaagcaauaucacaacagacaguagaugcccaacccaaggcgaagcaacacugguugaagaacaagaugcaaauuuugucuguagacgaacauuuguggauagagguuggggaaacggcuguggccuuuuuggaaagggcagccuaauaacaugugcaaaauuuaaauguguuacaaaguuggaagguaaaaucguacaauaugaaaaucuaaaauacuccguaauagucacaguacauacuggagaccaacaucagguaggcaaugaaucgacugagcacgguacgacugcgacuauuacaccgcaagcaccaacgacugagauucaacuuacugacuauggagcguugacguuggauugcuccccacgaacuggacuagauuucaacgaaaugguuuuauuaacuaugaaggaaaagucauggcuaguacauaaacagugguuccuagacuugccauuaccauggacaaguggcgcuucaacaagucaggaaacauggaauagacaggaccuauuaguaacuuuuaaaacagcgcacgccaaaaagcaagaaguaguuguccuagguagucaagaaggugcuaugcacacagcauugacgggcgcaacugagauacaaacgucaggaacuaccacaauuuuugcagggcaucucaaaugccgacuuaaaauggauaaauugacccuuaaaggaaugucuuacgugauguguaccgguucauucaaacuugagaaggagguagcugaaacacaacacgguacuguguuaguccaaauaaaauaugaagggacugaugcgccuuguaagauuccauuuucaacacaggacgagaaaggggucacacaaaauggaagguuaauuaccgccaauccaauagucacugauaaagaaaaaccugugaauauugaagcagaaccaccauucggcgagucuuacauaguuauaggggcaggggagaaagcccuaaagcuauccugguuuaagaaagggucgucuauaggaaaaauguuugaagcuacugcccguggggcaagaagaauggcaauauuaggggauacggcaugggauuuuggaucaauaggcgguguguucacaaguguaggaaaguuaguccaccaaauuuuuggcacagcauauggaguucuauuuucggguguaagcuggacaaugaaaauagggaucggaguuuuacucacgugguuagggcugaauagccguuccacuucuuuaucaaugacauguauagccguaggacuggugacauuguaucugggaguaauggugcaagcagauucagguugugucauuaauuggaagggaagagaauuaaagugcggcuccgguauuuuugugacgaaugagguacacacauggacugaacaauauaaauuucaagcagauucaccuaagcgccucagugccgcuaucgggaaagcaugggaagagggaguaugcgggauaagaagugcuacuaggcuugagaauauuauguggaaacaaauaaguaacgaauuaaaucauauuuugcuagagaacgauaugaaauucaccguggucgucggugacguagcaggcaucuuagcacagggcaaaaagaugauaagaccccaaccuauggaacauaaauauagcuggaagucuuggggaaaagcaaaaauaaucggugcugaugugcaaaacacaacuuuuaucauugaugguccaaacaccccagaguguccggacgaccaaagggccuggaauauaugggaaguugaggacuacggguucggcauauuuacaacaaacauauggcugaaacuaagagauucauauacacaaguaugcgaucauagguuaaugucugcagcaauaaaagacucaaaagcaguucaugccgauaugggguauuggauagaaagcgagaaaaaugagacuuggaaacuagcuagagcuucuuuuauugaagugaaaacuuguauuuggccaaaaucucauacacuuuggagcaauggagugcucgaaucugaaaugauaauuccgaaaauauaugggggaccaauaucgcagcauaauuaccgaccaggguauuucacccaaacggcgggcccauggcacuuggggaaacuggaacuagacuuuaaucucugugagggaacaacggucgucguggaugaacauuguggaaaucgggggccaucacuacgcacaacuacagugacgggaaaaauuauacacgaauggugcugucgaucuugcacacuucccccuuuaagauuuagaggggaagauggguguugguauggcauggaaauuagaccagucaaagaaaaagaggagaaucucgugaaaucgaugguuucugcagguagcggagaaguagauagcuucucacuagggcucuuauguauaucaauuaugauagaagagguaaugagaucuagguggucacguaagaugcuaaugacugggacacuggcuguguucuuuuuauugauaaugggucaguugacuuggaaugacuuaauccggcuaugcauuauggucggggcaaaugcuagcgaucgcauggggaugggcaccacuuauuuagcuuuaauggcaaccuuuaaaaugagaccaauguuugcagugggucuacuauuccgaaggcuuacaucacgcgaagucuuguuacuaacuauuggucuaucacuuguagcgucgguugaauugccuaauaguuuagaggaauuaggagauggauuagcuauggggauuaugauacuaaaauuacuaacugauuuucagucucaucaacugugggcuacccucuugagucucacauuuauaaaaacaacuuucucauuacauuaugcguggaagaccauggcaaugguacucuccauuguuaguuuguucccauugugccucucuacaacgucccagaaaacgaccuggcucccaguauuguuaggaucccugggaugcaaaccacuaacaauguuccuuauagcagaaaacaaaauaugggguagaaaaaguuggccuuuaaaugaagguauaauggcaguagggauagugaguauacuguuaucaucguuacuaaagaaugauguuccuuuagcagguccuuuaauugcaggcgguaugcuuauugcauguuacguuaucagcggaagcagugcugauuuaaguuuagaaaaagccgcagaagucaguugggaagaagaagcggaacauaguggagcaagucacaacauauuaguggaaguacaagacgauggaacaaugaaaauaaaggacgaggaaagggaugacacuuuaacuauauuacugaaagccacacuauuagccguaucuggagucuauccccuuuccauaccggcaacauuguuuguaugguauuucuggcaaaagaagaaacagagaucugguguccuaugggauacgccaucaccuccugaaguugaaagggcagugcuagaugauggaaucuaccguauaaugcaaagagguuuacuagggagaucgcaaguuggagucgggguuuuucaagagaacguuuuccauacaauguggcauguuacacggggcgcugugcucauguaccaaggaaaaagacucgaaccaucaugggcauccguuaagaaagaucucauauccuacgguggcggauggaggcuucaagguucguggaauacaggagaggagguacaaguuauugcaguagagccgggcaaaaacccuaagaacguacagacagcgccgggcacauucaaaacgccagaaggggaagugggugcaaucgcuuuagauuuuaaacccggaacauccgguucaccgauagucaacagagaagggaaaaucguaggauuguacggaaacggaguaguuacaacauccggaacguauguaagugcaauagcacaggcgaaggcaagucaggaaggaccacuacccgagauagaagacgaaguauuccguaaacgaaauuuaaccaucauggauuuacauccggguuccgguaaaacucggagauacuugccagccauuguccgagaagcuauuaaacggaaacuaagaacccuaaucuuagcaccaacgagaguaguugcuagugagauggcagaggcuuuaaaaggaaugccaauucgcuaccaaacuacagcuguaaaauccgaacauacagguaaagaaaucguagauuuaaugugccaugcaacuuuuacaaugcgacuucuaucgccagugcgagugccuaauuacaacaugauaauuauggaugaggcucacuuuacggauccgucaagcauagcagcucgaggguauaucaguacacgagucggaaugggagaagcugcagcgauuuucaugacggcuacaccaccagguucgguugaggcuuucccucaaucuaaugcugucauacaagaugaagaaagagacauacccgaaagaaguuggaauagugguuaugaauggauuacugauuucccaggcaaaacagugugguuugucccaagcauaaaaagugguaacgauauugcuaacugccucagaaagaauggaaaacgaguuauucaacuaagucgaaaaacauuugauacagaguaccagaaaaccaaaaacaacgacugggacuauguggucacuacagauaucagugaaaugggagcuaauuuccgcgcugacagaguaauagauccaagacggugucuaaaaccgguaauacugaaagacggaccagagaggguuauucuagcgggaccuaugccuguaacaguggcuagugcugcccaaagaagaggucgcguuggaagaaaccacaauaaagaaggagaccaauauauauauauggggcaaccgcuaaauaaugaugaagaccacgcucauuggaccgaagcaaaaauguuacuagacaauauuaauacaccagaaggcauaaucccagcucuauucgaacccgaaagagagaaaagugccgccauugacggugaguacagauuacguggugaggcucguaaaacauuuguggaauuaaugagaagaggggaccuaccuguuuggcuuucauauaaaguugcgucagaagguuuccaauacucggaccgucgcugguguuuugacggcgaaagaaauaaccagguucuugaggagaauauggacgucgaaaucuggacuaaagagggugaacgaaagaaauuaagaccuagaugguuagaugcacguacauauucagauccuuuagcacuuagagaauuuaaagaauuugccgcgggaaggagaaguguuuccggugacuuaauauuggaaauagguaaacuaccacaacaucucacucaacgagcacagaacgcucuugauaauuuaguuaugcuccauaacagugaacaaggagggcgagcuuaccgacaugcgauggaagaauuaccggacaccauugaaacacuaauguuauuagcacuuauagccguuuuaacuggagguguaacacuauucuuuuuaucgggccguggacuagggaaaacaucuauuggcuuacuuuguguaauggccucgagcguauuacuuuggauggcaucaguagaaccacauuggauugccgccagcaucauucuagaauuuuuccuaauggucuuguuaauaccagaaccagaccgacaacgaacgccacaggauaaccaauuagcuuauguuguaaucggacuacuguuuaugauccuaacaguugccgcgaaugaaauggggcuauuggaaacaacuaagaaagaccuagguauugggcauguagcaguugaaaaucaccaucaugccgcuauguuggauguugauuuacacccagccucugcauggaccuuguaugcuguugccacaacuaucauaaccccaaugaugaggcacaccaucgaaaauacaaccgcuaauauauccuuaacagcuauagccaaucaagcggcuauauugauggggcuagauaaaggguggccaauaucaaaaauggauauaggcguuccauuauuagcacugggguguuacagucaaguaaacccacucacgcucacagcugcuguguuaaugcuaguggcccacuacgcaauaauaggaccgggcuuacaagcaaaggccacacgagaagcgcaaaaacgaaccgcagccgguauaaugaagaauccgacuguggacgggauaguugcaauagaucuugacccagucgucuaugaugcaaaauuugaaaagcaauuaggucagauaaugcuauugauacuaugcacuucgcagaucuuacuuaugcgcacuacaugggcuuuaugcgaaucaauaacguuagcaaccgguccacuaaccaccuugugggaaggaagcccaggcaaauucuggaacaccaccauugcaguauccauggcaaauaucuuuagaggaucguauuuagcuggagcgggguuagcauucucccucaugaagucauuaggaggaggcagaagagggacuggagcucaaggagaaacccuuggggaaaaauggaaacggcagcuaaaccagcuguccaaaucagaguuuaacacauacaaaagaagugguauaauggaggucgacaggagugaagcuaaagaaggauuaaagcguggagaaacgaccaaacacgcuguuucacgcggaacagcuaagcuaagaugguuuguugaaaggaacuuagugaaaccagaaggaaagguaauugauuuaggguguggaagagguggguggaguuacuauugcgccggccuaaagaaagugacugagguuaaaggauacaccaaggguggaccaggccaugaagaaccaauucccauggccaccuauggguggaaucuagucaaacuucacagcggaaaagacguuuucuucauacccccagagaaaugcgauacgcuacugugugauauuggagagucuaguccaaaccccaccauagaagaaggacguacacuacgaguauugaaaaugguugagcccuggcuaaggggaaaucaguuuuguauaaagauucucaacccauauaugccaagcgugguggagacauuagaccaaaugcagaggaaacauggggguauguuaguacgaaauccccuaucacgaaauagcacacacgagauguacugggucagcuguggaacuggcaauaucguaagugcggucaauaugacuucaagaaugcucuugaauagauuuacuauggcgcauagaaagccaaccuaugaaagagacguugaucugggagccggaacuagacacgucgcuguagaaccugaaguugccaaucucgacauuaucggucagcgaauugaaaacauaaagcaugaacauaaaaguaccuggcacuacgacgaagauaacccauauaaaaccugggcuuaccaugguaguuacgaggucaaaccaagcgggucagccaguucuaugguuaacggcguggugaaacuacuaacuaaaccaugggauguuaucccuaugguuacacaaaucgcuaugacugauacgacaccuuucggucaacaaagaguguucaaggaaaaaguugauacucggacgccuaaagcgaaaagaggaacaacgcaaauuauggaggucacugcaagauggcuauggggguuccuuagucgaaacaagaaacccagaauuuguacuagagaagaauuuacaagaaaagucagaagcaaugcugcaauaggugcgguauucguugaugaaaaucaauggaacuccgcaaaggaagcaguagaggacgaacgauuuugggaccuaguacauagagaaagagaauugcauaagcagggaaaaugugcaacauguguguauaauaugaugggaaaaagggagaagaaauuaggggaguucggcaaagcaaaaggcucuagagcaauaugguacaugugguuaggcgcaagguuucuagaauuugaggcgcuagguuuuaugaaugaggaccauugguucucucgugaaaacucauuaucagggguagaaggagaagguuuacauaaacugggauauauucuaagggauauaucaaaaaucccuggugguaacauguacgcggacgacacugcgggaugggacacaagaauuacagaggaugaccuacaaaacgaggcaaaaauaacggacauuauggagccggagcaugcacucuuagcuaaagcaaucuucaaacuuacguaccaaaauaaagugguacguguacagaggcccgccaaaaacgguacugucauggacguaauaucacgucgggaccagagaggcucuggacaaguaggaacguauggccugaacacuuuuacuaauauggaagcccaauugauacgccaaauggaaagugaaggaauuuuuaguccaucagagcuagagacaccgaaccuagcggaacgcguauuggauugguuagaaaaauacgggguagaacgucuaaaacgaauggcaauaucaggcgaugauuguguaguaaaaccuauugaugaucgcuuugcaacagcguugacagcccugaacgauaugggaaaaguaaggaaagauauaccacaaugggaaccaucuaaaggguggaacgauuggcaacaaguaccuuuuugcagccaucauuuccaccaacucaucaugaaagaugguagagaaauagugguaccuuguagaaaucaagaugaauuaguuggcagggccagaguaagccagggagcaggauggagccuacgcgaaacagcgugcuuggguaaaucuuacgcucaaauguggcaacuaauguauuuucauaggagagaccuaagacuugcagcaaacgcgaucugcuccgcgguaccagucgacuggguaccgacaagucguaccacauggaguauucaugcccaucaucaguggaugacaacagaagacaugcugagugucuggaauagaguauggauagaagaaaauccauggauggaagacaaaacucacauauccaguugggaggacguaccuuacuuagggaaacgagaggaccaauggugcgguaguuuaauagguuugaccgcaagagcgacaugggcuaccaauauucaagucgcuauaaaccagguacgcagacuuauaggaaaugaaaauuaccuugacuauaugacgucaaugaagagguuuaaaaacgaaagugauccagaaggugcucuaugguaa

SEQ ID NO: 22054 - RNA, 9879 nt, Artificial Sequence
  derived and/or modified CDS sequence (opt6) from DENV-1__KC762637__SS-prME
ucaguaacaaugcuuuuaaugcugaugccaacggcauuagcuuuucacuuaacaacaaggggaggagaaccacauaugaucgugaguaaacaagaaagagguaaaucuuuauuauuuaaaacaagugcaggagucaauauguguacauuaauagcaauggauuuaggagaacucugugaagauacucugacguauaaaugcccuagaauaacagaagcggaaccagacgauguggacugcuggugcaaugcaacggauacuugggucacauacgguacauguucacaaaccggugaacaccggagggacaaacgaaguguugcauuagcaccccauguugggcucggguuagaaacacgcaccgaaacauggaugucaucugaaggagcauggaaacaaauucaacggguugaaacgugggcuuuacggcacccaggauucacugugauugcucucuuccuggcacacgcaauaggaacaucgauuacacaaaaagguauaauauucaucuuacugauguuaguuacgccuaguauggcuaugcgauguguuggaaucggaucacgagacuuuguggaaggacuuagcggugcaaccuggguagacguagugcuagaacauggcagcugugugacgaccauggccaaagauaaaccaacgcuagacaucgaauuacuuaaaacagaaguaaccaacccagcaguauuacgaaaacugugcauagaagccaaaauauccaauacaacaacggacucccgcugucccacucaaggagaagcgacccuaguggaagaacaggaugcaaauuuuguauguagaagaacguuuguugaucgcggaugggguaacgggugcggauuguuugguaaagguucuuugauuacaugcgccaaguucaagugugucacgaaauuagaaggaaaaauagugcaguaugaaaacuuaaaauauucgguuauaguuacgguacauacaggagaccaacaccagguuggaaacgaaucuacagaacacggaacaacggcuacuauaacgccacaagcuccaacaacagaaauucaacuaacugauuacggcgcguuaacgcuagacuguuccccacgaacagguuuagacuuuaaugaaaugguuuuguugacuaugaaagagaaaagcuggcuugugcauaaacaaugguuucucgauuuaccgcuccccuggacaucaggagcauccacaagucaggaaacguggaauagacaagaccuacucguaaccuuuaaaacagcacaugccaagaaacaagaaguuguuguccuugggucucaggaaggagccaugcauacggcacucaccggggcuacagaaauacagacaaguggaacuacgacaauauucgcaggucaccuuaaauguagguuaaaaauggauaagcuaacccucaaagguaugucauauguuauguguacggguagcuuuaaauuagaaaaagaaguugcagaaacacaacauggaacaguuuuaguacaaauaaaauaugaaggaaccgacgcuccaugcaaaauuccguucaguacgcaagaugaaaagggagucacucaaaacggacgccuuauaacggcaaacccgaucguaacugauaaggaaaagccaguaaacauagaagccgaacccccuuuuggugaaagcuauauagucauaggagccggugaaaaagcccugaaacugucaugguuuaagaaaggaucaucaauuggaaagauguuugaagcaaccgcuagaggggcacgaagaauggcuaucuuaggugauacugccugggacuuuggaucaaucggugggguguuuacaaguguugggaaauugguacaccaaauuuucggaacagcuuaugguguacuguucuccggaguuucauggacaaugaaaauagggauaggaguacuucuaacuugguuagggcugaacucgcgaucgaccuccuuaaguaugacauguauagccgugggauuaguaaccuuauauuugggagugauggugcaagcagauaguggaugcguaauaaacuggaaaggacgagaacugaagugcgggucuggaauauucgucacgaaugaagugcauacauggaccgaacaauacaaauuucaggcagauucgccuaaacgauugucugcugccauuggcaaggcuugggaagaaggagugugugguauacgaucugccacccgacucgaaaauauuauguggaaacagauauccaacgaguugaaccauauauuacuugaaaaugauaugaaguuuacaguaguagugggugacgucgccggcauacuagcccaaggcaagaaaaugauaagaccacaaccaauggaacauaaguauucauggaaaagcuggggaaaggcuaaaauuauuggugccgauguacaaaauacaacauucauaaucgaugguccaaauacccccgaaugcccggacgaucaaagagcuuggaacauuugggaaguggaagauuacggauucgguauuuucacaacuaauaucuggcuuaaauuaagagacaguuacacacaaguaugugaucaccgguuaaugagugcugcgauaaaagacucuaaggcgguacacgcggacaugggauauuggaucgaaucugagaaaaaugaaacauggaaauuagccagagccucguuuauagaggucaagaccuguauauggccgaaaagucauacccuauggaguaaugguguccucgagagcgaaaugauuauaccaaaaauuuacggaggcccuauaagccaacauaauuaucgacccgguuauuuuacucaaacagcaggacccuggcaccugggaaaguuagagcuagacuucgaccuaugcgaagggacuacaguaguugucgaugagcacuguggaaaccguggacccucgcuucguacaacuacgguaaccgguaaaauaauacacgaauggugcugcaggagcugcacucuaccgcccuuacguuuucggggagaagaugggugcugguacgguauggaaauacgacccgucaaagaaaaagaagagaaucuggucaaaaguaugguuagugcgggaaguggcgagguugacagcuucucccucggucuauuaugcaucaguauaaugauagaagagguaaugcgaaguagauggucaagaaaaaugcuaaugacuggcacguuggcaguauucuuuuuacuuauaaugggucagcuuacuuggaacgaucugauacggcucugcauaauggucggagcaaaugcuagugaucguaugggaauggguacaacauauuuggcauuaauggcuacuuucaaaaugcgaccaauguucgcagugggauuauuauuucgucgccuuacuucacgagagguauuguugcugaccaucggccuuucacuuguagccucaguggaacugccaaacucauuagaagaguuaggggauggauuagccaugggaauaaugauccugaagcuacucaccgacuuccaaucacaccaauuaugggccacuuuauugucgcuaacauucauuaaaaccacauucagccuccauuacgcguggaagacuauggcgaugguuuuaucaaucguuagccuguuuccgcugugucuguccacgacaucacaaaagacaacuuggcugccaguguugcuugguagucuagguugcaaaccacuaacaauguuccucauagccgaaaauaagauauggggucgaaaaagcuggccauuaaacgagggcaucauggcagucgggauugucucaauacuauuaucaucguuauuaaagaaugauguuccuuuagcgggcccacuaauagcuggggguaugcuaauugcauguuaugucaucucagggucaagugcugaccuauccuuagaaaaagcagcagaaguuuccugggaggaagaagccgaacauagcggggcaucgcacaauaucuugguagaaguacaagaugacggaacaaugaaaauuaaagacgaagaaagagaugauacauugacaauuuuacuaaaagcaacacuauuggcgguaaguggugucuaucccuuaaguauaccggccacuuuauucguuugguacuuuuggcagaaaaagaaacaaaggucuggcguacuaugggacaccccgaguccaccugaaguagagcgugcuguacucgacgacgguauauaucguauuaugcaacguggcuuacuaggaagaucucagguaggcguuggagucuuucaggagaacguguuucauacaauguggcacgucacuagaggcgcaguucuuauguaccaagggaaaagauuggaaccuaguugggcaucaguaaagaaagaucuaaucaguuauggaggaggcuggagacuacaaggcaguuggaauaccggugaggaaguacaaguaauagcaguugaaccgggcaaaaaccccaaaaacguacagacugcaccaggcacguucaaaacaccugagggggaaguuggagccauugcuuuagacuuuaaaccagggacaagcggaucgccuaucguuaaucgagaagggaaaauagugggucuauacgguaacggugugguaacgacaucaggaacauauguaagugccauagcgcaagcuaaagcaucacaggaggggccgcuuccugaaauugaagacgaaguauuccgcaaaagaaaucugacaauuauggauuuacauccgggaucaggaaaaacucgccgauaccuaccagcuauagugcgagaagcaauaaaaaggaaacucaggacacuuauacuugcuccaaccagaguaguagcuagcgaaauggccgaagcguuaaaagggaugccuauacgauaucaaacgacggcaguaaaaucugagcacaccgguaaggagauuguagaucugaugugucaugcgacauuuacaaugcgauuauuaagccccguaagagugccaaauuauaauaugaucauaauggaugaagcacauuuuacagauccuaguagcauagcagcacgcggauauaucucaacaagagucgguaugggugaggcagcagcaauauucaugaccgcaacuccaccgggaaguguggaggcuuuuccucaaucuaacgcgguuauacaggaugaagaaagagacauaccugaaagaaguuggaacuccgguuaugaauggauaacagauuucccaggaaaaacgguaugguucguacccuccauaaaaucaggaaaugauauagcuaauugucugaggaagaacgguaagagggucauacaauugucacggaaaacuuuugacaccgaauaucagaaaaccaaaaauaaugauugggauuacgucgucacgacugauaucagugaaaugggagcuaacuuccgcgcagacagagugauugacccacggcguugcuuaaaaccggucauuuugaaagacggaccagaacggguaaucuuagcggguccuaugcccguaacagucgcuagcgcagcacaaaggcguggaagaguaggacggaaccauaacaaagaaggagaccaauauauauauaugggucaaccauugaauaacgaugaagaccaugcacauuggaccgaagcaaaaaugcuuuuagauaauauuaacacaccggaaggcaucauaccggcucuauuugagccagagagagagaaaagugcagcaauagauggagaguaucgguuaagaggcgaagcgcggaaaacauucguugaacuaaugaggcgaggugauuuaccugugugguuaaguuauaagguagcuagcgaaggcuuccaauacagugauagacgguggugcuuugauggggaaagaaauaaccaaguacuagaagaaaauauggacguagaaauauggacuaaagaaggugaaagaaagaaauugagaccacgcuggcuggacgcgcguacauauuccgauccgcuagcuuugagagaauuuaaagaguucgcagcugggcgaagaaguguuaguggagaucuaauacuugaaauuggaaaauuaccccagcaucuaacccaacgggcccagaaugcauuagauaaccuagugaugcuacauaacucggaacaaggagggcgagcauauaggcacgcaauggaagaacuuccagauacaauagaaacccuuauguuacuugcucucauugcgguauuaacaggcggcguuacucuauucuuccuaagugggagggguuugggcaaaacgagcauagguuuacuaugcgucauggcaucaucagucuuacuauggauggcaagcguagaaccacauuggauagcagcuucgaucaucuuagaguucuucuuaaugguucuuuuaauaccugagccugaccgacaacguacuccacaagauaaucaacuggcauauguaguaauuggacuuuuguuuaugauccuuacaguagcagccaaugaaaugggucuuuuagaaacaacuaagaaagaccuagggauuggacacgucgcaguugagaaucaucaucaugcggcuaugcuagacguugaucuacaccccgcaucagcguggacauuauaugcaguugcaacuacaauuauuacaccgaugaugcgucacacgaucgagaacacgaccgcuaauauaaguuuaacagcuauagcuaaucaggcugcaauucuaaugggguuagauaaagguuggccuaucuccaaaauggauauaggagucccacuucuagcacuagguugcuacucccaagugaacccuuugacccuaacggcugcaguauugauguuaguagcgcauuacgcgauuauaggaccaggacuacaagcuaaggcuacgagagaagcacaaaaacgaacggcagcagggauaaugaaaaauccuacggucgaugguauaguugcaauugauuuggaccccguaguguaugacgcaaaauuugaaaagcaacuaggucagauaauguuguuaauauuaugcacaagucagauacugcuaaugcggacaacuugggcacuaugugaaucaaucacguuagcuacggguccacuaacaacuuuaugggagggaucaccuggaaaauuuuggaacacaacaauugccgucagcauggcuaauauauucagaggaucauaccuggcuggggccggccuggcguucaguuuaaugaaaagccuaggggguggaagacgugguacaggggcucaaggugaaacucugggagaaaaauggaaacgccaacuuaaccaacucucuaaaagugaguuuaauacguacaaaaggucuggcaucauggaaguggaucgaucagaagcuaaagaagguuuaaaaagaggugaaacaacaaaacacgcagucucacgcgguacugcuaaauugcgaugguucgucgaaaggaauuugguaaagccagaaggaaaaguuaucgaucucggcuguggaagagguggauggucuuacuauugcgccggacuuaagaaaguuacugaggugaagggauacaccaaagggggaccaggccaugaagaaccaauaccaauggccacguacggguggaacuuggucaaacuucacucagguaaagauguauuuuucauuccaccugaaaagugugacacguugcuuugugauaucggugaaucgucaccgaacccaacuauagaagaaggacguacucuacgcguucugaaaaugguagaacccugguuacgaggaaaccaguuuugcaucaaaauauuaaauccauauaugccgagugugguugaaacacuugaacagaugcaacguaaacaugggggcaugcucgugagaaauccacugaguagaaauaguacucaugaaauguacuggguaagcuguggaacuggaaauaucguaagcgcuguuaacaugacaucuagaaugcuuuuaaacagauucacgauggcacaucgcaaacccacuuacgaaagagacgucgauuugggggcugguacuagacauguugcaguagaacccgaaguagccaacuuagauauaauaggacaaaggauugaaaauauuaaacacgaacacaaaaguacauggcauuacgaugaagauaauccauauaaaacuugggccuaccacggaucauaugaaguaaagccgucuggaucagccucgaguauggucaauggagucgucaaacuuuuaacaaagccgugggaugucauaccgauggugacgcaaauugcgaugacugauacgaccccuuuuggccaacaacgaguauuuaaagagaaaguagacacuagaacaccuaaggcaaaaagagggacgacucagauaauggaaguaacugccagaugguuguggggcuuccucaguaggaauaagaaaccaagaaucuguacgcgagaagaguuuaccagaaaaguacgaucgaacgccgcaauaggggcugucuuuguagaugaaaaccaguggaacucggcuaaagaagcgguggaagaugaacgauucugggaucuuguacauagagaacgcgagcuacauaaacaggggaagugugcaacuugcguauacaauaugauggguaaaagagagaagaaacuaggagaauuuggcaaagcaaaaggaucgcgugcaauuugguacauguggcuuggugcacgcuuuuuagaguuugaggcauuaggauuuaugaaugaggaucauugguuuucccgugaaaacucacuuuccggcguagaaggagagggucuacauaaauugggcuacauacuucgagauauaagcaaaauuccaggagguaauauguaugcggacgacacagcuggcugggauacacgaauaacugaagaugauuuacaaaaugaggcgaaaaucacagacauuauggaaccagaacaugcuuuauuagcaaaggcuauauucaagcuaacuuaucaaaauaaggucgugagaguucaaagaccugccaaaaauggaacuguuauggauguaauaagcagaagggaucagcgcggaagcggacaagucgggaccuauggacuaaauaccuuuacaaacauggaagcucaauuaauacgucaaauggagagcgagggaaucuucaguccuagugaacuggagaccccuaauuuagcagaacgagucuuagauuggcucgaaaaauauggaguagaaagauugaaacggauggcgauaaguggagaugacugcguaguaaagcccauagaugacagguuugcgacugcacuaacagcucuaaaugauaugggaaaagugaggaaggacauaccacaaugggaacccucgaaaggauggaacgacuggcaacaagucccuuuuugcagccaucauuuucaccagcuaauaaugaaagauggacgugaaauagugguuccuuguagaaaucaagaugaauuagucgggagagcuagagucucacagggugcagguuggucauuaagggagacagccugucuaggcaaaagcuacgcccaaauguggcagcugauguacuuucaucgucgggaucuaaggcuagcggcaaaugcaauaugcucugcuguaccaguagauuggguucccacgucacgaaccacuuggucgauacaugcgcaucaccaauggaugacaacagaagacaugcucucgguauggaauagaguuuggauugaagaaaaucccuggauggaagauaaaacacauauuucaucuugggaagauguuccguaccuuggaaagcgggaagaucaauggugugguagccucauaggauugacugcgcgagcgaccugggcaacaaacauucaaguugccauaaaucaggugagaagacugauagguaacgaaaacuaccucgacuauaugacaaguaugaaaagguucaagaaugaaagcgauccggagggagcauugugguga

SEQ ID NO: 22055 - RNA, 9879 nt, Artificial Sequence
  derived and/or modified CDS sequence (opt6) from DENV-1__KC762620__SS-prME
uccguaacuauguuguuuaugcuacuaccaaccgcucuugcauuccacuuaacuacacgggguggugaaccacacaugauaguaagcaaacaagaaagaggaaaaucuuugcuauuuaaaacgagcgcaggaguuaacaugugcacucuuauugcaauggaucuuggagaacugugcgaggauacuaugacuuacaaaugccccagaauaacugaaacagaaccagacgacguugacuguugguguaacgcaaccgaaacuuggguaacuuaugguaccugcucgcaaacuggagaacauagaagagacaaacgaagcguugcacuugcuccacacguuggauuagggcuagaaacucggacagaaacuuggaugagcucagaaggggcauggaaacaaauucaaaaaguugaaacuugggcuuuaagacacccaggauuuacuguaaucgcguuauuucuagcucaugccauaggaacaucuauuacgcaaaaaggcaucauauuuauacuuuuaaugcuaguuacuccuaguauggccaugagaugcgucgguaucggaaaucgagauuuuguugaagggcuaaguggugcaacauggguggauguaguauuagaacacggaucuugugugacuacaauggcuaaagauaaaccgacacuugacaucgaacuucugaaaacugaggugacuaacccagccgugcucagaaaacuuuguaucgaagcaaaaaucucaaauacaacaacugacagucguuguccaacacaaggagaagcaacuuuaguugaggaacaagacacuaacuuugugugucguagaaccuucguagauaggggaugggguaacggaugcggacuauuugggaaaggcagccuuauuacaugcgcaaaauuuaaauguguuaccaaauuggaaggaaaaaucguucaauacgaaaaucuuaaauacucaguuauaguuaccguccauacuggggaccaacaccaagucggaaaugaaacgauugagcacggaaccacagcuacaauaacaccgcaagcacccacuuccgaaauacaauuaacagauuauggugcacuaacacuagacuguaguccacguacaggauuagauuucaacgaaaugguauuauuaacaaugaaagaaaaaucgugguuagugcacaaacaaugguuuuuagauuugccauuacccuggacaaguggagccagcacuucucaagagacauggaaccgucaagaccucuuaguaacuuucaaaacagcacacgccaagaaacaagaagucguaguucucggcucgcaagaaggagcuaugcacacagcuuuaacaggcgcuacagagauacagacuuccggcacuacgacaauauuugcgggccaucucaaaugcagacuaaaaauggacaaacuuacacuaaagggaguuucguaugugauguguacuggguccuucaaguuagaaaaagaaguagcagaaacacaacacggcacaguccuaguacaaguaaaguacgagggaacagacgcgccuuguaagauccccuuuagcagucaagaugagaggggagugauccaaaaugggcguuuaaucacagcaaauccgauuguuacugacaaagagaaaccaguuaacauagaagcagaaccuccauuuggagaaucauacauaguugucggugcaggagagaaggcucuuaaguuauccugguucaagaaaggaucuucuaucgguaaaauguucgaggccacugcacgaggagcgcgaaggauggccaucuugggugauacggcaugggacuucggaucuaucgguggagucuucacuucaguuggaaaacuuguccaucaaauauuuggaacggcuuacggaguacucuuuagugguguaucauggacgaugaaaauaggcauuggaauacugcucacauggcuugguuuaaacagcagaaauacuagcuugucaaugacauguauugcggucgggaugguaacacucuacuuagggguaaugguacaagcggauuccggcugcguuauaaauuggaaaggucgugaacuaaaaugugggucuggaauuuucgucacaaacgaaguacacacauggacagaacaauauaaauuucaagcagauucgccgaaacgacuuuccgcagcaauagguaaggcaugggaggaagguguaugugggauacguucggccacucgacuugaaaacaucauguggaaacagaucuccaacgagcucaaucauauuuuacuagaaaaugauaugaaguucaccguaguaguuggcgacguuaguggaaucuuggcacagggcaagaaaaugauuaggccacaaccaauggaacacaaauacaguuggaaaucauggggaaaagcuaaaauuauuggcgcagacguccagaauacaacauucaucauugaugggccaaacaccccagaauguccagacaaccaacgugccuggaauauaugggaagucgaagauuauggcuucgguguguucacaacuaauaucuggcucaagcuacgagauaguuauacucaaguuugcgaucauagguuaaugucggcggcuauaaaagauagcaaggccguacaugcugauaugggauauuggaucgaauccgagaaaaacgaaaccuggaaguuagaaagagcaucauuuauagagguuaaaaccugcauauggccgcgaucacauacacuuuggaguaauggcguacuggaaucugagaugauaaucccaaaaacauauggugguccuguuagccaacacaacuauagaccagguuacuuuacucaaacugcgggaccauggcacuuaggaaaacucgaauuggacuuugauuuaugcgaaggaacaacaguuguggucgaugaaaacuguggcaacagagggccaucauugaggacuacaacaguaacagguaaaauuauacacgaaugguguuguaggucauguacacuaccgccuuugagauuuaaaggggaggauggauguugguaugguauggaaauuagaccuguaaaggaaaaagaggaaaaucuaguaaaaucgaugguuagcgcugggucuggagagguagauucuuuuagucuuggacuacuaugcauuagcaucaugauagaagaaguuaugcggagccgguggucuggaaaaauguuaaugacggguacguuggcugucuuucuauuguugacuaugggacaacucacuuggaaugacuuaauaagauuauguauaaugguaggcgcuaacgcgucagauaugauggguaugggcacaacuuaccuagcuuuaauggccacguuuagaaugagaccgauguuugcagucggacugcuauuccggagacucacaucacgggaagugcuguuacuaacuguuggcuugucgcuagcugcaagcguugagcuaccaaauucguuggaggaacugggagacggccuugccauggggauaaugauguuaaaguuacugacggacuuccaaucacaucagcugugggcgacuuuauugucacuuacauuugugaaaaccacauucucucuccauuacgcguggaagacuauggcaaugauuuuaucaauuguuagcuuauucccauuguguuugagcacgaccucacagaaaacaacgugguuaccaguacuuuugggcagcuugggcugcaaaccgcucacuauguuauugauuacagaaaauaaaauauggggcagaagaaguuggccaauaaacgaggggaucauggcaauagguauaguaucuauauuacuaagcucacuccucaaaaaugaugucccucuagcaggaccccucauagccgguggaauguuaaucgcuuguuacguuaucaguggaaguuccgcagacuuaucgcuagaaaaagcugccgaaguguccugggaggaugaagcagaacacuccggagcaagucacaauauuuuaguugaagugcaagaugacgggacgaugaaaauuaaggaugaagagagggacgauacccucaccauacuauuaaaggcaacgcuccuugcuauuucaggcguuuacccaaugucuauaccagcgaccuuauucguaugguauuucuggcagaagaagaaacaacgcuccggagugcugugggauacgccuucacccccugagguugaaagagcuguguuagacgauggcaucuacagaauuuuacaacguggauuacuaggaagaagucagguaggagucggaguauuucaagagggaguauuucauaccauguggcacguaacccgaggagcagucuuaauguaucaagguaaaagauuagaaccuaguugggcaaguguuaagaaagaccuuaucucauauggaggagguuggagauuucaagggucuuggaauacgggggaagaaguacaagugauagcugucgagccugggaaaaauccaaagaaugugcaaacaacaccaggcacauuuaaaacuagcgagggugagguaggggcaauagccuuggacuucaaaccugguacaagugguaguccaauugugaaucgagaagguaaaauagucggacucuacgggaacgggguagugacuacaucaggaacguaugucagcgcaaucgcacaagccaaagcuagccaagaagguccgcuaccagaaauagaagacgaagucuuuagaaagcguaaccuuacaauaauggaccuacacccugguucagggaaaacacggcguuaucuuccugcaauacuaagagaagccaucaagcgaaaguugcggacauuaguacuagcaccgacccgugugguagcaucagaaauggcagaggcacuuaagggaaugcccauccguuaucaaacaacagcagucaaaagugaacauacgggcaaggaaauaguagaucugaugugucacgcgacguuuaccaugagacuguugaguccaguuaggguuccuaauuacaacaugaucaucauggaugaggcacacuucaccgauccggcaaguauugcagcaagagguuacauaaguaccagagucggaaugggggaagcagcagcaauauucaugacugcuacacccccaggcuccguagaagcauucccacaaagcaaugcgguaauucaggaugaagaacgagauaucccggaaagaucauggaacucuggauacgacuggauaaccgacuucccgggaaaaaccguaugguuuguuccaaguaucaaaagugguaacgacauagcuaauugccuaaggaaaaauggcaaaagaguuguacagcuaucucgcaaaacauucgacacugaguaucagaaaacgaaaaacaacgauugggacuacguggugaccaccgauauuagcgaaaugggggccaauuuuagagccgacagggugauagauccuagacgauguuugaagccaguuauucuaaaggacgguccggaaaggguaauccuagcuggaccaaugccuguaaccgucgcaucagcagcacaaagacgaggaaggaucggacguaauucaaacaaggagggcgaucaauauguuuauaugggacaaccacucaauaaugacgaagaucaugcucauuggaccgaagcaaagauguuauuggauaacauaaacaccccagaagggauaauuccagcgcuuuuugaaccagaaagagagaaaagcgcggcuauagacggcgaauacagguugagaggggaagcaagaaagacauuuguagaauuaaugagaagaggggauuugccagugugguuaaguuacaaaguagcgagcgagggauuccaauauucagauagacgaugguguuuugauggggaacguaauaaucaaguauuagaagaaaacauggauguagaaauauggaccaaggagggagaaaggaaaaagcuacguccucgcuggcucgacgcucgcacguauagcgauccccuagcacucagagaguucaaagaauuugcggcugguagacguagcguaucuggcgacuuaauauuagaaauaggaaaacuaccacaacacuuaacccaaaaggcccaaaaugcauuagacaaucuaguuaugcuccauaacagcgaacaggguggaaaagcauacagacaugcgauggaggaacuacccgauacaauugaaacauuaaugcuucucgcgcuaaucgccguguuaacaggagguguaacauuauucuuucuaucaggucgcggauugggaaaaacgucuauagggcuucucuguguuauggccucuagugcauuauuauggauggcuagcguugaaccgcauuggauagccgcuucaauaauauuagaguucuuuuuaaugguauuacucauaccugagcccgacagacaaagaacuccccaagauaaccaacucgcauauguuguaauaggacuuuuguucaugauauuaaccguagcagcgaaugaaaugggucuucuugaaacuaccaagaaagaucuaggaaucggacaugcugccgcagagaaccaccaccacgccgcgaugcuggaugucgaucuucaccccgcaucggcauggacacuauaugccguagcuacaaccaucauaacaccuaugaugaggcauacaauugaaaacacgacagcuaauauuuccuuaaccgcaauagccaaucaagcugccauauuaaugggucucgauaaaggguggcccauaucaaagauggacaucgguguuccgcuacuggcacucggaugcuacagucaagucaauccacuaaccuuaacugccgcuguauugauguuagucgcacauuacgccauuaucggacccggacuacaagcuaaggccacaagagaagcgcaaaagaggacagcggcaggaauaaugaaaaacccuacuguagacggcauaguagcaauugaucuugauccagucguauacgaugcuaaauuugagaaacagcuaggccagauuauguuacugaucuugugcaccucacaaauuuugcuaaugagaacgacaugggcauuaugcgagucaauaacauuagcaacgggaccgcucacgacucugugggagggaagcccaggaaaauucuggaacacgacaauagcagucucaauggcgaauaucuuucgaggcagcuaccuagccggagcuggacuagcauuuaguuuaaugaagucacuaggaggaggaagaagggguacuggagcucagggggagacacucggugaaaaauggaaacgacaacuaaaucaacuuucuaaaagcgaguucaauauauacaaaagguccggaauaauggaaguagaucgaagcgaagccaaagagggacuaaaacgaggugaaacuacaaaacaugcagucaguagggguacugcgaaacugagaugguuuguugaacggaacuuagucaaaccagaaggaaagguuauagaccucggguguggaagaggcggauggucguauuacugugcagggcuaaagaaaguaacggaaguuaagggguacacaaaaggaggacccggccaugaagaaccaguaccgauggcgacauauggcuggaacuuaguaaaauugcacucgggcaaggacguuuucuucacuccuccugaaaagugugauacuuuauuaugcgauauuggagaguccaguccuaauccaacaaucgaagaaggaagaacacuacgcguacuaaagaugguggaaccuuggcuacgaggaaaucaauuuugcauaaaaauccucaauccguauaugccaucagugguugaaacuuuagaacaaaugcaaagaaaacauggcgguaugcugguuagaaauccacuauccagaaacaguacacaugaaauguacuggguuaguuguggcacgggcaacauagucucugcaguaaauaugacaagucgaaugcuauuaaacagauuuacaauggcgcauagaaaacccacuuaugagaaagauguagaccucggagccggaacuagacacguugcaguugaacccgagguggcaaaucuggauauaauaggucagagaauagagaauaucaagaacgaacacaaaaguacuuggcauuaugaugaagacaauccuuauaaaacaugggcguaucacggaaguuaugaagucaaaccaucagggagcgcgaguucaauggucaacggagucguaagacuccucacaaaaccaugggacguaauaccgauggucacucaaaucgcaaugacagacacaaccccuuuuggccaacagcgaguauucaaggagaaaguagauacuaggacaccaaaagcaaaacgcgguacugcacaaauaauggagguuacugcuaaauggcuguggggauuucuaucccgcaauaagaaaccacgcauuuguacacgcgaagaauuuacucgaaagguccgcaguaaugcugcaauaggugcaguauuuguugaugaaaaccaguggaacagugccaaagaagcaguagaggaugaaagguuuugggacuuaguacauagagaaagagaauugcacaaacaagguaaaugugcuacgugcgucuauaacaugaugggaaaacgggaaaagaaacuaggggaauuuggcaaagcgaaaggcucuagggcaauaugguacauguggcuaggggccagguuuuuagaguuugaagcguugggauuuaugaaugaagaucauugguuuucgagagaaaauucccuuucggguguugaaggugaagguuuacauaaacuuggcuauauacuaagagacauuucuaaaauaccugguggaaaucuauaugcagaugacaccgcuggcugggauacccgaaucaccgaggacgauuuacaaaacgaagccaaaaucacugauauaauggaaccagaacaugcguuacuugcuaccucaaucuuuaaauuaacauaucaaaauaaagucguuagggugcaacggccagcgaagaauggaacaguaauggacguaauuuccagaagggaucaaaggggcaguggucaggucgggacauaugguuugaauacauucacaaauauggaagcccaacuaauuagacagauggagagugaggguauauuuaguccauccgaacuagaaacuccgaacuuggcaaagcgagucuuagacuggcuugagaaacacgguauugaacgacuaaagcgcauggcuaucaguggagaugacuguguaguuaaaccgaucgaugaucgcuuugccacagcguugacggcacuaaaugauaugggcaaaguacguaaagacauaccacaaugggaacccuccaaagguuggaacgauuggcaacaaguaccguuuuguagccaccacuuucaucaguuaauuaugaaagauggacgagaaaucguagucccaugcaggaaucaagaugagcuuauugguagagcucgugucagccagggagccgguuggucguugagggaaacugcuugucuaggaaaaaguuaugcacaaauguggcagcucauguacuuucaccgaagagaucuucguuuggcagcaaacgcaaucugcucagcaguccccgucgauuggguccccacgagcaggaccacauggagcauucaugcgcaccaucaauggaugacgaccgaagauauguuaucgguauggaaccgcgucuggauugaggaaaacccguggauggaggauaaaacucauguaucaucaugggaagauguuccguaccucgguaaaagagaagaucaauggugugggagcuuaauaggccucacagcccgggcgacaugggccaguaacauccagguugcaauuaaucaaguuaggcggcucauaggaaacgagaauuaucuagacuacaugacaaguaugaaacguuucaaaaaugaaucugaucccgaaggagcgcugugguag

SEQ ID NO: 22056 - RNA, 9879 nt, Artificial Sequence
  derived and/or modified CDS sequence (opt6) from DENV-1__KC762631__SS-prME
ucaguuaccauguugcugauguugaugccgacugccuuagcuuuucauuugacuacuaggggaggggagccacauaugacaguguccaaacaagaaagagguaaaagccuuuuauucaaaacaagcgcaggagucaauaugugcacacugaucgcaauggaccuuggcgaauuaugcgaagauacguuaacauauaaaugcccacgaauaacugaagcggaaccagaugauguugauugcugguguaaugccaccgauaccuggguaacauaugguacuugcagucaaacuggugaacauaggagagacaaaagaucaguugcucuagcaccccacguuggacuaggauuggaaacgagaacagaaacauggaugucaagcgaaggggcuuggaaacaaauucagaggguugaaacgugggcauuacgucacccaggcuuuacgguaauagcacuauuucuugcgcaugccauagguacuucaauuacacaaaaaggaauaauauuuauuuuacuuaugcuuguuacaccaucaauggcaaugcgcugcguaggaauuggcagucgagauuucguagaaggauuaaguggggcgacauggguugaugucguauuggaacauggaaguugcguaacaacaauggccaaagauaaaccaacauuggauauagagcuacuaaaaacagaagugaccaauccagcaguuuuaagaaaacuguguauagaagcaaagauuucuaacacaaccacagauagucguugccccacucaaggggaggcaacccuugucgaagaacaagaugcaaacuucgugugccgccgaaccuucguugauagaggauggggcaacggauguggcuuauuuggaaaagguagucucauaaccugcgcuaaauuuaaguguguaacaaaacuagaaggcaagaucguucaauacgaaaaccuaaaauauucuguuaucguaacaguacauaccggagaucagcaccaagucggaaacgagucgacagaacacgguacgaccgcaaccaucacaccgcaagcacccaccacugaaauacaacuaacagauuauggagcacuuacuuuagacugcagcccccgcacuggacuagauuuuaaugaaauggucuuguuaaccaugaaagaaaaauccuggcuaguccacaaacagugguuuuuagaccuaccucuaccauggacuuccggcgcgagcacaucacaggaaacauggaaucgccaggaucuacuuguuacauuuaaaacggcacacgcgaagaaacaagaagucguugucuuagggucucaagagggugccaugcacacagcauuaacuggagccaccgaaauacagaccuccggaacuacaacaaucuuugccggacauuuaaaaugcaggcuaaaaauggauaagcuaacacuaaagggaaugagcuacguaauguguacaggauccuuuaaacuugaaaaggaaguugcugaaacgcaacauggaacaguucuaguacagaucaaguacgagggcacagaugcaccauguaaaaucccuuucucuacacaagaugaaaagggaguaacgcagaacggaagauuaauaacggcaaauccaauaguuacugauaaggagaaacccguuaauauagaagcagaaccaccauucggugaguccuauaucguaauuggugccggagaaaaggcacugaaguuauccugguuuaagaaagggaguucuauaggcaaaauguuugaagcuacagcucgcggagcaagaagaauggcaauccugggagacacugcaugggacuuugggucgauuggaggcguguucaccaguguaggcaaacugguacaucaaauuuuuggcaccgcguauggugucuuauucucgggcguaucauggacaaugaaaaucggaaucggaguuuuacugacaugguuaggucuaaauuccagaaguaccucauuaaguaugacaugcauugccgugggguuaguuacguuauaccugggaguaaugguucaagcggauagcggauguguuauaaacuggaaaggacgugagcuuaaauguggaucagguauauuuguaacaaaugaaguucauacauggacugaacaauauaaauuucaggcagauucgccgaaacgacuuucagcugcgauuggaaaagcaugggaagaagguguguguggaauacgaagugcaacuagauuagaaaacauuauguggaagcagauaucuaaugagcuaaaucacauauuauuagaaaaugacaugaaauuuacgguugucguaggagaugucgcgggaauuuuagcacaaggcaagaaaaugauacgcccucaaccaauggagcacaaauacucuuggaaaucauggggcaaagcuaaaauaauaggagcggacguucaaaauacaacuuuuaucauagauggacccaauaccccagaaugcccugaugaccaacgggcuuggaauauaugggaaguagaagacuaugguuuugguauauuuacaacaaacauauggcuuaaacuuagagauucauacacucaagugugugaucauagacucaugagugcagcuauaaaagacaguaaagcaguacaugcagauauggguuauuggauagaauccgagaaaaacgaaacauggaagcuagcacgagcgucauuuauugaaguaaaaacgugcaucuggccgaaaagucauacguuauggaguaacggaguacuugaaagcgagaugauaauacccaagauuuacggugguccuauaucacaacauaauuacagaccuggauauuuuacacaaacagcagggcccuggcauuuagguaaacuugaguuagauuuugaucucugcgaaggcacaacugugguaguugaugaacacugcgguaauagaggaccuagccuucguacaacuacuguaacuggaaaaaucauacaugagugguguugcagaucaugcacacuuccaccccuacgauucaggggagaagacggauguugguacgguauggaaauaagaccugucaaagaaaaagaagaaaaucuaguaaaaucaauggucucagcuggaaguggugaaguagacaguuuuucguuaggucuucuuuguauaaguaucaugauugaggagguaaugcggagccgcuggagcagaaaaaugcuuaugacggguacauuagccguuuucuuucugcuuaucaugggacaauugacguggaacgaccugauaagacuguguauaauggugggcgcgaacgcaagugaucguaugggaaugggaacuacguacuuagcacuaauggcuacuuuuaaaaugcgucccauguucgcuguaggacuccucuuuagacgacuaacaucacgagaaguauugcuucuuacaauuggccuaucuuuaguagccaguguagagcuaccaaacucgcuugaagaauuaggagauggguuggcaauggggauaaugauccuuaaauuguugacugacuuucaaucccaucaacugugggccacucucuuaucccuaacguuuaucaaaacaacuuuuagcuuacauuacgcauggaaaaccauggcuaugguucucaguauagucagccuauucccacugugucuuaguacuacgagucagaaaaccacauggcuaccugucuugcuugggucgcucggaugcaagccucuuacaauguucuugauagcagagaacaaaauuugggggagaaaaagcuggccgcugaacgaaggaauaauggcaguugguauuguuucaauucuucucaguagcuuacucaaaaacgauguuccgcuagcuggaccguuaauagcuggagguaugcuaaucgcauguuacgucaucuccgguucgucugcggaucucucauuagaaaaagcugcugaagugucuugggaagaagaagcagagcauucaggcgcgagucauaacauacugguggagguacaagaugacggcacuaugaagaucaaggacgaagaacgagaugauacuuuaaccauuuuacugaaagcgacgcuucuugcugucucggguguauauccacuuucaauaccggcgacacuuuucgugugguauuucuggcagaagaagaaacaaagaagcggaguacugugggacacaccaucgccuccagaaguugagagggcgguacuagaugaugguauauaucggaucaugcaacgcgguuuguugggacgcucacaaguuggaguuggaguauuucaagaaaacuuauuucacacaauguggcacgugacgaggggagcggucuuaauguaucaaggaaaaagauuggagccgucaugggcaucggugaagaaggacuuaaucaguuaugguggagguuggagacuccaaggaucuuggaacacgggcgaagagguacaaguaauagccguagaaccgggcaaaaauccgaagaaugugcaaacggcccccgguacauuuaaaacgccugaaggagagguaggagcuauugcguuggacuuuaaaccaggaacaucuggaucaccaauagucaaucgcgagggaaagaucguuggcuuauauggaaauggaguugugacaacuucgggaacauauguaagugccauugcucaagcaaaggcuucacaagaagggccacugccagaaauagaagaugaaguguuuagaaaaaggaauuuaacaaucauggaccuccauccaggaagugggaaaacuaggagauauuugccggcuauaguucgagaagccauaaaaagaaaauuaagaaccuugauauuagccccuaccagaguaguagcgagugaaauggcugaggcacuaaaaggaaugccgauuagguaucaaacuacugccguaaagucagaacauacaggaaaagagauaguggacuuaaugugucacgcuacguucaccaugagauuacucucgccuguacgaguuccuaauuacaauaugauaauaauggaugaagcacauuuuacagauccaucuucaauagcagcacgcgguuauauuaguaccaggguagggaugggagaggccgcagcuaucuuuaugacagccaccccucccggcuccguagaagcguucccacagucgaacgcaguaauucaagacgaagaaagagauauccccgaacgaagcuggaaucuaggauacgaauggauuacagacuuuccaggcaaaacagugugguuuguuccuagcauuaaaagcggaaaugauauugcuaacugucuucggaaaaacggaaaacgaguuauacaacuaagcaggaaaacuuuugauacggaauaucagaaaacuaaaaauaaugauugggauuacgugguuacgacugacauaucagaaaugggcgcuaacuuucgagcagaucgagucauagauccacgucgaugucucaaaccaguuauccucaaggauggcccugaaaggguaaucuuggcaggcccuaugcccguuacuguggcuagcgcggcacaaaggaggggucgaguaggucguaaucauaauaaggagggagaccaguacauauauaugggacaaccacuaaacaaugacgaagaucacgcucacuggacugaagccaaaauguuacucgacaauaucaacacuccagaaggaaucauuccggcacuauucgaaccagaacgagagaaaagcgcagccauagacggcgaauaucgacuuagaggugaagcacgaaaaacuuucgucgaauuaaugcgucgaggggaucuaccgguauggcuuuccuauaaagucgcuucugaagguuuccaguacucagauagaagauggugcuuugauggugaaagaaauaaccagguccuagaggagaacauggacguagagauuuggacgaaggaaggagaaaggaagaaguuacggccgcgauggcuagacgcuagaacuuauucagauccucuagcacuucgagaauuuaaagaauuugcagcuggaagaagaagcguaucaggggaccuuaucuuagaaaucggcaagcuaccucaacacuugacacaacgggcacaaaacgcgcuggauaaccuagugaugcuucauaacagugaacaaggaggacgugccuauagacacgcgauggaagaauuaccugaaacaauugaaacccucaugcuacuagcauugauagcgguacuuacuggugguguaacgcuguucuuucuaucagggaggggauugggcaaaacaaguaucggcuugcuaugcguaauggcaucaucgguacuuuuauggauggcaaguguagagccacauuggaucgcugcuuccauuauucucgaauuuuucuugauggucuuacuuaucccggaaccggacagacaaagaacaccgcaagauaaucaacuagcauacguaguuauugguuuacucuucaugauuuuaacuguagcagcaaaugaaauggguuuacuagagacaacuaagaaagaccuggguauugggcacguugcgguagaaaaccaucaucaugcagcaaugcuugauguggauuuacauccggcuucggcuuggaccuuauacgcgguagccacaaccauuaucacaccuaugaugcgacauacaauagaaaauacaacggcuaauaucagucucacagcaaucgcaaaucaagcagcaauucuuaugggguuagauaaagguuggccaauuucuaagauggauauaggaguuccguuguuagccuuagguuguuacagucaaguaaauccccuuacuuugacagcagcugugcucauguugguugcccauuacgcgauaauugguccaggacuacaagccaaagcaacuagagaagcacagaagaggaccgcagcaggaauaaugaaaaauccuacgguggacgggaucguugcuaucgauuuggauccggucguauaugaugcuaaauucgagaaacaauugggacaaaucauguuacuaauacuauguacaucccaaauacuccuaaugcggacgacaugggcuuuaugugaaagcauaacucuagcaacuggaccucuaacaacauuaugggaaggaagcccagggaaauuuuggaauacuaccauugcugugaguauggcaaauauauucagaggaaguuacuuagcaggcgccggacuagcauucucguuaaugaaaucucuaggagggggacgaagagguacgggagcccaaggagaaacccugggagagaaguggaaacggcaacugaaucaguugucaaaaagugaguucaacacauacaaaagaaguggcaucauggaaguugaucgcucugaagcaaaagaaggacuuaaaagaggagaaacaacaaagcacgccguaucgcguggaacagcuaagcugcgaugguuuguggaacgcaauuuaguaaagccagaagguaaagugauagaccuaggauguggacgaggagguuggagcuauuacugcgccggauugaagaaaguaacggaaguuaaaggauacacaaaaggaggaccuggacaugaagaaccaaucccaauggcuacauacggauggaaccucgugaaacuucacuccggaaaggauguauuuuucauaccuccagagaagugugacacacuccugugugauauaggugagucuuccccaaacccuacaauugaagaaggaagaacccuuaggguguugaaaaugguagaacccugguugaggggcaaucaauucuguauaaaaaucuugaaucccuauaugcccaguguaguagagaccuuggaacaaaugcaaagaaaacaugggggaauguuaguccgcaauccccuuucacgcaacucaacacaugagauguacugggugaguugugguacgggaaacaucguaucagcagugaauaugacauccagaaugcuguuaaauagauuuacaauggcacaucggaaaccuacuuaugagcgugacguugaucuuggggccgguacacgccauguggcagucgaaccagagguugccaaccuagauauaauaggacaacgcauagaaaacaucaagcacgaacacaaaaguacuuggcacuacgacgaagauaacccuuacaaaacgugggcguaccaugguuccuaugaagugaaaccgagcggaagugcgucaucgaugguaaacggcguaguuaaauuauuaacuaagccaugggauguuauuccaaugguaacucaaauagcaaugacagacacaacgccauuuggccagcaaaggguauucaaagaaaaaguagacacucguacuccaaaggccaaaagaggaacaacucaaauaauggagguaacggcaagaugguuauggggguucuuauccaggaauaagaaaccgcgcauaugcacgcgagaagaauuuacgcgaaagguaagaucaaaugcagcuauaggugccguauucguagaugaaaaccaauggaauagcgccaaggaagcaguugaagacgagcgauuuugggaguuagugcaccgggaaagagaacugcauaagcaaggcaaaugcgcgacaugcgucuacaauaugaugggaaaacgugagaagaaacucggcgaauuugguaaagcuaaaggaagucgagcaauaugguacauguggcuuggggcucgcuuccuggaauuugaagcucuuggguucaugaaugaagaucacugguuuagucgagaaaacucacuaagcgguguagaaggagaaggacuucacaaacucggauacauauuaagggacauuucuaaaauaccagggggaaauauguacgcagacgacacggcaggaugggacacccguaucaccgaagaugacuugcagaaugaagcaaaaaucacagauauaauggaaccagaacaugccuuauuagccaaagcaauauuuaaacugacuuaucaaaauaaaguaguuagaguucaacgcccagcuaaaaacggaacggucauggacguaauuucuagaagggaccaaagaggaaguggccaggucgguacauauggauugaauacguucacuaacauggaagcacaacuaauuagacaaauggaauccgaagguauauuuucuccaagugagcucgagaccccuaaucuggcagagcggguucuugacuggcucgaaaaauacgguguugaaagauugaaaagaauggcaauaaguggggaugauuguguaguaaaaccgauagaugauagguuugcaacagcgcuuaccgcuuugaaugacauggguaagguuagaaaagauauaccucagugggaaccaaguaagggauggaaugauuggcagcaaguuccauucuguagccaucacuuucaucaauuaaucaugaaagauggaagagaaauuguggugccaugucggaaccaagaugaacuuguagggcgcgcacgugucagucaaggggcggguuggucccuaagagaaacagccugccuagguaagucauaugcacaaauguggcaacuaauguauuuccauagacgcgauuuacggcuagcugcaaacgcaauauguucagcuguaccuguugacuggguaccaacuucucgaacaaccuggaguauacaugcacaucaucaguggaugacuacggaagacaugcuuucaguauggaaucgcguauggauugaagaaaaucccuggauggaggacaaaacacauauuaguucuugggaagauguaccauacuuggguaaaagggaagaucagugguguggcagcuugaucggguuaacagcgagggcaacaugggcgacuaacauacagguggcgauaaaucaagugcguagacuuauuggaaaugagaauuaucuagacuauaugacuuccaugaaaagauucaaaaaugaaucagaccccgaaggugcauuaugguag

SEQ ID NO: 22057 - RNA, 9879 nt, Artificial Sequence
  derived and/or modified CDS sequence (opt6) from DENV-1__KC762621__SS-prME
aguguuacaauguugcuaaugcuaaugccgacggcucuagcauuccacuuaaccacgaggggaggagaaccacauaugauuguuucgaaacaggaacgaggaaaaucccuacuguucaaaacaucggcugguguaaauauguguacauuaauagcuauggauuuaggggaauuaugugaagauacacuaacauauaaaugcccacguaucacagaggcagagccagaugacguagacuguuggugcaacgcaacggacacauggguaacauacgguacuuguucucagaccggggagcauaggagggacaaaaggucaguagcuuuagcaccacauguaggacuaggauuagagacaagaaccgagacauggaugucaagcgaaggagcguggaaacaaauacaacguguagaaaccugggcauugagacacccaggauucacagucauagcgcuauuucuggcucacgcuauaggaacuagcaucacccaaaaaggaauaauauuuauauuguuaaugcuaguuacuccauccauggcaaugcguuguguggggauagggagucgugauuucguagaaggucucuccggggcaacguggguagacguugugcuagagcaugggaguuguguaacuaccauggcuaaagauaaacccacuuuagacauagaguuacuuaaaacugaaguaacuaacccugcuguuuuaagaaaauuaugcauugaggcaaaaauuucaaauacgacaacugacagucguuguccgacacaaggcgaagcaacacuugucgaagaacaagaugcaaacuucguauguagaaggaccuuuguggauagagggugggguaacggauguggccuauucggaaaagguagucuaaucacuugcgccaaauuuaaaugugucaccaaauuggaggggaaaauaguacaauaugagaauuuaaaauacaguguaauuguaacaguacauacaggcgaccagcaucaaguuggcaacgaaagcacagaacauggaacaacggcgacaauuacaccacaagcuccaacuacugaaauccaauuaacugauuacggugcguuaacucuggacugcagcccaagaaccggucuggauuucaacgaaaugguuuuauuaacaaugaaagaaaaaucauggcuaguucauaaacaaugguuuuuagaucucccucuuccuuggacuucaggagccucgaccucccaggaaacuuggaauagacaagacuuauuaguuacauuuaagacagcccacgccaagaaacaggaaguuguaguacuugguagucaagaaggagcaaugcacacagcgcuuaccggugcgacugaaauccagacaagugguacaacgacuauuuuugcaggacaccuaaagugcagauuaaaaauggauaaacucacucuaaagggaaugucuuaugugauguguaccggaaguuuuaaacuagagaaggagguugcugaaacccaacaugggacgguucuaguucaaauaaaauacgaagguacagaugcacccuguaaaauacccuuuagcacacaagaugaaaaaggugucacucaaaacggucguuugauuacagcaaauccuauugugacagauaaggaaaaaccugucaacauagaggcggaaccaccauucggggaaagcuauaucgucauaggcgcaggagaaaaggcucuuaaauuaucaugguuuaaaaaggggucuuccaucgguaaaauguucgaagccacagcucguggagcaagaagaauggcgauauuaggugauacagcaugggacuuuggcucaauuggaggcguauucaccucagugggcaagcuaguacaccaaauauuuggaacugcuuauggcgugcuguuuucaggaguaaguuggacaaugaagauaggaaucggaguucuuuuaaccuggcuuggcuuaaauuccagauccacuagcuugaguaugacuuguauagcaguagguuugguuacuuuauaucuuggcgugaugguacaagcugauucagguugcgugauaaacuggaaaggaagagaauugaaaugcggcucagguauuuuuguuacaaaugagguucauaccuggaccgaacaauacaaauuccaagcagauagccccaaacgauuaucagcagccauagguaaagcgugggaggaaggcgucugcggcauuagaagugccacaagacuagagaauauuauguggaagcaaaucaguaaugaacugaaucacaucuugcuagaaaaugacaugaaauuuaccguuguaguuggagacguugcaggcauucuagcacaagguaagaaaaugauaagaccacaaccuauggaacauaaauauucuuggaaauccuggggaaaggcuaaaauaauaggagcagacguacaaaauacaacuuuuauaauagacggaccaaacacuccggaguguccugaugaucaacgcgcauggaacauaugggaaguagaggacuaugguuucgguauuuucacaacgaauaucuggcuaaaguuacgagacucguauacucaaguaugugaccacagacuaaugagcgcugcuauaaaagauucaaaagcuguccaugcagacaugggauacuggauugagagugaaaagaacgaaacguggaaauuggcacgggccagcuucauugaaguaaaaaccugcaucuggccgaaaucccauacauuaugguccaaugguguacuagagucagagaugauaauucccaaaauauacggugggccaacuucucagcacaauuaucggccagguuauuuuacccaaacagcaggucccuggcauuuaggaaaauuagaauuagacuuugacuuaugugaaggcacgacaguaguaguugaugaacacugugggaauaggggcccgagccugcgaacaacuacaguuaccgguaaaauuauucaugagugguguugcagaagcuguacccuaccaccucuuagguuuagaggcgaagauggcuguugguauggaauggaaauacgaccaguaaaagaaaaggaggaaaaucuagugaaaaguauggugucagcugguucuggagaaguggauucguuuucacuaggacugcuauguaucaguaucaugauugaggagguuaugaggaguagauggagucgaaaaauguugaugaccgguacacucgcaguauucuuuuuauuaauaaugggccaauuaacguggaacgaucuuaucagacuauguauaaugguaggagccaacgccagcgacagaaugggaaugggcacaacuuacuuagcuuuaauggcaacauuuaagaugcgccccauguuugcuguaggccugcuauuuaggcgcuugacuagccgagaaguucuuuugcuaacaauaggccucagcuuaguugcgucaguugaacuaccgaacucacuagaagaauuaggggacggauuagcuaugggaauaaugauccugaaauuguuaacagacuuccagucacaucaacuuugggcuacucuucuuagcuuaacauuuauuaaaacuaccuuuucguuacacuaugcguggaaaacaauggcaaugguacugagcauagucagucuuuuuccgcuuugucugaguaccacaagucagaaaacaaccuggcuaccaguacucuuaggaucacuaggguguaaaccgcuuacaauguuccuuauugcugaaaauaaaauuuggggucguaaaucauggccucuuaaugaagguauaauggcuguagguaucgugaguauacuuuugucuucccuacucaaaaaugacguuccgcuagcugggccucuaauugcggguggaauguugaucgcguguuaugugauaagugggagcuccgcagacuuaucauuagaaaaagcagcggagguuagcugggaagaagaggcagaacauuccggagccucgcacaauaucuuaguagaaguucaagaugacgguaccaugaaaauuaaagaugaagaaagggacgauacauuaacgauucuauuaaaagcuacccugcuagcuguaaguggagucuauccucuuaguauaccagccacucuguuuguuugguauuuuuggcagaagaagaagcagagaucuggagucuugugggacacacccucaccaccagaagucgagagagccgugcuagacgacgguauuuauaggauaaugcagagagguuuacuaggacgcucacaaguaggugugggggucuuccaagaaaaugucuuccauacaauguggcaugugacgaggggugcgguauuaauguaucagggcaaaagacucgaaccuuccugggccagugucaagaaggauuuaauuagcuacgguggaggguggcgccugcaaggcaguuggaauaccggagaggagguccaagugaucgccguagaaccugguaaaaauccuaagaacguucaaacagccccuggaacauucaaaacaccggaaggugaaguaggcgcaauagcguuagauuuuaaaccuggcaccucggggucaccuauugugaacagggagggaaagauaguugggcuauaugguaauggaguagucacaacaaguggaaccuauguaucugcgauugcacaagcaaaagcaucacaggaaggucccuuaccggaaauugaagaugaaguuuuuagaaaacggaaucucaccaucauggaccuucaccccggcucagggaaaacccgaagauacuugccagccauaguacgagaagcuauuaagagaaaacugaggacgcugaucuuagccccuacgagaguugucgccucagaaauggcagaagcacuuaaaggaaugccaauacgauaucaaacaacugcuguaaaaagugaacauacuggaaaagaaauuguagaucuuaugugucaugcaaccuuuaccaugcgucuauuaagcccugucagagucccuaacuacaacaugauuauaauggaugaagcccacuuuacggacccaagcagcauugccgcuagaggauacauaucuaccagggucgguaugggugaggcugcagcaaucuuuaugacagcgacuccacccggauccguagaagcauucccccaaaguaaugccguaauccaagaugaagaacgagacauaccagagcgguccuggaacucagguuacgaauggauaacugauuuucccgggaaaacuguaugguucgugccuaguauaaaaucaggaaaugacauagcuaauugcuuacgaaagaauggaaaaagaguuauccaacuuucgagaaagaccuucgauaccgaauaucagaaaacuaaaaauaaugauugggauuacguaguaacgacagacauaagugaaaugggggccaacuuccgugcugaccgagucauugauccacgucggugccuaaaaccaguaaucuuaaaagauggaccugaaaggguaauacucgcaggaccaaugccaguaacugucgcgagcgcagcccaacggcgaggaagaguuggaagaaaccauaacaaagagggcgaucaauauauuuauaugggucaaccucugaauaaugaugaagaccaugcccauuggacugaagcaaagaugcucuuagauaacauaaacacucccgaagguaucauucccgcacuguuugaaccagaacgagaaaaaucggcagcuaucgauggugaauaccgacuccgcggagaagcaagaaaaacuuuugucgaacuaaugagaagaggagaccuaccuguuuggcuaucuuacaaaguugcuucugaaggguuccaauauucugaccggagauggugcuucgacggagagcguaauaaccaggugcuagaagaaaauauggauguggaaauauggacaaaggaaggagagcgaaagaaauugagaccuagauggcuugaugcgagaaccuauuccgacccccuagcucugcgagaauuuaaagaauuugccgccggcagaagaucgguuaguggggaucuuauuuuagaaauugggaaauuaccccagcacuuaacgcaaagagcucaaaaugcgcucgauaaccucguaauguuacacaauucggaacaaggagguagggcauaccgccacgccauggaagaacucccggacacuauagaaacucuaaugcuacucgcccuuauagcuguauuaaccgggggcgugacccuauucuuucuuagcgguaggggacuaggaaaaacuucgauagggcuucuuuguguaauggcgucgucaguucucuuauggauggccucaguagagccacauuggauagcagccucaaucauucuagaguucuucuugaugguacuuuuaauuccugaaccggauagacaaagaacuccacaagacaaccaguuagcauacguaguaauuggacuccuguuuaugauauuaaccguagcagccaacgaaaugggucuguuagaaacuacuaagaaagaucugggaauagguuauguagcgguagagaaccaccaccacgcggcaaugcuugaugucgaucugcauccagccagugccuggacauuauaugcaguggccacaacaauuauuacaccuaugaugaggcauacaaucgaaaauacaacagcaaauauuagcuuaaccgcuauugcuaaucaagcggcaauacuaaugggacucgauaaaggguggccaauaucaaaaauggacauugguguaccauuauuagcacuaggauguuauagucaaguaaacccauuaacauuaacagccgcgguucucaugcucguugcacauuaugcuauuauagguccaggucuacaagcgaaggcaacuagagaggcacaaaaacgaacugcagcuggcaucaugaagaauccgacuguugacggcauuguggcgauugacuuagacccugucguguaugaugccaaauuugagaaacaauuggggcagauaauguuacuuauucuauguacuucacagauauuauugaugcggaccacaugggcgcuaugugaaaguauuacacuagcaacagggccucuaaccacguugugggagggaaguccgggaaaguuuuggaauacaacuauagcaguaucuauggcaaacaucuucagaggaucauaccuagcaggggcuggauuagcauucucguuaaugaaaucgcuagguggggguagacgaggcacaggugcacagggagaaacccuuggagaaaaauggaaacgacagcuaaaucaguuauccaaaucggaauuuaacacauauaaaagaucagggauuauggagguagauagauccgaggcaaaggagggacuaaagagaggcgaaacaacgaagcaugcuguaucccgggggacugcgaagcuaagaugguuuguugaaaggaaccuaguaaaaccugaagguaagguuaucgauuuaggaugugggaggggcggauggucguacuauugcgcgggccugaagaagguaacagaggucaaaggauacacaaaagggggucccggacacgaagaaccaauaccuauggccacguacggguggaaccuugugaaacuacacucugggaaggauguuuucuuuauacccccagaaaaaugcgauacgcuuuuaugugacauaggagaaucgucaccuaaccccacuaucgaagaggguagaacucugaggguacugaaaaugguugaaccguggcugaggggaaaucaauuuuguauaaaaaucuugaaucccuauaugccuagcgugguugagacucuagaacaaaugcagcgaaaacauggcgguauguugguuagaaauccccuauccagaaacuccacgcaugagauguacuggguaaguugcggcacuggcaacauagucucugcagucaauaugaccucucgaaugcuucuaaauagguuuacuauggcgcauaggaagcccacauaugaacgagaugucgaccuuggugcgggcacaagacauguagcaguugaacccgaaguagcuaaucucgauauuaucggucaacguaucgaaaauauuaaacaugaacauaaauccacauggcauuacgaugaagacaacccauauaaaaccugggccuaccauggcucguaugaaguaaagccauccggaucggccagcagcauggucaacggaguagucaaguuauuaacgaaaccaugggacguaauacccaugguuacacaaaucgcuaugaccgacaccaccccuuuuggacagcaaaggguauuuaaagaaaaaguggacacacgcaccccuaaagcuaagagagguaccacccagauuauggagguaacugcgagguggcuauggggauuuuuaucaaggaacaagaaaccaaggauaugcacgagagaggaguuuaccaggaaagucagaucaaaugcugcuauuggugcggucuucguagacgaaaaccaguggaacagcgcaaaagaagccguagaagaugaaagauucugggaucugguacaccgcgaaagggaauugcacaagcaaggcaaaugcgcaacauguguuuauaauaugaugggcaagcgugagaagaaacuaggggaguucggaaaagccaaagggagcagggcaauaugguauauguggcuuggagccagauuucuugaguuugaagcgcuaggguuuaugaacgaagaucacugguuuucccgggagaacucuuugagcggugucgaaggagaaggacuucauaaacuuggauauauccugagagauauaucgaaaauaccagggggaaauauguaugccgaugauacggcuggcugggacacuagaauaacagaagaugaucuacaaaaugaggcgaaaauaacagauauaauggaaccggaacacgcauuacucgcgaaagcaaucuuuaaacuaacauaucaaaauaagguuguccgaguucagagaccagccaaaaacggaacuguaauggacguaauaagcagaagagaucagagaggaucagggcaaguaggaaccuauggccuaaauacguucaccaacauggaagcucaauuaauacggcagauggaaucagaaggcauauuuucaccaucggaacuggagacacccaaucucgcugaaagaguccuagacuggcuagaaaaauauggaguagaacgucugaaaagaauggccauaaguggagacgauuguguagucaagccuauagaugauagauucgcuacggcuuuaacugccuugaaugauauggguaaaguucgcaaggacauaccucaaugggaaccaucuaagggguggaacgacuggcaacaagugccguucugcucucaccacuuucaucaacucauuaugaaagauggaagggaaaucguagugcccugucgcaaucaggacgaacuuguagguagagcuagggugucacaaggggcugguuggucacucagagaaacggcaugccucggaaaaucuuaugcgcaaauguggcaauuaauguauuuccauaggcgagaccuucguuuagcugccaaugcaauauguagcgcaguuccaguagacuggguuccuacaucacgcaccacauggagcauacacgcucaccaucaauggaugaccacagaagauaugcuauccgucuggaauagaguauggauagaagagaaucccuggauggaggacaaaacucacguuucaucaugggaggaugucccuuaucuuggaaaaagagaagaucaauggugugguucuuuaaucggcuuaacagcacgagcaacuugggccaccaauauacaaguggcgauaaaucaagucaggaggcucauaggaaacgaaaauuacuuagacuacaugacgagcaugaaaagauuuaaaaaugaaucugauccggaaggagcacuuugguaa

SEQ ID NO: 22058 - RNA, 9879 nt, Artificial Sequence
  derived and/or modified CDS sequence (opt6) from DENV-1__KC762643__SS-prME
uccguaacaauguuauuaaugcuaaugcccacagcauuagcauuucaccugaccacucgaggaggagaaccacacaugauaguaucaaaacaagagcgaggaaaaucauuauuguuuaaaacaagcgcugguguaaauaugugcacauuaauugcaauggacuuaggugaauuaugugaagacacacuaacauauaaaugcccccgaauaacggaagcagaaccagaugauguagacugcugguguaaugcuacugacaccuggguaacguauggaacaugcucucagacaggcgagcauagaagggauaaaaggaguguugcauuggcaccucacgucggauuaggacucgaaacucguacugaaacuuggaugucaagugaaggugcauggaaacagauccagcggguugagaccugggcuuuaagacaccccggauucacagugauggcacucuuucuagcccaugcaauaggaaccaguauaacacaaaaaggcaucauauucauauugcuuaugcugguaacaccuaguauggcgaugcgcugugucgggauaggaagucgagauuuugucgaagguuuaucuggggcuacuugggucgacgucguuuuagaacacggcucgugcguaacaacgauggcaaaagauaaaccuacauuagacauugagcuacuuaaaaccgagguuacaaacccugcagugcucagaaaacuuuguauagaagcuaaaauaucaaacacaacaacugauuccaggugucccacacagggcgaagccaccuugguggaggaacaggaugcuaacuuugucuguagaagaacauucgucgacagaggauggggaaauggaugcggauuauuugggaaaggaucucuuauuacaugcgcaaaauucaaauguguaacgaagcuagaggguaaaaucguucaguaugaaaaucugaaauauagcguaauaguaacuguacauacuggggaccaacaccaaguaggcaacgaauccacagagcacggaacaacggcuacaaucacuccccaagcgccaacaacagaaauucaauugacugacuacggggcucugacgcucgauuguaguccacgaaccggacuugacuuuaacgagaugguucuacucacuaugaaagaaaagagcuggcuaguacauaaacaaugguuuuuagauuuaccucuuccauggacuucgggagccucaacaucacaagaaacauggaauagacaagacuuacuggucacguuuaaaacagcccaugcaaagaaacaagaaguagucgugcuagggagucaagaaggagcaaugcauaccgccuugaccggagcgacagagauacaaaccucggguacaacaacgauauuugcaggacaccuuaaguguagguuaaaaauggacaaacuaacuuuaaaagggaugucauauguaauguguacagguucauucaaguuagaaaaggaaguagcagaaacucaacacgguacaguccuaguacaaauaaaguaugagggaacagaugcaccaugcaaaauaccauuuucaacucaagaugagaaaggcguuacacagaauggucgucuaauaacagcaaaucccauaguaacagacaaggagaaaccgguuaacaucgaggcggaaccgccauuuggagagagcuauauaguuauaggagccggugaaaaggcauuaaaauugucaugguuuaagaaaggguccaguauagggaagauguuugaagcaacagcacguggagccaggagaauggcuauucuaggcgacaccgcaugggacuucggaagcauaggcggaguauuaacaaguguaggcaaguuagugcaccaaaucuuugguacagcauauggaguauuguucagugggguuucuuggacaaugaagaucggcauaggaguucuccuaaccugguugggacuuaacaguagaucgacuagccucagcaugacuugcauagccguaggccuaguuacacuguauuuagggguaauggugcaagccgacucggguuguguaaucaauuggaaagggagagaacucaaaugcggaucagguaucuucgugacuaaugaaguccauacguggaccgaacaauacaaauuccaagcagauucaccgaaacgauuauccgcggcaauaggcaaggcaugggaagaaggcguaugugguauaagaucagcuacacgacuugaaaauauaauguggaagcagauaaguaaugaguugaaccauauacuauuagaaaacgauaugaaauucacagugguaguaggagacguggcaggaauauuagcccaagguaagaaaaugauacggccacaaccuauggagcauaaauauagcuggaagucauggggcaaagcuaaaauuauaggagccgauguacaaaacacgacguuuauuauagauggaccaaacacaccugaauguccagaugaccaaagagccuggaauaucugggaagucgaggacuauggauucgguauauuuacaacgaacauaugguugaaacugagggacucuuacacgcaagugugugaucaccgacuuaugagcgcagcaaucaaagacucaaaggcuguucaugccgacaugggauacuggauugaaagcgagaaaaaugaaacuuggaaauuagcacgugcaucuuucauagagguuaaaacuugcauauggccaaaaagucacacauuauggucaaauggaguuuuagagucugaaaugaucauaccgaaaauuuauggaggccccacaagccaacacaauuaccgccccgguuacuuuacucaaacagcugguccuuggcacuuaggaaagcuagaacuagauuucgaccuaugcgaggggacaacaguaguagucgacgaacacuguggaaacagagguccaucacuuagaaccacuacgguaacgggaaaaauaauccaugaaugguguuguagauccuguacucuuccuccacuacgauuucguggugaagacggcuguugguauggaauggagauccguccgguaaaagagaaagaagaaaauuuaguaaagucaaugguuagugcagguucaggcgaagucgauaguuucucccuagggcuccuaugcauaagcauuaugauagaagaaguuaugagaagccgauggucacguaagauguuaaugacagguacauuagcuguauucuuuuuauuaauaauggggcaacuaacguggaacgaucuuauuagauuaugcauaaugguuggagcuaaugcaagcgaccguauggguaugggaacaacuuaucuagcacuaauggcaacauuuaaaaugcgaccaauguucgcagucggauuguuguuccggagacugacaucgagagagguuuuauuauuaacaauaggcuugucgcuuguggcaaguguagaauuaccgaauagucuggaggaauuaggugacgggcuagcaauggguauuaugauacugaagcuccugacggauuuucaaagucaccaacuaugggcaaccuuauuaagccugacauucauaaaaacgacguuuucccuacacuacgcauggaaaacuauggcaauggugcucaguauaguaaguuuauucccucucugucuaucaaccacgucucagaaaacaacuuggcuucccguauuauuagggucuuuaggcuguaagccauugacaauguuuuuaauagccgaaaacaaaauauggggucgaaaaucuuggccauuaaacgaaggaauaauggcggugggaauaguuagcauuuuacuaucgaguuugcucaaaaaugaugugccucuagcaggcccucugauagcgggaggaauguugaucgcguguuaugucauuucgggaucuagcgcugacuugaguuuggaaaaagcagccgaaguuucaugggaagaagaggcugaacacucuggugcgucucauaacauucuaguagaaguacaagacgaugguacaaugaaaauuaaagaugaggaacgggacgauacucuaacaauacugcuuaaagcgacacuucuagccguaaguggagucuacccacuuagcaucccugcgacacuauucguaugguacuucuggcagaaaaagaaacagaggucuggaguccugugggauacaccaagucccccggaaguugaaagagcagugcuugacgauggaaucuaucgaauaaugcaaagaggauuauugggacggucacaagucgggguaggaguauuucaagaaaauguguuccauacaauguggcauguaacuagaggagcggucuuaauguaucaaggaaaaagacuugaaccaucaugggcgucugucaagaaagaccuaauuagcuacggggguggauggagauugcaggguucauggaacacuggagaggaaguacagguaauugcuguugaaccugggaagaaucccaagaauguucaaacagccccggguacauucaagacgccggaaggugaaguaggcgcaaucgccuuagauuucaaaccugggacgucugguaguccuauagugaaccgagaaggaaaaaucgucggauuauaugguaauggaguaguaacuacuucaggaacauauguuucggcuauagcgcaagccaaagcaucucaggaggggccccugccagaaauugaagaugagguguuuaggaaaagaaauuuaacuauuauggauuuacauccaggaucagggaaaacaaggcgauauuuaccugcaauaguuagagaagcaaucaaaagaaaacuuagaacgcuaauacuagcuccuacacggguaguugcgagugaaauggcagaagcacuaaaagggaugccaauacgcuaucagacaacagcagucaagucugagcauacuggcaaggagauugucgaucuuaugugccaugcaacauuuacuaugagacuuuuaucaccaguuagggucccuaauuauaauaugauaaucauggacgaagcucauuuuacagauccaucaaguauagcagccagaggauauauuucaacucguguaggcaugggugaagcugcugcaaucuucaugacugcaacacccccaggcagcguagaggcauuuccgcagagcaaugcaguaauacaagaugaagaaagagacauaccagagcggaguuggaacucuggauaugaauggauuacagauuucccagggaaaacugucugguuuguaccuaguauaaagucagguaaugacaucgcaaauugucugcggaagaauggaaaaagaguaauccaauuaagucgcaagacguuugauacugaauaucaaaagacaaagaacaaugauugggacuacguaguaacuacagacauuagcgaaaugggagcgaauuuucgcgcagacagaguaaucgauccaaggagauguuugaagccaguaauccuaaaagauggcccagaaagaguuauccuagcugggcccaugcccguaacuguugcaagugcggcucaaagaagggggagaguuggacgaaaucacaacaaagaaggagaccaguauauauacaugggacaaccauuaaauaaugaugaggaucaugcccacuggacagaggcuaaaauguuacuugauaacaucaauacaccugagggaauaauacccgcguuguuugaaccggaacgugagaaaucagccgcaaucgacggagaauaucgguuacgaggugaagccagaaagacauuuguagaacucaugagaagaggugaucuaccggucuggcuuagcuacaaaguagcuucugaagguuuucaguauagugaccgucgcuggugcuuugacggggaacguaauaaucagguucuggaagaaaacauggauguagaaauuuggacgaaagagggcgaaagaaagaaacuacggccacguuggcuugaugcacgcacauacagcgacccccuagcauuacgcgaauuuaaggaauuugcagcaggucgaagaucugugucaggugaccuuauacucgaaaucgguaagcucccgcagcaucuaacccaacgagcgcaaaacgcuuuagauaauuugguaauguuacauaauagugagcaaggcggcagagccuaucgccaugcaauggaggaacuaccugauacgauugagacguuaauguuacuagcuuuaauagcggugcuaacgggcggcguaacauuguucuuucuguccggaagaggacuaggaaaaacgaguauaggauuacuaugcguaauggcaucaaguguacuccuauggauggcaucaguagagccacauuggauagcagccucaaucauauuagaauuuuuccuaaugguacugcuuauaccggagccugauagacagagaacuccgcaagauaaucaauuagcguauguugugauuggacuauuguuuaugauucuaacugucgccgcgaacgagaugggccuauuagaaaccaccaagaaagaucuugggaucgggcauguagcagucgaaaaucaccaucacgcggcaaugcucgauguugacuuacaucccgcgucagcuuggacucuauacgccguagcaacaacgauuauaacaccaaugaugcgacauacuauugagaacacgacagcuaauaucucguuaaccgcuauagccaaucaggcagcuauccuaaugggauuggauaaaggauggcccauaucuaaaauggacaucggugugcccuuauuagcucugggcuguuauagccaggugaauccauugacuuuaacagcugcuguccucauguuagucgcacacuacgccauaauuggaccugguuuacaagcaaaagcaacuagagaggcacagaagcgcacugcugcaggcauuaugaagaauccaacaguugaugggauaguagcaauugacuuagacccagucguauaugacgcuaaauuugaaaaacaauuaggacaaauaaugcugcuuauuuuguguacaucgcaaauucugcucaugagaacgacaugggcuuuaugcgagaguauuacauuggcgaccggaccgcugacaacgcuuugggagggaagcccaggaaaguuuuggaauacaaccaucgcaguuaguauggcgaacauuuuccgaggaaguuauuuagcgggggcaggauuggcguuuagccuuaugaaaucacuaggcggcgggagaagggggacaggugcucagggagaaacuuuaggggaaaaauggaagaggcaacuaaaccaacugucaaagagugaauuuaauacauauaaaaggagcggaaucauggagguugauaggucggaagcgaaagagggauugaaacgaggagaaaccacaaaacaugcggucucucgaggcacugcuaaauuaaggugguuuguugaaaggaaccugguaaagccggaggggaaaguuauagaucucggcuguggaaggggaggauggucuuacuauugugccggccucaaaaagguaacggaaguuaaaggauacacaaagggaggaccuggacaugaagaaccuauucccauggcaacuuacggcuggaaucucgugaaacugcacagcgggaaggauguauucuucauaccuccggaaaaaugcgauacacuuuugugugauaucggcgaaaguaguccgaacccuacaaucgaagaaggucgaacucuaagaguacuuaagaugguagagccguggcuaagaggcaaucaauuuugcaucaaaaucuugaauccuuacaugcccucaguuguagaaacauuagaacaaaugcaaagaaagcacgguggaauguuaguacgaaacccuuuaucccggaacucaacucacgaaauguauugggucuccugugguaccgggaauauugucucggcaguuaacaugacuagcagaaugcuacuaaaucgauuuacaauggcucauaggaagccgacauaugaacgcgaugucgaucugggugcugggaccagacauguugcgguagagccagaaguagcaaaccuugauauaauuggccaaaggauagaaaauauaaaacaugaacauaagagcacauggcauuaugaugaagacaaccccuacaaaacgugggccuaucauggauccuacgaggucaagccaucagggucagccagcucuaugguuaaugguguaguaaaauuauuaacaaaacccugggauguuauaccaauggugacgcaaauagccaugacugacacuacuccuuuugggcaacaaagagucuuuaaggagaaaguagauaccagaacacccaaggcuaagcgaggcacuacacaaauaauggaaguuacugcucgguggcuuugggguuucuuaucuagaaauaagaaaccaaggauauguacucgugaggaguuuauucgaaaaguaagaucuaacgcugcaauaggugcugucuuuguugaugagaaccaguggaacuccgcuaaagaggcgguugaggacgaacguuucugggaccuuguacaucgggaaagggagcuucauaagcaagggaaaugcgcaaccuguguuuauaauaugaugggaaaaagagagaagaaacugggagaauuuggaaaagcaaagggaucucgagcgauaugguauaugugguuaggagcuagauuucuugaguucgaggcuuuaggauuuaugaacgaggaucauugguuuagccgagagaauaguuugucgggaguagaaggcgagggauuacauaagcucggauauauacuacgggacauaucaaagauaccagguggcaauauguaugcagacgauacagcgggaugggacacccgcauaaccgaggaugaccuacaaaaugaagcuaaaauaacagauauuauggaaccggaacaugcacuucucgccaaggcgauauucaaacucaccuaccagaauaaaguuguaagaguacaaagaccagccaaaaauggaacaguaauggacguaauaagucgcagagaucaaagagguaguggucaaguagggacguauggacuaaauacuuuuacaaauauggaagcucaacuaaucaggcaaauggaaucugaggguauuuucaguccuuccgaguuagaaacgccaaaucuagcugaacggguacuggacugguuagaaaaauauggaguagagagguuaaaacggauggcuaucuccggcgaugauuguguagucaagccaauagacgaucguuuugcuacagccuuaaccgcguuaaaugacaugggaaagguccguaaagauauuccgcagugggaaccgucaaaaggauggaaugauuggcaacaaguaccuuuuugcagccaucacuuucaccaacuuauaaugaaagauggaagggaaauagucguacccugcagaaaucaggacgaacuugucggucgugcaagagucagucaaggagcaggcuggagucuaagagagacagcuugccuaggaaaaucauaugcacaaauguggcaguuaauguauuuccauagacgugauuugcgauuagcagcuaaugcaauauguagugcugucccaguggauuggguucccacaucaaggacaacuuggucaauacaugcucaucaucaauggaugacaacagaagacauguuaagugucuggaauagaguauggaucgaagaaaauccauggauggaagauaaggcacauguuucauccugggaagacguaccauaucuugggaagagggaagaccaauggugcggaucguuaauuggucuuacggcucgugccacaugggcaacaaacauucaaguagcaaucaaccaaguucggagacugaucggcaacgaaaauuauuuggacuauaugacaucuaugaagagauuuaaaaaugaaagugacccagaaggggcuuuaugguaa

SEQ ID NO: 22059 - RNA, 9879 nt, Artificial Sequence
  derived and/or modified CDS sequence (opt6) from DENV-1__KC762651__SS-prME
agcguuacgaugcuauuuauguuauuaccaacagcuuuagcuuuucaucuaacaacuagaggaggagaaccucacaugauaguaagcaaacaagaacgcgggaaaucccuacuuuucaaaacuuccgccgguguaaauauguguacauuaauugcaauggauuuaggagaauugugugaagauacuaugacguauaaaugcccaagaauaacugaaacugaaccagacgacguugauuguugguguaacgcuacggaaacauggguaacuuaugguacgugcucgcaaacgggagaacacagaagagauaaaagaaguguagcuuuagcaccgcacgugggauuaggccuagaaacacgcacagaaacguggaugaguucagagggagcguggaaacaaauacagaaaguagaaacaugggcacuacgacauccuggauuuacggugauugcucuuuucuuagcacaugcuauagggacaaguauuacucaaaaaggaauaauauuuaucuuauuaauguuagugacaccaucuauggcaaugcgcugcgucgggauugguaaccgagauuucgucgaaggacuaucaggagcgacauggguagacgugguacuggaacauggaaguugcgucacuacaauggccaaagauaaaccgaccuuagauauagaauugcuaaaaacugaagugaccaauccagccguacuuagaaaacucugcauagaagcaaaaauaucuaacacuacaacugauucucgcuguccgacgcaaggugaagcuacccuuguggaagaacaagauacuaauuucguaugcagacgaacauucguagacagaggauggggaaacggcuguggacuauuuggaaaaggaagccuuauuacuugugcaaaauuuaaauguguaaccaaacucgaaggaaaaauaguccaauacgaaaaccuuaaauauucaguuauaguuacaguacauaccggagaccaacaccagguugguaaugaaacuacggaacaugguacaaccgcaacuauuacaccacaagcgccgacaagcgaaauacaacucacagauuauggagcauuaacacuagacugcucaccgagaacgggauuggauuucaaugaaaugguucuucuaacuaugaaagaaaaaucauggcugguucauaaacaaugguucuuggaucuaccauugccauggaccaguggagccucgaccucgcaagaaacauggaacagacaagaccuacuuguaacuuuuaaaacagcacaugccaagaaacaggaaguuguaguauuagguagucaagaaggagcgaugcauacagcacugaccggagcaacugaaauucagacauccgguacaacuacaauuuuugcgggccacuuaaaaugccggcuuaaaauggauaaauuaacacuaaaagguguuucuuacgugaugugcacuggaaguuucaaacuagaaaaagaaguggcugagacucaacauggcacaguauuaguacaagucaaauacgaaggaacagaugcaccaugcaaaauaccauucaguucacaagacgaaagaggcgucauacaaaacgggagacuaauaacugcgaaucccauuguuacagacaaagaaaagcccguaaauauagaagccgagccacccuucggagaaagcuauaucgucguaggugcuggugaaaaggcacuaaaacugaguugguuuaagaaaggcucaucaauaggcaaaauguuugaagcaacagcccgaggagccagaagaauggcuauauuaggugauacagcuugggauuuuggaucuauaggaggaguguucacaucgguaggaaaauuaguacaccagauuuuugggacugcuuacggaguccuguucucuggaguuucuuggacgaugaaaauagggauugggauucuguuaacaugguugggucuuaacucuagaucaacuucccuaucaaugacauguauugcagucgguaugguaacucuguaccugggaguaaugguucaggcugauucaggaugcgucauaaacuggaaagggcgugagcucaaaugugguagugguauuuuugucacaaaugagguacauacauggacugaacaauauaaauuccaagcugacucaccuaaaaggcuuagcgcagcgauuggaaaggcaugggaagaagguguauguggaaucagaagugcaacuagauuagaaaauauaauguggaagcaaauuagcaaugaguugaaccauauuuuacuagaaaacgacaugaaauucacaguuguagugggagacguaucugguauccuagcacaagggaagaaaaugauaagaccacaaccgauggagcacaaauacaguuggaaauccugggguaaagcuaaaauuaucggagccgauguacagaacacaacauuuauuauagacggaccgaauacgccggaauguccggauaaucaacgagccuggaauauuugggaaguugaagauuauggauuuggagucuuuacaacaaacauuuggcuaaaauuacgugacucauauacacaaguaugugaccacagguuaaugagcgcugcaauaaaagauagcaaggcaguacaugcagauaugggauacuggauagaaagcgagaaaaacgaaacuuggaaacucgaaagagcaucauucauagaaguaaaaaccugcauauggccgcgaucgcauacauuauggucaaauggaguacucgaaucugaaaugaucauucccaaaacauacgguggccccgugagucagcacaacuauagacccgguuauuuuacucaaacggcggggccauggcauuuaggaaaacuagaguuagauuuuaaucucugcgaaggcacaacuguagucguagaugagaauugcgguaaucguggcccgagcuuacgaacaacuacuguaacggguaagauuauccacgaaugguguugucgaucauguaccuuaccuccuuugcgcuuuaagggcgaggaugguugcugguauggaauggaaauaaggccgguaaaagaaaaagaagagaaucuuguuaaguccauggugagugcuggaucgggugaagucgauaguuuuucccucggucuuuuauguaucucaauuaugauagaagaagugaugagaagcagaugguccggcaaaauguuaaugacagguacacuugcggucuuuuugcucuuaacaaugggacaacuaacguggaaugaucucauacgacucugcauuaugguaggugccaacgcaucugacaugauggguaugggaacaacuuaccuugcuuugauggcaacauuccguaugagaccgauguuugcuguuggauuacuguuccgucggcuuacaagucgagaagucuuauuauugacaguugguuugucguuggucgcuaguguagaacucccaaacagccuugaagaguuaggcgacgguuuagcuauggguauaaugaugcuaaaauugcuaaccgauuuucagucucaccaacuaugggcgacacuacuaucgcuaacauucgugaaaacggcguucagcuuacauuacgcuuggaaaacaauggcgaugauuuuaucuauagucaguuuauucccuuuauguuugucaacuacaagccagaaaacuacuugguuacccguuuuauuaggaucacuaggguguaagccacuaacgauguuacugauaaccgaaaauaaaauuugggggagacgaucuuggccccucaaugagggaauuauggcgauagggauaguaucuauucuucugucauccuuacucaaaaacgauguuccauuagccggucccuuaauagcaggcggaauguuaauugcaugcuauguaauaucaggguccucagcugaccuuucacuggaaaaagcagcugaagugucuugggaagacgaggcagagcacucuggugccucccauaacauccuaguagaaguucaagaugacggcacgaugaaaaucaaggaugaagaaagggaugacacuuugacaaucuuacucaaagcgacauuguuagcaauuaguggaguauaccccaugagcauaccagcuaccuuauucguaugguauuuuuggcagaagaagaaacaaagaagcggaguacucugggacaccccaaguccaccagaagucgaaagggcggugcuugacgacggcaucuacaggauucuacaaagagggcuauuaggaagaucccaaguggguguaggaguuuuucaggaaggaguauuucauacaauguggcauguaacaaggggcgcaguguugauguaucaaggaaaaagauuggagccgucaugggcaagugucaagaaagaucucauuagcuauggggguggauggagauuucaaggaucuuggaacacaggagaagaaguacaagugauagcaguugaacccggcaaaaaucccaaaaauguacaaaccacacccgguacguuuaagaccucugaaggugaaguaggcgccauagcauuagacuucaaaccgggcacaagcgguucccccaucgucaauagggaaggcaaaauuguaggauuauauggaaauggcguaguaacuacaucaggaacauaugucucugcgauugcacaagcuaaagcaucucaggaaggaccacuuccagagaucgaagaugagguuuuccgaaaaagaaaccuuacgauuauggaccuccacccaggaagcggcaaaacccgcagauaucuuccagcuauauugcgcgaggcgauaaaaagaaaacuaaggacccuaguauuagccccaacacguguuguagcuucggaaauggcggaggcuuuaaaagguaugccgauuagguaccaaacgacggcaguuaaauccgaacacacugggaaagagaucguugacuuaaugugucacgccacguuuacaaugagauuacuuucacccgugagaguccccaacuacaacaugauaauaauggacgaagcucacuuuacugauccagcuaguaucgcggcaagagguuacauuucaacgagaguaggcaugggggaagcugcugcaauuuuuaugaccgcgacucccccaggcuccguugaggccuuuccucagucgaacgcaguaauucaggaugaagagagagauauaccagagcguagcuggaauagcggauaugacuggaucacugacuuuccaggcaaaacagugugguuugucccaucaaucaaaagcggaaacgauauagcuaauugccugaggaaaaacggaaagcgcgugguucaauuaucaagaaaaacguucgacacagaauaccagaagacuaaaaauaacgauugggacuacgucguaacaaccgauauuucagaaaugggagcuaacuuucgagcagauagaguuauagauccucggagaugccuaaaacccguaauauugaaagacggaccagaaagaguaauacuagccggaccaaugccaguaacuguggcuucggcugcucaaagacgcggcaggauagggcggaauccaaacaaagaaggcgaccaauauguguacaugggacaaccguuaaacaaugaugaggaccaugcacacuggaccgaagcaaaaaugcugcuggauaauauaaauacaccggaggguauuaucccggcucuuuuugaaccggagagagagaaaucagcagcuauugauggcgaauacaggcuuaggggugaggcucgcaaaacauuuguagagcuuaugcguaggggcgacuuaccagucuggcuuucuuauaaaguagcaucagaaggauuccaauauucugauagacgauggugcuucgacggagaaaggaacaaccaggucuuagaagagaauauggacgucgaaauauggacuaaggagggagaaaggaagaaauugcgcccgcgauggcuugaugcuagaacauauucagauccuuuggcacugcgagaguucaaagaguuugcggcgggaagaaggucuguuuccggagaucuaauucuagaaauuggcaaacuaccacaacauuuaacucaaaaagcacaaaacgcgcuggauaauuuagugaugcuucauaacucggaacaaggaggcaaagccuacaggcaugcaauggaagaguugccggauacaaucgagacuuuaauguuauuagcuuugaucgcaguacuaacagguggcguaacuuuauuuuucuuaucaggaagaggauuggguaaaacaaguauaggacuucuaugugugauggcaucuucggcccuacucuggauggcaucaguugaaccucauuggaucgcugcuaguaucauacuagaguuuuucuugaugguacucuuaauaccggagccggaccgccaacgcacgccgcaagauaaucaacuggcguauguugugauaggacucuuauuuaugauccucacaguagcagccaaugaaaugggacuacuagagacaacuaaaaaggaucuuggcauugggcaugcugcugcugaaaaucaccaucaugcagcuaugcuagauguagaucuccacccagccagugcguggacgcuauacgcuguagcaaccacuauaauaacaccaaugaugagacauaccaucgaaaacaccacagccaauauuucucuuacggcaauagcgaaccaggcggcuauacuaaugggccuagacaagggauggccaaucucuaaaauggauauagguguaccguuacuagcacucggcuguuacagucaaguaaauccgcugacguuaacagcugcuguauugauguuaguagcucauuacgcuauuauagguccugggcuccaagcaaaagcuacgagagaggcacaaaaacgaacagccgccggcauaaugaaaaacccgacgguugauggaauuguugccauugacuuagauccaguugucuaugacgcaaaauuugaaaaacaguuaggacaaauaauguugcuaauccuauguacaucucaaauacuuuuaaugcgaacuacaugggcguuaugcgaguccauuacacuggcaacggguccucuaacaacucuaugggagggauccccggggaaauuuuggaauacgacaauagccguuucgauggcuaauaucuuucgggguaguuaccuggccggggcgggacuugcauucagccucaugaaaucauugggaggaggaagaaggggcacaggagcucaaggagaaacauugggagagaaguggaagcgacaguugaaucaacugucaaaaucagaguucaacauauauaaaagaagugguauaauggagguagaucguagcgaggcaaaagaaggacuaaagcgcggagaaacaacgaaacaugcagugucgcgcggaacugcuaaauuaagaugguucguugaacgcaaccuuguaaaacccgaagguaaaguaauugaucuuggaugugguaggggaggauggaguuacuauugugcagggcugaagaaagucacagaggugaagggguacaccaaaggugggcccggucaugaggaaccaguuccaauggcgacuuacgguuggaaucuaguuaaauugcauagugggaaagauguauuuuucaccccgccagaaaaaugcgacaccuuauuaugcgauaucggagaaagcucaccuaaucccacuauagaagaaggaagaacucuucguguauuaaagauggucgaacccuggcuacgaggcaaucaauucuguaucaagauucuaaacccauauaugccaucgguaguagaaacccuggaacaaaugcaacgaaagcacgguggaaugcuuguuagaaauccucuaucgcguaacucgacgcaugaaauguacuggguaaguugugggacuggcaacaucguauccgcaguuaauaugacgucaagaauguugcuaaaucguuuuacaauggcgcaucgaaaacccacauaugaaagagacguggacuugggggcagggacaagacauguagcaguagaaccagagguugcaaauuuggauaucauaggucaaaggauagaaaacaucaaaaacgaacauaaaaguacauggcauuacgacgaggacaauccguacaaaacaugggcauaccacggaucuuaugaaguaaaaccuucuggcagcgcaucuaguauggugaacgguguagucagguuacuaacaaaaccaugggacguuauuccgaugguaacucaaauugcaaugacugauaccaccccguuugggcaacaacgaguuuucaaagaaaaagucgauacuagaacgccaaaagcuaaaagagguacggcacagauaauggaaguuacggcgaaaugguuguggggauuccuuucacgaaauaagaagccaaggaucuguaccagagaagaguucacgagaaaggugcgguccaacgcagcuauuggugcuguauucguagaugaaaaucaguggaacucugcaaaagaagccguggaagacgaacgauuuugggaccuuguacaccgagaaagggaauugcauaaacaaggaaaaugcgcaacaugcguguacaacaugaugggaaagcgugagaagaaauugggagaauuuggaaaagccaaagggucaagagcuaucugguauauguggcuaggugcgagauucuuggaguuugaagcacuuggauuuaugaaugaggaccauugguuuucaagagaaaauucuuuaucugguguugagggagaagggcuacauaaacuuggguauauacuccgugauauuucaaagauuccuggcggaaacuuguacgcggaugauacagcagguugggacacccggaucacugaagaugauuuacagaaugaagcgaaaauaacugauauuauggaaccugaacaugccuuauuagcaacaucgauauuuaaauuaacauaccaaaacaagguuguacguguccaaagaccagcuaagaauggcacuguuauggacgucauaucaagacgugaucagagaggaagcgggcaaguuggaaccuauggacuaaacacauucacuaauauggaagcacaacucauccgucaaauggaaucagaagggaucuucagccccucugagcuggaaacaccgaauuuagcgaaaagggugcuugauuggcuagaaaaacauggcauagaaagacuaaaaagaauggcaaucucuggagaugacugugugguuaagccaauagaugaccgcuucgccacggcgcuuacggcacucaacgacauggguaaaguuaggaaagacaucccacaaugggaaccgucaaaaggauggaaugacuggcaacagguuccguuuuguucgcaccauuuucaucagcucauaaugaaagacgggagggaaauaguugugccuugucgaaaucaggacgaacuaauuggcagagccagagucagccaaggagcuggguggucguugagagaaacagcaugccuugguaaaucauaugcacaaauguggcagcugauguauuuucaucgcagggauuuacgacuugcagcaaacgcuaucugcucugcaguaccaguggauuggguaccuacgaguaggacaaccuggagcauacaugcccaucaucaauggaugacgaccgaggacaugcugagugucuggaaucguguauggaucgaggaaaauccauggauggaagacaaaacacaugucucaucuugggaagaugugccuuaccuugguaagagagaggaccaguggugcggcucacuaauagguuuaacggcuagagcaacuugggcuucgaacauucaaguagcuauaaaccaaguccgcagacuaauagggaacgaaaauuaucuagauuauaugacaaguaugaaaagauucaaaaaugaauccgacccggagggugcauuaugguaa

SEQ ID NO: 22060 - RNA, 9879 nt, Artificial Sequence
  derived and/or modified CDS sequence (opt6) from DENV-1__KC762653__SS-prME
agcguuaccauguuauuaaugcuauuaccgacagcauuagcauuucaucuaacaacaagaggaggagaaccacacaugauaguauccaaacaagaacgagggaaaagucucuuauucaaaacaagugcaggaguaaauauguguacacuaauagcgauggauuuaggagaacuuugugaagacaccaugacuuauaaauguccgagaauaacugaaacagaaccagaugauguagacuguugguguaaugcgaccgaaacauggguuaccuacgguacuuguuaucaaacaggagaacaccgcagagacaaaagaagugucgcauuagcaccgcauguagguuuaggauuggaaaccaggacugaaacuuggauguccucugaaggcgcauggagacaaauacaaaaaguugaaacgugggcacuacgucauccaggcuucacugucauugcucuguuccuugcucacgcaauuggcacuucaauaacucagaaaggcauaaucuuuauacuacuaauguuaguuacgccaagcauggcaaugaggugcguagguauagggaauagagacuuuguagaaggccuuucaggcgcgacuuggguagauguggucuuagagcacgggucauguguaaccacaauggcaaaagacaaacccacacuugacauugagcucuuaaaaacggaagugacgaacccggcaguccuacgaaaauuauguauagaggcaaaaaucucgaauacaacuacagauagccgaugcccaacccaaggagaggcuacccucguagaagaacaggauaccaacuuuguauguagaagaacuuuugucgaucgugguugggguaauggauguggauuauucggcaaaggaucuuuaaucacgugcgcgaaauuuaaauguguuacuaagcuagaagggaaaauagugcaauaugaaaauuuaaaauacagcguuauaguaacaguccauaccggugaucagcaccaaguugguaaugagacuacugaacacggaacuacugcuacaauaacaccccaagcgcccacaagugagauacaauuaaccgauuacggagcacuuacacuggacuguuccccuaggacggguuuagauuucaacgagauggugcuccuaacuaugaaagagaaaaguuggcucguacauaaacaaugguuucuagaccuuccucucccguggacuucaggagcuagcacuucgcaagaaacguggaauagacaagacuuauuagugaccuucaaaacugcccacgcgaagaaacaagaagugguaguauuaggaucucaagaaggagcgaugcauacugcuuuaacuggugccacagaaauacagacgucaggaacuacaacuauuuuugcaggucauuugaaaugucgccuaaaaauggauaaguuaacucuuaaaggcaugucauacgugauguguacuggaucuuucaaacuugaaaaagaaguugcugaaacacaacaugguacaguucuaguucaaguaaaauaugaagguacugaugcaccuuguaaaauaccauucucuagucaggacgaaaaaggaguaacucaaaacgggagacuaauuacagcuaaucccauaguuacugauaaggagaagccaguaaacauagaagcggaaccucccuucggagagucauauuuggugguaggcgcuggggaaaaggcauuaaaacucucuugguuuaagaaaggcucuagcauaggaaaaauguuugaagccacugcaagaggugcaaggagaauggcaauucuaggugauacagccugggauuuugggucaauaggcggcguguuuacuucgguagguaagcugauacaccaaaucuuugguacagcuuaugguguacucuuuucuggcguuuccuggaccaugaagauuggaauuggcaucuuacugacuugguugggauuaaacucgcguucaacaucacucucuaugacuugcauagcagucgguaugauaacauuguaucuuggaguaaugguacaggcagauucuggcugcgucauaaauuggaaagguagagaacuaaaaugugguucagggaucuuugucacaaaugaagugcauacuuggacggaacaauauaaauuccaagcagauagccccaaacguuuaagcgccgcaaucggaaaagccugggaagaagguguaugcgggauccguuccgcaacgaggcuggaaaauauuauguggaaacagauaaguaacgaguuaaaucacauauuguuagaaaaugauaugaaauuuacaguuguuguaggugaaguaaacggaauccuagcucaaggcaagaaaaugauaaggccucaaccuauggaacauaaauauucguggaaaucuuggggaaaagcuaaaguuaucggugcugacguucagaauacaacauuuaucauagacggaccaaauacaccagaauguccagauaaucaacgcgcauggaauauuugggaaguugaggacuacgguuuuggaauauuuacaacuaauaucugguugaaacuucgcgauucuuauacacagguuugugaucauagauuaaugagcgccgccauaaaggauaguaaagcaguucacgccgauaugggguauuggaucgaaagcgagaaaaaugaaacguggaaauuagcacgagccaguuuuaucgagguaaaaaccuguauuuggcccaaaagucauaccuuauggaguaauggaguacuggaaagcgaaaugauaauucccaaaauauaugguggaccuauuucccaacauaacuaucgucccggauacuuuacccaaacggccgguccauggcaccucggcaaacuugaacuagacuuugaauugugugaagguaccacaguuguaguugaugaacacuguggaaacagaggcccgucauuaagaacaaccacgguaacgggaaaaauuauucacgaguggugcugucgguccuguacauugccaccgcuaagguucaaaggugaagaugggugcugguaugguauggaaauacggccuguuaaagagaaagaagaaaauuuaguaaagucuauggugucggcggggaguggcgaagucgauucauuuucgcuuggauuauuauguauuucgauaaugaucgaggaaguuaugcguucacgguggagccgaaaaaugcuaaugacgggaaccuuggcaguguucuugcucuugacgaugggucaauuaaccuggaaugaucuaauacguuuaugcauaauggugggagcuaacgcaagugauaaaauggggaugggaacgacauaucucgcauugauggccacuuucagaaugcgaccaaugcuagcaguaggucugcuauuccgccggcugacgucgagggaaguauuacugcuaaccguuggacucaguuuaguagcgucgguagaguuaccaaauucauuagaagaauugggggacgggcuggcaaugggaauaaugaugcugaaacuacuaacugauuuccaaagucaucaguuaugggcagcuuuguuaucauuaaccuuuguaaaaacaacauuaucucuacacuaugcauggaagacaauggccaugauucugucaaucguaaguuuauuuccgcucugucuauccacaaccagucagaaaacuacauggcuuccugugcuacuugguucauuggguugcaaaccucucaccauguuccugauaacagaaaacaaaauauggggaagaaaaucauggccauugaaugaagguaucauggcaguugggauugugucgauuuuacuuucaagccugcuaaagaacgacguaccccuugcagggccuuugauagcaggaggaauguuaauagcguguuauguaauuucuggguccucagcugaccugagcuuagagaaagcagcugaagugaguugggaagaagaagcagaacauuccggagcaucgcauaacauauuaguagaaguacaagaugaugggacuaugaagauaaaagacgaagagagagaugacacacugacgauucuacucaaagcgacucuccuagccauuucaggaguauauccaaugucuauucccgccacauuauuuguuugguacuuuuggcaaaagaagaagcagcgaucagggguccugugggacacgccgucuccgccugagguagaaaaagcagucuuagaugacggaauuuauaggauacuucaaaggggacuccucgguaaaagucaaguaggagucggaguauuucaagaaggaguauuccacacaauguggcauguuacgcguggcgcuguauuaauguaucaaggcaaaagguuggaaccgaguugggcuucugucaagaaagacuuaauaaguuaugggggaggauggcguuuccaaggaaguuggaacaccggagaagaaguucaaguaauagcuguagaaccagguaagaaucccaagaauguucaaacggcuccaggcacauuuaaaacgcccgaaggugaagucggggcaauagcuuuagauuuuaaaccaggaacgucggguaguccaauuguuaaucgugagggcaaaauuguuggacuguauggaaacgguguaguaacaacauccggaaccuacgugucagcgauagcacaggcuaaggcaagccaagaaggaccacuaccagaaauagaagaugagguauuccgcaaaagaaaccuaacgauaauggaucuucauccuggaaguggaaaaacacgacguuaccucccugcgauuguuagggaagcgauaaaacgaaaacuuagaacauuaguacuagcccccacuagaguaguagcguccgaaauggcggaagcauuaaaagguaugcccauacguuaccaaacaacagcagugaaaucugaacacacaggcaaagaaaucguugacuuaaugugccacgcaacuuuuacuaugagauuacuaucgccugugagagugccaaauuacaacaugauaauaauggaugaagcucacuuuacagacccagcauccauagcugcaaggggcuauauuuccacacgaguaggaaugggagaagccgcagccauuuuuaugacugcgaccccaccagguagcauggaagccuuuccgcagucaaacgcagcgauacaagacgaagagagggauaucccagaacgaucguggaacagugguuaugacuggaucacugauuuuccggggaaaacuguaugguuugucccaagcauuaaaucaggaaacgacauagcaaauugccuaagaaagaauggaaaaaggguaauacaauuaucgagaaaaacauuugauacagaauaucagaaaacgaaaaauaaugauugggacuauguuguaacaacagauauuagcgaaaugggagcaaauuucagggcagauagaguaauagacccucgucgcugucugaaaccagucauacuaaaggacgguccagaaagggucauauuagcagggccaaugccuguaacuguggcuucagcugcacaacguagagggagaauaggaagaaaucaaaauaaggaaggggaccaauacauauauauggggcagccacucaauaacgacgaagaccaugcacauuggacagaagcaaaaaugcugcuggauaacauuaacacaccagagggaaucauacccgcacuauucgaacccgaacgagagaaaagugcagcgaucgauggagaauauagguugaggggugaggcuagaaaaacguuugucgaauuaaugcguaggggugaucuaccaguauggcucaguuauaaaguagcuucggaaggguuccaauacagugaccgucgcugguguuuugacggggagagaaauaaucaaguucucgaggaaaacauggauguugaaaucuggaccaaagaaggcgagcgaaagaaauugagaccgaggugguuagacgcgaggacguauuccgacccucucgcacuuagagaguucaaagaguucgcagcgggucguagaucaguaaguggggaccuaauacuugagaucgggaaacuaccacaacaccuaacccaacgagcacaaaaugcgcuggauaauuuagugauguuacacaacucggagcaaggaggcaaggcuuaccgccaugcaauggaggaauugccugacacaauugaaacguuaaugcuauuggcgcugauagcaguacuaacuggaggaguuacacucuuuuuccucagcggaagggguuuggguaaaacauccauuggccuacuuuguguaauggcgucaagcgcacuauuguggauggcuucaguagaaccacacuggauugcagccucaaucaucuuagaauuuuuccugaugguguugcuaauaccggaaccggaucgacagcgaacuccucaagacaaucaacuugcuuaugugguuauuggucuccuauucaugauauuaacagucgcagcuaaugagaugggguuacucgagacaacuaagaaagacuugggaaucggacacgcagccgcggaaaaccaccaccacgcugcaauguuggauguagaucugcauccagcaagugcguggacauuauaugcuguagcuacaacuauuauaacuccuaugaugaggcacacuauagagaauaccacugcaaacauaaguuuaaccgcuauagccaaucaagcagcaauacugaugggauuagacaaaggguggccaaucuccaaaauggauaucggugucccgcuccuagcauuagguugcuauagucagguaaaccccuugacacuaacugcagcaguacugaugcucguagcucauuaugcaaucaucggaccgggccuucaagcuaaggcuacaagagaagcccaaaaacguaccgcagcuggcauaaugaagaauccaacaguagacggcaucguugcuaucgauuuagauccgguaguuuaugaugcaaaauucgagaaacagcuaggucaaauuauguuauugaucuuguguacuucucaaauuuuacucaugcguacaaccugggcccuaugugagaguauaacauuagcaaccggaccauuaacaacguuaugggaagggucacccgguaaauucuggaacacgaccauagcagucuccauggcaaacaucuuucggggguccuauuuggcgggagcuggccuagcuuucuccuuaaugaaaaguuuaggaggcggaaggcgcggaacaggggcccaaggagaaacucuuggugaaaaauggaagagacaguuaaaccaauuaucaaaaagugaauuuaacacauauaaaagauccggaauuauggagguagaccggagugaggcaaaggaaggacugaaacgcggugaaacaacaaagcacgcaguaagccgaggaacggcgaaguugcgaugguuugucgaacgaaacuuaguaaagccagaagguaaaguaauugauuuggguuguggucguggugguugguccuauuacugcgcuggucuaaagaaaguuacagaagucaaaggguacaccaaagggggaccaggacacgaggaacccauaccaauggcaacauacggcuggaaucuaguaaagcuccauagcggaaaagauguauuuuucacuccgcccgaaaagugugauacacuguugugugauauaggggaaucauccccgaacccuacgauagaagagggaaggacauuaagaguauuaaaaaugguagaaccauggcucagaggaaaucaauuuuguauuaaaguauuaaauccuuauaugccaucagucaucgaaacccuagagcagaugcaaaggaaacaugguggaauguugguaagaaauccuuugucgcgcaacaguacucaugaaauguauuggguaagcuguggcacaggaaauauuguuuccgcaguuaauaugaccagucguauguuauuaaacagauucacaauggcacauaggaagccuacguacgaacgggaugucgaucuaggagcagggaccaggcacguggcuguggagccagagguugcaaauuuagauauaauuggccaaagaauagagaacaucaaaaaugaacacaaguccacuuggcacuaugacgaagacaacccuuauaaaacaugggccuaucauggguccuaugaagugaaaccuucugguagcgcaucauccaugguaaacgguguaguacgucuucucacgaagccuugggacgucaucccaaugguaacucaaauagcaaugacagacacaacgccuuuuggucaacaaaggguauucaaagaaaaaguggacacgagaacaccaaaagcuaaaagaggaacagcacaaauaauggaaguaacagcucgguggcuguggggguuccuguccagaaauaaaaagccuagaaucugcacgagagaggaauuuacgcgcaaagucagaucgaacgcagcaauuggagccguauucguugaugaaaaccaauggaacucugcaaaggaagcggucgaggaugaaagguuuugggaucucguccauagagaacgugaacugcauaaacaaggcaagugugccacaugcguuuauaacaugauggggaagcgagagaagaaacucggagaguucggaaaagccaaaggaucaagggcuauaugguauaugugguuaggggcacgauuuuuagaguuugaagcccucggcuucaugaaugaggaccauugguuuucuagggaaaauucauuaaguggaguggaaggugaaggacuccacaaauuaggcuauauucuacgggauaucucaaaaauacccggcgggaauauguaugcagacgauacagcaggcugggacaccagaauaacagaagacgaucuacaaaaugaggcaaagauuacugauauaauggaaccagaacacgccuuacuagcgaccaguauuuuuaaguugaccuaccaaaacaaggucguacgaguccaaagaccggccaaaaaugguacaguaauggaugucauaucgagacgggaucagcguggcaguggacaaguaggaacauaugggcuaaauacauuuacuaacauggaggcacaacuaauacgacaaauggaaagugagggaauauuuacacccagugaauuggaaacaccaaaccuugccgagcgaguacuugacugguuagaaaaacacgggaucgaacgauugaagcguauggcaaucagcggcgaugauuguguaguuaaaccuauugacgaccguuucgcaacagccuugaccgcauuaaaugauauggggaagguacggaaagauaucccccaaugggaaccuucuaaagguuggaacgauuggcagcaaguucccuuuuguagucaucauuuccaucagcuaauaaugaaggauggacgggaaauagucguaccaugccgcaaucaagaugaacuuguuggucgagcccgaguaagucagggugcgggauggucuuuaagagagacagcaugccucgggaaaagcuacgcacaaauguggcaauuaauguauuuucaucgccgugaccuacgccuagcggcuaaugcgaucuguagugcgguuccaguggacugggucccaacaucacgaacgacauggaguauacaugcacaucaucaauggaugacuacagaggauaugcucucgguguggaacagaguauggauagaagaaaauccguggauggaggauaagacacacguaucuagcugggaagauguaccauaucucggcaagcgugaagaucaauggugcggaagucucauuggauugacugcuagagcuacgugggcaacaaauauacaaguagcuauuaaucagguacgaagauuaaucgguaacgaaaauuaccucgauuacaugacgucaaugaaaagguuuaaaaaugaauccgacccugaaggagcacugugguag

SEQ ID NO: 22061 - RNA, 9879 nt, Artificial Sequence
  derived and/or modified CDS sequence (opt6) from DENV-1__KC762640__SS-prME
ucuguuacuauguuguugaugcuacuaccaacugcacuggcauuucauuuaacgacuagaggaggagaaccucauaugauugucucaaaacaagaaagagguaaaucgcuacuauuuaaaacaucagcgggaguaaauaugugcacucuaauugcaauggauuugggcgaacuuugcgaagacaccaugacauauaaauguccaagaauuacugaaacugaaccugacgauguugauugcugguguaaugcgacugaaaccuggguaacauacgguacguguucacaaacuggugaacaucgacgagacaaaagaagcguggccuuagcaccccacgucgguuuaggccuggaaacaaggacugaaacauggaugucaucggaaggggcuuggcgucaaauucagaaaguagaaacaugggcacugcggcauccaggauuuaccguuauugcccuuuuucuagcacaugcaauaggcacaagcauaacacaaaaaggaauuauauuuauuuugcuaaugcuaguaacaccaucaauggcgaugcgguguguagguauaggaaauagggauuuuguggaaggacuuucuggugcgacaugggucgauguuguuuuagaacaugguagcugcguaaccacuauggcaaaagacaaaccgacauuagauauugaacuuuuaaaaacagagguuacaaacccagcuguuuuacgaaaauuaugcauagaggcgaaaauaucaaauacuaccacugacucacgaugcccaacacagggagaagccacauuaguagaagaacaagacacgaauuuuguuugucgcagaacguucguugaucgaggguggggaaauggaugugggcuuuuuggcaaagggagucucauuacuugugcaaaguuuaaaugcgucacuaaacuugaaggcaagauuguacaauacgaaaauuugaaauacagugucauaguaacgguucauacaggcgaucaacaucaaguaggcaacgaaacuaccgagcauggaacaacggccacaauuaccccacaggcuccgaccucagaaauacaguugacggauuauggagcuuuaacguuagauuguagcccacguacaggacuagauuuuaaugaaauggugcuacucaccaugaaagagaaaaguugguuaguccacaaacagugguuccuagaccuacccuuaccuuggacaaguggagcaagcacaagucaagagacuuggaauaggcaggaucuauuaguuacauucaaaacagcgcacgcuaagaaacaagaaguagugguccuagguucacaggaaggagcgaugcacacggcuuuaacgggugcuacggaaauccaaacgagcgguacgacuacgaucuucgcgggacacuuaaaaugcagacuaaaaauggauaaacucacucugaaagggguuuccuacguaaugugcacugguagcuucaaacuagaaaaagaaguagcugagacccagcacggaacagugcucguacagguaaaauacgaaggaacggaugcaccuuguaagauuccauuuuccagucaggacgaaaaaggaguuacacaaaacgggagacuaauaacggcgaauccaaucgugacugacaaagaaaaaccggugaauaucgaagcugaaccaccauuuggagaaucauaccuaguaguaggggcuggggaaaaagcauuaaaauuaagcugguucaagaaggguaguucuauuggaaagauguuugaagcgacagcucggggugcuagaagaauggcuauuuuaggagauacagcaugggauuucggaucuauaggagggguuuuuacaaguguagggaaacuuauccaccaaauuuuuggaacggcuuacgggguacuauucucuggcguaucauggacaaugaaaauugguauagggauuuuacuaacauggcucggguuaaacucucgaucuacaucacuaucuaugacauguauugccguaggaaugguaacguuguaccuagggguaaugguccaagcagacaguggaugcguuauaaacuggaaaggucgagaacugaaaugcgguaguggaauuuuugugacuaacgaggugcauacauggacagaacaauacaaauuccaagcugauagucccaaaagauuaagugcggcaauuggcaaagccugggaagaaggcguaugcgggauaagaucagcaacccgacuagaaaauauaauguggaaacaaauaagcaaugagcuaaaccacauacuucuugaaaacgauaugaaguucacuguugucguuggugaaguaaauggaauauuagcgcaagguaagaaaaugauucggccgcaaccuauggaacauaaauacaguuggaagucuuggggaaaggcaaaaguaauaggagcggacgugcaaaacacaacauuuauaauugauggaccuaauacaccagaaugcccagacaaucaacgcgcauggaauauuugggagguugaagacuaugguuuuggaauauuuacuacaaacauuugguuaaaguuacgugauucuuacacacaagucugugaccauagacugaugagugccgcuauaaaagacuccaaagcuguccacgccgauaugggcuacuggaucgagagugagaaaaacgaaacuuggaaacuggcuagagcaucuuucauagaagugaagaccuguauauggccaaagucacauacucuaugguccaacggaguacuggaauccgaaaugauuauuccaaaaauauacgguggacccauuucccaacauaacuauagaccagguuacuucacucaaacagcuggcccauggcauuuggguaaauuggagcuagauuuugaacuaugugaaggaaccacgguuguuguagaugaacacugugguaaccguggccccagcuuaaggacuacaacgguaacaggcaaaauuauacaugaaugguguuguaggucuuguacauuaccaccauugagguuuaagggcgaggaugguugcugguauggcauggaaauaaggccggucaaggaaaaagaagaaaaccugguuaaaucuauggucagcgcugguucaggagaggucgauaguuuuucauuaggucuucuauguauaucgaucaugauugaagaagucaugagaucaagguggucucguaagauguuaaugacaggaaccuuggcaguuuuccuacuacugacaaugggacaacuaacuuggaaugaucuaauuagacuuugcauuauggucggugccaaugcgagcgauaaaauggggaugggaaccacauacuuggcauuaauggcaacauuucgcaugagaccaauguuugccguugguuugcuauuccggcguuuaacgucaagagagguauuacuacucacagugggacuaucccucguugccucaguagaacugccuaauaguuuggaggaauuaggugacgggcucgcaauggguauaaugauguuaaaguuacuuaccgacuuucaaagucaucaacugugggcugcauuacuaucacuaacguucguaaaaacuacauuaucacuacacuaugccuggaaaacuauggcaaugauauugucgauaguuucguuauucccucuauguuuaucuacaacgagucaaaagacaacuuggcuucccgugcuauuaggcucacuagggugcaaaccacucacaauguuucuaauaaccgaaaacaaaaucuggggaagaaaaagcuggcccuuaaaugaaggcauaauggcaguugguauagugucaauacuauuaaguucgcuccuaaagaacgacguaccacuagcgggaccauuaauagcuggaggaaugcuaauugcuuguuauguaauaucagguucaucggcggaccuuagccuagaaaaagcggcagaaguuagcugggaagaagaagccgagcacucuggggcaucacauaacauauuagucgaaguacaagaugacggcacaaugaaaauaaaagaugaggaacgagaugacacacuuacuaucuuguuaaaagcaacauuauuagccauuuccgguguguaccccaugaguauuccagcgacacuguuuguaugguauuucuggcagaaaaagaaacaaagaucaggggucuuaugggacaccccaucaccaccagaaguagaaaaagcaguccuugaugaugggaucuaucggauucuacaaagagggcuacuuggaaaaagucaaguugggguaggaguauuccaggaggguguguuccacacuauguggcacguaacuagaggcgcaguuuuaauguaccagggaaaaaggcuggaaccaagcugggcaagugugaagaaagauuuaauuaguuacgguggaggauggagauuucagggaaguuggaauacgggugaagaaguccagguaaucgcuguggaaccggggaaaaauccuaaaaacguacagacagccccaggaacguuuaaaacuccagaaggugaaguaggagcuauagccuuggauuuuaaacccgguacuucaggcucaccaauagucaacagggaaggcaaaaucgucggucuauauggcaacggaguuguaacgacaucgggaacuuacgugucggcaauugcccaggcaaaggcuucacaggagggaccacucccagaaauagaagacgaggucuucaggaaacguaauuugacuauaauggacuuacauccagggucugggaaaacaagacgguauuugcccgcuaucguaagggaggcuauuaagagaaaguugcggacuuuaguacuagcaccuacacgagucguugcaucagaaauggcugaagcucuuaaaggaaugccgaucagauaccaaacgacggcaguuaaaucagaacacacugguaaagaaauuguagaucuuaugugccacgcuacguucacaaugagauuacuuagccccguucggguaccaaauuauaauaugauuaucauggacgaggcacauuucacugacccugcaagcauugccgcgcgcggauauauaaguacaagaguuggaaugggugaagccgccgcaaucuucaugacagcgacaccuccagguaguauggaggcuuuuccccagaguaacgcagcgauacaagacgaagaaagagacaucccagagcgaaguuggaacucaggauacgauuggauuacagauuucccaggaaaaacgguuugguucguuccaaguauuaagaguggaaaugauauugcaaauugucuaaggaaaaacggcaaaagagugauucaauuaaguagaaaaaccuucgacacugaguaccagaaaaccaaaaauaaugacugggauuauguagucacaacugauauaagugagaugggugcaaauuucagagcugacagaguaauugacccacgacgauguuuaaaaccgguaaucuuaaaagaugggccagaacgaguuauacuugcagggccaaugccaguaaccguggcaucagcagcccaaagaagagguagaauaggacgaaaccaaaauaaagagggcgaucaguauauauauaugggccaaccuuuaaauaacgacgaagaccacgcgcauuggacugaggcuaaaaugcugcuugauaacaucaauacaccagaaggcauaauaccagcucuuuucgagccggaaagagaaaaaucagccgcaauagauggagaguacagauuaaggggcgaagcacgaaaaacauuuguagaauuaaugaggcguggagaucuuccaguauggcuaaguuacaagguugcgucugaagguuuucaauacagugauagaagauggugcuuugauggagaacgaaacaaucagguucuugaagaaaauauggauguagaaauauggacaaaggaaggagaaaggaagaaauuacgaccacguuggcuagaugccagaacuuacucugauccgcucgcacuucgcgaguucaaggaauuugcugcugggagaagaagcguuagcggagaccuaauacuagaaauagggaaauuaccacaacaccuaacucaacgcgcccaaaacgcacucgauaauuuggugaugcuucacaacucagaacagggaggcaaggcauacaggcaugccauggaagaacuaccagacacaauagagacuuuaaugcuucuagcguuaaucgccguucuaacuggcggcguaacguuauucuuuuuaagcgguagaggucuagggaaaacaaguauagggcuucugugugucauggccaguagcgcacuguuguggauggcaucuguagaaccacauuggauagcagcgagcaucauucucgaguucuuucuaaugguuuuacuaaucccagaaccagacaggcaacggacgccucaagacaaccaacucgcuuaugugguaauaggccuacuuuuuaugauacugacgguugcagcaaaugagaugggucuacuagaaacaacuaagaaagaccucgggauaggacaugccgcagcugaaaaucaucaccaugcugcuauguuagacgucgauuugcauccugcgucagccuggacacuguacgcuguggcaacaacaauaauuacuccuaugaugagacauacuauagaaaauacaacagcaaauauaucucugacugcaauugccaaccaagcagcuauucugauggggcuggacaaagguuggccgauaucuaagauggauauugguguaccacugcuggcauuagguugcuacucgcagguuaauccuuugacuuugacugcagcaguucuaauguuaguagcccauuaugcgaucauaggcccggggcuccaagcaaaagcaacaagagaggcucaaaaacggacagcagcgggaaucaugaaaaacccaacgguagacggaauaguugccaucgaccuagacccuguuguguaugaugcgaaauucgagaaacaauuaggccagauuauguuauuaauauugugcaccucccagauucuuuugaugagaaccacaugggcacuaugugagagcauuacguuggcaaccggaccacuuacuacacugugggaagggaguccugguaaauuuuggaauacaacuauagcgguaucgauggcuaauauauuccgagggucauacuuagcaggagccggacuagcguuuucucuaaugaaaagccugggaggaggacgucgagguacuggagcacaaggagagacacucggagaaaaguggaaacgacaauugaaucaauuaucgaaaucagaguuuaauacuuacaagaggucagguauaauggaaguagaucguucggaagcaaaggaaggguuaaaaagaggagaaacaacgaaacaugcugucucacgggggacggcuaaauuacgaugguucguggaacgaaaccuuguuaaacccgaggguaaagucaucgacuuagguuguggcagaggaggauggaguuauuacugcgccggucuuaaaaagguuaccgaaguaaaaggcuauaccaaggguggcccagggcaugaagaaccaauaccgauggcaacuuauggauggaaccuuguuaaacuuuacucgggcaaagaugucuuuuucacaccucccgaaaaaugcgauacccuauuaugcgacaucggugagucaaguccaaauccaacuauugaagaaggcaggacgcuucgagugcuaagaaugguugaaccauggcuaagggguaaccaauucugcauaaaaguacugaauccuuauaugccaagcguaauagagacacuagaacagaugcaaagaaaacacgguggcauguugguucgaaauccucuuucuagaaacucgacucaugaaauguauuggguuaguugugggacagguaauauagucucugcggucaauaugacgucacgaaugcuauugaaucgcuucacaauggcacauagaaaaccuacuuacgaaagagauguagauuugggagcuggaacgcgucauguggcagucgaaccagaggucgcuaauuuagaaauaauaggucaacguaucgaaaacaucaaaaaugaacauaaguccaccuggcauuaugaugaagacaacccuuauaagacgugggcuuaccacggaucauacgaaguuaaacccucagguagcgcgucuucaauggugaaugggguuguuagauuacucacaaagccuugggacguaauacccauggugacucagauagcaaugacggacacuacaccauucggccaacagagagucuuuaaggaaaaaguagauacccgaacaccuaaggccaaacgagggacagcucaaauaauggaagucacggcaagaugguuauggggauuuuuaaguaggaacaagaaaccacgcauaugcacccgagaggaguuuacgagaaaaguccgaucuaaugcagcaauaggagcaguuuuuguagaugaaaaccaauggaacucagcaaaagaagcuguugaagacgaacgcuuuugggaccuuguucauagggaacgagaauuacauaagcaaggcaaaugugccacaugugucuacaacaugauggguaagagagagaagaaauuaggagaauuugguaaagcaaaggggagcagagcaauuugguacauguggcugggugcaagauuucuagaauuugaggcuuuaggauuuaugaacgaagaccacugguuuagcagagaaaauucccucaguggaguggaaggagaagggcuacauaagcucggauauauucuucgcgacaucucgaaaauaccugggggaaacauguaugcagaugauacugcggggugggauacacgaauaacugaggaugaucuucaaaaugaggcaaaaauaacggacaucauggaaccagagcaugcccuacuagcaaccucaauuuuuaaauuaacauaucaaaacaaaguuguacgaguacagcgaccggccaaaaauggaacgguuauggaugucaucucuaggagggaccaacgcggaaguggucaaguggguacuuauggucuaaauacauucaccaauauggaagcccagcuaauaagacaaauggaguccgaagggauuuucacgccuagugaacuggagaccccaaaccuugcugaacgaguucuagacuggcuagaaaaacauggaauagaaagacucaagcgaauggccauaaguggagacgacugcguuguaaaaccuauugaugaucgguuugcaaccgcucuaacugcguuaaacgauaugggcaaagugcgcaaggacauaccucagugggaacccucuaagggguggaacgauuggcaacaaguaccuuucugcucccaucauuuucaccaguuaauaaugaaggacggacgggagaucgucgucccuugccgaaaucaggaugagcuagugggcagagcaagggugucucaaggagcuggauggagucuacgagagaccgcaugucuaggaaaaaguuaugcacaaauguggcaauugauguacuuucauagaagggacuuacggcucgcagcgaacgcuauuuguucggccguaccgguagacuggguaccaacaucuagaacaacuuggucaauucaugcccaccaccaauggaugacaacagaagacaugcuuucuguauggaaucgaguauggauagaggaaaauccauggauggaagacaaaacucauguaucuucuugggaagacgugcccuaccugggcaaacgggaagaucagugguguggcucacuuaucggauuaacugcuagagcgacaugggcuacaaacauacaaguugcaauaaaucagguaagaagauuaauagggaacgaaaauuauuuggacuauaugacgucaaugaaaagauuuaaaaaugaaucggauccagaaggagcccuuugguga

SEQ ID NO: 22062 - RNA, 9879 nt, Artificial Sequence
  derived and/or modified CDS sequence (opt6) from DENV-1__KC762645__SS-prME
aguguuacaaugcuucuaauguuaaugccaacugcucucgcguuccauuuaaccacgagaggaggagaaccccacaugaucguaucaaaacaagaacgagggaaaaguuuguuauuuaaaacaucugcuggaguaaacauguguacacuaauagcuauggaccuuggagagcuaugcgaagauacauugacauauaaauguccacguauaacggaagcagaaccagacgacguagauugcuggugcaacgcaacagauacuugggugacauaugguaccuguucucaaacaggcgaacauaggagggauaaaagaagcguagcgcucgccccacauguaggacucggucucgaaaccagaaccgaaacuuggaugucuagcgagggugcuuggagacaaauucaaagaguagaaacgugggcccuuagacacccagguuuuacggugauugcgcuauucuuagcacaugccauuggcacaaguaucacucagaaaggcaucauauuuauauuacuuauguuaguaaccccgagcauggcuaugagaugcguaggcauugggucacgugauuuuguagaaggcuuaucaggugcaacauggguagacgugguacuugaacacgggaguuguguaacgacuauggcaaaagauaaaccuacacuagauauagaauuguuaaaaacugaagugacaaaucccgccguauugcguaaacuaugcauagaggcaaaaauuucaaauacaaccacugauucgagauguccaacucaaggugaagccacuuuaguugaagaacaggacgcgaauuuuguuugucgacgcacauucguagaucgugguugggguaauggaugugguuuguucggaaaaggcagccuaauaacgugugcgaaauuuaaaugcgugaccaaacuugagggcaaaaucguacaguacgagaaucucaaauacucugugauaguuaccguucacacgggagaucagcaucaaguaggaaacgagucaacagaacauggaacaacggcaacaaucacaccacaagcaccaaccacagagauucagcuaaccgauuauggugcgcucacauuagauuguucaccaagaacaggacuugacuucaaugagaugguauuacuuaccaugaaagaaaaaucaugguuagugcacaaacaaugguucuuagacuugccacuuccauggaccucaggcgccucuacaagucaagaaacguggaaucgucaagacuuacuugucaccuucaaaacagcgcacgccaagaaacaagaaguagugguacuuggaucacaggagggcgcuaugcauacagcacuaacaggagcuacggaaauucagacaucuggaacgaccaccauuuuugcuggacaucuaaaauguagacuuaaaauggauaaauuaacacucaaagguaugucauaugucauguguaccgggagcuuuaaauuggaaaaagaaguagcagaaacucaacacggcacggucuuaguucaaauaaaauaugaaggaacagacgcaccuugcaaaauaccauucaguacacaagacgaaaaaggaguaacucagaaugggcggcucauuacggcaaacccaauugucacagauaaagagaaaccugucaacauagaggcugaaccuccauucggugagucguauaucguaauaggugcaggagaaaaagcacuaaaacuaucaugguucaagaaagggaguucgauuggaaaaauguucgaagccacagcuagaggggcucguagaauggcuauacuaggcgacaccgcuugggacuuuggcucaauagguggcgucuucacgucaguaggaaagcuaguucaccaaaucuuugggacagcauauggaguucucuucucaggcguuuccuggacaaugaaaauagguauuggaguauuauuaacaugguuaggccugaacucaagguccacaucauuaucaaugacguguauagcggugggucuagucaccuuauauuuaggaguaauggugcaagccgauaguggcugcguaauaaacuggaaggggcgagaacuaaaaugugggucugguaucuucguaacgaaugaaguacauaccuggacggaacaauauaaauuucaggcagauucaccuaaacgucuuucugcagcaaucgguaaggcuugggaggaaggggugugcggaauaagaucggcaacgcgucuugagaauauuauguggaagcagaucagcaacgaauuaaaccauauauuauuagaaaacgacaugaaauuuacuguuguuguaggugaugucgcugguauccuggcccaagggaagaaaaugaucaggccgcagccaauggaacauaaauauucuuggaaaucaugggggaaagcaaaaauuauuggagcagacgugcaaaauacaaccuucauaauagaugguccaaauacaccagaauguccggacgaccaaagagcauggaauauuugggaagucgaagauuacgguuuuggcauuuuuacuacaaauauauggcuuaaacuuagagacaguuauacacaaguaugcgaccauagauuaaugagcgcagcuaucaaggacaguaaagcgguacacgcagacaugggauauuggauagaaucugagaaaaaugaaaccuggaaauuagcucgugcgucuuucauagaaguaaagacuugcauauggcccaagagucauacacuaugguccaaugggguacuagaaagugagaugauuauuccuaaaaucuacggaggaccuauuucucaacauaacuaucgaccgggguacuuuacacagacagccggucccuggcaccuggguaaauuagagcuagacuucaaccugugcgagggcacuacaguuguaguagaugaacacugcgguaauaggggaccauccuuaagaacaacgacagucacugggaaaauaauucacgaaugguguugcagaucauguacacuaccuccccugcgauuucguggagaagauggcugcugguacggaauggaaauaaggccaguuaaagagaaggaagaaaauuuggucaaaaguaugguuuccgcuggcaguggggaaguagacaguuuuucucugggacugcuuuguauuucuauaaugaucgaagaaguaaugcgcucacgguggagcaggaaaauguuaaugacuggaacucucgcgguauucuuucuccuaaucaugggucaacuaacguggaacgauuuaauacgccuauguauuaugguaggugcaaacgcgucugaucggauggguauggguacgaccuacuuagccuuaauggcaacauuuaagaugagaccaauguucgcuguugguuuguuauuuagaaggcuuacaucgagagaaguacuucuccuaacuauuggucucagcuuaguagcaucaguagaguugcccaacucucuugaagaauuaggugacggucuggccauggguauaaugaucuuaaaacuuuuaaccgacuuucagagccaccaacuuugggcuacgcuauuaagccuaaccuuuauuaaaacaaccuucucucuacauuaugcguggaagacuauggcaaugguucugaguauaguuucgcuauucccucucugccucucgacgaccagccagaaaaccacguggcuuccaguauuacuugguucauuaggguguaaaccguuaacaauguuccuaauugcagaaaauaaaauauggggccgaaaaucuuggccccuaaacgaggguaucauggcuguuggaauuguaaguauacuguugucaucauuauuaaagaaugauguaccacucgcaggucccuuaauagccggcgguaugcuaauagcauguuaugugaucaguggaucgagcgcugauuugagucuugagaaggcugcugagguuucuugggaagaagaagcagaacauagcggagcuucacauaacauauuaguagaaguccaagaugacggaacuaugaaaauuaaggacgaagagagggacgacacauuaacaauccuuuuaaaagcgaccuuacuagccguaucagguguuuauccacuaagcauaccugcaaccuuauuugugugguacuuuuggcagaaaaagaaacagcgaucaggaguacuuugggauacaccauccccacccgaaguugagagagcgguacuugacgauggaaucuaucgaauuaugcaacggggacuauuaggacgaucgcaaguaggugucggugucuuucaagaaaaugucuuucacacgauguggcaugugacccgaggagcaguacuaauguaccaaggcaaacguuuggagcccucgugggcuucagugaaaaaggaucuaauuaguuauggagggggauggagguuacaaggcaguuggaacaccggagaagagguucaaguaaucgcgguagaaccaggcaaaaauccuaaaaacguacaaaccgcccccgggacauuuaagacuccugaaggcgaaguaggggcuauugcacuagacuuuaaaccugggacauccggguccccgauaguuaaucgagaaggcaaaauaguaggcuuauauggaaauggagugguaacaacgagcggaacauauguauccgcaauugcacaagcaaaagccagucaggaaggcccucuacccgagauagaagaugaaguauuccguaaaagaaaccuuacaauuauggaccuucaucccggcuccgggaaaaccagacguuaucuaccagccauagucagagaagcuauuaagcgaaagcuacgaacuuuaauauuggcuccgacucgcguuguagcaucugagauggccgaagcauugaaagggaugccaauacguuaucagaccacugccgugaaaucagaacacaccggaaaagaaaucguagauuugaugugucaugcaacauuuacaaugagacuguuaucaccuguacgaguuccaaacuacaacaugauaauaauggacgaagcacacuucacagauccauccaguauagcagcaagaggcuauauaucaacuagaguuggaaugggagaggcugcagcuaucuucaugacggccacgccaccuggaagugucgaagcauuuccucaaucaaaugcagugauacaagacgaagaaagagacauaccugaacgaucauggaacucuggauaugaauggauaacggacuuuccgggaaaaaccguuugguucguaccaaguauuaaaucuggaaaugauauugcuaauuguuuaaggaaaaaugggaaaagaguaauucaauuaucuagaaaaaccuuugacacugaauaccagaagacuaaaaacaaugacugggauuaugugguaacgaccgauauuucagagaugggagcaaauuucagagccgaucgaguaauugauccucgcagaugcuuaaaaccugugauacucaaggauggcccugaacguguaauuuuagcuggaccaaugccagucacgguagcuucagcugcacagcgccggggaagagugggucgaaaucauaacaaagaaggcgaucaauacaucuacaugggucagccauuaaauaaugaugaggaucaugcucacuggacagaagcgaaaaugcuguuggauaacauaaacacaccagaaggaauaauaccagcacucuucgaaccggaaagggaaaaaucugccgcaauagacggcgaauaucgauugcgcggugaagcgagaaaaacauucguagaacuuaugcgucgaggugaccuaccaguauggcuuaguuacaaaguagcaucugaagguuuccaguacucugauagaaggugguguuuugacggugagcggaauaaccagguauuagaagaaaauauggauguugagauauggacuaaagaaggagaacgcaaaaagcuaagaccaagguggcuagaugccagaacguacucugauccucuagcguugagagaauuuaaagaauuugcagcugguaggagaucugugucuggugaucugauccucgaaauaggaaaacuuccacaacaccugacucaacgcgcccagaaugcccuagauaaucuaguaauguuacauaacucagaacaaggaggucgagcauaucgacaugcaauggaagaacuuccagacacaauugaaacgcuaauguuacucgcuuugauagcuguuuuaacagguggcguaacacuauuuuucuuaagcgggaggggcuuaggaaaaacgucaauaggccugcucugcguuauggccucuucuguacuauuauggauggcgaguguacaaccacauuggauagcagcaucaaucauccuagaguucuuuuuaaugguccucuuaauuccagaaccugaucggcagcguacaccacaagauaaucaacuagcauacgugguaauaggucuguuguuuaugauucuaacgguugcugcuaaugaaaugggauuacuugaaacaacgaagaaagaccuaggaaucggccaugucgcgguggaaaaucaccaccacgccgccaugcuugauguugaccuccauccggcaucagcauggacauuauaugcagucgcgacuacuaucaucacaccaaugaugagacacacaauagaaaauacaaccgcaaacaucucauuaacugcaauagcaaaucaagcggccauccuuaugggucuugacaagggauggcccaucuccaaaauggacauaggggucccucuacuagcuuuaggaugcuauagccaaguaaauccccuaacuuuaacggcagcaguacuuaugcuaguagcucacuaugccauuauagguccuggucuucaggcgaaagcaacucgugaagcucaaaaacgaacagcugcaggaauuaugaaaaauccuacuguagaugguauaguagcuauagaucuagauccuguaguauacgaugcaaaauuugaaaaacaauuggggcaaaucaugcuucuuaucuuauguacgagucaaauuuuacuaaugaggacaacaugggccuuaugcgaguccaucaccuuagcaaccggaccccuaaccacacuuugggaaggaucaccugggaaguucuggaauacaacgauugccguaucgauggccaauauuuuuagagguucguaccuagcuggagcuggacuagcuuuuucucucaugaagucguuaggggguggaagacgagggacaggugcacaaggugaaaccuugggcgagaaauggaaaaggcaacugaaucagcuaagcaagucugaguucaauacuuacaagagaaguggcaucauggagguagaccgaagugaagcuaaagaaggucucaaacgaggagagacaacgaagcaugcuguaagcagagguacggccaaacucagaugguuugucgagagaaacuugguuaaaccggaaggaaagguaauagauuuaggaugcggucgcggcggcuggucguauuacugugcaggacuaaagaaaguuacagaagugaaaggauauacaaaaggagggccaggacaugaagaaccuauucccauggcuaccuacggauggaaucuuguaaaauuacauagugguaaagauguguucuuuauacccccagagaaaugcgacacucuccugugugauauaggagagucgagcccaaaucccacuauagaagaagggaggacguuacguguauuaaagauggucgaaccauggcuacgcggaaaucaauuuuguauuaaaauucuaaauccguauaugccuagcguaguugaaaccuuagaacaaaugcaaagaaaacacggcggaauguuaguccgaaauccacuaagccgaaauuccacacacgaaauguauuggguaagcugcggaacuggaaauauuguaucagcggugaauaugacuagcagaaugcuacugaauagauuuacuauggcccaucguaaaccuacuuaugaacgugacguagaccuaggcgcaggaacgagacacguagcuguagagccagaaguggcaaauuuggacauuauuggccaaaggauagaaaauauaaaacaugaacauaagucuacauggcauuacgaugaagauaauccuuauaagacuugggcguaucacggaaguuacgaaguuaaaccaagcggaagcgcgaguucgaugguaaauggcgugguaaagcuacuaacaaaaccaugggaugucaucccgauggugacgcagauugcaaugacagacacaacuccguucggacaacaaagaguuuuuaaagaaaaaguagauacacgaacuccuaaagcaaaacgugguacuacacaaaucauggaaguuacggcaaggugguuauggggauuccugucgaggaacaagaaacccaggauauguaccagggaagaguucacacggaaaguaagaagcaaugccgccauaggcgcaguauucgucgacgaaaaucaauggaacucugcgaaagaagcaguagaagaugagcgguuuugggaucuuguucaucgagaaagagagcuacauaaacagggaaaaugugcaacauguguuuauaacaugaugggaaaaagagagaagaaacuaggcgaauuuggaaaagccaaaggcucuagagccauaugguauauguggcuaggugcccguuuucuagaguuugaagcgcucgguuuuaugaaugaggaccauugguucucacgcgaaaauucauuaagcggaguagaaggagaagggcuacacaagcucggcuauauauuacgagauauuaguaaaauacccggugguaacauguaugcagaugacaccgcugguugggauaccagaauuacagaagaugauuuacagaaugaagcaaaaauaacugacauuauggaaccugaacacgcacuuuuagcaaaggcaaucuuuaaauuaacauaccaaaauaaagucguuaggguucaaagaccugccaagaacggaacuguuauggacgucauaucacguagagaucaacgaggcagcggucaaguagggacguauggucuaaauaccuucacuaauauggaagcacaauugauccgacaaauggaaagcgaggguauauucucacccagugaacuugaaacaccuaacuuggcagaaaggguauuggauugguuagagaaguaugguguugaacgccuaaaacggauggcaauuucuggagaugauugcguuguaaagccuauugaugacagauuugcuaccgcgcuaacugcacugaaugauaugggaaaaguuaggaaggacaucccgcaaugggaaccgucaaagggauggaaugacuggcaacaaguaccguuuuguagucaucauuuccaccaacuaauuaugaaagauggacgagagauagucguuccaugcagaaaucaagaugaauugguuggacgagcgagggucucucaaggugcaggguggagccuaagagaaaccgcuugcuuaggaaaaaguuaugcccaaauguggcaguuaauguauuuucauagacgagauuuaagacuugcugcgaaugcaauaugcagcgccgucccaguugauuggguuccaacaucgaggacuacuuggucaauucacgcucaccaccaauggaugacaacggaagacauguuaucuguuuggaacaggguauggauagaggaaaauccauggauggaagacaaaacucauaucagcucaugggaggacgugccguacuuagguaagagggaggaucaauggugcggcucacugauagguuuaacggcacgcgccacuugggcaaccaauauacaaguagcgauaaaccagguaagaagacucauagguaaugaaaauuauuuggauuauaugacaucaaugaaaagauucaaaaacgaaucagauccagaaggagcauuaugguag

SEQ ID NO: 22063 - RNA, 9879 nt, Artificial Sequence
  derived and/or modified CDS sequence (opt6) from DENV-1__KC762628__SS-prME
uccgucacuaugcuuuuaaugcuguuaccgacggcauuagcauuucacuuaacuacgagggguggugagccacacaugauaguaaguaaacaagaacgagguaaaucccuguuauuuaaaacuucugcgggugucaacauguguacucuuauugcuauggaucucggagaguugugcgaagauacaaugacauauaaauguccacgaauaacugaaacagaaccugaugauguagacugcuggugcaaugcgacugaaacuuggguuaccuaugguacauguagucaaacuggagaacaccggagggauaaaaggucaguugcauuagcaccacacguuggauugggacuagaaacacgaacagaaaccuggaugucaagcgaaggagcauggagacaaauacaaaaaguagaaacgugggcucuacgacauccagguuuuacagucauagcauuauuucuggcucaugcaauaggaaccucuaucacacaaaaaggaaucauauucauacuacuaaugcuuguaacgccaaguauggcuaugagguguguaggaaucggcaacagagauuucguagagggcuugagcggcgcaacuuggguagaugugguguuggagcauggcuccuguguaaccacaauggcaaaagacaaaccaacauuagauaucgaauuacuaaaaacugaagucacaaacccagcagugcucagaaaacuauguaucgaggccaaaauaagcaauacuacuacagacucaagaugucccacgcaaggggaagcaacauuagucgaagaacaagauacaaacuucguauguagaagaacauucguagaucggggaugggggaacggcuguggucuuuuugguaaagggagucucaucacgugugcaaaauucaaauguguaacaaaacuggagggcaaaauaguacaauaugagaaucugaaauacuccgugauuguaacgguacacaccggagaucaacaucaggucgguaaugaaacaacagaacauggaaccacggcaacaaucacaccacaagccccgacaucggaaauucaacugacugacuacggagcguuaacucucgacuguuccccgcgaaccggauuagauuuuaacgaaaugguauuauugacaaugaaagaaaagucauggcugguccauaagcaaugguuucuagaucuuccuuuaccuuggacuucaggagcgagcacaagccaagaaacuuggaaccgacaagauuuguuaguaacauuuaagacagcgcaugcaaagaaacaagaggugguaguacuagggagucaagagggagcaaugcauacagcgcucaccggcgcaacggaaauucaaacgucaggaacuacaaccaucuuugcgggucacuuaaaaugucguuuaaaaauggacaagcuaacguuaaaagguguaagcuaugucauguguacggggagcuuuaaauuagagaaagaaguagcugagacccaacaugguacaguauuaguccaaguaaaauaugaaggaacggaugcuccauguaaaauaccauuuucuucacaagacgaaaaaggcgugacacaaaacggacgacuaauaacugcaaauccaauagugacagacaaggaaaaaccaguaaauauagaagccgagccaccauuuggagaaagcuauuuaguggucggugccggugaaaaggcuuuaaaacuuaguugguuuaagaaagguucaaguauaggaaagauguuugaggcaacugcuagaggagcucgucgcauggcaauuuuaggagauacagcaugggauuucggaaguauagguggaguauucacuucagugggaaaacucauucaucaaauauucggaacagccuacgggguacuguuuaguggaguuucauggacgaugaagauaggaauaggcauauuacuaacauggcuagggcuaaauucaagaucgaccaguuuaucuaugacuugcauagcagucggaauggugacauuauaccuuggcguaauggugcaggcggauucuggcugugucaucaacuggaaggggagggagcugaaauguggaagcggaauauucguaacaaaugaaguucauacuuggacagagcaauauaaauuccaagcggacuccccgaagcggcugagugcggcaauuggaaaagccugggaagaaggaguaugcgggauuagaucagcaacaagauuagagaacauaauguggaaacagauaucuaacgaacuuaaccacauccugcuagaaaacgacaugaaauuuacuguaguuguaggugaaguaaauggcauauuagcacagggcaagaaaaugauacguccucagccgauggaacacaaauauagcuggaaaucaugggguaaagcaaagguaauaggcgcggacguucaaaacacaacauuuaucauagacggaccaaauacgccagaguguccggauaaccagagagcuuggaacauaugggagguagaggauuauggauucggaauauucacgacaaauauuugguugaaacuaagagauuccuacacacaaguaugugaccauagauuaauguccgcagcaauaaaagauagcaaagcuguacacgcagacaugggauacuggauagaaucggagaagaacgagacauggaaacuagcucgcgcuagcuucauagaagugaaaacuuguaucuggccaaagucacauacacuguggucaaauggaguauuggaaucagaaaugauuauaccuaagauauauggcggaccuauaucacagcacaauuauagaccuggauacuuuacacagacagcaggcccauggcacuuggggaaacuugaauuggacuuugagcugugcgagggaacaacaguaguaguggacgaacauuguggaucucgaggacccagcuuaagaacaacuacuguaacgggaaaaauaauccacgaaugguguugcagaucguguacccuaccgccccuaagauuuaaaggagaagauggaugcugguaugggauggagauuagaccugucaaagaaaaagaagaaaaucuaguaaagucgauggucagcgcagguucuggcgaaguugauucguucucacuaggacugcuuuguaugucgauaaugauugaagagguuaugcguagcagauggucgaggaaaaugcuaaugacaggaacacuagcaguauuccuuuuauuaacgaugggccaacuaacauggaaugauuuaauccgauuauguauaaugguaggcgcaaaugcuucugauaaaauggggaugggcacaacacauuuagcacugauggcaaccuuuagaaugcgacccauguucgcggugggccugcuauuucgacguuugaccucacgugagguauuguuauugacugucggacuaucauuaguggccucgguagaacuccccaacucguuggaagaauuaggggaugguuuagcaaugggaauaaugauguuaaaauugcuaacugauuuucaaucucaccaacucugggccgcauuacuaucucuuacguuuguuaagaccacuuuaucauugcauuacgccuggaaaacgauggcuaugauuuugucgauuguaagccuuuuuccacugugucucucgacaacaagucagaaaacuacuuggcuuccuguguuacuuggcucacuggguugcaagccgcuuacaauguuucuaauuacagaaaauaagaucugggggcgaaaauccuggccgcuaaacgaagguauuauggccguugguauugugaguaucuugcuuucuucacuucugaaaaaugauguaccucucgcgggcccacucauagcugggggcaugcuaauagcuuguuaugucaucaguggaucaagugccgaccuuucuuuagaaaaagcagcagaaguauccugggaagaagaagcagagcauucaggagcaucacauaauauccuugucgagguacaagaugauggcaccaugaaaauaaaagaugaggaacgugaugacacacuuacaauauuacuuaaagcaacguuacucgcaaucuccggaguguauccuaugucgauuccagcuacucuguuuguaugguauuuuuggcagaagaaaaagcaacguucgggagucuuaugggacaccccaaguccaccagaagucgagcgagcaguucuugacgauggcaucuaccguauacuccaacgcggguuguuaggcaaaucacaagucgggguaggaguauuucaagaaggaguauuucacaccauguggcacgucacacgaggugccgucuuaauguaucaagggaagcggcucgagccauccugggcaucggugaagaaagacuuaauaucauauggaggaggauggagauuucagggauccuggaauaccggagaagaaguacaggugauagcgguagaaccagguaagaacccuaaaaauguacagacugcacccggcacguuuaaaacgccugagggcgaaguuggagccauagcuuuagacuuuaaaccugggacaucagggucaccuauagucaaucgcgaaggaaaaauaguaggauuguacgggaacggcguagucacgacaucagguaccuaugucagugcuauagcucaggccaaagcaagucaagaaggaccuuuaccagagaucgaagaugaagucuuccguaaaagaaacuuaaccaucauggaucuccauccagggagcgggaagaccagacgcuaccuaccugccaucguacgugaagcgauaaaaagaaaacuaaggaccuuagugcuugcuccaacucgcguuguggcgucagaaauggcugaggcuuugaaaggaaugccgauacgauaccaaacaacggcugucaaaagugaacacacuggaaaagaaauaguagaucuaaugugccacgcaaccuuuacgaugcgauugcuaucuccgguucggguuccuaacuacaacaugauaauaauggacgaggcgcauuuuacugauccagccuccauugccgcaagaggcuauauaaguacaaggguagggaugggggaggccgcagcaauauucaugacagcgacaccuccaggcagcauagaagccuuuccgcagucuaacgccgcuauccaagaugaagaacgugauauaccugaacgaagcuggaacucgggguacgauuggaucacagacuuuccaggaaagacagugugguuuguaccuucuauuaaaagcgguaaugauauagcuaacugccuuaggaaaaauggcaaacgagucauacaacucucuagaaaaacauuugauacagaguaucagaaaaccaaaaacaaugauugggauuauguaguaacuaccgacauaucggaaaugggcgccaauuuucgcgccgauagggugauugaucccaggagaugccuaaaaccuguuauacuaaaggacggaccagaaagaguaauauuagcgggaccuaugccaguaacaguggcuucggcagcucagcguagaggacgaauaggaagaaaucaaaacaaagaaggagaucaauauaucuauaugggacaaccgcugaacaaugacgaagaucacgcccauuggacugaagcaaaaauguuacuagauaacaucaauacaccagaaggaaucauaccagcucucuucgaaccagaacgagagaaaagcgcagccaucgacggugaauauagauuaagaggcgaagcgcgcaaaacuuuuguugaauuaaugagaagaggugaucucccaguuugguuaagcuauaaaguugcgagugagggauuucaauauuccgaccgacgguggugcuuugauggcgagagaaacaaccaaguucuagaagaaaauauggacguagaaauauggacaaaggagggcgagagaaagaaguuaagacccaggugguuagaugcaagaacauacagugauccauuagcccuucgugaauuuaaggaguuugcagcgggccgcagaucgguguccggugacuugauucuagaaauaggcaaauuaccacaacauuugacucaacgagcacaaaaugcacucgauaauuuaguuaugcuacauaauucugaacaagguggaaaagcauaucgccacgcaauggaagaacuaccugacacaauagagacgcuaaugcuccuagcauugauugcuguucucacgggagggguuacauuguuuuucuuauccggaagaggacugggcaaaacaucaauaggacugcuaugcgugauggcuucuuccgcgcuuuuguggauggccucaguagagccgcauuggauugccgcuaguauuauauuagaguucuuucugaugguacucuuaaucccagaaccggauagacaaagaacuccgcaagacaaucaauuggcuuaugucgucauuggauuauuauucaugauccucacuguugcggcaaaugaaaugggauuauuggaaacuacaaagaaggaucuagguauugggcaugcagcugcggaaaaccaccaccaugcugcaaugcuagacguugauuugcauccagcaagugcauggacccuguaugccguugcuacaacuauuaucacacccaugaugcgucacacaauagaaaauacaacagcuaacauaucucuaaccgcgauugcuaaucaggcggcaauuuuaaugggauuagauaaaggguggccaaucaguaaaauggacauuggagucccacuacuagcgcuagguuguuauucgcaaguaaacccucugacucugacagcggcuguacuaaugcuuguagcacauuacgcaauaauuggcccuggucuccaagccaaggcuacacgagaagcacagaagaggacugcagcagguaucaugaagaaccccacugucgacggaauagucgcaauagauuuagaucccgugguuuaugacgcuaaauuugaaaaacaauugggccaaauaauguuauuaauauuauguacgucacaaauacuauugaugaggacgacaugggcacugugcgaaaguaucacgcuugcuaccgguccuuuaacaacacucugggagggcagcccggggaaauucuggaauacaacuaucgcuguaucgauggcgaauauuuuucgcggguccuaccuugcuggcgcuggucuagcauucucacuuaugaaaucguuaggaggagguagacgagguacaggagcgcagggagaaacauuaggcgagaaguggaaacggcaacugaaucagcugucgaagucagaauuuaauacuuacaaaaggucagguauuauggagguagauaggucugaagcuaaagaaggacuaaaacgcggagagaccacaaaacaugcaguaucaagagggacagcuaaacuaaggugguuuguagagagaaauuuaguuaaaccggaggggaaagugaucgaccuuggcugcggacgggguggguggaguuacuacugcgcugguuugaagaaagugacggaagucaaagguuauacgaaaggagggccuggacaugaggagccaaucccgauggcuacguacggauggaaucuaguaaagcuccauagcggcaaagacguauuuuucaccccaccagaaaaaugugauacauuacuaugcgacauaggugaaagcagcccaaaccccacgauagaagaggguaggacauuacgugucuuaagaaugguggagcccuggcuaaggggaaaccaauuuuguauuaaaguucugaacccauauaugccuucaguaauugaaacgcuagaacaaaugcaaagaaaacauggaggaauguuagugcgcaacccauuaucaagaaauucaacucaugaaauguauugggugagcugcggcacagguaacaucguuagugcaguaaacaugacaucaagaaugcuucuaaaccgauuuacaauggcacauaggaagccaacauacgaaagagauguggaccugggugcgggaacucgucacguagccgucgagccagaaguagcaaaucucgauauaauaggccagaggaucgaaaacaucaaaaaugaacauaaaaguacauggcauuaugaugaagacaauccguauaaaacaugggccuaucauggaucauacgaagucaaaccaucugggucagccucaaguaugguaaacggaguagugagauuguuaacaaaaccaugggaugucaucccuaugguuacucaaauagcgaugacagauaccacaccauuugggcaacaaaggguauucaaggaaaaaguagacacaaggacgccaaaagcaaaacggggcacagcacaaauuauggaagugaccgcgcguuggcuauggggcuuuuugucgaggaauaagaaaccacguauuuguacccgagaagaauuuacucggaaggucaggucgaaugcagcaaucggugcaguguuuguagacgaaaaucaauggaacucggccaaagaagcugucgaagacgagagauucugggacuuagugcauagagaaagagaauugcacaaacaagguaaaugugccacaugcguuuauaauaugauggggaaacgugagaagaaauugggagaguuugguaaagcaaaaggcucacgcgcaauaugguacauguggcuuggagcacguuuucuggaauuugaagcacuagguuuuaugaaugaggaucauugguuuucucgagaaaacuccuugagugguguugaaggugaaggucuacacaaacuaggauauauacugagagauauaaguaaaauuccuggaggcaacauguaugcagacgauacugcagggugggauacaagaauuacagaagacgauuuacagaacgaagcuaaaauuacggauaucauggaaccggagcaugcccuacuugccaccucaauauuuaaacucacuuaucaaaacaaagucguucguguacagcgaccagccaaaaauggaacaguaauggacgugauaagccgccgagaccagcgcggaagcggacaaguagguaccuacggacuuaauacguuuacgaacauggaagcccaauugaucagacagauggaguccgaagggauauuuacucccucugaacucgagacgccaaaucuagcggagcgcguccuugauuggcucgagaaacacgguauugagcgcuuaaaaaggauggcuauaaguggcgacgauugugucguaaaaccuaucgaugaucgcuuugcuacagcucuaacggccuuaaacgacauggguaaaguaaggaaagacaucccacaaugggaaccaucaaaaggauggaaugacuggcagcaggucccauuuuguucacaccauuuucaucaacucaucaugaaagacgguagagaaaucgugguuccaugccgaaaucaggacgaacucguagguagagcaagaguaucacaaggggcaggauggucauuaagagaaacugcaugucugggaaaaucauacgcucagauguggcaacuaauguauuuccacagacgcgaccuacgacucgcagcgaacgcuaucugcagcgcuguuccuguagacuggguaccaaccagccggacgacauggucuauucacgcacaccaccaguggaugacgacagaagauauguuaucaguuuggaaucguguuuggauugaagaaaacccauggauggaggauaaaacucauguaucauccugggaagacguaccuuaucuuggaaaacgagaggaucaauggugcggcagucucauagggcuuacugccagagccacaugggcuacuaacauucaaguagcaauuaaucaaguccgacgucuuauagggaaugaaaauuauuuagacuauaugacuucaaugaaaagauuuaagaacgagagcgaucccgaaggcgcacuuugguaa

SEQ ID NO: 22064 - RNA, 9879 nt, Artificial Sequence
  derived and/or modified CDS sequence (opt6) from DENV-1__KC762624__SS-prME
ucaguuacuauguuauuaauguuaaugcccacugcacuagcauuccaucuaacaacaagagggggagaaccucacaugauuguaucaaaacaagaaagggguaaaagccuuuuauucaaaaccuccgccgguguaaauauguguaccuuaauugcaauggauuuaggugaacuuugugaagacacccuuacuuacaaaugcccaagaauuacggaagcagaacccgacgacguugauuguugguguaaugcuacagacaccugggugacuuauggaaccuguucacaaaccggugaacaucgaagagauaaaagaucugucgccuuagcaccucacgugggccuuggacuugaaacgcggacagaaacauggaugaguucagagggggccuggaaacaaauucaaagaguugaaacaugggcauuacggcacccgggguuuacuguaaucgccuuauucuuggcacacgcaauagggacuuccauaacccaaaaaggaauaaucuuuauauuacuaaugcugguaacuccgucgauggcuaugagauguguuggcauuggcagucgagacuuuguagaaggauugaguggggcaacauggguugauguaguacuugaacauggaaguuguguaacaacaauggccaaagauaaaccuacacuagacauagaacucuuaaaaacggaggugacuaaccccgcaguacuuaggaaacuaugcauugaggccaaaaucuccaacaccacaacugacucucguugccccacucaaggugaagcuacccucguagaagaacaagaugcaaacuuuguaugcagaagaacuuuuguugacagaggauggggcaaugguuguggacuguuuggcaaaggcucacucauaacaugugccaaauucaaaugcguaacaaaauuggaaggaaaaauuguacaauaugagaauuuaaaauauagcgugauugucacaguucacacaggagaucaacaccaaguugggaaugaaucaacggaacauggaacuacagcaacaauaacaccccaagcaccaacaacagagauacaacuaacagauuauggcgcacuuacauuagacuguuccccuaggaccggacuggauuucaaugaaaugguccuacuaaccaugaaagagaaaagcuggcuaguccacaaacagugguuccuagacuuaccguuaccauggaccaguggugcaucaacaucccaagagacauggaauagacaggaucuucuaguuacauuuaaaacugcgcaugccaagaaacaagaaguuguuguauuagguagucaggaaggagcaaugcauacggcacucacuggugcaaccgaaauucaaaccucuggaacaaccacuauauuugcgggccaccuaaaaugcagguuaaaaauggacaaauuaaccuuaaaagggaugagcuacguuaugugcacaggaucauuuaaauuagagaaagaaguggccgaaacccaacacggcacaguacugguacaaauuaaauaugaagggacagaugcaccgugcaagauaccauucucaacacaggaugaaaaaggggucacccagaaugggagauuaauaacagccaacccaauagucaccgauaaagaaaaaccaguuaacauagaagcagaaccaccauucggagaaucuuauaucguaauaggggccggagagaaagcgcuaaaauugucgugguucaaaaaggguucgaguauaggaaagauguuugaagcaacagcucgaggcgcccggcgcauggcaaucuugggcgauacugccugggauuuuggaagcauagguggaguguucacuucagugggaaagcuaguucaucaaauuuuuggaacugcuuauggcguuuuauucaguggagucaguuggacuaugaagaucgguauagguguacuucugaccugguuaggucuaaacucaagaaguacaaguuuaagcaugacuuguauagcuguaggacuuguaacauuauacuuaggaguaaugguacaagcagauucgggaugugugauuaacuggaaaggcagagaauuaaaaugugggucgggaauauucgucacuaacgaaguccacacuuggacggaacaguacaaauuucaggcagacaguccaaaaagacuaagcgcugccauaggaaaggcuugggaagaaggagucugcgggauucgaucagcgacuagauuagaaaauauaauguggaaacaaauaaguaacgaauuaaaucauauuuuauuggagaacgauaugaaauucacagugguaguaggagauguagcuggaauacuagcacaggguaagaaaaugauuaggccacagccaauggaacauaaauauagcuggaaauccuggggaaaagcuaaaauuauuggcgcggaugugcaaaacacuacuuuuauaauagauggcccgaauacuccagaaugcccagaugaucaacgagcguggaacaucugggaaguugaagauuauggauucgggaucuuuacaacaaacauauggcuuaaauuacgcgauaguuauacacagguuugcgaccaucgguugaugucggcagcuauuaaggauuccaaagcuguccaugcggauaugggauacuggaucgaaucugagaaaaaugaaacauggaaacuugcucgugccucauucauugaaguaaaaacuuguauauggccgaagucgcacacauuguggaguaacggaguuuuagagagcgagaugaucauucccaaaauauacggaggcccgacaagucaacacaacuacagacccggauauuuuacacagacugcaggacccuggcaccuuggaaaacuugaguuggauuuugauuuaugugaaggaacaacagucguggucgaugagcacuguggaaacagagguccaagccuaaggacuacuacuguaacaggaaaaauuauacaugaaugguguugcaggucuugcacucuaccacccuugagguuuagaggugaagacgguugcugguacgguauggaaauaaggccaguaaaggaaaaagaggaaaacuuggucaaaucuauggugagugcugguagcggagaaguggauucuuucucguuagggcuacuguguauaaguauuaugauagaagaaguuaugcgaucaagguggagcagaaagauguuaaugacaggcacguuggccguauucuuuuuacucauuaugggucaacuaacguggaacgacuugaucagguuauguauaaugguaggagcaaacgcaucagaucgcauggguaugggaacuacguauuuggcacuaauggcuacuuuuaaaaugcggccaauguucgcaguaggucuauuauuucgaagacugacgucuagagaaguucuccugcucacgauaggacucagucuaguagcaucuguagagcuuccuaacucauuggaagaacuaggagacggacuagcuaugggaauaaugauacuuaaacuuuugacugauuuucaaucgcaucaacuuugggcaacguuguuaucccuaacuuucauuaaaacgacauucucgcuucacuacgcauggaaaaccauggcgauggugcuaucaauagugagucuuuuuccucuauguuuauccacaacgagucagaaaacgacuuggcuaccaguauugcuaggaagucucgggugcaaaccauuaacgauguuuuuaauugcugaaaacaagaucuggggacguaaaucuuggccacuuaacgaggguauaauggcaguaggcauagugaguauuuuauuaucuagucuacuuaaaaaugacgucccacuagcaggaccacuaauagcaggagggaugcugauugcauguuacguaaucagcggcaguagcgcugauuuauccuuagaaaaagcggcagaaguuagcugggaggaagaagcugaacacaguggcgcgucacauaauauauugguagaaguacaagaugauggaaccaugaaaauaaaggacgaagagagagacgauacucuaacaaucuuacugaaagcuacccuauuagccgucucugguguuuaccccuugucgauacccgcgacgcucuuuguaugguauuuuuggcaaaagaagaaacaacguagcggagucuuaugggacacgccguccccaccagaaguugaaagggcuguauuagacgauggaauuuacagaauuaugcaacggggucuacuuggaagaucgcaaguuggugugggcguauuucaagaaaauguguuccauacaauguggcauguuacuagaggugcgguauuaauguaccaagggaagagacuggagccuucaugggcaagugucaagaaagaucuaauuuccuaugggggcgguuggaggcuccagggaagcuggaauaccggggaagaaguccaaguuauugcaguagaaccggggaaaaaucccaaaaauguacaaacugcuccuggaacguucaaaacuccagaaggagaaguuggugcaauugcauuggauuuuaaaccuggcacgaguggcucgccaaucgucaauagagagggcaagauaguaggcuuauauggcaauggcguaguaacaacgaguggaacuuauguaagcgcaauagcacaagcuaaagcgucacaagagggcccuuugccugaaauagaagaugaaguauuuaggaaaaggaaucuuaccauaauggaccuucauccaggaucagggaagacacgacgauauuugccggcuauuguccgggaagcaauaaaaaggaaguuacgaaccuuaauacuagcaccuacccguguugucgcuucagagauggcugaggcuuuaaaaggaaugcccauacgcuaccaaacaacugcaguuaagucagaacauacaggaaaagaaauuguugauuugaugugucaugcuacguucacaaugcguuuacuaucuccuguuaggguacccaauuacaauaugauaauaauggacgaagcgcauuucacugaucccucgaguauugcagcacgaggauacauaucgacccgagucgggaugggugaggcugcagcuaucuuuaugaccgcuacuccaccugguucgguagaagcauuuccccaaucuaaugcaguuauacaagaugaggagcgagacauaccagagagauccuggaacagcggcuaugaauggaucacugauuucccagggaaaaccguaugguuuguaccuucuauaaagagcggcaacgacauugcgaauugucucaggaaaaauggaaaacggguaauacagcuaucuaggaaaacauuugauaccgaauaccaaaagacgaaaaauaacgauugggacuauguagucacaacggacauuucagaaaugggagcgaauuuccgagccgaucgaguaauagauccuaggaggugucucaaaccaguaauccuuaaagacgguccugagagaguaauacuagcuggcccuaugccaguuacgguagcaagcgcggcccaaagacgcggacgaguuggacgcaaucauaauaaagaaggugaccaauacauauauaugggacaaccacuuaauaaugaugaagaucacgcucacuggacagaagcuaaaaugcuguuggacaacauuaacacgcccgaagguaucauaccugcauuauuugaacccgaaagggaaaaaucggcggccauagauggggaguaucgguuaagaggagaagcaagaaaaacuuucgucgaguuaaugcgaagaggggaucuacccgugugguuaagcuauaaaguugccuccgaaggguuccaguauucagauagacgauggugcuuugacggugagcgaaacaaucaagugcucgaagagaacauggauguugagauauggacuaaagagggagaaaggaagaaacuaagaccucgauggcuugaugcaagaacauacagugacccucucgcuuuacgugaauuuaaagaguuugcugcugggcgacgaucgguaucaggcgaccucauacucgaaauuggcaaauuaccacaacaucucacgcaaagagcccaaaaugcuuuagauaaccuuguaauguuacauaauucagaacaaggcgggagagcauaccgacacgcuauggaagaacuacccgauacaauugaaacccuuaugcuacucgcuuuaaucgcgguauuaacagguggagucacccuguucuuccucucgggccggggccugggaaaaacgucaaucggacuguugugcguuauggcaagcuccguauuauuauggauggcauccguggagccgcauuggauagcagccuccauuauucuugaauuuuuccucauggucuuauugauucccgaacccgaccgacagcggacuccucaagauaaucaacuagccuacgugguaauuggauuacuauucaugauccuaacaguggcagcuaacgaaaugggcuuguuggagacaaccaagaaagacuuagguauagggcauguugcaguugaaaaccaccaccacgcggcaaugcuugacguagauuuacacccggccagcgcguggacucuuuacgcggucgcaacaacaauuauaacccccaugaugcgucacaccaucgaaaacacgacugccaauaucucguugacugcgauagcgaaucaggcagcaauuuuaaugggguuggacaaaggcuggccaauaaguaaaauggauauaggagugccucuucuugcucuuggauguuauagucaaguaaauccacuuacuuuaacggccgcaguguuaauguugguugcacauuaugcuauuauuggaccuggcuugcaggcuaaagcuacacgcgaagcacagaaaagaacagcugcuggcauaaugaaaaauccgacuguagacggaauuguugcuauagacuuagauccuguaguguaugaugcaaaauucgaaaaacaguuaggucagauaauguugcugauucuaugcacuagccaaauacuguuaaugcgaaccacaugggcuuugugugaaucaaucacguuagcuacaggacccuuaacaacacuaugggaagggagcccaggcaaauucuggaauacaacuauagcaguaucgauggcaaauauuuucagagguucguaucuagcaggggcaggauuggcauuuucucuaaugaaaaguuuggguggaggccgcagggguacuggggcacaaggggaaacgcuuggggaaaaauggaaacgacaauugaaucaacuaagcaaauccgaauuuaauaccuauaaacgaagugguauaauggaaguagauagaucugaagcgaaagaaggauugaagagaggggaaacaacaaagcaugcugugucucgagggacggcgaaauugagaugguucguugagcgcaaccugguaaagccugaaggaaaaguuauugaccuagguuguggacguggaggcuggaguuacuauugugcagggcucaagaaaguuacagaagugaaaggguacaccaaaggggguccaggacaugaagaacccauucccauggcuacuuauggcuggaacuuagugaagcugcacuccgggaaagauguauucuuuauaccuccagagaaaugugauacauuguugugcgauaucggggaauccagucccaauccaacuaucgaggaaggucgaacacuaaggguacuaaaaaugguagaaccgugguuaagaggaaaccaguuuugcaucaagauacugaauccuuauaugccgucggucguugaaacuuuagagcaaaugcaaaggaagcauggagggaugcuaguaagaaauccucuaagccgaaauagcacccacgaaauguauuggguaucuuguggaacagguaacaucguuagugcuguaaauaugacaucucgaaugcuccuaaacagauuuaccauggcgcaccggaaaccuacguaugaaagagauguggauuuaggagcaggcacuagacauguggccgucgaaccagagguggcaaauuuagauauaauaggucagcgaauagaaaacauaaaacaugaacacaaaaguacauggcacuaugaugaagauaacccauacaaaacgugggcuuaucaugggucuuaugaagucaaacccucagggucugcuucuucaaugguaaacggaguuguaaagcugcuaaccaaaccgugggauguaauaccuaugguuacacaaaucgcuaugacugacacuacaccuuucggucaacaacgcguuuucaaagaaaaaguugauacaaggacgcccaaagcaaaaagggguacgacacaaauuauggagguaacugcaagaugguuaugggguuucuuaucaagaaauaagaaaccacgcaucugcaccagagaagaauuuacaagaaagguacgaucgaacgcagcuauaggcgccguguucguagaugagaaucaauggaauagcgcaaaggaagccgucgaagacgagagguucugggaccuuguacacagggaaagagaauuacauaaacagggaaaaugcgcaacauguguauauaacaugauggguaaacgggagaagaaguuaggagaauuugguaaagcgaaagguagccgugcaaucugguauauguggcucggcgcaagauuccuagaguucgaagcacuugguuuuaugaaugaagaucauugguuuagcagggaaaauagucugaguggcguagaaggcgagggacuacauaaguuggguuauauuuuaagagauauaucuaagauaccuggggguaauauguacgcagaugauacagccgguugggacacaagaauaacagaagaugaccuacagaacgaggcaaaaauaacagauauuauggagccggaacacgcucuauuagcgaaagcaauauuuaaguuaacguaucaaaauaagguuguucgggugcaaagaccggcgaaaaaugguaccgucauggacguuauuagccgacgagaccagagaggaucgggucaaguaggcacauauggucuaaacacuuuuacaaauauggaagcacaauuaauaagacagauggagucagaaggaauuuucucgccaagugaauuagaaacaccaaauuuagccgaaagagugcucgauugguuggagaaauauggagucgaacgguuaaaacgaauggcuaucucuggagaugauuguguaguuaaaccgauugaugaccgauuugcaacagcgcucacagcacuaaaugacaugggcaaaguccgcaaagauauuccacaaugggaaccaagcaaaggauggaacgauuggcaacaaguaccauuuugcucgcaucacuuccaucaauuaauaaugaaagauggccgcgaaaucgucgucccuugucgcaaucaagaugaacuuguaggccgagccaggguuagccagggcgcgggcuggagcuuaagagaaacagcauguuugggaaaaucguaugcucaaauguggcaguuaauguauuuucauaggagagauuuaagacuugcugcaaaugccauaugcucagcaguaccugucgacugggugccaacgagcagaacuacauggucaauucaugcacaucaucaauggaugacgacugaagacauguuauccgucuggaaccguguguggaucgaagagaauccguggauggaggauaaaacacacgucucaaguugggaagauguaccuuauuugggcaaacgagaagaccaauggugugguucacuuauaggguuaacugcaagagcaacuugggcuacgaauauucaaguagcgauaaaucagguaagaagauuaauaggcaaugaaaacuauuuagauuauaugacaagcaugaaaagauucaaaaaugaaagcgaucccgaaggagcucuuugguaa

SEQ ID NO: 22065 - RNA, 9879 nt, Artificial Sequence
  derived and/or modified CDS sequence (opt6) from DENV-1__KC762644__SS-prME
ucagugacgaugcucuugaugcuuaugccgacagcccuggcuuuccauuuaacuacaagagggggagaaccccauaugauugugagcaaacaagaacguggaaaaagucugcucuuuaaaacaagcgcagggguaaauaugugcacacuaauugcaauggacuuaggagaacucugcgaagauacacucacauauaaguguccacgaaucacggaagcagagccugaugauguagauugcugguguaacgcuacagacaccuggguuacauacggaacuuguucccaaacaggcgaacaccgaagagacaaaagaucgguagcucuggcaccacaugucgguuugggccuagaaacccguacagaaacguggauguccucugaaggugcauggaagcaaauucaacgcguagaaacaugggcacuaaggcauccaggguuuacaguaaucgcacuguuucuugcacacgcuauuggaacaucaauuacccaaaaaggcauaauuuuuauacuucuaaugcuugugacgccaaguauggcgaugcgaugcgucgggauagguagccgugacuucgucgaaggauuaucuggugcaaccuggguagacguaguacuagaacacggaaguugcguaaccacuauggcaaaggacaagccuacccuagacauagagcuacuaaaaacugaaguaacaaacccagcuguacucagaaaauuguguaucgaagcaaaaauuagcaauacuacgacagauagccgauguccaacacaaggagaagcaacccuaguagaggagcaagaugccaacuuuguaugucggaggaccuuugucgacagagguuggggaaaugggugcgguuuauuugggaaagguucucuaauuacaugugcgaaguuuaaaugcguaacaaaauuagagggaaagauaguacaauaugaaaaucucaaguacagugugauaguaacuguccacaccggagaucaacaucagguaggcaaugaaucaacagaacacggaacgacagccacgauuacaccccaagcaccgaccacagagauacagcuuacagauuauggugcacuuacccuagauuguaguccacguacaggucuagauuuuaaugagauggucuuacuuacuaugaaagagaaaaguuggcuuguucacaaacaaugguuuuuagauuugccccuucccuggacaagcggagcgagcacuucgcaagagacuuggaacagacaagauuuauuggugacauucaaaaccgcgcaugcuaagaaacaagaagugguaguuuuagguucccaagagggagcuaugcauacagcgcuaacaggugcgacugagauccagacaucggguacuacaacuauuuucgcugggcaccuaaaaugucgacuaaaaauggauaaacuuacauuaaaaggcaugaguuauguuauguguacugggucauuuaaacuugagaaagaaguagcagaaacucaacacggaacuguguugguccaaaucaaguacgaaggcacugacgcuccgugcaagauaccauuuaguacacaggaugaaaaggguguuacacaaaacggacgucucauaacagcuaaccccauugugacagacaaagaaaagcccguaaacauagaggcugaaccaccauuuggcgaaagcuacauaguaauuggagcgggagaaaaggcauuaaaacuaaguugguuuaagaaagguucaucuauuggcaagauguucgaagcaacugcaaggggagcucgaagaauggcaauauuaggugauaccgcgugggacuucggauccauagguggcguauuuacuagcguaggaaaauuaguacaucagauauuuggaacagcauacgggguucuauucucuggaguuagcuggacuaugaaaauaggcauaggaguucuauuaaccugguuaggucucaauagccgauccaccagcuuaagcaugaccugcaucgccgucgggcugguaacucucuaucucggaguaaugguacaggcagacucgggauguguaauaaacuggaaagguagagaauuaaaauguggaagcggcaucuuugugacuaacgaaguccauaccuggacugaacaguauaaauuccaagcugauaguccuaaacgauuaagugcagcuauaggaaaagcgugggaagaagguguaugcgguauacggagcgcaacuagacucgaaaacauaauguggaaacaaaucucuaaugaauuaaaccauauauuacuugaaaaugacaugaaauuuacaguagugguuggagacguugcggguaucuuagcucaagggaaaaagaugaucagaccccagccgauggagcauaaauauaguuggaaauccugggguaaggccaagauaauaggugcagaugugcaaaauacaacauucauaauagacggccccaacacuccagagugcccagaugaucaacgugcauggaauaucugggagguagaagauuauggcuuuggcauauucacgacgaacauuuggcugaaauuacgugacagcuauacacaggugugcgaucaucgucuaaugagcgcagcgauuaaagacagcaaggcaguacacgcagauaugggguauuggauugaaucugagaagaaugaaacauggaaacuugcuagagcgucauuuauagaagugaagacuuguauauggccgaagucacauacucuauggaguaauggaguacuagagagcgaaaugauuauaccaaaaauauacggaggaccaauaucacaacacaauuaucggccaggauauuucacacagacugcaggaccuuggcaccuaggaaaauuagagcuagacuuugaccuuugcgaaggaacaacuguugucguugaugagcauuguggaaaucgaggaccauccuuaaggacaacaacagucacuggaaaaauaauucacgaaugguguugccguucauguacucugccacccuuaagauuucgaggagaggauggaugcugguacgggauggaaauaagaccaguaaaagagaaggaagaaaaccuaguaaaaucaaugguuucugccggaucuggagagguagacaguuuuucauuaggacuuuuaugcaucagcauuaugaucgaggaaguaaugcguuccagauggagcagaaaaaugcuuaugacagguacgcuagcaguauucuucuuacucaucaugggucagcuaaccuggaaugauuuaauaagauuauguauaaugguaggugcgaacgccucagaucgaaugggaauggguacuacauacuuagcauugauggcaacauuuaaaaugcgaccuauguuugcaguagguuugcuauucagaaggcuaaccucuagggaaguacuguuacuaaccauuggucuuagucuugucgcuucaguagaacucccaaauaguuuggaagaacuaggugacggacuggcaauggguauaaugauuuugaaauuacuuacagauuuucagucucaccaauuaugggcaacacuguugucucuaacuuucauuaaaacuacauuuagucuacacuacgcguggaagacaauggcuaugguacuauccauaguuucucuauuuccauuaugccuguccacaacaucacagaaaacaacauggcuucccgugcugcuaggaucacucggcuguaagccuuuaacaauguuucuaauugccgaaaauaagauuuggggucguaaaaguuggccauuaaaugagggcauaauggcaguugggauuguauccauuuuacuaagcagcuuacuuaagaaugauguaccacucgcagguccauugaucgcgggagguaugcuuauagcaugcuauguaauuucagguucaucugcagaccuuuccuuggaaaaggcagcagaaguuucaugggaggaagaagcagaacauaguggugcuucccauaacauauuaguggaaguccaagaugacggaacgaugaaaauaaaggaugaagaaagagaugacacuuuaacaauccuacucaaggcaacuuuacuugcuguaaguggcguuuaucccuuauccauccccgcaaccuuguucguaugguacuucuggcagaaaaagaaacaaaggagcggcguauuaugggacaccccaagucccccagaaguggagcgagcaguauuagacgaugguaucuauagaauuaugcaacguggauuauuaggucgaagccaaguugggguuggaguuuuucaagagaauguguuccauacaauguggcacguaacaagaggagcaguacucauguaccaagggaagagauuggaacccuccugggcuagcgucaagaaggauuuaauaucauauggugguggcuggcgacuacaagggucauggaauacaggagaagaaguacaaguuauugcuguugaaccggguaaaaacccuaagaacguccaaacagcgccggguacauuuaaaacaccagaaggagaggugggugcuaucgcucucgauuuuaaaccagguacaaguggcaguccgauuguaaacagagaaggaaagauaguaggccuuuacgguaacggcgucguaacaaccagugguacauacgugucugccauugcacaagccaaagcaagucaggagggcccuuuaccagaaauagaagacgaggucuuccguaaaagaaaucugacuauuauggauuuacauccaggaucaggcaaaacccgacguuacuuaccugcuauugucagggaagccauuaaacgaaaacuuagaacacuaaucuuggcaccuacgagaguuguugcaucagagauggcggaagcacuuaaaggaaugccaauacgauaucaaacaaccgcgguuaagucugaacauaccggaaaagaaaucguugacuuaaugugucacgcgacuuucacaaugagauuauuauccccggugagggucccuaacuauaacaugauaaucauggaugaagcccauuucacugauccaucuucgauagcugccagaggauauauauccacaagaguagggaugggagaagcagcagcaauauucaugacagcaacuccgccaggaucuguagaggcguucccccagucaaaugccgucauccaggaugaggaacgagauauaccagagaggucguggaauagcgguuaugaauggaucaccgauuuuccaggaaaaacaguaugguuuguuccaaguauuaaaucgggcaaugauauagcuaacuguuuaaggaaaaauggcaaaagaguaauccaacucagcagaaagacauuugauacagaauaucagaaaacuaaaaacaaugacugggauuacguaguaacuacagacauuucagaaaugggagccaauuuucgggcagauaggguaauagauccucgacguugcuuaaaaccagucauucuaaaggauggaccagaacgcguuauucuggccggaccuaugccaguuacgguugccagcgcugcccaaaggagagggagaguuggacggaaucacaauaaagaaggcgaccaguacauauacaugggccaaccgcuaaacaaugacgaagaucaugcacauuggacggaagcaaaaaugcuccuggauaacauaaauaccccugaaggaaucauaccagcgcuuuuugagccagaaagggagaaaagugcggcaauugauggagaguaucgacugcguggagaagcacguaagacuuuuguagaacuaaugaggagaggcgaccuccccguauggcuguccuauaaagucgcaucugaaggcuuucaguacagcgaucgucgcugguguuuugacggcgaacgaaacaaccaaguacuugaagaaaacauggaugucgaaauauggacaaaagaaggagaaaggaagaaauugcgaccacguugguuagaugcacgaacauacucagaccccuuagcguuaagagaauuuaaggaguuugcugcuggacgaagaucggugucuggcgaucuaaucuuggaaaucgguaaacucccacagcaucugacccaacgagcucagaaugcucuagauaauuuagugaugcuccacaauucagaacagggaggaagggcguauagacaugcaauggaggaacuaccugauacuauugaaaccuuaaugcucuuagcauugauagccguauuaacgggcggaguaacccuauuuuuccuaaguggucgaggacuaggaaaaacuucgauuggguuauuauguguuauggcaagcuccguucucuuauggauggcuucaguagaaccacauuggaucgcugcaaguaucauauuagaguuuuuccuaaugguuuugcuaauaccugagccggaucgccaaagaaccccgcaagacaaucaauuggcguacgugguuauaggccuacuauuuaugauacucacgguagcugcuaaugaaaugggucuacuagaaacaacuaagaaagaccuaggaauuggccacguagcaguggaaaaucaucaccaugcagcaauguuagauguggaccuacauccugccuccgccuggacccuuuaugcggucgcaaccacaauuauaacgcccaugaugcgucauacaauagaaaauaccaccgccaauaucucuuuaacagcaaucgcaaaucaggcugccauauuaaugggauuagacaaagguuggccuauuucaaaaauggauauaggaguaccuuuguuagcauugggauguuauucgcaaguuaacccguuaacgcugacagcagcuguacuuaugcuaguagcacauuaugcgaucauaggaccaggacuacaggcgaaagcgacacgugaggcacagaaaagaaccgcugcaggaauuaugaaaaauccgacuguggacggaaucguugcuauagacuuagauccaguaguauacgaugcgaaauuugaaaaacaauuagggcagauuaugcuacuaauuuuauguacaagucaaauauuauuaaugcguacaacaugggcacuaugugaaaguauaacucuagcaacaggaccccuuacaacauugugggaggggucaccaggcaaauuuuggaauacaacaauagcuguaaguauggcuaacauauuuagaggaagcuacuuggccggugccgguuuagcauuuagucuaaugaaaucauugggagguggucgucgcgguacgggagcucaaggugaaacgcuuggggagaaguggaaacggcaauuaaaucagcuuagcaagagugaguucaauacuuacaaaagaaguggcauaauggaaguagaucggagugaggcaaaggaggguuugaaacgaggugagacuacaaaacacgcuguauccagagguacagcuaaacugcgaugguuuguggaaaggaaucuuguaaaaccugaaggaaaaguuauugaucuuggcuguggucgagguggguggucauauuauugugcugguuugaaaaagguaacagagguuaaaggcuauacuaaagggggacccggucaugaggaaccaaucccaauggcuacauacggauggaacuugguuaaauuacauucuggcaaggauguauucuuuauacccccagaaaagugugauacauuacuaugugacaucggagagucuucucccaacccaacuaucgaagaaggucguacucuccguguauugaaaaugguagagccaugguuacgagguaaccaguucuguauuaaaauucuaaacccauauaugccuucaguagucgagacgcuagaacaaaugcaaaggaaacaugggggcaugcuuguacggaacccuuuaucaagaaauaguacacacgaaauguauuggguuucuugcgguacgggaaauauuguaucugcaguuaauaugacgucacguauguuacuaaaucgguucacgauggcccacagaaagccaacauacgaaagggacguagaccucggcgcagguacacggcacguagcuguagagcccgagguugcuaauuuggauauaauagggcagagaauagaaaauauaaaacaugaacauaagaguacuuggcauuaugaugaggauaauccauauaagacaugggccuaccacgguucauacgaaguaaaaccuagcgggucagcaucaucuaugguaaacggcgucgugaaacuucuaacaaaaccuugggauguaauacccauggugacacaaauagcaaugacggacaccacaccauuugggcaacagagaguauucaaagaaaagguagauacacgcacuccgaaagcaaagcgaggaacaacacagauaauggaaguaaccgcaagaugguuauggggguuuuuaaguagaaauaagaaaccacgaauauguacuagggaggaguucacacgaaaaguaaggucaaaugcagcgauuggagcuguauuuguugacgaaaaucaauggaacucggcuaaagaggcuguugaagacgaaagauucugggauuugguccauagagagagagaguuacauaaacaggggaagugcgcgacguguguauauaacaugaugggcaaaagggagaaaaagcuaggagaauuugggaaagccaaaggaagcagggcaauaugguacauguggcuaggcgcaagguuucucgaauuugaggcuuuaggauuuaugaaugaagaccauugguucucgcgugaaaacucauuaucaggaguagaaggggagggauugcacaaacuaggauacauauuaagagauauaucaaaaauaccaggcgguaauauguaugccgaugauacagcuggaugggacacuaggauuaccgaggacgaccugcaaaaugaagcuaagaucacggacauaauggagcccgaacaugcacuauuggcuaaagcgauauucgaauuaacuuaucaaaauaaagucguucguguacaacgaccagccaaaaacgguacagucauggauguaauaucgaggagagaccaacgcgguucaggccagguagguacguauggacucaauacauuuacuaauauggaggcucagcugauuaggcaaauggaaucagaagguauauuuucaccuucugaauuggaaacuccaaaccuggcggaacgggucuuagacugguuagaaaaauauggaguagagcgauugaaaagaauggcaauaucaggggacgauugcgucgucaaaccgauugacgaccgguuugccacugcacuuacugcgcugaacgacauggggaaagucagaaaagacauaccccagugggaaccauccaaggguuggaaugacuggcaacaaguaccauuuuguagucaccauuuccaccaacuuauaaugaaggacggcagagaaaucgugguaccauguagaaaucaagaugaauuggucgguagagcacgugugucgcaaggagcaggauggucauuaagagaaaccgcuugucuaggcaaaucauacgcucagauguggcaauugauguauuuucauagaagggaucuacgucuugcagccaaugcaauauguuccgcuguaccgguagacugggucccaaccucacgaacaaccuggucuauucaugcccaccaucaauggaugacaacagaagauauguuaagcguguggaacaggguauggaucgaagaaaaccccuggauggaagacaaaacacacauuucaucaugggaagacguaccuuauuuagggaaacgugaagaucaaugguguggaucccuaauaggccucacagcgagggcgacaugggcaacuaauauacaaguggcuauaaaccagguacgucguuuaauaggaaaugaaaauuaucuagacuauaugaccucuaugaaacgauuuaaaaaugaauccgaucccgaaggcgcgcucugguaa

SEQ ID NO: 22066 - RNA, 9879 nt, Artificial Sequence
  derived and/or modified CDS sequence (opt6) from DENV-1__KC762630__SS-prME
agcguaaccguuuuauuuaugcucuuaccaacugcuuuagcauuccaccugacaacaaggggaggugaaccucacaugauugucucgaaacaagaaagagggaaaagccucuuguuuaaaacaagugccggggucaauauguguacauuaauugcgauggacuugggggaacucugcgaagauacaaugaccuacaaaugcccuaggauuacugagacugagccagaugauguugauugcuggugcaaugcaacggaaacauggguaaccuaugguacguguucacaaaccggggaacaucgaagggacaaacgaucugucgcccuggcaccacacguagggcugggacuugaaacucguacagaaacauggaugucguccgaaggcgccuggaaacagauacaaaaagucgaaaccugggcguugaggcacccgggauucacaguuauagccuuauucuuagcacaugccauagguacauccaucacccaaaaaggaauaauuuuuauauuauuaaugcuagucacaccguccauggcuaugagaugugucggaauagguaaccgagauuuugucgaggguuuaaguggagcuacaugggucgauguaguauuggagcauggaaguugcguaacaacgauggccaaaaauaaacccacccuggacauagaacuacuuaaaacugaaguuacaaacccggcuauacuaagaaaacuguguauagaagcaaaaauaucuaauaccacaacagauaguagauguccuacccaaggggaggccacucuuguagaagaacaagacacaaauuuuguaugucgcaggaccuuuguagauagaggauggggcaacggcuguggccuguuugguaaggggaguuugauuacaugugcaaaguucaaauguguuacuaaauuagaaggaaaaauaguacaguaugagaaucuaaaauauucaguaauuguaacaguccauacaggagaucagcaccaaguuggaaaugaaaccacggaacauggaacuacggcaauuauaacaccccaagccccuacaagugagauacaguugacagauuauggagcuuugacacucgacuguuccccaaggacagggcuagacuuuaaugaaaugguuuuauuaacaaugaaagaaaaaucauggcucguucacaaacaaugguuucucgaucuuccgcuucccuggacaucuggcgccucaacgagccaagaaaccuggaaucgacaagacuuauuaguaacauucaaaacugcacacgcuaaaaagcaagagguuguagugcugggaucacaagagggagcaaugcauaccgcacucaccggcgcuacggagauacaaaccucaggaacgacgacgauauucgcaggacacuuaaaaugucgauugaaaauggacaagcuaacacuaaagggcguaucauacguuaugugcacuggguccuucaagcuggaaaaagaaguugcagaaacucagcacggcacaguccuuguacagguaaaauaugaagguacagaugcuccguguaagauaccuuuuucaagucaagaugaaaaagggguaauacaaaauggucgacugauuacagcuaauccaauaguaacagauaaggaaaaaccugucaauauagaagcagaaccaccuuucggcgagaguuauauaguaguaggcgcuggagagaaagcgcuaaaacugaguugguucaagaaaggaucgaguauaggcaagauguucgaggcuacagcacgaggugcacgaagaauggcuauccucggugacaccgcaugggauuucggcuccauuggcgguguuuuuacaaguguagggaaacucgugcaccaaauauucgggacagcuuaugguguucucuuuaguggaguaucauggacgaugaagaucggaauuggaauauuguuaacauggcuaggccuaaauucuagaagcacaaguuuauccaugacauguauugcgguggguaugguaacgcuauauuugggugugaugguucaagcagauagugggugcguaauaaauuggaaagguagagaacucaagugcgguucggggauauucguaacuaaugaaguucacacauggacugaacaauacaaauuccaagccgauuccccuaagagacucucagcagccauaggaaaagcaugggaagaagguguuuguggcauuagaagugccaccagauuagagaauauuauguggaaacaaauaaguaaugaauuaaaccacauucucuuagaaaaugacaugaaauuuaccgucguaguaggcgauguaucaggaauuuuagcucaagguaagaaaaugauaagaccgcaaccaauggagcauaaauauucauggaaaagcuggggaaaggcgaaaauaauuggcgcggaugugcaaaauacaacauuuaucauugaugguccaaacacgcccgaaugcccggacaaucaaagggcguggaauaucugggaaguggaagacuauggauucggaaucuucacaacuaauauaugguuaaaacuuagagauagcuacacgcagguaugugaucaucguuugauguccgcagcgauaaaagacagcaaagcagugcacgccgauaugggauauuggauugagucugagaaaaacgaaaccuggaaauuagccagagcaaguuuuauagaaguaaaaacuugcauuuggccuaaaagucauacauuguggagcaauggaguacucgaaagcgagaugauaauaccuaaaauuuacggaggcccgguuagccaacacaacuacagaccuggauauuucacacagacagccggaccguggcacuuaggaaagcuggaacuugauuuugacuuaugcgaaggcacaacaguugucguugacgaaaacuguggaaacagaggaccgaguuuacgaacuacgacaguuacggguaaaacaauacacgaauggugcugucgauccugcacuuuaccaccucuucgauuuaaaggagaggacgggugcugguacggaauggagauacggccaguaaaagaaaaagaagaaaaucuugugaaaaguaugguuucggcaggcucaggugaaguagacagcuuuagucugggccuccuaugcauaaguauuaugauagaagaagucaugcguucacgauggucuagaaaaauguuaaugacagggaccuuggcugucuuucugcuucuuacaaugggacaauugacuuggaaugaccucaucagacuaugcauuaugguaggagcaaacgcuagugacaugaugggaaugggaacaaccuacuuagcauuaauggcaacauuccguaugcgcccuauguuugcuguuggacuucuuuuccgccgccuuacaucuagagaaauauuacuauuaacgguuggauuaaguuuaguggcaucaguagaauugcccaauucauuggaagaauugggagaugguuuagcuauggguauaaugauguuaaaacuguugacagauuuccaaccccaccagcuuugggcaacuuuauuaagccuuacauuuguuaagacaacacucucuuugcacuacgcuuggaaaacaauggcuaugauuuuaucaauaguaucucucuuaccauugugucuaagcacgacuagccagaaaacuacuuggcuuccaguucucuugggaaguuuaggguguaagccucuaacaauguuucugauaacagagaacaaaauaugggguagaaggagcuggccacugaacgagggaauaauggcaauugggauaguaagcauacuauuaucaucuuuacuaaagaacgacguuccauuagcugguccucugaucgcagggggaauguuaauagcauguuacgucauaucuggaucuucagcagaucuaagucuagaaaaagccgcagaagucucaugggaagaugaggcggaacauagcggggccagucacaacauauuaguugaaguccaagacgaugggacgaugaaaauaaaggaugaagaaagagaugacaccuugacaaucuugcuaaaggcaacauuacucguaaucaguggaguuuauccgaugucuguaccggcuacuuuauucgucugguacuucuggcaaaagaagaaacagcgaucaggcguucuuugggauacuccaucaccaccggaaguugaaagagcaguccuggauaauggaauuuauagaaucuuacaacgcggcuuacugggacgaagucaaguaggaguagguguauuucaagaggggguauuccauacaauguggcacguaacaagaggugcgguucuaauguaucagggaaaaagguuagaaccaucuugggcaagcgucaagaaagaccuuaucuccuaugguggagguuggagguuucaaggcagcuggaauacuggugaagaaguccagguaauugccguagaaccaggcaaaaacccgaagaaugugcaaacgacucccggcacauuuaaaaccccggaaggcgagauuggugcaauagcacuagacuucaagccggggaccagugguucgccaauuguaaauagagaaggaaaaauaguaggcuuauacgggaauggcgugguaacaacuagcgggacauacguuagugcuauagcccaagccaaaguaagccaagagggaccacuaccagagauugaagaugaaguguuccgaaagaggaaucuuacaauuauggaucuacauccugguagcgguaaaacccgcagguauuuaccagcgauuguaagggaggcaauaaaaaggaaacuuagaacucuaguccuagcgccgacucgaguaguagcgagugaaauggcggaagcauuaaaggguaugccuauuagauaucaaacaacagcaguuaagucugagcauacuggaaaagaaauaguugaccuuaugugccaugcaacauuuaccaugagacuccuaagcccagucagaguaccaaauuacaacaugauuaucauggaugaggcacauuuuacugauccagcaucaauugcugcuagagguuacauaucuacgcgaguugggaugggugaagcugcagccauauuuaugacugcaacuccaccaggcucagucgaagccuuuccucaaagcaacgccgugauucaagacgaggaacgggauauuccagaacgaagcuggaauagcggauaugaauggaucacugauuuuccagguaaaacaguaugguuuguuccaucuauaaaaucugguaacgacauagcuaacugucuuaggaaaaaugggaagaggguuguacagcuaaguaggaagacuuucgauacagaguaucagaagacuaaaaacaaugacugggauuaugucguaacaacugacauaagcgagaugggagcgaauuuuagagcugacaggguuauagacccucgaaggugcuuaaagccgguaauauuaaaagauggucccgaacgaguaauccucgcagguccgaugccaguaacaguagcuagcgcggcucaaagacgaggcagaauaggacguaaucccaauaaagaaggggaucaauacguuuauaugggucaaccucuuaauaaugacgaggaucaugcacacuggacugaagcaaaaauguuacuagauaauauuaauacaccugaagguauaauaccagcuuuauucgaaccugagagagaaaaauccgcugcaaucgacggagaauauagauuacggggugaagcacggaagacuuuuguugaauuaaugcguagaggugaucucccaguuuggcuaagcuacaaaguugcgucagaaggauuccaauacagcgauagaagaugguguuuugauggagaaaggaacaaccaaguacucgaagagaauauggacguagagauuuggacuaaagaaggggaaaggaagaaacuuagaccacguuggcucgaugcacgaacauauucagacccucuagcauugagagaguuuaaagaguucgcagccggaagaaggagcgucucgggcgaccucauucuagagaucggaaaacuuccucaacauuugacuuuaaaagcucaaaacgcuuuagacaauuuaguaaugcuacauaauucagaacaggguggaaaggcuuauagacaugcaauggaagaacuacccgacacgauagaaacuuuaauguugcuggccuugauugcagucuuaacgggaggcguuacacuauuuuuccuaagugguagaggacuaggaaagacgucuaucgggcuucuuugcgucauggcaaguucggcauuacuauggauggcuagugucgagccccacuggauugcugccucaaucauuuuagaguucuuccuuauggucuugcuaauaccggaaccagacagacagagaacaccucaagacaaccaauuggcauacguggucauaggucuucuauuuaugauucucacaguggcagccaaugaaaugggacugcuggaaaccacuaagaaagaucuggguauuggucaugccgcugcugaaaaccaucaucacgcggcuaugcucgauguugaucuucauccugccagugcauggacacuauaugcgguagccaccacgauaaucacgccaaugaugcgacauacgauagaaaacaccacugccaauaucaguuuaacagcaaucgcaaaccaagcagcgauacuuauggguuuagauaaaggguggccgauuucuaagauggacauaggaguuccucuccuggcucuuggauguuauucccagguaaauccacuaaccuugacugccgccguucucauguuaguugcacauuacgcgaucauaggcccugguuugcaggcgaaggcuacuagagaagcacaaaagaggaccgcugcgggaauuaugaaaaauccaacaguggauggaauuguggcuauagaucuugaucccguaauuuaugaugcuaaauuugaaaaacagcugggacaaaucauguuacugauacuauguaccagccaaauacuucuaaugcguacuacaugggcccuaugugaauccauuacccuagcuacaggcccgcuaacaaccuuaugggaagguagcccuggaaaauuuuggaacacuacgauugcaguuucaauggcgaacaucuucagggguuccuaucuagcaggagcaggguuagcauuuucacucaugaagucauuaggaggagguagaaggggcaccggugcucaaggugaaaccuugggagagaaguggaaaagacaauuaaaucaauugaguaagucagaguuuaacauuuauaaaaggaguggcauaauagaaguagacaggagcgaagccaaagagggguuaaaaagaggagaaacaacaaaacaugcuguaucacgugggacugcaaaauuacgaugguucguagaacgcaaucuaguuaagcccgaaggaaagguaauugaucuaggaugugggagaggggguuggucguauuauugcgcugguuuaaagaaaguaacugaaguuaaaggauacacaaaaggcggacccggacaugaagaaccgauuccuauggcaacguacggauggaaccucguuaaauuacauuccggcaaagacguauuuuucaccccaccagaaaagugcgauacuuuauugugcgauauuggcgaaucgucaccgaauccgacaaucgaggaggguagaacacuaagggugcuaaaaaugguggaaccguggcuacggggaaaucaauucuguaucaaaaucuuaaauccauauaugcccucuguaguugagacccuagaacaaaugcaaaggaaacaugguggaauguuaguccgaaauccucucagucgaaauucgacacaugaaauguauugggugaguuguggaacagggaacaucgucucggcagucaacaugacuucuagaauguugcugaauagauucacgauggcccaccgaaaaccaacauacgaacgagaugucgauuuaggcgccggaacaagacauguugcgguagaaccggaaguagcgaaccuagauauaaucggacaacguaucgaaaauauuaaaaacgaacauaaaucaacuuggcauuacgaugaagacaauccuuauaagacaugggccuaucauggaucauaugaggucaaaccgucugguucagcaucaaguauggucaauggaguaguuagauuacuaaccaaaccaugggacguaauucccauggucacccaaauagcaaugacagauacaaccccuuuuggccaacaacgcguauucaaagaaaaaguggacacccguacaccaaaagcuaaacgaggaaccgcucaaaucauggaagugacagcacgaugguuauggggguuccucucaagaaauaagaaaccuagaauaugcacacgagaagaguuuacaagaaagguuaggucuaaugcggcuaucggagcugucuucgucgacgaaaaccaguggaacuccgcgaaagaggcaguagaggacgagagauuuugggaucuaguacacagagaaagagaguuacauaaacaagguaaaugugcgacaugcguauauaauaugaugggaaaaagggagaagaaauugggagaguuugguaaagccaaagguucaagagcgauuugguauaugugguuaggcgcaagauuuuuagaauuugaggcacuuggguuuaugaacgaagaccacugguucagucgugaaaacagccucagugggguggaaggggaagggcuucacaaauuaggauauaucuugagagacauaucgaaaauaccaggagggaauauguacgcagacgauaccgccgggugggauacucgaauaaccgaagaugauuugcaaaaugaagcaaagauuacggacauaauggagccugagcaugcccuauuggccacaucgauuuucaaauuaacuuaucaaaauaaaguaguaagaguucagagaccagguaaaaauggaacggugauggacguaauaucccgaagagaucaacgugggaguggccaaguuggcacuuauggacucaauaccuuuacuaauauggaggcgcagcuaauacgacaaauggagucagaaggcauauuuucgccgucagagcuugaaacaccuaacuuagcugaaaggguauucgacugguuagagaagcauggaauagaaaggcuaaaaagaauggcgauuuccggggacgauugcgucgucaaaccaauagacgacagauuugcaacagcauuaacagcccugaacgauauggguaaaguuagaaaggauauuccacaaugggaaccaucuaagggguggaaugacuggcaacaagucccauucuguagucaucauuuccaucaauugauaaugaaagacggacgagagauaguaguuccaugccgaaaucaagaugaauugguaggaagggcaagggugucacaaggugcuggguggucguugcgugaaacugccugucuugguaaaucauaugcucagauguggcaacuaauguauuuccaccgacgugauuugagacuagcugcuaacgcaauaugcagcgcaguaccuguugauuggguaccaacaaguagaacaacauggaguauucaugcacaucaccaguggaugaccacagaagacauguuaucuguauggaacagaguuuggauagaagaaaacccauggauggaagauaaaacgcaugugucaucaugggaagauguacccuauuuagguaaacgagaagaucaauggugcgguucgcuaauugggcuuacagcuagagcuacuugggcaaccaacauacaaguagcaaucaaucaaguacgaagacuuauaggaaaugagaacuauuuagauuauaugacuucaaugaaacgcuucaaaaacgagucugaucccgaaggugcacucugguaa

SEQ ID NO: 22067 - RNA, 9879 nt, Artificial Sequence
  derived and/or modified CDS sequence (opt6) from DENV-1__KC762641__SS-prME
ucuguaaccauguuauuaauguuaaugccaaccgcucuagcauuccaccuuacgacaaggggaggagaaccacacaugauuguuucaaaacaagaaagggggaaaaguuugcuauucaaaacgucggcagggguaaauaugugcacgcuaaucgcaauggacuuaggagaauuaugcgaagauacacugacauacaaauguccgaggauaaccgaagcugaaccagacgacguugacuguugguguaacgcaaccgacaccugggucaccuaugggacgugcagucaaacaggggagcaccggcgugauaaaaggucaguugcuuuggcaccacauguaggguuaggauuagaaacccguacagaaacuuggaugaguagcgagggggcguggaagcaaauucaacggguugagacaugggcgcuaagacacccuggcuucacuguaauagcguuauuucucgcccaugcuauagguacaucaauaacacaaaagggaauaauauuuauacuguuaaugcuaguuaccccaagcauggcaaugagaugcguaggcaucggaaguagagauuucguggaaggacuaaguggugcaaccuggguagacguaguucuugaacaugguagcuguguuacaacaauggcaaaagauaagccaacguuagauauagaacuccucaaaacggaaguuacgaacccagcgguccuacgaaaguuaugcauugaagccaaaauaagcaauacaacgaccgacagcagauguccuacgcaaggggaagccacguuggucgaagaacaagacgcuaauuuuguuugucgaagaacauucguggauagaggauggggaaauggcuguggccucuuuggaaaagguagcuugauaaccugcgcgaaauucaaguguguuacuaaauuagaaggaaaaauuguacaauaugagaaucuaaaauacucugucauuguuacuguucauacuggagaucaacaccaaguuggcaaugaaagcaccgaacacgggaccacugcgacgauuacaccacaagcaccaacgacugaaauccaacugaccgauuacggcgcguugacccuagauugcaguccacguacugguuuagauuuuaacgaaaugguacuuuugacuaugaaggagaaaaguuggcuuguacacaaacaaugguuccuggaccuaccccugcccuggacaucuggggcgagcacuagccaagaaacauggaacaggcaagaccuccuaguuacauuuaaaacagcacaugccaagaaacaagaaguugucgugcugggcagucaagaaggugcgaugcacacagccuugacgggggcgaccgaaauacaaacaucugguacuaccacaaucuucgcgggccaccugaaaugucggcuuaaaauggacaaauugacuuuaaaaggcauguccuaugugauguguaccgggucauuuaaauuggaaaaagaaguugcugaaacucaacauggaacaguucuuguacaaauaaaauacgaggggacggaugcacccuguaaaauaccuuuuucgacacaagaugaaaaagguguaacucagaacgggaggcuuauuacagcuaauccaauagucaccgauaaggaaaaaccggucaauauugaggcagaaccuccauuuggagaaagcuauauaguuauaggcgcaggggaaaaagccuugaaauuaagcugguucaagaaaggaucuucaaucgggaaaauguuugaagccaccgcacguggagcacgccggauggcuaucuuaggugauacagcuugggacuucgguucaauuggaggcguauuuacaagcguaggaaagcuaguacaucagaucuuuggaacggcuuauggaguacuuuucucaggaguuucguggacaaugaagauuggcauaggaguacuacuuaccuggcuuggucuuaauaguagaucgacuucauugucaaugacauguauagcugugggccugguuacucucuaucucggaguaaugguucaagcugauucuggcuguguuaucaauuggaaagggcgcgaauuaaaauguggaucagguauauuugucaccaacgaagugcauacuuggacggaacaguauaaauuccaggcugauucaccuaagagacuaagugcugccauaggcaaagcaugggaagaaggaguguguggaauacguuccgccacuagauuagagaauauuauguggaaacaaauaaguaacgaacucaaucauauacuucuggaaaacgauaugaaauucacggucgucguuggugaugucgcuggcauucucgcccagggcaagaaaaugauucggccucaacccauggaacacaaauacaguuggaaaucauggggcaaagcuaagauaauaggugcagauguccagaauacgacauuuauaauagaugggcccaacacaccggaauguccggaugaucaaagggcguggaauauaugggaaguugaagauuauggguuugggauauuuacaacgaacauaugguuaaaguuaagggauucauacacacaagucugugaucacagacuuaugucagcugcaauaaaggacaguaaagcggugcaugcggauaugggcuauuggauagaaagcgagaaaaaugaaacuuggaaauuagcaagagcaucauuuauagaagucaagaccugcaucuggccuaaaagccacacauuauggucgaauggcguacuugaaucagaaaugauuauuccuaagaucuauggagguccaaucucccaacauaacuauaggccuggauacuuuacacaaacagcagguccauggcacuuagguaaacuugaauuagauuuugaccuaugugaagguacgacaguuguaguagacgaacauuguggaaaccgaggaccaucacuacgcacaacgacagucacagggaaaauuauucacgaaugguguugucgauccuguacccuacccccauuacgauuuagaggagaagaugguugcugguaugguauggaaauacguccugucaaagaaaaggaggagaaccugguuaaaaguaugguaucagcaggaaguggcgaaguagacuccuucucucuggggcugcuauguauuucaauaaugauagaagaggucaugaggagccgauggucgagaaaaauguuaaugaccggaacauuagcuguauucuuuuuauuaauaaugggucaauuaaccuggaaugaccuaauacgacuauguauuaugguuggagcaaaugcuagugacagaaugggaaugggaacaacauauuuagcucuaauggcuacguuuaaaaugagaccuauguuugcaguaggacuucuuuuccgcagacucacuucucgugagguuuuacugcucacgauagggcuaucuuuaguugcuaguguagaauuaccaaauagcuuagaagaauuaggggaugguuuggcaaugggcauaaugauucuaaaguuacuaacugauuuucagucucaucaauugugggcaacgcuucuuagccuaacguucauuaagacuacauucagcuuacacuaugcauggaaaacgauggccaugguccuaaguauagugucuuuauuuccauuaugcuugucaacgaccagucagaaaacaacaugguuacccguauuguuaggcucgcuggguuguaaaccacucaccauguuccuaauagcggaaaauaaaauauggggucggaaaucauggccguuaaaugaagguauaauggcaguagggauaguaaguauccuuuuaagcucucuacuuaagaacgauguaccccuagcagguccccuuauugcaggagggauguuaaucgcauguuauguaauaaguggaagcagcgcagaccucuccuuagaaaaagcugcugaaguuucaugggaagaggaggcagaacacaguggggccagucauaacauacucguagaagugcaagacgaugguaccaugaagauaaaagaugaggagcgagacgauacccuaacaauacuccucaaagcaacguugcucgcaguuucugggguauauccacuaucaauaccagcuacuuuguucgugugguacuuuuggcaaaagaagaaacagagaagugguguuuuaugggacacaccauccccaccggaaguagaaagggccguacuagaugauggaaucuauagaauuaugcaaagaggucuauuaggcagaucccaaguugggguaggcguguuucaggaaaacguauuccauacuauguggcaugugacaagaggggcaguccuuauguaccaaggcaaaagguuagaaccaagcugggcuucagucaagaaagaucuaaucucauauggaggaggauggagacuacagggaucauggaacacgggggaggagguacagguuauagcgguggagccugguaaaaaccccaaaaacguacaaacggcgccagggaccuuuaagacaccagaaggagaaguuggggcaauagcguuagauuucaaaccggguaccaguggauccccaaucguaaaccgagaagggaagaucguagggcucuaugguaauggaguuguaacaacaucaggcaccuauguaucagcgauagcacaggccaaggcgucacaagaggggccuuuacccgagauugaagaugagguuuuucggaagagaaaccucacaaucauggauuuacauccagguaguggaaaaacaagacgauaccuaccugcuauaguucgagaagccauuaaaaggaaauuacggaccuuaauauuagcuccuacuagaguaguggcgucggaaauggcggaagcacucaagggaaugccuauuagauaccaaacgacagccguaaaauccgaacacacaggcaaagaaauaguagauuugaugugucaugccacguuuacgaugagacuauuaaguccaguaagaguaccaaacuauaacaugauaauuauggaugaagcucauuucacagacccgagcaguauugcagcuagaggcuacauauccacccgaguuggaaugggagaagccgcugcaauauuuaugacggcuaccccucccgguucuguggaagcauuuccccagaguaaugccguaauacaagacgaggaaagagauauucccgaacgauccuggaauagcgguuaugaauggauaacugauuucccgggcaaaaccguuugguucguuccguccauuaaaucaggcaacgauauugcaaacugucuacguaagaaugggaagcgaguaauacaauuaagucgcaaaacauucgauacugaauaccagaaaacuaaaaacaaugacugggacuauguaguuacuacugauauaagugaaaugggugccaauuucagggcugaccguguuauagauccacgcagauguuuaaagccugucauauuaaaggacggaccagagagaguaauucucgcaggcccaaugccgguaacaguagcaagugccgcccaaagaagaggucgaguaggaagaaaucauaauaaagagggugaccaguauaucuauaugggccagccauuaaacaaugaugaagaccaugcacauuggacagaagcaaaaauguuguuagauaauauuaauacuccagaggguauuauaccggcccucuuugaacccgaacgagaaaaaucggcggcuauagauggggaguauagacuuagaggggaagcaaggaaaacauucguugagcuaaugagacgaggagaucuaccaguguggcugucauacaagguugcuagcgagggguuucaguacucagaucgucgauggugcuucgauggagaacgaaacaaucaaguuuuggaagaaaauauggauguagaaauauggaccaaagaaggcgagagaaagaagcugaggccaaggugguuagacgcaagaaccuacucugacccguuagcauugagagaguucaaagaauuugcggccggaagaaggucaguaucgggugauuuaaucuuagagauugggaagcucccgcagcauuuaacucaaagggcgcaaaaugcccuagacaacuuaguuauguugcacaacagcgaacaaggaggccgugcauacagacaugcaauggaagaauuaccugauacuaucgaaacuuuaaugcuacuagcgcuaauagcgguccuuacugggggcgugacacucuuuuucuuauccggacgaggucucggaaaaacaucuauaggauuacucuguguaauggcuucgaguguucuacuauggauggcaucaguggaaccucauuggauagcugcuagcauuaucuuggaguucuucuuaaugguauuguuaauucccgagccagauagacaacgaacuccgcaggauaaucaacuugcguauguaguaauaggacuguuauucaugauauuaaccguaacagcaaacgaaaugggucugcuugaaacaacgaagaaagaccuggggauuggucauguagcaguggaaaaucaccaccacgcugcgaugcuagauguagauuuacacccugccagugcuuggacacuauacgcaguugcgacaacuaucaucacgccuaugaugcgccauaccauagaaaauacgacagcaaacauuucacuaacugcaauagccaaccaggcagcuauauugauggguuuggacaagggauggccaauaaguaaaauggauauaggagucccuuuauuggcuuuaggcugcuauucccaaguaaacccauuaacguugacugcagcuguccucaugcuaguggcgcauuaugcgauaauaggaccaggauuacaagcuaaagcuaccagagaagcucaaaagagaacagcugcugggauaaugaagaauccuacuguggauggcauaguagcuauagauuuagauccaguaguguaugaugcgaaguuugaaaaacagcuaggucaaauaaugcuacugaucuuaugcacgucccagauucuacuaaugcggacaacgugggcacuuugcgaaaguauuacacuagcaacuggaccauugacaacccuuugggaaggaucaccagggaaauucuggaacacaacuauagcaguaagcauggcuaacauauuuagaggaaguuauuuagcuggcgcaggauuagcauucaguuuaaugaagucauuagggggcgggagacgaggaacuggagcacagggagagacguuaggagaaaaauggaaaaggcaguuaaaucaacuuucuaaaagugaguucaauacuuacaaaagaucagguauaauggaaguagauagaagugaggcuaaagaaggccuaaaaaggggugaaacgacaaagcacgcuguaucacgugguacggcgaaauuaagaugguucguagagagaaaucuaguaaaaccagaagggaaggucauugauuuaggauguggacguggcggauggucuuauuauugugcuggucuaaagaaaguaacagagguaaaaggauacacuaagggugguccaggacacgaagaaccaauuccgauggcaacauauggauggaaucucguaaaauuacauagugguaaggauguauucuuuauaccacccgaaaaaugugauacucugcugugugacauaggugaauccucaccgaauccgacuauugaagaagguagaacauuaagagucuugaaaaugguugagccaugguuacgagguaaucaauucugcaucaaaauccugaacccauauaugccaucaguuguagaaacgcuagaacaaaugcaacgaaagcauggaggaauguuagucagaaacccccucucuagaaauagcacccacgaaauguauuggguaagcugcggcacugguaauauaguuucagcggugaacaugacaucucgaaugcuucuuaaucgcuuuacaauggcacauaggaaacccacauaugagagggauguggaucuaggugccggaacacgucacguagcagucgaaccagagguagcaaacuuggauauuauuggacaacgcauagagaauauuaaacaugaacauaaaucaacauggcauuacgacgaagauaauccuuauaaaacaugggcuuaccacggauccuaugaaguaaaacccucaggaucagcgagcagcaugguaaauggagugguaaaauugcuuacaaagccuugggacguaauaccuaugguaacacagauagcgaugacugacacuacaccuuuuggucaacaaaggguuuuuaaagagaagguugauaccagaacuccaaaggcgaaacguggcacaacgcaaauaauggaagucacugcccguugguuauggggauuuuuaagccggaauaagaaacccagaaucugcacaagggaagaguuuacaaggaaaguaagaagcaaugcagcaauuggugcaguauucguugaugaaaaccaguggaacucagcaaaggaagcuguagaagacgagcgguucugggacuugguucaccgggaacgagaauuacauaaacaagguaaaugcgcaacaugcguauauaauaugaugggaaaacgagagaagaaauuaggcgaauuuggaaaagcuaaagggagccgagcuauaugguauaugugguuaggagcaagauuccuagaguuugaagcguuaggcuucaugaacgaagaccacugguuuucgagggaaaauagucuuaguggaguagaaggagagggacuccacaaacuagguuacauucugagggauauauccaaaauaccugguggaaauauguacgcggaugacacggcuggaugggacacuagaauuacggaagaugacuugcaaaaugaggcaaaaaucacugauauaauggagccugaacaugcguuauuagccaaagccauauuuaaacuaacauaucagaauaaagugguucggguacaaagaccggccaaaaauggaacaguuauggacguaaucaguagacgagaucaacggggauccggacaaguggguacauauggucuaaauacauuuaccaauauggaggcacaacugauaagacaaauggaaagugaggguauuuuuaguccgucugaauuagaaacgccuaaucuggcagaaagaguucuagauuggcuggaaaaauaugguguagaacguuuaaagagaauggcaauaagcggugacgacuguguagugaaaccaauagacgaucgcuuugcgacagcguuaacggccuuaaaugacaugggcaaaguacgaaaggacaucccccagugggaaccaaguaaaggauggaacgauuggcaacaaguuccuuuuugcucucaucacuuccaucaauugauuaugaaagauggacgagaaaucgugguaccaugcaggaaccaagacgaauuaguaggaagggcucgugucagccaaggagcagguugguccuugcgagagacggcgugucuaggaaagucguacgcacaaauguggcaacuuauguacuuccaccguagagaucuuagauuagcggcaaaugcaauaugcagcgcagucccuguugacuggguaccuacauccagaacaacguggaguauucaugcucaccaccaauggaugaccacugaagacaugcuaucuguuuggaauagaguauggauagaagaaaaucccuggauggaggauaaaacucacaucaguucaugggaagauguccccuacuuagggaaacgggaagaucaauggugugguagcuugauuggucuaacugcccgcgcaacaugggcgacuaacauacagguugccauaaaucaaguucguaggcuaauaggcaaugagaacuauuuagacuauaugacaaguaugaaaagauuuaaaaaugaaagcgauccugaaggcgcacuaugguag

SEQ ID NO: 22068 - RNA, 9879 nt, Artificial Sequence
  derived and/or modified CDS sequence (opt6) from DENV-1__KC762648__SS-prME
aguguuacgaugcuacugaugcugaugccgaccgcauuggcuuuucaucugacaacucgaggaggagaaccacauaugauuguuagcaaacaagaaaggggaaaaagucuacuauuuaaaacgucugcuggagucaacauguguacucugauagcaauggauuugggggaauugugugaagauacccugacauacaaaugcccucgaauaacugaagcagaaccagaugauguggacuguugguguaaugccacggacacuugggugacauacgggacauguagucaaacgggagaacacaggcgugauaaacguuccgucgcguuagcgccacaugucggucucggguuagaaacucgaacggaaaccuggaugaguagugaaggggccuggaaacagauacaaagaguugaaacgugggcauuaagacacccuggguuuaccgucaucgcuuuauucuuagcacacgcuauaggcacaagcauuacucaaaaaggaauaauauucauccuuuugaugcucgucacuccuagcauggccaugagaugcguaggaauuggaaguagagacuuuguggagggauugucgggagcaacuuggguagacguugugcuugaacauggaagcuguguuacaacaauggccaaagacaaaccaacauuagauaucgaguuauuaaaaacugaaguaaccaacccggcaguacuucguaaacuuugcauagaggcgaaaaucucaaauaccacaacagacucgaggugucccacacaaggagaagcuacacucguagaagaacaagaugcaaauuucguuugucgacgaacguuuguagauagaggcuggggaaacggguguggacuauuuggcaaaggaagccuaaucacgugugcgaaauuuaaaugugugaccaaauuagaggggaaaauaguacaauacgagaaccuaaaauacucuguaauaguaacuguacauacaggcgaccaacaucaagucggaaaugaaaguacagaacauggcacgacggcgaccauuacgccgcaagcgccaacaacagaaauacagcuaacagacuauggagcccuaacucuagauuguaguccuagaacugguuuggacuuuaaugagaugguauugcugacaaugaaagagaagaguuggcuaguucacaaacaaugguuucuagauuuaccauuaccguggacuucaggagcaucuacuucccaagaaaccuggaauagacaggaccuuuuaguaacauuuaaaacggcacaugcgaagaaacaagaaguagucgugcuggguucgcaagagggagcaaugcauacagcucuaacuggugcuacggagauacagacaagugguacaacgacaauauucgcaggacaccuaaaaugccgauuaaaaauggacaaacucacacucaaggggaugucuuacguaaugugcacgggcagcuuuaagcuagaaaaagaaguagccgaaacccagcacggaacaguacugguucaaauaaaauaugaagguacagaugcaccaugcaaaaucccguucagcacccaggacgagaaaggaguaacccaaaauggccgacugauaacugcuaauccaaucguaacagauaaggaaaaacccguuaauaucgaggcggaacccccuuuuggagagucauauauuguaaucggcgccggcgaaaaagcacuaaaauugucgugguuuaaaaaggguagcucaaucgguaaaauguucgaagcaaccgcuagaggugcgagacguauggcgauauuaggagacacagcaugggacuucggaucuauaggcgggguguuuacaagcguggguaaauuaguacaucagauauuugguacugccuauggaguacuauuuagcggaguuaguuggacaaugaaaauagguauuggugugcuauuaacauggcuaggcuuaaauagcaggucaacguccuugucuaugacuugcaucgcuguaggccuaguaacauuauauuuagguguaaugguacaagcugauaguggcugcguuauaaauuggaaaggacgggagcugaaauguggcagugggauauucguuacaaacgaaguucauacauggaccgagcaauauaaauuccaagcggacagcccgaagagauugucggcugcuauaggaaaagcaugggaagaaggaguaugugguaucagaagugcaacuagacuagaaaauauaauguggaaacagauaaguaaugaauugaaccacauacuccuggagaaugauaugaaauucacaguuguaguuggugauguagcggguauacucgcccaagggaaaaagaugauaaggccacaaccaauggaacacaaguacucauggaaaagcuggggaaaggccaaaauuauuggagcagaugugcagaacacuaccuucauaauagauggaccgaacacuccagagugcccggaugaccaaagagcauggaauauuugggaaguagaagacuauggcuucgguauauucacaacuaauauuuggcucaaauuacgugauucauauacacagguuugugaucauaggcuaaugagugcugcaauuaaagacucgaaagcgguacaugcggacaugggauauuggauugaaucagaaaagaaugaaacguggaaauuagcucgcgcaucuuucauagagguaaagacuuguauuuggcccaaaucacacacacuauggagcaacggagugcuggaauccgaaaugaucauuccaaaaauuuauggagggccgauaucacagcauaauuaccguccugguuacuucacacaaacagcugggccauggcacuuagguaaguuagaauuagauuuugaucuaugugaagguacuacuguugucguggacgaacacuguggaaaccguggaccaaguuuaaggacaacaacuguaaccgggaaaauaauacaugagugguguugucguucauguacuuuaccuccacugcgcuuuagaggcgaagauggauguugguacgguauggagauacguccuguuaaagagaaagaagagaacuuaguaaaaucaaugguuucugcaggaagcggagagguggacuccuucagccugggguuauugugcauaaguauuaugauagaagaagugaugcggucaaggugguccagaaagaugcuaaugacgggaacacuagccguauucuucuuguuaauuaugggacagcuuacauggaacgacuuaaucagauugugcauaaugguaggugcuaaugcuagcgaccgaauggggaugggaacaacguaccuugcuuuaauggcgacuuucaaaaugagacccauguuugcaguuggacuacuauuuagacgacuaacgucccgugaagugcuccuucuaacuauaggacucagucuuguagcuucgguggaauuaccaaacagcuuagaagaacuaggcgauggacucgcaaugggaauaaugaucuuaaaguuacuaacugauuuucagagucaccaguuaugggcaacccuuuuaucccuuacauucaucaaaacuacuuuuagccugcacuacgcuuggaaaacuauggccaugguucugaguauuguuucccucuucccacugugucugucaacuacaucucagaaaacgacauggcucccgguacugcucggcucgcugggguguaagccacugacuauguuucuaauagcggaaaacaagauuugggggagaaaaagcuggccacugaaugaggguauaauggcugugggcauaguuucaauacuacucucaucgcuccugaaaaaugauguaccucuagcggguccauuaauagcugguggaauguugauagcaugcuauguaauaucagggucaagugcagaccuaaguuuggagaaagcggcugaaguaucaugggaagaagaagcugaacacucuggcgcaucucauaauaucuuaguggagguucaggacgacgggaccaugaaaauaaaagacgaagaaagagaugauacacuaacaauacuauuaaaagccacucuuuuagcaguaaguggaguuuacccauugucaauuccugcaacauuauucguaugguacuucuggcagaagaagaaacaaagauccgggguacuuugggacacccccagucccccugaaguggaaagggccguacuagacgauggaaucuacagaaucaugcaacgaggacuauuaggccgcucacaaguaggaguagguguauuucaagaaaauguauuccauacgauguggcauguaacacgaggcgcaguauuaauguaucaggguaaacgucuagaaccaagcugggcuagcguuaagaaggaccugauaucuuacggugguggauggagauuacaaggaagcuggaauacuggugaagagguacaaguuaucgcaguagaacccggcaaaaauccgaagaauguucaaacagcaccugguacauucaaaaccccugaaggggaagucggggcaauagcacuagauuuuaaaccagguacaucggguucaccaaucguaaaccgcgagggcaaaauaguagguuuauaugguaacggagugguaacuacaagcggaaccuacgugucagcuauagcacaagcaaaagccucgcaggaagggccacugccugaaauagaagaugaagucuuccgaaagcgaaaucucacaauaauggauuuacauccugguuccggcaaaacccgccgauaccuaccagcaauuguuagggaggcuauaaaacggaaacuaaggacgcuaauacuggcccccacccgaguaguugcuagcgaaauggcugaagcucucaaggguaugccaauacgauaccagacgacagcgguaaagagcgaacacacggguaaagaaauaguugauuuaaugugucacgcgacguucacaaugaggcuacuaucuccggugcggguaccuaacuauaauaugauaauaauggaugaagcccacuuuacagacccauccucaauagcggccaggggguacauauccacucgcguaggcaugggcgaagcggcagcaaucuucaugacagcgacuccucccgguucaguugaggcguucccacaaaguaacgcggugauucaggacgaagaaagggauaucccagagagaucauggaacucaggauaugaauggauaaccgauuuucccggaaaaacaguaugguucguaccaucaaucaaauccggaaacgauaucgcgaauuguuugcguaaaaaugggaaaagaguaauucaacuaucgagaaaaacguuugauacggaauaucagaagacuaaaaauaaugauugggacuacguaguuacaacugauauaucagaaaugggggcaaacuucagagcggaccggguaauugacccacgaagaugccuaaaaccuguuauacuuaaagaugguccugaaagagucauuuuagcugguccuaugccagucacgguugcaucggcagcacagcguagaggucguguugggagaaaccacaauaaagaaggagaccaguacauuuauauggggcaaccccuaaauaacgaugaggaccaugcacauuggacugaagcuaaaauguuacuagacaauauaaacacuccagagggcauuauaccggcgcucuuugagccugagcgcgagaaaagugcagcaaucgauggcgaauacagacuacggggugaggcuagaaaaacguuuguagaacuuaugagaagaggcgaccuaccaguauggcuaucuuacaaaguagcuucagaaggauuccaauacucagauagaagaugguguuuugacggcgaacgaaacaaccaaguacuagaagaaaauauggacguggaaaucuggacuaaggaaggcgaaagaaagaaacucagaccucguugguuagaugcuagaacuuacucagauccauuggcucuaagagaguucaaagaguucgcagcuggcagaaggaguguaucuggcgacuugauauuagaaauuggcaaguugccucagcacuuaacccaacgagcucagaaugcccuagacaauuuaguuaugcuacauaauucagaacaaggcgggagggcguaucggcacgcaauggaagaacuuccagauacaauagaaacguuaaugcuacuagcguuaaucgcagugcuaacaggcggaguuacauuauucuuucuaucagguagaggcuuaggaaaaaccucaauagguuuauuauguguuauggcauccuccgcacuguuauggauggcgucugucgaaccacacuggaucgcagcuagcauaauuuuggaguucuuccuuaugguuuuacuuauaccggaaccagauaggcaacguacgccacaagacaaucagcuugcuuauguaguuaucggacuauuauucaugauacugacaguagcugcuaaugaaaugggacuuuuagaaacaacuaagaaagacuuagggauaggacauguugcgguagaaaaucaccaucacgcagcaaugcuggauguugaccuacaucccgcgagugcauggacauuauacgcagucgcaacuacgauaauuacaccaaugaugagacauacaauagaaaauaccaccgcaaacauuagccuuacugcaaucgccaaccaagcagccauucuaauggggcuugauaaaggcuggccaaucaguaaaauggacauuggaguuccacuacuugcauugggauguuauagucagguuaacccuuugacauuaacagcugcagucuugauguuaguagcacauuaugcuauuauuggcccuggacuucaggcgaaagcaacuagagaagcacaaaaacguacugcagcagggauuaugaagaauccaacaguagacggaauaguagcaauugaucuugauccuguaguuuaugaugccaaauucgaaaagcaauugggacagaucauguuacuaauacuauguacaucucaaauacuucuuaugaggacaacuugggccuugugcgagagcaucacguuagcuacugguccccucacaacacugugggaagggucgccaggaaaauuuuggaauacaacaauugcaguaagcauggcaaacauauucagagguucguauuuagccggugccggucuugcauuuucauuaaugaaaaguuuagguggggguagaagagggacgggagcucaaggagaaacuuugggcgagaaauggaaaaggcaacuaaaucaauuauccaaaucagaauuuaauaccuauaaaaggagugggauuauggaaguggacagauccgaagcaaaagagggauugaaacgaggggaaaccaccaaacacgcaguauccagagggaccgcaaaauuacgaugguuuguagaaagaaaucuugucaaaccggaaggaaaggucaucgaccuagguugugguagaggaggaugguccuauuauugugccggcuuaaagaagguuacggagguuaaaggauacacaaaaggagguccuggccaugaagaaccuauuccaauggcaaccuauggauggaaucucgugaaauuacacucggggaaagacgucuucuuuauuccaccugaaaaaugcgacacacucuuaugcgauauaggagaaucaagcccgaauccgacuaucgaagaaggacgcacauugagaguucugaaaaugguugagccauggcuacgcggcaaucaguuuugcauaaaaauauugaauccuuauaugccuagcguaguagagacuuuagaacaaaugcaaagaaaacacggugguauguugguucgaaauccauuguccagaaauaguacccacgaaauguauuggguaaguugugguacgggaaauauagucucagcgguaaauaugacgucgagaaugcuucuaaacagguuuacaauggcacacaggaaaccuacguaugagcgugacguagaucuaggagcaggaacacgucauguagcuguugaaccggaggucgcaaacuuggauaucauaggccaaagaaucgaaaacauaaaacaugaacauaaaucuacauggcauuacgacgaagauaacccauacaagacaugggcauaucacggaaguuaugagguuaagccuucgggaagugcaucguccaugguaaacgggguaguuaaacuacuuaccaaaccaugggaugucauuccuaugguaacgcaaauugcgaugacugacacuacuccguuugggcagcaacgaguauuuaaagaaaaaguagacacacgaacuccuaaggccaaacgaggaacgacacagauaauggaaguuacagcuagauggcucuggggauuucuaucuagaaacaagaaaccgagaauauguacgagggaagaauuuacaaggaaaguaagaagcaaugcagcaaucggggcggucuuuguggaugaaaaccaauggaacuccgcuaaagaagcaguugaggacgaaagauuuugggaccuaguacauagagaaagagaguuacauaaacaaggcaaaugugcaacauguguauauaacaugauggguaaacgagagaaaaagcucggcgaguucggcaaagcaaaggguucaagagcaauaugguauaugugguuaggggcucgguuucuggaguucgaggccuuagguuucaugaaugaagaccacugguuuucacgcgaaaauucacuuucuggcgucgagggggagggccuacacaaacucggguacauuuuaagagacauuucuaaaauaccugggggaaacauguaugccgacgauacagccggaugggauacacggauuacagaagaugaccugcaaaaugaagcaaaaauaaccgauauuauggagcccgagcaugcauuacuagcuaaagcuauuuucaaguuaaccuaucaaaauaaaguaguaagggugcaaagaccugccaaaaauggaacagugauggaugucauuucaaggcgggaucagagaggcuccggucagguugguaccuauggccuaaauaccuuuacgaacauggaggcacaacucaucagacaaauggaaucggaagagauauuuucaccuucagaauuagaaacuccgaauuuggcagaaagaguucuagacuggcuggaaaaauaugggguugaaaggcucaaacgaauggcgauuucuggagaugacugcguuguaaaacccaucgaugacagauuugcaaccgcuuugacagcguuaaaugauaugggaaaaguuaggaaagauauaccacaaugggagcccucgaaagguuggaaugauuggcaacaggugccauuuuguucccaucauuuucaucaacuaauuaugaaagacgggcgcgaaauagugguuccaugucgaaaucaagaugaauuaguagguagagcuaggguaagccagggagcagguuggucuuugagagaaacagcaugccuggguaaaagcuaugcucagauguggcagcuuauguauuuccauagaagggauuuaaggcuugcagcaaaugcuauuugcucugcagugccuguggacugggucccuaccucuaggacaaccuggaguauacaugcacaucaccaauggaugacgaccgaggacauguuaaguguauggaaccgcguauggauugaagaaaauccauggauggaagauaagacacauauuucuucaugggaagauguaccuuauuugggaaaacgugaggaccaaugguguggcagcuuaaucggcuuaacagcucgagcaacaugggcaacgaacauacaaguagcaaucaaucaagugagacgucuaauaggaaacgaaaauuaucuggauuauaugacgucuaugaaaagguucaaaaaugaaucugauccggaaggagcacuaugguag

SEQ ID NO: 22069 - RNA, 9879 nt, Artificial Sequence
  derived and/or modified CDS sequence (opt6) from DENV-1__KC762622__SS-prME
ucaguaacuaugcuucucaugcugaugccaacagcacucgcauuccaccucacaacacgcggaggggaaccacauaugauugucucaaaacaagaaagggggaaaucauuacuauuuaaaaccucugcuggagugaauauguguacauuaaucgcaauggaucuuggggaacuaugugaggauacucuaaccuauaaauguccaaggauaacagaagcggaaccagacgaugucgauugcuggugcaaugcaacugacacuuggguuacuuacgggacgugcucacaaacuggugaacauaggcgagacaaacgauccguugcacuugcaccgcacguggguuugggauuagaaacgagaaccgaaaccuggaugaguagugaaggugcauggaaacaaauacaacgaguagaaacgugggcauuaagacauccgggauucacaguaauggcgcuuuucuuagcacaugcaauagguacaucaaucacucaaaaagguaucauauuuauucuccugaugcucgucaccccuucgauggcaaugagaugcguagggauaggaagcagggauuuuguagaaggauuaagcggugccacuuggguagauguaguacuggaacacggaagcuguguaacuacaauggcuaaagauaaacccaccuuagauauugaacuucuuaaaacagaaguuacuaauccagccguacuaaggaaauugugcauugaagccaaaauaucaaauacaacgacagacagccgaugccccacacaaggagaagcgacgcugguagaagaacaagacgcaaacuucguaugcaggaggaccuucguggaccgaggauggggaaauggcugugggcuauuuggcaaaggcagucuaauuacuugcgcgaaauucaaaugugugacuaaacuugaagguaaaaucguucaauaugagaauuugaaauauucaguaauugucacuguacacacaggugaccagcaccagguagguaaugagucuacagagcauggcacaacagcaacuauuacuccacaggcaccgacuacggaaauucaacuuacugauuauggggcacuuacgcuugacuguucaccacgaacaggcuuggacuucaaugaaaugguacuauuaaccaugaaagagaaaagcugguuaguucacaaacaaugguuccucgacuuaccccucccguggacgaguggagcaucuacaagccaagaaacauggaaucgacaagaucuacuugugacuuuuaaaacagcccacgccaagaaacaagagguaguaguuuugggcucucaagagggugccaugcauacagcucugacaggugcaacagaaauacaaaccucggggacuaccacuauuuucgcgggucaucugaaaugucggcuaaaaauggauaaauugacacuuaaagguaugaguuauguaauguguacuggaaguuuuaaacuugagaaagaaguagcugagacucagcauggcaccguuuuaguucaaauaaaauaugagggaaccgacgcuccuugcaaaaucccuuuuaguacccaagacgaaaaaggugucacccagaacgguagacuaauuacagcaaacccaaucgugacagauaaagaaaaaccaguaaauauagaagcagaaccaccauucggagagucauacaucguuauaggagcgggggaaaaagcguugaaacuuucaugguuuaagaaagguucgagcauaggaaaaauguuugaggcgacagcucgcggggcgaggcgcauggcgauuuuaggugacaccgcuugggacuucggaucuauaggagggguguuuacaucaguuggaaaguuagugcaccaaaucuuugguaccgcauaugggguucuuuuuagcggaguuucauggacaaugaaaauugguauugguguacuacuaacgugguuaggucuuaauucccgaucaacaagucuuagcaugacauguaucgcgguaggacucguaaccuuauaccuaggaguaaugguucaagcugauucagguuguguaauuaauuggaaaggccgggaauugaagugcggaucugguaucuuugugacaaacgagguccacacauggacagagcaguacaaauuccaggcagacaguccuaagagacuuucagcugcaauagggaaggcuugggaggagggcguauguggaaucaggucagcgaccagacuggaaaacauaauguggaagcaaauaaguaacgaacuaaaccauauucuucuagaaaaugacaugaaguucacugugguaguaggggauguugcaggcauauuagcacaaggcaagaaaaugaucagaccucaacccauggaacauaaauauucguggaaaagcuggggcaaagcaaaaaucauaggugcagacguccagaacacuaccuuuauaaucgaugggccaaauacgccggaauguccugacgaccaacgagcuuggaauauuugggaagucgaagacuacggauuuggaauauuuacuacaaacauauggcuuaaacuaagagacucauauacacagguaugugaccaccgguugaugagugcugcuaucaaagacucgaaagcaguacaugcagauauggguuauuggauagaaagugagaaaaaugaaacuuggaaacuagcucgagcuagcuuuauagaaguaaaaacuuguauuuggcccaaaucucauacgcucugguccaaugggguccuagaaagugaaaugauaauaccgaaaauuuauggaggucccacaagucaacauaauuaucgcccugguuauuucacgcaaacagcagguccauggcaucuagguaaacuggaauuagacuucgaccugugcgagggaaccacugucgucguugacgagcacugugguaacagagguccaucgcuucguacaacuacaguaacugggaaaauaauucaugaaugguguuguagaagcuguaccuugccaccuuugagguuuagaggagaagacggaugcugguauggcauggaaaucagacccgugaaggagaaggaagaaaaccuugugaaaagcauggugucugcuggcucuggagaaguagauagcuuuucauugggacuuuuauguauuucaaucaugaucgaagaggucaugaggucgagguggucuagaaaaauguugaugaccggaacucucgcgguauuuuucuuacugauaauggggcagcuaaccuggaacgauuuaauaagauuauguauuaugguuggugcaaaugcuucugacagaauggggaugggaacuacauauuuagcuuuaauggcaacauuuaaaaugagaccgauguucgcuguuggauuauuauuuagacgacugacaagcagagaaguucuccuacucacgauaggucuaucgcugguagcaaguguagaauugccaaacucccuggaggaacugggagacgguuuggccauggguauaaugauacuaaaauuauugacggauuuccaaucgcaucagcugugggccacccuccugagucuaacuuucauaaaaacgacguuuucacuccauuacgcuuggaagacuauggcgaugguucuaaguauugugucauuguucccucuuugccugagcacgacuucccagaaaacuacaugguugccuguacuacuugggagcuuagggugcaaaccuuuaacgauguuuuuaauagcagaaaauaagauauggggucgcaaaucauggcccuugaacgaagggaucauggcaguaggcauaguuucaauccuacuaucaagccuccuuaaaaaugacguaccgcuugcggguccauugauagcagggggcaugcuaauagccugcuauguuauaagugguaguuccgcugauuuaucguuagaaaaggccgcagaaguuuccugggaagaagaagcagagcauaguggugcaucucacaacauucugguagaaguucaagaugaugguaccaugaaaauaaaggacgaagaacgagaugauacuuugacaauauuacuuaaagccacauugcuagcuguaagcggcgucuacccguuaucaauuccugcaacuuuauuugucugguauuucuggcagaagaagaaacaaagaagcggaguauugugggacacaccgagucccccugaaguagaacgugccguucuagaugauggaauuuauaggauuaugcaaagaggucuacuuggcagaucacaaguuggcguagguguauuccaagaaaacguuuuucacacgauguggcauguaacaagaggagccguucuuauguaucaggggaaaagauuggaaccuucgugggcuuccgucaagaaagacuugauuuccuauggggguggauggcggcuacaaggaucauggaacacaggagaagaaguacagguaauagcgguugaaccaggcaaaaauccuaagaacguccaaacagcacccggcaccuucaaaacgccugagggagaagucggugcgauugcacuggauuuuaaaccuggcacgucaggcucaccaauuguaaauagggagggaaagauugucggacucuacgggaauggagucgugacaaccucaggaacauauguaagcgcgauagcacaagccaaagcaucacaagagggacccuuaccagagaucgaagaugaaguauuucggaaacgaaauuugacuauaauggaccuccacccgggaaguggaaaaaccagaagguauuugccugcuauuguucgagaagcgauaaaacgaaaauuaagaacacucauacuagcuccuacucguguuguggccagugaaauggcagaagcacuaaaaggaaugccaauuagauaccaaacuacggcaguaaaaucugaacacacggguaaagaaaucgucgaccuaaugugccaugcuacauucacuaugcgccucuugagucccgucaggguccccaacuauaacaugauuauuauggacgaggcucauuucaccgaucccagcucuaucgcagcacgcgguuauauauccaccaggguaggaaugggcgaagcugcggcuaucuucaugacugcuacaccuccugguucuguagaagcauuuccgcaaucaaaugcugucauacaagaugaagaacgggauaucccugagagaucguggaacucgggauaugaguggauuacugauuuucccgggaaaacagucugguuuguaccaucaauaaagucagguaaugacauagcaaacuguuugaggaaaaauggcaagcgugugauacaacucucgagaaaaacauucgauacagaauaucaaaagaccaaaaacaacgauugggacuauguagucacaacagauauaucagaaaugggcgcaaacuuuagagccgauaggguuauugaucccagacgauguuuaaaaccaguaauacuaaaagaugggccugagcgaguaauauuggcggguccaaugccaguuacaguagcaagugcugcgcagcgaagaggaagaguuggcagaaaccacaauaaagaaggugaucaauacauauacaugggacagccgcuaaacaacgaugaagaccacgcucacuggacugaagcaaaaaugcuguuagauaacauaaacacaccagaagguauuauucccgcguuauuugagccagaaagggaaaaaucggcugcuauagacggggaauaccguuugcgaggagaagcuagaaaaacauucguggaauuaaugagacgcggggaucuucccgucugguugaguuacaagguugcuucugaagguuuccaauacucagauagaaggugguguuuugacggcgaacggaauaaccagguccuagaagaaaauauggacgucgaaauauggacaaaagaaggugagagaaagaaauugaggccuagauggcuagacgcaaggacguauagcgacccacuugcucugcgagaauuuaaagaauuugcugccggacgucgauccgugagcggugaucucauccucgaaaucgguaaacuaccacaacaucuaacucaacgagcccaaaacgcuuuagauaaucuaguaauguugcauaauuccgaacaaggugguagagcauacaggcaugccauggaagaguuacccgauacaauagagaccuuaaugcugcucgcgcuaaucgcaguucuaaccggaggagugacacuauuuuucuugucagguagaggguuaggaaaaaccaguaucggccucuuaugcguuauggcuaguaguguacucuuauggauggcaucaguugagccacauuggauagcugccucuauuauccuggaguucuuucuuaugguuuuacucauuccagaacccgacagacaacguacaccccaggacaaccaacuagcauauguagucauaggauuacucuuuaugauacuuaccguagcggcgaacgagauggggcuauuagaaacaacuaaaaaggaucuaggaaucggucacguagcuguagaaaaucaccaucacgccgccaugcucgaugucgaccuacacccagcaucagcguggacauuauaugcaguugcuacaacuaucauaacuccgaugaugaggcauacuauagaaaauacaacugccaacauuucacucacagcaauagcaaaccaagcugcaauucuaaugggauuagauaaaggauggccuaucucaaaaauggauauaggagugccauuauuagcacucggguguuauagccaaguaaacccacuaacauugacugcugcgguucuaauguuaguggcacacuaugcaauaauuggcccuggccuucaagcaaaggccacacgugaagcucagaagagaacugcggcagguaucaugaaaaaucccacuguugacgggauagucgcgauugaucuugauccaguaguguaugaugcuaaguucgaaaaacaacugggccaaauaauguuacuuaucuugugcacuagccaaauauuauuaaugagaacaacaugggcauuaugcgaaucuaucaccuuagcaacaggaccuuugacaacauuaugggaaggaaguccugguaaauuuuggaauacaacaaucgcagucaguauggcaaacauauucagagguucguacuuagcaggggcaggauuggccuucagcuuaaugaagaguuuaggaggugguaggagaggaacaggugcacaaggcgaaacacuaggggaaaaauggaagagacaacuaaaucagcucaguaagucagaauuuaacacuuauaaacgaucuggaauaauggaaguggaucgcucagaagcaaaggaaggcuugaaacguggagaaacuacaaaacaugcugucucccggggcaccgcuaaacucagaugguuugucgaaaggaaucuuguaaaaccugaaggaaaaguuauugaccugggaugugguagaggcgguugguccuauuacugugcagggcuuaagaaaguaacggaaguaaagggauauacuaaaggcgguccgggacacgaggaaccuauuccgauggcaacauauggauggaauuuaguuaaacugcacucagguaaagacguauuuuucauaccgccggaaaaaugcgauacacuguugugugacauaggggaaaguaguccuaauccgacaauagaagaagguagaacuuuaagaguacugaaaauggucgaaccaugguuaagaggaaaucaauucugcaucaaaauacuaaaccccuauaugccgucaguagucgaaacgcuagaacaaaugcagagaaaacauggaggaauguuaguuaggaacccacucaguagaaauaguacucaugaaauguauugggucucuugcgguaccggaaauaucgucuccgcuguuaacaugacgagucgaaugcuccucaaucgauucacuauggcacaccggaagcccacauaugaacgugauguggaccuaggugcuggaacaagacauguugccguugaacccgagguagcuaaucuugacauaaucggucaaagaauagagaacauaaaacaugaacauaagagcacguggcauuacgacgaggauaauccuuauaaaacuugggcauaccauggaucuuacgaaguuaagccuaguggcagugcgucaucuaugguaaauggaguuguaaaacucuuaacgaaaccgugggauguaauuccaaugguaacacaaauagcuaugacagauaccacgcccuuugggcaacaaagagucuuuaaagagaaaguugauacaagaacucccaaagcgaagcgugggacaacgcaaauaauggaagucacggcucguuggcuauggggcuuucuaucucguaauaagaaaccgagaaucuguacuagagaagaauuuauaagaaaaguacguagcaacgcugccauuggagcggucuucguagaugaaaaccaauggaacucagcaaaagaggccgucgaggacgaaagauucugggacuuaguacaucgugaaagagaauuacacaaacagggaaaaugugccacuugcguguauaacaugaugggcaagcgagagaagaaacuaggugaauuugguaaagccaaaggcucaagagcaauaugguacauguggcuaggugcaagauuccucgaauuugaagcacuuggauuuaugaaugaagaucacugguuuucccgagaaaauucacucuccggcgucgaaggcgaaggacuacauaaauuaggauauauuuuaagggauauuaguaaaauuccuggagguaacauguaugcugacgauacagcagggugggauacgaggaucaccgaggaugauuuacaaaacgaagcuaaaauaacagauauuauggagccagaacacgcccuacuagccaaagcuauauuuaaguuaacauaccagaacaaagucgugagaguucagcguccugccaaaaauggcacaguaauggauguaaucucgcgacgggaccaaagggguaguggacaaguuggcaccuacggauuaaauacauucacuaacauggaagcacaauuaaucagacaaauggaaucugaagggauuuucagcccaagcgaguuagagaccccaaauuuagcagagagaguucuagacugguuagaaaaauacggaguagaaagacugaaacguauggcgaucucaggagaugauugcguagucaagccuaucgacgacagguuugcgacugcuuugaccgcuuugaaugacauggggaaaguaagaaaagauaucccacagugggaacccucaaaaggauggaaugacuggcaacaaguuccauucugcagccaccauuuccaccagcuuauaaugaaggauggaagggagauaguaguaccauguagaaaucaagaugaacucguaggaagggcccgcguuagccaaggcgcagguuggucgcucagagagacagcaugccugggaaaaaguuaugcacaaauguggcagcuuauguauuuccacaggcgagaccugcgauuggcugccaaugccauaugcucggcgguaccgguugauuggguuccuacuucuagaacaaccugguccauccaugcucaccaucaauggaugaccacggaggacaugcuauccguguggaaccggguauggauagaggaaaauccauggauggaagacaaggcgcacguaaguagcugggaggaugugccauaccuugguaagcgagaagaccaauggugcggaagucuaauuggacuaacggcaagagccacuugggcaacgaacauucaaguugccauaaaucagguaagaagguugaucggaaaugaaaauuaucuagacuauaugacuagcaugaagagguuuaaaaaugaaagcgauccggaaggagcacuaugguaa

SEQ ID NO: 22070 - RNA, 9879 nt, Artificial Sequence
  derived and/or modified CDS sequence (opt6) from DENV-1__KC762629__SS-prME
ucaguaacaaugcucuuaauguuaaugccaacugcucuugcuuuucauuuaacgacucgcggaggggaaccucauaugguaguaucaaaacaagaacgugggaaaucacucuuauuuaaaaccucagccggggugaauauguguacauugauugcuauggaucuuggagaacugugugaagacacuuuaacauauaaauguccaaggauuacggaagcagaaccagaugauguggauuguugguguaaugcgaccgauaccuggguaacuuauggaacguguagucaaaccggugaacacaggagagauaaacguucggucgcuuuggcaccacaugugggccuuggacuugaaacaaggacagaaacauggaugucauccgaaggagcuuggagacaaauacaacgaguagaaacaugggcgcuccgucaucccggauuuacagugauagcuuuauuuuuagcacaugcuauaggaacaucaaucacacaaaaaggaauaauauuuauucuauugaugcuaguuacuccgagcauggcaaugcgcugcguaggaauugguaguagagauuuuguggaaggguuaucaggcgcaacauggguagacguuguucucgaacauggaaguugcguaacaacaauggcgaaagauaaacccacuuuggauauugaauuacucaaaacggaaguuacaaauccagcaguccuacgaaaauuauguauugaggccaaaauuaguaacacaacuacugacaguaggugcccaacucaaggggaggcuacccuaguagaagaacaagaugcuaauuuuguauguagacgcacguuuguugaucgcgguuggggaaauggaugugguuuauuugggaaagguucuuugauaaccugugcgaaauucaaaugugucaccaaacuggaaggaaaaauagugcaauaugaaaauuuaaaauauaguguaauugucaccgugcauacgggagaucaacaccaagucgguaacgaaucuacagagcaugguacaacugcuaccauuacuccgcaagcgccaacaacugaaauucaauuaacagacuauggugcgcuaacauuagauugcucgccuaggacagggcuugacuuuaaugagauggucuuacuaacaaugaaagagaaaaguugguuaguacauaaacagugguuccuagauuuaccuuuaccuuggacguccggagcuuccaccucacaggagacuuggaaccgacaggaucuauugguuacauuuaaaacugcucaugccaagaaacaagagguagugguucuggggucucaggaaggagcgaugcauacugcgcugacaggcgccaccgagauacaaacgagcggaacaaccacaauauucgcgggacacuuaaaauguagguuaaaaauggacaaacuaacgcuuaaagguaugucuuauguaauguguacagggucguuuaaacucgaaaaagaaguugcggagacacaacacggcacuguauuaguucaaauaaaauaugaaggcacugacgcuccuugcaaaauuccauucucaacgcaagacgaaaaaggaguaacacaaaauggaaggcucaucacagcaaacccaauuguuacagacaaagagaaaccaguaaauauugaggcugaacccccauuuggcgagucauacauuguuaucggagccggggagaaaacucuaaaauuaucuugguucaagaaagggucaaguaucggaaaaauguucgaagcgacagcaagaggcgcccggagaauggcaauacuaggcgacacagcaugggacuuuggguccaucgggggagucuuuaccucaguagggaaacugguacaucaaauauuugggaccgcauacgguguacuguuuucaggagucucuuggacuaugaaaauugggauaggagucuugcuuacuugguuagggcuaaauaguaggucaacaucacuaagcaugacuuguauagcugucggguugguuacguuguacuuagguguuaugguccaagcggacagugggugcguuaucaauuggaaagggcgagagcuaaaaugcggguccggcauauuuguuacaaacgaaguccauaccuggacagaacaguauaaauuucaagcggacagcccuaaaagauuaucagcagcuauuggaaaagccugggaagaagguguaugugguauucguucugccacuagacuggaaaacauuauguggaaacaaauaucuaaugaauugaaucauauacuuuuagaaaacgauaugaaauuuacaguggugguuggugaugucgcaggcauucucgcucaaggcaagaaaaugauaaggccgcaaccaauggaacacaaauauucauggaagucaugggguaaagcaaaaaucauaggagcagauguccaaaauacaacuuuuauaaucgauggcccuaacacgccugaaugcccggaugaucagcgcgcguggaacauuugggaaguagaagauuacgguuuugggauuuuuacaacaaacauaugguugaaauugagagauagcuauacucaaguaugugaccauagauuaauguccgcugccauuaaagauucaaaggccguucaugcagacaugggcuauuggauugaaagugagaaaaaugagacauggaaauuagcgcgagcaucguucauagaaguuaaaacguguauuuggccaaaaagucacacgcucuggaguaacggcguauuagaaucagaaaugauaaucccaaagauauacggcgggccaauaagccagcauaauuacagacccggauacuuuacucaaacagcgggaccauggcauuugggaaaacuugagcuugauuuuaacuuaugugaaggcacaacuguaguaguugaugagcauugcgggaacagaggaccaucguuaagaacaacaacuguuacaggaaagauaauacaugaauggugcugucgaagcuguacgcugccuccccuaagguuuagaggagaagacgguuguugguacgguauggaaauaagaccaguaaaggagaaggaagaaaaccuaguaaaaucaaugguauccgcagggucuggagagguugacaguuuuucgcugggauuauuauguauaagcauaaugauugaagagguaaugagaucuagauggucucguaaaaugcucaugacagguacauuggcuguauuuuuccuuuuaauaauggggcaacucacguggaaugaccucauuagauugugcauaauggugggagcaaaugccucagacagaaugggaauggguacgaccuaucuugcacuuauggccacguuuaagaugaggccaauguucgcggucggucuccuguuucgacgguugaccucacgugaaguacuucuauuaaccaucggguugagcuugguagcaaguguggagcuaccaaauucccuagaagaacugggagauggauuagcuauggguaucaugauccuuaaacuucuaacagacuuccaaucacaucaacuaugggcuacuuuauuaucgcugaccuucauuaaaacaacguuuucucuacauuacgcauggaaaaccauggcgaugguucugucgauaguaucacuuuucccacuaugucugagcacuacaucucagaaaacaaccuggcucccuguauugcucggcucucuuggaugcaaaccccugacuauguuuuuaauugcugaaaauaaaauauggggacgaaaaaguuggccauugaaugaagguauuauggcaguuggaauaguaucaauuuuacuuucgucacuacuuaagaacgauguuccucuagccgguccucuaauugcggguggcaugcuuaucgcuuguuaugucauuucagguucuuccgcagaucuaucauuagaaaaagccgcugaaguaucgugggaagaagaagcagaacacaguggagcgucgcacaacauucuaguugaagugcaggaugacgggacaaugaaaauuaaagacgaagaaagagacgacacguuaacgauucuucugaaggcuacauuacuagccguuuccgggguuuauccguuaucaauaccagccacacucuuuguuugguauuuuuggcagaagaagaaacaaagaucuggcguauuaugggauacgccgaguccuccugaaguagaaagagcaguauuggaugacgggauuuauagaauaaugcaaagaggccuuuuagggcgaucucagguuggugucgggguauuucaagagaaugucuuucacacuauguggcauguaacaaggggagcaguccuuauguaucagggaaaaagacucgaaccaucaugggcauccgugaagaaagacuuaauaaguuaugguggggguuggaggcuucaaggauccuggaacacaggagaagagguacagguaaucgcgguggaaccaggcaaaaacccuaaaaacguacaaacggcacccggaaccuuuaaaacgccugaaggagaaguaggugccauugcuuuggauuuuaaaccgggaacaucugggucacccauuguuaaccgagagggaaaaauugucgggcuuuacggaaaugggguugugacaaccucugggacuuacgugagcgcaauagcccaggcaaaagcgagucaggaagggccacuaccagagauugaagaugaagucuuccgaaaaagaaauuugacuauaauggaccuucaucccggaagcggaaaaacgagaagauauuugccggcaauagucagagaggcaaucaaacggaaacuuagaacccuaauauuagcaccaacaaggguuguugcaagugaaauggcagaagcguugaagggaaugccuauccgauaucaaacaaccgcuguaaagucugagcauacuggcaaagagaucguagaccuuaugugucaugccaccuucacgaugagguuauuguccccgguacgaguuccaaacuacaauaugauaauuauggaugaggcucauuuuacugaucccucaagcaucgcggcaagaggcuauauuucaacaagaguaggaaugggggaagcggcagcaaucuucaugacagcaacuccaccuggcaguguagaggcuuuuccucaaucaaaugcgguaauacaggacgaagaaagagauaucccagagagaucauggaacucaggcuacgaguggauaacagauuuuccaggcaagacuguuugguuuguaccaucaaucaaaaguggaaaugauauagcuaauugcuuacguaagaaugggaaacggguuauacaacuaucaaggaagacauuugacacggaauaccagaaaacgaaaaacaacgacugggauuauguggucacaacggauauaagugaaaugggggcaaauuuuagagcagaccgagucaucgacccacgacgaugcuuaaaacccgucauucuaaaagacggccccgaacgaguaauauuagcaggaccaaugccaguaacuguggcaucagcagcgcagagacgagguaggguaggccgaaaccacaauaaggaaggagaccaauauauauacaugggccaaccacuaaauaacgaugaggaucaugcccacuggacagaggcuaaaaugcuacuagauaacaucaauacaccggaagguauaauaccagcgcuauuugaaccugagagagaaaaaucugcugcgauugacggagaauacagguuaagaggggaagcuagaaaaaccuucgucgaacuuaugagacggggagacuuaccaguuuggcuaaguuauaaaguugcaagugaagguuuucaauacucugaucgaagaugguguuucgauggcgaaagaaauaaccaaguccuugaagaaaacauggauguugagauauggacuaaagagggcgaacgaaagaagcugcgcccuagaugguuagaugcaagaacguacucagacccacuugcucuacgugaauuuaaagaauuugcagcaggucgacgaucaguuucaggugaccuaaucuuggaaauuggaaaauuaccccagcaucuuacacagagggcccagaacgcacuagauaacuuaguuaugcuacacaacagugagcaaggcggacgggcauaccgacaugcuauggaagaacuaccugauacuauagaaacccuuauguuguuggcacuuauugcaguccuuacagggggugucacauuauucuuuuuauccggcagaggucuggguaaaacaucaauaggacuuuuguguguaauggcaucaucuguucuucuuuggauggccaguguggaaccucacuggauagcagcaucaauaauucuugaguucuuucuaaugguucucuuaauucccgaaccugaccgacaaagaacuccucaggacaaucaauuagccuauguaguaauaggcuuauuauucaugauucuaacgguugcagcuaacgaaaugggccuacuagaaacuaccaagaaagaccucgggauaggccauguagcuguagaaaaucaccaccaugccgcaauguuggauguagaucuccacccggcuucagcuuggacgcucuaugccguugcaacuacaaucauaacgccgaugaugcgucauacaauagaaaauacaacagcaaauauaucccuuacagcgauugccaaucaagcugccauacuaaugggauuagauaaaggcuggccaaucucaaaaauggauauaggggugccauuguuagcauuaggcuguuacucccaggugaacccacugacguugacagcagccguccuuaugcuuguagcacacuacgcaauuauuggaccgggauuacaagcaaaggcaacaagagaagcacagaaaagaaccgcagcaggaauuaugaaaaaucccacggucgauggcaucgucgccauagaccuugauccaguaguguaugacgcaaaauucgagaaacaguugggccaaauaauguuacuuauacuuugcaccucacaaauacuacuaaugagaacaacaugggcgcuuugugaaucuauaacacuagcgacagggccucugacaaccuugugggaaggcuccccgggaaaauuuuggaauaccacuaucgcaguaucuauggccaauauauucagggggaguuacuuagcaggagcagguuuagcauuuucacuaaugaaaucacuagggggaggccgacgagggacaggagcacaaggagagacacucggagaaaaauggaaacgucaauuaaaccaacucagcaaauccgaauuuaacacuuauaaaagaagcggaauaauggaagucgaccgaagcgaggcaaaagaaggguugaaaaggggugaaacuacgaaacaugcuguaucgagaggaacagcaaaauuaagaugguuuguagagagaaauuuaguuaaaccugaaggcaagguaauagauuuaggcugcggcagagguggauggucauauuacugugcuggacuaaagaaaguaacagaaguuaaagguuacacuaagggaggacccggucaugaagaaccuauaccgauggcgacuuacgguuggaauuuggugaaacuucacuccggcaaagaugucuucuuuaucccgccugagaaaugugauacucugcuaugugauauaggagaaucgucaccuaacccaacgauagaagaaggucgaacuuuacggguccugaaaaugguagaaccguggcuaagggguaaucaguuuugcauaaagauacuaaauccauauaugccaaguguaguagaaacucucgaacaaaugcagcguaaacauggaggcauguuaguaaggaacccgcuaucgagaaauucuacacacgaaauguauuggguaucauguggcacagggaauauaguuucagcggucaacaugaccagcagaaugcuuuuaaacagguuuacaauggcgcauagaaaaccaaccuacgaaagagacguagaccuaggcgcuggaacuagacacguugcaguugaaccagagguagcgaaccuagauaucauagggcaacgaauagagaacauuaagcaugaacacaaaucaaccuggcauuaugacgaagauaauccuuacaaaacgugggcauaccacggaucuuaugaaguaaaaccuucaggaucugccucaucuauggucaauggcgucguaaaauuacugaccaaacccugggaugucaucccaauggucacacaaauagcaaugacagacaccacaccuuuuggucaacagagaguguucaaagagaagguggacaccagaacaccuaaagcaaaacgagguacaacacaaauaauggaaguaacagcaagauggcuuugggguuuucuuagucgcaacaagaaaccccggaucugcacaagggaagaguuuacacgaaaagucagaucaaacgcugcuaucggcgcaguauuuguugacgaaaaccaauggaauagugcuaaagaagcagucgaagacgaaagguucugggaucuaguacauagggagcgugagcuacacaaacagggaaagugcgcgacuugcguauauaauaugaugggaaaaagagagaagaaauuaggagaauuugggaaagccaaggguaguagagcaauaugguauaugugguuaggugcuagguucuuagaauuugaagcguuagguuucaugaaugaggaccacugguuuucacgggggaauagccugagugguguagagggugaaggauugcacaaauuaggauauauacuacgcgauauaucuaaaauuccgggaggaaacauguacgcagacgacacugccggaugggacaccagaauuacugaagacgaucuacaaaaugaggcuaaaauaacugacauuauggagccugaacacgcguuacuggcaaaagcgauuuuuaaauuaacuuaucaaaauaaaguaguacguguucaaagaccggccaaaaauggaacuguuauggacguuaucucccgaagagaccaaagggggaguggccaagucggaacauauggauuaaacaccuuuacgaacauggaggcgcaacucaucagacaaauggaaucagaaggaaucuucaguccuucagaacuggaaacuccuaaccuggcugagaggguucuagauuggcuagaaaaguaugguguagagagguuaaagcguauggcgaucaguggcgaugauuguguggugaaaccuauagaugaccguuuugcaacagcacuaacagcacuuaaugauaugggaaaaguacguaaagauauaccacagugggaaccaaguaaaggauggaacgauuggcaacaaguucccuucugcucucaucacuuucaucaauuaaucaugaaagacgggcgcgaaauagucgugccgugucgcaaccaggaugaacucgucggcagagcuagagucagucaaggagcagguuggagccucagagaaacagcaugucuugguaagaguuaugcacagauguggcaacuuauguauuuccauaggcgggaccucagacuggcggcuaacgcuauuuguagugcuguuccaguugauuggguuccuacaucacguaccacauggaguauacaugcacaucaccaauggaugacuaccgaagauaugcuuucaguuuggaacagaguuuggauugaagaaaaucccuggauggaggacaagacucauauaagcucaugggaagauguaccauacuuaggcaagcgagaagaucaguggugcggcucacuuauaggacugaccgcccgcgcuacgugggcaacuaacauucaaguugcaauaaaucagguaaggcgucugauaggaaaugaaaacuacuuggauuacaugacgucgaugaagcgcuuuaaaaaugaaucagauccagaaggggcccugugguaa

SEQ ID NO: 22071 - RNA, 9879 nt, Artificial Sequence
  derived and/or modified CDS sequence (opt6) from DENV-1__KC762627__SS-prME
agcguuacuaugcuucuaauguuaaugccuaccgcucuggcuuuucauuuaacgacacgagguggcgaaccacauaugauuguuucaaaacaagaacgugggaaaaguuuauuguuuaaaacuucggcuggaguaaauauguguacgcuaauagcaauggauuuaggugaacuuugugaagacacguuaacuuauaaaugcccacgaauuacagaagcagaaccagaugauguggacuguuggugcaaugccacugauacuuggguaacauacggaacuuguucccaaacgggagaacauagaagggacaaacgaucagucgcguuggcaccacaugugggauuaggacuugaaacacggacagaaacguggaugaguucagaaggagcguggaaacaaauacaaagaguagagacaugggcguugcggcauccuggauuuacuguuauugcccuuuuucuagcacacgccaucggaacgagcauaacacaaaaagguauaaucuuuauauuacuaaugcuaguaacuccgaguauggcaaugcgaugugugggaauaggcucccgagauuuuguggaagguuuauccggcgccaccuggguugaugucguucuggaacaugguaguugcguaacuacaauggcaaaagacaaacccacucucgacauugaauuauugaaaaccgaagugacgaaucccgcuguguuaaggaaacuuugcauagaagcuaaaauaaguaauaccacuaccgacucgaggugucccacacaaggagaagcaacacuggucgaagaacaagacgccaauuuuguaugcagacgaacuuucguggacagagguuggggaaacggaugcggucucuuuggaaaagggucucugaucacuugugccaaauucaaauguguuacuaaacucgaaggaaaaauaguucaauacgaaaaucuaaaauauagcguuauuguaacaguucauacuggagaccaacaccaaguaggaaaugaaucuaccgaacaugggacuacagcuacgauaacaccucaagcaccaacaacagagauacaacuaacugauuauggagcauugacuuuagauuguucgccaagaacagguuuagauuucaaugaaaugguauuacucacaaugaaagagaaaagcuggcuaguccacaaacaaugguuuuuagaccuuccucuaccguggaccucaggggccuccaccagccaagaaaccuggaaccggcaagaccuccuaguuacauuuaagacagcacaugccaagaaacaagaaguggucgugcucggaucacaggagggggcaaugcauacggcguuaacuggggcuacagaaauucagacgucuggcacuaccacaauauuugccggucacuuaaaaugucgcuuaaagauggauaaguuaaccuuaaaggguaugucuuacgugauguguacggguucguucaagcuggaaaaggaaguagccgagacacaacaugguacaguacuuguucaaauuaaauacgaaggcacggacgcucccuguaaaauaccuuuuucaacucaagacgagaaaggagugacucagaauggacgacuuauuacugcaaauccuauaguaacagauaaagagaagccaguuaauauagaagccgaaccaccauuuggggagagcuauauuguaauuggcgccggggagaaagcucuaaaauuauccugguucaagaaaggcagcaguauuggcaaaauguucgaagcaacagccagaggcgcuagaaggauggcuauuuuaggggauacggcaugggauuucgggagcauaggaggcgucuuuacgucaguagguaaauuaauacaucaaauauucgggacagcauaugguguguuauucaguggagucucuuggacgaugaaaauaggaauagggguauuacuaacauggcugggacucaauaguagaagcacaucauuaucaaugacaugcauugcagugggucugguaacucuuuauuugggaguuauggugcaagcagacuccggauguguaauaaauuggaaaggccgcgaguuaaaaugugguucggguauauucgugacaaaugaaguacauacuuggacagaacaguauaaguuucaggcugacucuccaaaaaggcucucagcagcaauuggcaaggcaugggaggaagguguaugcggaauacguucagcaacaagguuagaaaacauaauguggaagcaaauuaguaacgagcuaaaucauauccuguuggaaaaugauaugaaauuuacuguuguugugggugauguggcagggauauuagcccaagguaagaagaugauccgaccacaaccgauggaacauaaauauucauggaagaguuggggaaaagcaaaaauaauuggagcagauguacagaacacuaccuucauuauugaugguccaaacacuccagagugucccgaugaccaaagggccuggaacauuugggagguugaggauuauggcuuugggauauuuacgacaaauauuuggcucaaacuuagagacucauauacgcaaguaugugaucauagacuaaugagcgcggcuauuaaagauaguaaagcgguccaugcagacaugggguauuggauagaauccgagaaaaaugaaacguggaaauuagcuagagcguccuuuauagaaguaaaaacuuguaucuggccgaaaucacacacacuuugguccaaugggguauuagaaucggagaugauuaucccgaaaauauacgggggacccaucucccaacacaacuacaggccuggcuauuucacacaaaccgccgguccguggcacuuagguaagcuggaguuggacuuugauuugugcgagggaacgacgguaguagucgacgagcacugcggcaaccguggacccucuuuaaggaccacaacuguaacagguaaaaucauucacgaauggugcugccgguccugcacauuaccaccacugagguucagaggcgaagacggauguugguacggaauggagauuagaccugugaaggaaaaagaggaaaaccuaguuaagagcaugguaagugcagggagcggagagguagauucauuuagucuaggcuuacuaugcauaucuaugaugauagaggaaguuaugcgcucuagguggucgcguaaaaugcuaaugaccggaacauuagcagucuucuucuugcuaauaaugggacaacucacguggaacgaccuaauaagauuauguauuaugguaggggcuaacgcaucugacagaaugggaauggguacaacguaucuugcgcuaauggcgacguuuaaaaugcggccaauguucgccguuggacucuuauuucggcgucuuacaagucgagaaguacuacuuuuaacuauuggccuaagucuaguagccagcgucgaauugccaaauucacucgaggaacuuggagauggcuuagcaauggggauuaugauacugaaacuauuaaccgauuuucaaagccaccaacuaugggccacauuguugucacucacauuuaucaaaacuacauuuagccuacacuaugcauggaagaccauggcgaugguguugaguauagucucacucuucccgcuaugccuaaguacaacgagucagaaaaccacuuggcugccgguacuucuggguucacuaggauguaaaccacuuacgauguuucuaauagcagagaauaagauaugggguagaaagaguuggccgcuaaaugaaggaauuauggcuguaggcauuguaucaaucuuacuuucuucacuacuuaaaaaugaugugccucuagcugggccucuaauagcugguggaaugcuaaucgcauguuacguaaucaguggcucauccgccgacuuaucacuggaaaaggcugccgaaguaaguugggaagaagaagccgagcauagcggugccagccacaauauccuaguggagguacaagacgacgggacuaugaaaauuaaagacgaggaaagagacgauacccuuacaauuuuacuuaaggcaacauuacuagcaguuucagggguauacccuuugucaauuccagcaacucucuuugugugguacuuuuggcagaaaaagaaacaacgcucuggcguuuuaugggauaccccgucaccacccgaaguugaaagagcuguacucgaugaugguauauaucgcauaaugcagagaggccuauuaggacgcucccaaguggguguuggaguauuccaagagaacguauuccauacuauguggcauguaacucgaggagcuguguuaauguaccaagguaagagacucgagccuucgugggcaucuguuaagaaagacuugauaucuuauggcggaggauggcgauuacaaggaagcuggaacacuggagaagaaguccaggucauugcugucgaaccggguaaaaauccgaagaacguacagacagcaccuggaacauucaaaacuccugaaggugaagucggugcuaucgcucuagauuucaaacccggaacaucgggaucacccauaguaaaucgcgagggaaaaauuguagguuuauauggcaauggaguaguaacuacaucuggcacauaugucagcgcaauagcgcaagcaaaggcgucacaagaagggccgcucccggagauugaagacgaaguguuucguaaaagaaacuuaaccauaauggaucugcacccugggucaggcaaaacgagaagauaccuacccgcuauugucagagaagccauuaaaaggaaacuccgaacucucauauuagccccaacucguguugucgcaagugagauggcagaggcuuugaaaggaaugccaauuagauaucaaacuacugcugucaaaucggaacauacggggaaggaaauaguagauuuaaugugucaugcaacauuuacaaugcgacuacuuuccccuguaagaguucccaacuacaauaugauaaucauggaugaggcacauuucacagauccaucgucuauagcagcaagaggauauauaucaacuagaguaggaaugggagaagcagcagccaucuuuaugacugcaacuccuccugguagugucgaagcauucccccaaagcaaugcgguaauucaagaugaagaaagagauauaccagaaaggucuuggaacucagguuaugaguggauaacugacuucccuggaaaaaccguuugguuuguacccaguauaaaaucgggcaacgacauagcaaauugucuaaggaagaauggaaaacgaguaauacaacuaagucguaaaacauuugauacagaauaucaaaagaccaagaauaacgacugggauuacguaguaacaacggauauaagcgagaugggagcgaauuuuagagccgaucgcguaauugauccuaggagauguuugaaacccguaaucuuaaaagaugguccggaacgagucauauuggcggguccuaugccagucacuguugcgucugcugcgcagcggagggggaggguuggacgcaaucacaacaaagaaggugaccaauauaucuauaugggucaaccucuuaauaacgaugaagaccaugcucauuggaccgaagcaaaaaugcuccuagauaacauaaauacaccagaaggcauaauaccugcgcuuuucgaaccagaaagggagaaaagcgcugcaauugauggcgaauaccgacuaagaggugaagcuaggaaaacauucguagaacuuaugcguagaggagacuugccugucugguuaagcuacaaaguagccucagagggguuucaguauucagacagacguugguguuuugauggagaaagaaauaaucaaguacucgaggaaaacauggaugucgaaauauggacaaaagagggggagagaaagaaauuacgaccucggugguuagacgcgcguacauauucugauccacuagcucucagagaauuuaaagaguucgccgcagggcgcagaagcguuaguggagaccuaauauuagagauagguaaacuuccacaacacuuaacacaaagagcccaaaaugcacuagauaaucuaguaauguugcauaacagcgaacaaggaggacgagccuacaggcacgcaauggaagaauuacccgauacgauagaaacccucauguuguuagcauuaauagcugucuuaacaggggguguaacgcuauucuuucuaucaggacgcggcuuaggaaaaacgucuauuggacuacucugugugauggccucaagugucuuauuauggauggcuaguguugagccacauuggauagccgcuucuauuauacuagaguucuuucuaaugguauuauuaauaccagagccugacagacagaggacaccacaagauaaucaauuagcguauguaguaauaggacugcuauuuaugauauugacaguagcagcgaaugaaauggguuuauuagagacaacuaaaaaggacuuggguauaggccauguagcaguagaaaaucaucaccacgcugcaauguuggauguugaucugcauccagcaagugcguggacgcuauaugcaguggcuacgacuaucauaacuccuaugaugcgucacacuaucgaaaacacgacagcaaauauuagcuuaaccgcaauugcuaaucaagccgccauucuaaugggcuuagauaaagguuggccaaucucaaaaauggacauaggcguaccacugcucgcacuaggcuguuacucgcagguuaacccauugacacuaacagcagccguucucauguuaguugcccauuaugcuauuaucggaccuggucuucaagcaaaagcuacucgagaagcucagaaaagaacggccgcagguauaaugaaaaauccaacugucgacgguaucguagcuauagaucuagaucccgugguauaugaugcaaaauucgaaaaacagcugggccaaauaauguuauuaauacuuugcacaucccaaauccuguuaaugcggacaacaugggcguuaugcgaaagcaucacguuggcuacaggcccuuugacgacucuaugggaaggaucgccuggaaaauucuggaacacaacuaucgccguuucaauggcaaauauuuuucguggcucuuaccucgcgggagcgggcuuggccuucucauuaaugaaaaguuuagguggaggccgaaggggcacaggagcgcaaggagaaacacuaggagaaaaauggaaacgacaauuaaaucaauugucaaaaagugaauuuaacacguacaaacguuccggcauaauggaaguugaccgcucggaggcaaaagaaggacuaaagcgcggugaaacaaccaaacacgcgguuagucguggcacggcaaaacuaagaugguucguggaaaggaauuuaguaaagccagagggaaaagugauagaccuugggugcgggagaggcgguuggaguuauuauugcgcugggcucaagaaaguaacagaagugaaagguuauacaaaaggagggccaggacaugaggagccuauaccgauggccacauaugguuggaacuuaguaaaacuccacucagguaaagacgucuucuuuauuccacccgaaaaaugcgacacguugcuaugugacaucggcgaaagcagcccuaauccuaccaucgaagaaggcagaacucuaagagucuuaaaaaugguagagccguggcuccggggaaaucaauuuuguauaaaaauauuaaacccuuauaugccuucaguagucgagacacuggagcaaaugcagaggaaacauggaggaauguuaguaagaaauccucuaagccguaauuccacucaugagauguacugggugucauguggaacuggaaauaucguaagcgcagucaauaugacaucaagaaugcucuugaaucgauuuacgauggcacauagaaaaccgacauacgaacgcgacgucgacuuaggggcuggaacaagacauguugcugucgaaccggagguugcuaacuuagacaucauuggacaacguauagaaaauauaaaacacgaacauaaaucaaccuggcauuaugaugaagauaauccauauaaaaccugggcauaccauggaaguuaugaagucaagcccucaggaucagcaucaaguauggucaacggaguaguuaaacuguuaaccaaacccugggauguuauaccgauggugacacagauagcgaugacagacacgacaccuuuugggcagcaaagaguauucaaagaaaaaguagauacgagaacccccaaggcaaagagagggacaacccagauaauggaaguaacugcuagauggcuuuggucuuuucuaucuagaaacaagaaaccuagaauaugcacuagagaagaguuuacacgaaaaguccgaucaaaugcugcaauaggagccguuuuuguagaugaaaaucaauggaacucugcgaaggaagcuguugaagaugagcgcuuuugggaccuaguucacagagaaagagaguugcauaaacaagguaagugugcuacaugugucuacaauaugaugggcaaacgcgaaaagaaauuaggcgaauuugguaaagcaaaaggaagcagagcuaucugguauaugugguuaggggcacgauuuuuagaauuugaagcgcuuggauuuaugaacgaagaccauugguucuccagagagaacucacugucagggguugagggagaaggucugcacaaauuaggauacauuuuacgagauauuagcaaaauaccagggggcaauauguacgcagacgauacagcaggaugggacacccgaauaaccgaagaugaccuacaaaaugaagcgaagauaacagauauaauggaaccggagcaugcucuuuuggcuaaagccauuuucaaguuaacguaucaaaauaaaguaguuaggguacaaagaccggcgaagaacggcacuguaauggacgugauaaguagacgagaccagcgagguaguggucagguaggaacauacgguuuaaauacauuuacaaacauggaagcacaguuaauuagacaaauggaaagcgaaggaauauuuucaccaagugaauuagaaacaaguaauuuagcugaacguguacuugauuggcuagaaaaauaugguguugaacguuuaaagagaauggcuauuagcggagaugauugcguuguaaaacccauugaugauagguuugcaacugcguugacugcccugaacgacaugggaaaggugcguaaagauauaccgcagugggaaccaucaaaaggauggaaugacuggcagcaaguacccuuuuguucccaucauuuucaucagcuaauaaugaaagauggccgcgagauaguaguaccuuguagaaaccaagaugaauugguaggccgagcgcgagucagccaaggagccgguuggagcuuaagggaaacugcguguuuaggcaagucauaugcgcaaauguggcaauuaauguauuuucaccgucgugacuugagacucgcugcgaacgcgaucuguucagcaguaccggucgacuggguaccaacaaguagaacaacauggagcauacaugcacaucaucaauggaugacgacggaagauaugcuaucugucuggaauaggguuuggauugaagagaauccuuggauggaagauaaaacacauauaaguucuugggaagacguuccauaucuaggaaaacgagaggaccaaugguguggaucccuaauaggucuaaccgcuagagcaacuugggccacuaauauacagguagcuaucaaccagguaagacgucuuauagguaaugaaaauuacuuggacuauaugacgaguaugaaaagguuuaagaaugaaucugacccagaaggagcauuaugguaa

SEQ ID NO: 22072 - RNA, 9879 nt, Artificial Sequence
  derived and/or modified CDS sequence (opt6) from DENV-1__KC762647__SS-prME
aguguaacaaugcugcuuaugcuuacaccuacugccuuagcuuuucacuuaacaacucgagguggggaaccgcacaugaucguaaguaaacaagaacgagggaaaagucuucuauucaaaacaucugccggagucaacauguguacacuaauagccauggauuugggagaauuaugugaagauacucuuaccuauaaauguccaaggauuacggaagcagaaccugaugauguagauuguugguguaacgcgacugacacguggguaacuuauggaacauguucacaaaccggagaacaccguagagacaaacgcucugucgcguuagcuccacacgugggacuaggguuagaaacucgaacagagacuuggaugagcagcgagggggcauggaaacaaauucaaagaguugagacaugggcauuaaggcauccgggcuucacagugaucgcauuauuccuagcacaugcuaucgggacgagcauaacucaaaaaggaauaauauucaucuugcuaaugcuaguuacaccaaguauggccaugagauguguaggaauagguagucgggauuucgucgaaggcuuauccggugcaacauggguagacgucguacuugagcacggcuccugcguaacuacaauggccaaagacaaacccacguuagacaucgagcuauuaaaaaccgaaguaacgaacccugcaguacuacgaaaacuauguaucgaggcaaagauuagcaauacaacgacagauucaagauguccuacgcaaggagaagcgacacucguugaggaacaagacgcuaacuuuguuugcagaagaacauuuguagaucgggguugggggaacggaugcgggcuuuucggcaagggcucauugauaacaugcgcuaaauuuaaauguguuacaaaacuagaaggaaaaauaguacaauaugaaaacuuaaaauacagcguaauagugacugugcacacuggagaccaacaccaaguaggaaacgagaguaccgaacauggaaccacggcgacaauaaccccucaagcuccaacuacagaaauacaauuaacagacuauggugcacugacccuggacugcagcccuaggacgggauuagauuuuaaugaaaugguccuauuaacaaugaaagaaaaaucauggcuaguccacaaacaaugguuucucgacuuaccacugcccuggacuuccggggcuaguacaucgcaagaaacauggaauagacaagaucuauuaguuacguuuaaaaccgcucaugcuaagaaacaagaagugguaguauugggaucccaggaaggggcaaugcacacggcuuuaacaggugcaacagaaauccagacaucagguaccacaacaaucuucgcgggacauuuaaaauguagauuaaaaauggacaaacucacucugaaagggaugucguauguuauguguacagguucguuuaaguuagaaaaagaagucgcugaaacgcaacauggaacuguccuagugcagauuaaauaugaaggcaccgaugcaccaugcaagauaccuuucucgacgcaagaugagaaagggguuacacaaaacgggcguuugauuacagccaacccaaucgucacugauaaagaaaaaccaguuaauauagaggcugagcccccuuuuggagaaucuuacauaguuauaggcgcgggcgaaaaagcauuaaaguuaucuugguucaagaaagguaguuccauaggcaaaauguuugaagccacagcuaggggugcaagaaggauggcuauacuaggagacacagcuugggacuuuggaucuauagggggugucuucacuucuguugguaaacugguucaccaaauauuugguacagccuauggaguucuguuuucaggugugucguggacaaugaaaauaggcauaggaguucuauugacuuggcuuggacuaaauucgcguucaacaucgcuaucgaugacuuguauugcuguaggcuuaguuacacuguaucucgggguuauggugcaagcagauucugguuguguuauuaacuggaaagggcgagaauuaaaaugugguagugguauauucguaacgaaugagguucauacauggacagaacaauacaaauuccaggccgauucaccaaaaagguugagugcugccauaggcaaagcaugggaagaagguguauguggaaucaggagcgcgacacgcuuagaaaacauaauguggaaacaaaucucuaaugaauuaaaccauauauugcuagaaaaugacaugaaguuuacgguuguaguaggggauguggcagguauuuuagcgcaaggcaagaaaaugauacgaccgcaaccgauggaacauaaguacaguuggaaaagcuggggaaaggcaaagauaauaggggcggacguacaaaauacgacauuuauaauugacggacccaauacacccgaguguccugacgaccaacgcgcauggaacauaugggaagucgaagauuacggauuugguauauuuacaaccaauauuugguugaaauuaagggauucauacacacagguuugugaccauagacugaugucagcugcgauuaaggacucacgcgcuguacacgcugauauggguuauuggauagaaucggagaaaaaugaaacuuggaagcuggcccgugccagcuucaucgagguaaaaacauguguauggcccaagucacauacguuaugguccaauggaguauuagaaucugaaaugauuauuccaaagauuuaugguggucccaucucucaacauaauuaucgcccugguuauuuuacucagacugccggaccauggcacuuaggaaaauuagagcucgauuuugacuuaugugagggcacaacaguaguuguagaugagcacugugguaacaggggcccaucauugcguacgacaacaguuacaggcaagauaauacaugaaugguguuguagaucaugcacacuaccgccguuacgguucagaggcgaggacgguuguugguacgggauggaaauacguccggucaaagaaaaagaggaaaaucuaguaaaaucaaugguaagugccggcagcggcgagguugauaguuuuagcuugggccuacuaugcauuucaaucaugaucgaggaaguaaugcgaucaagauggucccggaaaauguuaaugacaggcacucucgcagucuucuucuuguuaauuaugggacaauuaacauggaacgaccugauacgacucuguauaaugguaggcgcgaaugcaucugaccggaugggcauggguacuacauaucucgcucuuauggcaacuuuuaaaaugcgaccuauguucgcagucggacuauuauuuagaagauuaacaaguagagagguauugcuucugacuauaggguuaaguuuaguagcgucgguugaauuaccuaauagucuagaagaauugggugauggccuugcaauggguauuaugauccucaaauuacuuacugauuuccaaucacaucaacuaugggcuacauuauuaucgcuaacuuuuauaaagacaacuuuuucacuacacuacgcauggaagacaauggcuaugguauuauccauaguuaguuuauuuccccuaugucuaucuacuacuucacagaaaacuacuuggcuaccgguguuguuagguucacuaggauguaaacccuugacaauguuccuuauagcagagaauaagaucuggggcagaaaaaguuggcccuugaaugaaggaauaauggcaguaggaauuguuaguauucuucuaucaucgcugcuaaagaacgauguuccuuuagcagggccauugauagcaggagggaugcuaauagcauguuaugucaucucuggcagcagcgcggauuugagcuuagaaaaagcagcugaggucucuugggaagaagaagcugaacacucuggagccucgcauaauauucuaguagaaguccaggaugauggaacaaugaaaauuaaggacgaggaaagggacgacacauuaaccauuuuacuaaaagcaacauuauuggcuguaucagguguuuacccguuaucuaucccugcaacguuguucgugugguacuuuuggcaaaagaaaaagcaacggagugguguacuuugggauaccccaucaccaccggaaguagagcgcgcuguucuugaugauggaauauacagaauuaugcagaggggucuacuaggacggagccaagucggcguagggguauuucaagaaaacguguuccauacgauguggcauguaacgagaggggcaguccugauguaucagggaaaaagauuggagccaucgugggcaucaguuaagaaagauuuaauuucauauggugguggguggagauugcaaggcucauggaacacgggagaagaaguacaaguuauagcaguagaaccagguaaaaaccccaaaaaugugcaaacugcaccagguacuuuuaaaacgccagaaggcgaaguaggagcuauagcauuggacuuuaagccuggaacaucaggcucaccuauaguaaauagagaaggaaagauuguaggauuauacgguaacggaguugucaccacgucuggaacauauguuucagcuaucgcucaagcaaaagcuagucaagagggcccacuaccagaaaucgaagaugaggucuuccgaaaaagaaaccucacuaucauggacuuacacccagguucuggaaaaacaaggcgcuaucuaccagccauugugagagaagcaaucaaaaggaaacucagaacacucaucuuagccccgacgaggguaguugcauccgaaauggccgaagcccuaaagggaaugccuauaagauaucagacuacagcugucaagucggagcacacugguaaggaaauuguugaucuaaugugucacgcaacauucacgaugcgacuauuaucucccgugagaguuccgaauuacaacaugauuauuauggaugaggcacacuuuacugacccuagcaguauugcggcacgugguuacauaaguacucgaguaggaaugggagaagcagcagcuauauucaugacugcaacaccaccagguagugucgaagcguuuccgcaaucgaaugcgguuauacaggaugaagaaagagacaucccagagaggagcuggaacucaggguacgaauggauuacggacuuuccugguaaaacagugugguuugugccuagcauaaaaucgggaaaugacauagcuaauugucuaaggaaaaauggcaaaaggguaauccaacuuagccgaaagacuuuugacacagaauaccagaaaacuaagaauaacgacugggauuauguugucaccacugauauaagugaaaugggagcaaauuuccgagcugauagagucauagacccgagaagauguuuaaaaccaguuauuuuaaaagacggaccggaacgaguuauauuggccggaccuaugccaguaacaguggcaagugcagcccaacgacguggucggguagguagaaaccauaauaaggagggugaucaauauaucuacaugggucaacccuuaaacaacgaugaagaucaugcacacuggacagaagcgaaaaugcuccucgacaacauaaauacuccagaaggaaucauuccagcauuauuugaaccagaaagagagaaaagugcggcaauugauggugaauaucgauuacgcggggaagcacguaaaacuuuuguagagcuaaugagacggggagauuugccuguuuggcuaagcuauaaaguagcaucggaagguuuccaauacucagacagaagaugguguuuugauggugaaagaaauaaucaaguacuagaagaaaauauggauguagagauauggacgaaagaaggcgaaagaaagaagcuaagacccaggugguuggacgcgagaacauacuccgauccacuugcauuaagagaauuuaaagaauuugccgcugggagaaggucgguaaguggggaucugaucuuggaaauagggaaauuaccucaacacuuaacacaaaaggcacaaaacgcauuagauaaccuuguuauguugcauaauucagagcagggaggacgugcauacagacaugcuauggaagaacugcccgauacgauagaaacauuaaugcuucuagcucuuaucgcaguucuuacaggaggagucacauuauucuuccuuaguggccgaggucuugggaaaaccucaauaggacuuuuauguguaauggccucaucaguauuguuauggauggcuucagucgaaccacacuggauagcagcauccauuauauuggaguucuuucuaauggugcuucuaauucccgaaccugauagacagaggacaccacaagauaaucaacuagcauacguuguaauaggucuccucuucaugauacugacagucgcugcaaacgaaauggguuuauuagaaacgaccaagaaagaucugggcauagggcauguagcuguugagaaucaucaccaugcagcaauguuggauguagaccugcauccagcuucugcguggacacuauacgcuguggcgacaacuauuaucacacccaugaugagacauacuaucgaaaacacgacagcuaauauuucguugacugccauagccaaucaagcugcuauucuuaugggacucgauaaaggauggccaauuaguaaaauggauauugguguaccucucuuggcacuuggauguuauucccaaguaaauccguugacacuaacugcggcaguucugaugcucguagcccacuacgcgauaaucggaccagguuugcaagcuaaagcgacucgugaggcacagaaacguacagcugcuggcauaaugaaaaacccaacagucgacgguauaguugcuauagacuuggauccagucguauaugacgccaaguucgaaaaacaguuaggucaaauuauguuacuaauccucuguacaagccaaaucuuguuaaugcgaacaacgugggcucugugugaaaguaucacacuugcaacgggaccacuuacuacccugugggaagggucacccggcaaguuuuggaacacgacaauagcagugagcauggcgaauauuuuuaggggcucauaccuggccggagcagguuuagcauuuucuuugaugaagucauuagggggagggagaagagggacuggagcacaaggggaaacauuaggagagaaguggaaacgacaauugaaccaacuuaguaaaucugaguuuaacacuuacaaacggaguggaauaauggaaguggaucgaucggaggcaaaagaaggauuaaaacgcggugaaacaacgaaacacgcuguaucaagagggacagccaaacucaggugguucgucgaaaggaaccuaguuaaaccagaaggaaaggugauagaucuagguuguggacguggcgguuggaguuacuauugugcaggauuaaagaaaguuacggagguuaaaggcuauacgaaaggaggaccgggacacgaggaaccuauaccaauggcaacauacgguuggaaucuggucaaacuccauagugguaaagacguauucuuuauaccucccgaaaaaugcgauacacuauuaugugauaucggggaguccucuccaaacccuacaauugaggaaggaaggacgcuaagggucuuaaaaaugguggaaccaugguuaagaggaaaucaguuuugcauaaaaguuuuaaauccauauaugccgagcgugguggaaacccuagagcaaaugcaaagaaagcaugggggcaugcuggugagaaacccacucaguagaaauucaacacacgaaauguauuggguauccugcgggacaggaaauauaguaucugcaguaaauaugacaagcagaaugcuacugaaccgcuucacaauggcccauagaaaaccgacguacgaacgugacguugaucuuggagcuggaacacgacacgucgcuguggaaccugagguugcaaaccuagauauaauuggacaaagaauugaaaacauuaaacacgaacacaaaucgacuuggcauuaugaugaagacaacccauauaagacaugggcauaccauggcucguaugagguuaaaccuucuggaagugcgucaaguauggugaacggagugguuaaauuguuaaccaagccgugggacguaauuccgaugguaacgcaaaucgcaaugacagauacuacuccauuuggucaacaacgaguauucaaagaaaaaguagauacaagaacgccaaaagcgaaaagaggaacgacucaaauuauggaagugacagccagaugguuaugggguuuucuaucaagaaauaagaaaccaaggauauguacuagagaagaguucacuagaaaaguacgauccaaugcugcgauuggugccguuuucguugacgaaaaccaauggaacucugccaaggaagccgucgaagacgaacgauuuugggaccuuguacauagggagagagaacuucauaaacaagguaagugugcgaccuguguauacaacaugauggguaaacgugagaagaaacuaggagaguucggaaaagcaaaaggaucaagagcaauaugguauauguggcucggagcaagauuuuuagaauuugaagcgcuuggcuucaugaaugaggaucauugguucagucgagaaaauagucuauccggaguagaaggggaagguuugcacaaauugggauacauauuacgagacauuaguaaaaucccgggcgguaacauguacgcagacgauaccgccggcugggacacuagaauaacagaagaugaucuccaaaacgaggcuaaaauaaccgacauaauggaaccugagcacgcauuacuggcuaaagcaauuuucaaacugacuuaccaaaacaaggugguaaggguacaaaggccagcuaaaaacgggacugugauggacgugauaucaagacgggaucagagagggagcggccaagucggaacguauggauuaaauacauucacgaacauggaagcucaguuaauaaggcaaauggaaucagaggggaucuucagcccaagugaacuagagacaccuaauuuggcugagagaguacuggacuggcucgaaaaauacggaguggagcgauuaaaaaggauggcaauaucuggugacgauugcguugucaaaccgauugacgauagauucgccacagcuuugacagcuuuaaaugacauggggaaaguucgaaaagauauuccgcagugggaacccucuaaaggguggaaugacuggcaacagguacccuucugcucacaucauuuucaccaauugauaaugaaagacggaagagaaauagucgugccguguagaaaccaagacgaacuuguggguagggcacgaguaagucaaggagcaggauggagccucagagaaccggcgugucuagguaaguccuacgcacagauguggcaacuuauguacuuucauagaagagaucucagacuagcggcaaaugcgaucugcuccgcuguuccuguagacuggguuccaaccucgcgaacaacuuggucaauucaugcacaccaucaauggaugacaacggaagacauguuaucaguauggaauaggguauggauagaggaaaauccauggauggaagauaaaacccacauaagcaguugggaggauguaccuuacuuaggcaaacgagaagaucaguggugcggcucacuaauugggcugaccgcacgagccacuugggcaacaaacauccaaguugcaauuaaucaagugcgcagacuuaucgggaacgagaauuaccuggauuacaugaccagcaugaaacgauuuaaaaaugaaucagauccagagggugcucuaugguaa

SEQ ID NO: 22073 - RNA, 9879 nt, Artificial Sequence
  derived and/or modified CDS sequence (opt6) from DENV-1__KC762639__SS-prME
ucaguaacaaugcucuugaugcugacuccaacggcucuugcauuucaucucacuacgaggggaggggagccccacaugaucgugagcaaacaggaaagaggaaagagcuuguuauuuaaaacaucggccgguguaaauauguguacauuaauugcaauggauuuaggagaauuaugcgaagauacuuuaacguauaaauguccaagaauaacagaggcagagccggaugauguugauugcugguguaaugcaacugacacguggguuaccuacggcacuugcucacaaaccggugaacacagacgagacaaacguucaguggcauuagcgccucacguugggcuggguuuagaaacucggacagaaacguggaugucgucagaaggagcauggaaacagauucaaagaguagaaacaugggcauuaagacauccagguuuuacuguaauugcgcuauuuuuagcccacgcuauuggaacaaguauaacgcaaaaagggauaauauucauacuguugaugcuuguaacgccaagcauggcaaugagauguguuggaauaggaucgagagauuucguagaaggacuaagcggcgcuacaugggucgauguuguccucgagcauggguccugugucacgacaauggcuaaagacaaaccaacuuuagauauagaacugcuuaaaacagaggucacaaaucccgcuguccucaggaaauuguguauagaagcaaaaauuucaaacacaacuacagacucacgcuguccaacccagggcgaagcaacgcuaguggaagaacaagacgcaaauuucguuugucgacggacuuucguggacagagguugggggaauggcugcggucuauuugguaaaggaucauuaauaacaugugcuaaauuuaaaugcguaaccaaauuggaagguaaaauaguucaauaugaaaaucugaaauauucuguuauaguuacuguacacacgggugaccaacaccaagugggcaaugaaucuacggagcauggcacuacggccaccauaacaccucaagcaccaacaacagaaauacaguuaacagauuacggggcuuuaacuuuggauuguucaccuagaacgggacuggauuuuaacgaaaugguauuacuaacaaugaaagagaaaucuugguugguacauaaacaaugguuucuagaucuccccuugccauggacaaguggcgcauccaccucacaagaaacauggaaucgacaagaccugcuggucacuuucaaaacugcccaugccaagaaacaggaaguuguaguacuuggaagccaagagggggcuaugcauacugcgcuuacaggugcaacagagauacaaaccucagguacaacuacuauauuugcaggacacuuaaaauguagacuaaaaauggauaagcuaacacuaaaaggcaugaguuauguaaugugcacaggaucauuuaaauuagaaaaagaagucgcggaaacccaacaugguacuguccuugugcaaauuaaauaugaaggaacggacgcuccgugcaaaauaccuuuuucuacacaagaugagaaagggguuacacagaauggucgcuugaucacugcaaaucccauaguuacagauaaagaaaaaccagugaacauugaagcugaaccaccuuuuggagaaaguuauaucgucauaggugcuggagaaaaggcuuuaaaacucucaugguuuaagaaaggaagcucgauaggaaaaauguucgaagcuacagcccgaggggcccgcagaauggcgauccuaggagauacggcaugggauuucgggagcauagguggcguguuuacgucagucgguaaacucguccaucagauuuuugggacagccuacgggguccuauucaguggaguaaguuggacuaugaaaauaggaauaggaguacuauuaaccuggcucgguuuaaacucaagaucuacaagucugucaaugacaugcauugcugucggacuugugacauuauaucuaggaguaaugguacaagccgacaguggauguguaauaaacuggaaaggaagggaauuaaaauguggaagcgguaucuuuguaacaaaugaaguacauacuuggacagagcaguacaaauuccaagcugauucuccgaaaagauugucagcugcgauagggaaagcgugggaggaaggaguaugcgguaucaggucggcgacacgguuggaaaauauaauguggaaacaaauaucaaacgaauuaaaucauauacuucucgagaaugacaugaaauuuacagugguuguaggagauguagcuggaauccuugcgcaggguaagaaaaugauacgaccgcaaccaauggaacauaaauauucuuggaaaagcugggguaaagcaaaaauaauaggagcugauguucagaacacuacguuuauaaucgacggaccaaauacaccagaauguccggaugaucaacgagcauggaacauaugggaagucgaagauuacggauuuggaauuuuuacuacuaacauuugguuaaaacuucgagacaguuauacacaggucugugaucaucgauuaaugucagcugcaaucaaagauucgagagcaguucacgcugacaugggauacuggauagaaucugagaaaaacgaaacuuggaaauuggcacgggcaaguuucauagaaguaaaaaccuguguauggcccaaaucucauaccuuauggucuaauggaguucuugaaagcgaaaugaucauaccuaaaauauacggugguccgauaucgcaacacaauuauagaccaggguauuuuacgcaaacggcaggaccauggcauuugggaaaacuagaauuggacuuugaccuaugcgaaggaacgacgguuguaguugacgagcauugcggcaacagagguccgucccucagaacuacaacugucacaggcaaaauuauacaugaaugguguugucggucauguacacuuccaccuuuaagauuucgcggagaggacggcuguugguacgggauggaaauaagaccuguuaaagaaaaggaagagaaucugguaaaaucgaugguaagugcaggaaguggagaaguagacagcuuuagucuuggacuccuauguauaagcauuaugaucgaggaaguaaugagaucccguuggagcagaaaaauguuaaugacaggaacuuuagcagucuucuuuuugcuaauaaugggucaacuaacauggaaugauuuaauacggcuuugcauaaugguaggcgcuaacgccagcgaucgaaugggaaugggaacuacguaccuugcacuaauggccacauuuaaaaugcguccuauguuugcuguaggcuugcuauuccggcgcuugacuucucgcgaaguuuugcuucucacgaucggcuuaucguugguagcaagugucgaauuaccuaacaguuuagaagaacuuggugacggauuggccauggggauaaugauauugaaacucuuaacagacuuccaaucacaucaacuuugggcgaccuuauugucuuuaacauucauuaagacaacuuucagucuacacuacgcauggaagacaauggcaaugguucuaucuauagucucacucuuuccuuuguguuuaagcaccacaucgcagaaaacuacuugguuaccuguauuauuaggcucacuuggauguaaaccuuugacgauguuucucauagcagagaauaaaauauggggucgaaaaucguggccgcucaacgaaggcauaauggcagugggcauaguaucaauccugcuaucaucauugcugaaaaaugauguaccccuagcgggaccacuaauagcaggagggaugcuuauugcaugcuacgucauuucaggaucaagugcagacuuaucccuagaaaaagcggcugaaguaaguugggaagaagaggcugaacauuccggcgcgucucacaacauucuugucgaaguccaggacgauggaacaaugaagaucaaagaugaagaaagagacgauacuuugacuauauuauuaaaagcaaccuuguuagcaguaucgggaguauacccuuuaaguauacccgcaacacucuucgucugguacuucuggcagaagaagaaacaacgaagcggaguucuaugggauacacccucuccacccgaaguugaacgugcaguauuagacgauggaaucuauagaauaaugcaaagaggauuacuugguagaucgcaagugggaguaggaguuuuccaggaaaacguuuuccauaccauguggcauguaacaagaggagcgguuuuaauguaucaggggaaaagacuagaaccaucaugggcgaguguuaagaaagaucuaauaaguuacgguggaggcuggcggcuacaaggcucuuggaacacaggagaagaaguacaagugaucgcuguugaaccuggcaaaaacccaaagaauguccaaacggcaccuggcacuuuuaaaacaccugaaggggaaguuggagcaauagcccuagacuucaaaccagggaccaguggaaguccaaucguaaauagagaagggaaaauagugggacuguauggaaacgggguaguaacgacuucgggaacguacguuucagcaauugcucaggcgaaagcgucacaggaaggacccuuaccggaaauagaggaugaaguuuuucgcaagcguaauuugacaauuauggaccugcaucccggaucaggaaagacaaggagguaccucccugcgauuguaagagaagcgauaaaacguaaauuaagaacccuuauucuugcaccaacuagagugguugcuagugaaauggcggaggcuuugaaaggcaugccaauaagguaucagacaacagcgguuaagucugagcacacgggaaaagaaaucguagacuuaaugugccaugcgacauuuacgaugcgucuauuaucaccaguucgaguuccuaacuacaauaugaucaucauggaugaagcgcauuuuacagauccaaguagcauagcagcgagaggauauauuuccacgagaguaggcaugggagaggcugccgccauauucaugacagccaccccaccagguucaguagaagcauucccucaaucuaaugcaguaauacaagaugaagaaagagacauuccugaacgcucauggaacucuggauaugaauggauaacagacuuuccuggcaaaacugugugguuuguacccucaaucaaauccggcaaugacauugcaaauugucuaaggaaaaacgggaaacgaguuauucagcuuagucggaagacuuuugauacggaguaucagaaaaccaaaaacaacgacugggauuaugucgucacaacagacauaucugaaaugggagcaaauuucagggccgaucguguaauugacccaagacgaugucuaaaacccguaauauugaaggauggaccugaacguguaauacuggcaggaccuaugccaguaacuguagcuagcgcugcgcaaagacguggcaggguaggaaggaaucacaauaaagaaggagaccaauacauuuauaugggccaaccuuuaaauaacgaugaagaucacgcacauuggacagaggcuaagaugcuuuuagauaauauaaauacuccagaggguauuauaccggcucuauuugaaccagaaagagagaaaagcgcagcuaucgacggcgaauacagacuccgaggagaagcgaggaagacuuuuguugaauuaaugcguagaggggaucuaccaguauggcuauccuauaaaguugcuucagaaggauuccaguacuccgaccgucgaugguguuuugauggggaacgaaacaaucaaguuuuagaagaaaauauggacgucgagauauggacuaaagagggagaacguaagaaguugagaccaagauggcucgacgcacguacguacucagacccgcuugcacuucgugaguucaaagaauuugcggccgguagacguucuguuucaggagaucuaaucuuagaaauagguaaacugccgcaacaccuuacccagaaagcucaaaaugcauuagacaaucucguuauguuacauaauagugaacagggcggacgugccuacagacacgccauggaggaauuaccugauacuauagagacguuaaugcuucuggcccuaaucgcaguacuaacaggagggguaacguuauucuuucucagugggcguggucuagguaagaccucgauaggacuacuuugugucauggccagcagcguacuguuguggauggcaagcguagagccccacuggauugcagccaguaucaucuuagaguucuuucugaugguacuacuaauaccagaaccagacagacaacguacaccgcaagacaaucagcuggcuuaugucguuaucgggcuguuguuuaugauccuaacgguagcagccaacgaaaugggacuacucgaaaccacuaagaaagaccuagguauugggcacguugcgguagaaaaccaucaucacgcugcuaugcucgauguugaccuucaucccgccagcgcauggacccuguaugcagucgcaacaacgauaauuacuccuaugaugaggcauacuauagaaaacacgacagcgaacaucucucuaacagcaauugcuaaccaggcugcuauccuaaugggccuagacaagggguggccuauaucaaaaauggacaucggugucccauuauuggcuuuagguugcuacagccaaguaaauccguugacacuaaccgcugcuguuuuaaugcuuguagcucauuaugccauaauagggccgggauuacaggcaaaagcuacuagagaagcucagaagcgaacggcugcuggaauuaugaaaaauccaacgguggacggaauuguugcaauagauuuagauccagugguauaugaugcaaaguuugaaaaacaacuaggucagaucauguuacuaauacuauguacaucucaaauacuucuuaugagaacuacuugggcauuaugugagucuauuacuuuagcaacaggaccuuuaacaacucucugggaagggucgccaggaaaauuuuggaauacaacaauugccgucagcauggccaacauauuucggggaucuuaucuggcuggugcuggacuagcauuuagucuaaugaaaucucuuggggguggacggcgagguaccggugcucagggggaaacacuaggugaaaaauggaaacgccagcuaaaucagcuaucaaaaucagaauuuaauacguauaagcguucugggauuauggaaguugaucgauccgaagccaaagaaggacugaaacguggugagacaacgaaacacgcuguuaguagggggaccgcgaaauugcgaugguuuguugaaaggaacuuaguaaaaccugaggguaaaguuauugaucuugguugugguagaggggguuggagcuauuauugcgcaggucuaaagaaagucacggaagucaaaggcuacacaaagggugguccaggucacgaagaaccuauaccuauggccacuuacggauggaaucuaguaaaauuacauagcgggaaagacguauucuuuaucccuccggagaaaugcgauacuuuacuuugugauauaggagaaagcucuccuaacccuacaauugaagaaggaagaacccucagaguauuaaaaauggucgagcccuggcuaagaggcaaucaauuuuguauaaagguacucaaucccuauaugccuagcgugguggagaccuuagagcaaaugcaaaggaaacauggagguaugcuagucagaaacccauuaucacguaacucgacccaugaaauguauuggguaucauguggaacagggaauaucguaucagcagucaauaugacgagucgaauguuacugaaccgauucacuauggcccauaggaaaccaacauacgaaagagacgucgaucuaggagcaggaacgcgacacguagcuguagaaccugaaguagcgaaucuugacaucauaggacaacgaauugaaaauauaaaacacgagcauaaaucuacauggcauuacgacgaagacaauccauauaaaacuugggcuuaucauggaaguuaugaaguaaaaccauccgguuccgccucauccaugguuaauggaguaguaaaguuguuaacaaagccuugggaugucauacccauggugacacagauugcaaugacugauacgaccccguuuggacagcagcgaguauuuaaagaaaaaguggauaccagaacaccgaaggcgaaaagaggcacgacccaaauuauggagguaacggcaagaugguuauggggauuucuaaguagaaacaagaaaccccgaauuugcacuagggaagaauuuacaagaaaaguaaggucgaacgcagcuauaggagcaguguucguagacgagaaccaauggaacagcgcgaaagaagccguagaagacgaaagauuuugggaucucguccacagggaaagggaauuacauaagcaagguaagugugcaacauguguauacaacaugauggguaagcgggagaaaaagcuaggcgaguuuggaaaagccaaggguagucgcgcuauaugguacaugugguugggagcuagguuucucgaguucgaagccuuaggauucaugaaugaggaccauugguucucgagagagaauagccuuucgggaguagaaggagaagggcuucacaaauugggauacauuuugagagauauaagcaaaaucccaggagguaauauguaugcugaugauacugccgguugggauacacgaaucacagaggacgauuuacaaaaugaagcuaaaauaaccgauauuauggagccagaacacgcacuucuggcuaaggcaauauuuaagcucaccuaccaaaacaaagucguccggguacaacgaccagccaaaaacggaacgguuauggauguaauaagccgacgcgaucaacgagguagcggacaaguuggaacauauggucuaaauacguucacaaacauggaagcacaauugauaagacaaauggagagugagggcauauuuuccccaucugaauuagagacgcccaaccuugcagaacgaguguuagauuggcuagagaaguauggaguugagagacuaaagcguauggcaauaagcggugaugauuguguagugaaaccgauagaugaucgcuucgcaacagcucugacagccuugaaugacaugggcaagguaagaaaagauauaccacaaugggaaccaucaaaaggcuggaaugauuggcaacaagucccuuucuguagucaucauuuccaccaauuaauuaugaaagacggacgagaaauugucguaccaugccggaaccaagacgagcuaguagguagggcccgggugucucaaggggcuggauggucgcuccgagaaacagcgugcuuaggaaaaaguuaugcucaaauguggcaacuaauguacuuccaccguagagaucugagauuagcagcaaaugcgauuuguagugccgugccaguagacuggguaccaacgagccggacaacaugguccauucaugcgcaucaucaauggaugacuaccgaagauauguugaguguuuggaaucggguauggauagaagaaaauccauggauggaagauaaaacccacaucaguucaugggaggauguaccguauuugggaaaaagagaagaucaaugguguggcagucuaauaggucugacggcgcgagcaacaugggcaacgaauauacaaguagcuauaaaucaagugcgccgcuuaauaggaaacgagaauuaucucgauuauaugaccagcaugaaaagauuuaaaaacgagucagauccagagggagcacugugguaa

SEQ ID NO: 22074 - RNA, 9879 nt, Artificial Sequence
  derived and/or modified CDS sequence (opt6) from DENV-1__KC762642__SS-prME
aguguuacaaugcuacuuauguugaugccaacagcacuugcguuucacuuaacaacaagggguggggaaccacauaugauugucucgaaacaagaacgaggaaaaucauugcuguucaaaacaagcgcggguguaaacauguguacacuuauagcaauggaccucggggaauugugugaagauaccuuaacauauaaauguccucgaauaacugaagcagaaccagaugaugucgauugcugguguaacgcaacagacacuuggguaacauacggaacuugcagccaaacuggagaacauaggcgugacaaacguaguguugcacuugcaccacacguuggacucggacuagaaacaagaacggagacuuggaugagcagugaaggugcauggaaacaaauccaaagaguagaaacuugggcucucagacauccaggauuuaccgugauagcucucuuccuagcacacgcaauaggaacauccauuacacaaaaggguauaauuuucauauuguuaauguuaguaacgccuucuauggcaaugagauguguaggaauuggaucgagagauuucguugagggucuaucuggagcaacgugggucgacguuguacuugaacaugguucaugugucaccacuauggcgaaagacaaaccgacacuugauauagaacuucucaaaacugaaguaaccaauccggcaguuuuacgaaaacuuuguauagaagcaaaaauaagcaacacuacuacggauucgcggugcccaacacaaggagaagcuacacugguagaggaacaggaugccaacuucgucugcagaagaacuuucguagacagaggauggggaaauggcugcggacuuuuugguaaaggaagccucauaacaugugcuaaauuuaagugugucacaaagcuggaaggaaaaauaguacaauaugagaaccucaaauauuccguaauuguaacuguucacacaggcgaccagcaucaaguggguaaugaaucuacagagcacggcacgacagcaaccauaacaccucaagccccaacuacugaaauacaauugaccgauuauggugcguuaacguuggauuguucaccgagaaccggguuagacuucaaugaaaugguacuuuuaacuaugaaagagaaaagcugguuaguccacaaacaaugguucuuagaccuaccgcuaccauggacuucaggugcaucaacaacucaagaaacauggaaucgacaggaucuucugguuacguucaaaacagcacacgcuaagaaacaagaaguugucguucuagggucccaagaaggcgccaugcauacagcuuuaaccggagcaaccgaaauacagacgucugggacuacuacaauauuugcaggacacuuaaaaugccgccucaaaauggauaaacuuacauugaaaggcaugucauacguaaugugcacaggaucguucaaacuugagaaagaaguagccgagacgcaacaugguacgguauugguccagaucaaauacgaagguacugacgcucccugcaagauuccuuucucuacacaggaugaaaagggagugacacaaaaugguagauuaauaaccgcaaacccaauaguuaccgacaaggaaaaaccgguuaauauagaagccgagccucccuucggugaaaguuauauuguuauuggugccggugaaaaagcauuaaaacuaagcugguuuaagaaagguucuucaaucggaaaaauguucgaagccacugcacgcggcgcacgcaggauggcgauucuaggcgauacagcuugggauuucggauccauuggagggguauuuaccucaguaggaaaguuaguacaccagauuuucggaacagcauauggcguccucuucaguggggucaguuggacuaugaagauaggcauugguguucuacuuacuugguuaggucucaacucuagaucuaccagucuuuccaugaccuguaucgcagucggccuagucacccuguaccuuggaguaaugguccaagccgauucugguuguguuauaaacuggaaagguagagaguuaaaaugcggaucgggaauauuuguuaccaaugaaguacacacauggacugaacaguauaaauuucaagccgauaguccgaaaagauugucugcagcuauuggaaaagcaugggaggaaggaguauguggaauaagaucggcaacaagauuggagaacauuauguggaaacaaauauccaacgaacuuaaucauauauuacuggaaaaugacaugaaauuuacaguuguuguaggggacguagcgggcauuuuagcacaggguaagaaaaugauacgaccccaaccaauggaacauaaauacucuuggaaaagcugggguaaagcaaaaauaaucggugccgauguacaaaacacuaccuucauuaucgacggcccaaauacaccugaaugcccggacgaccagcgagccuggaauauaugggaaguagaagauuauggauucgggauuuucacaaccaauauauggcuaaaauuacgugauucguauacccaagucugcgaucaccggcuaaugagugcagcuauuaaagacagcaaagcaguacacgcagacaugggauauuggauagaaucugagaaaaaugagacauggaaauuggcgagggcaaguuuuauagaaguaaaaacuuguauauggccaaagucccacaccuuauggucaaacgguguacuggaaagugaaaugaucauuccaaaaauauacggaggaccaauaucgcaacacaacuacagaccaggauauuuuacacaaacugccggaccauggcaccuaggcaaguuagaauuagauuuugaucucugcgaaggaacuacagucgugguugaugaacacugcgguaauagaggccccucacuucguacaacaacugucacgggcaagauaauucacgaauggugcugcagaaguugcacgcuaccaccacugagauuuagaggugaagauggauguugguauggaauggaaauuaggccgguuaaagaaaaagaggaaaaucuuguaaaaucuaugguaagcgccgguucuggggaagucgauucauuuagucucggguugcugugcaucucuauaaugauagaagaagucaugcgaucacgaugguccagaaagauguuaauaacaggaacauuagcuguauucuucuuacucauaaugggccaaguaacauggaaugaccuaacaaggcuauguauuauggucggagccaacgcaucugauaggaugggcauggguacuacauauuuagccuuaauggcuacauuuaaaaugcgcccuauguuugcagugggucugcuauuucgaagauuaaccucucgagaaguuuuacuucuaacgauaggguugucuuuaguagcaucuguggaauuaccaaauagucuugaagaacucggcgauggcuuagcgauggggauaaugauucuaaaacuuuuaacugauuuucaaucccaucaacuaugggcuacacucuugaguuuaacauuuauaaagaccacauucagucuacauuaugcuuggaaaacuauggcaaugguucuaucaauaguaagucuguuccccuuguguuuaaguacuacaucccagaaaacgacuugguuaccuguguuacucgggucuuugggaugcaagccucucacaauguuucugauugcagaaaacaaaaucugggguagaaaaucauggccacuuaaugaaggaauuauggcaguuggaauuguuaguauccugcuaucuucuuugcuuaagaacgauguuccacuagccggcccauugauugcggguggcaugcuuauagcuuguuacguaauaucuggaaguucagcugacuugucuuuggagaaagcggccgaaguaaguugggaggaagaagcagaacacucgggagcaucgcacaacauucuuguugagguacaggaugacgggacuaugaagauaaaggaugaagagagagacgauacucuuacuauacuauuaaaagcaacacugcucgcugugucgggcguuuauccucuuagcaucccagcuacccuguucgucugguauuuuuggcagaaaaagaaacaacggucaggaguuuuaugggauacaccaucuccucccgaaguugaacgagccgucuuagacgauggaauauaucggauaaugcaaagagguuuguuaggccgaucucaggucggaguagguguuuuccaagaaaauguauuucauacuauguggcacguaacaagaggggcuguguugauguaccagggaaaaaggcucgagccaaguugggcaucagucaagaaagauuuaauaaguuauggagguggcuggagguugcaaggcagcuggaauacaggcgaagaaguacaaguuauagcuguagaaccaggcaaaaaucccaaaaacguacagaccgcaccaggaacuuuuaaaacuccugaaggugaaguuggagcaauugcguuggauuuuaaacccgguacgagugguucaccuauuguaaacagggaaggaaaaauaguaggguuguacgguaauggaguaguuacaacuucaggcacuuauguuagugcaauagcacaggcaaaagcaucgcaagaagguccucuuccugaaaucgaggaugaaguauuuagaaaaaggaaucucacaaucauggacuuacauccaggaagcggaaaaacaagaagauacuuaccugccauugucagagaggccauaaagagaaaacuacggacgcuuauacuugcgccaacacgcgugguagcguccgaaauggcagaagcacuuaaggguaugccgauacgcuaccagacgaccgcagucaaaagugaacacacuggaagagaaaucguggaucuaaugugccacgcgaccuuuacuaugaggcuacuuucgccaguaagggucccuaacuauaacaugauaauaauggaugaggcgcacuuuacagauccaucaucaauugcagcccgagguuauauuucaacgcgugucggaaugggggaagcagcagcaauauuuaugacagccacaccacccggaagugucgaagcguucccacagaguaacgccguaauacaagacgaggaaagggacaucccugaaagaucauggaacuccggauacgaauggauuaccgacuucccagguaagaccgugugguucguaccuucaauaaagucugguaaugauaucgccaauugccuaaggaaaaauggaaaaagaguaauacaauuaucaagaaagacuuuugacacggaauaccaaaagaccaaaaacaacgauugggauuauguuguaacaacagauauaucagagaugggugcgaacuuuagagcugauagggugauugauccaagacgguguuuaaaaccaguaauauuaaaagaugguccugaacgaguaauucuggcaggaccaaugccuguaacaguugcuucagcugcucaacgaagaggucguauaggcagaaaccacaauaaagaaggugaucaauacauauauaugggacaaccauuaaauaaugaugaagaccacgcacacuggacggaagcaaagaugcuacuagacaauaucaauaccccagaagguauaauuccagcauuauuugagcccgagcgcgagaaaagugcagcuauagacggugaguauagauugagaggagaagcgcgaaaaacuuuuguagagcucaugcggagaggagaucuaccagucuggcugucuuauaaaguagcaucugaagguuuccaauauuccgaucgacgauggugcuucgauggagaaagaaacaaucaaguucucgaagaaaauauggauguggagauauggaccaaagaaggcgaacgcaagaaauuacggccaaggugguuagaugcccgaacauacucugauccacuggcacuccgagaauuuaaagaguucgcggcgggccgucgcucuguaucaggugacuugauuuuggagauuggaaagcucccucaacauuuaacccaacgcgcccagaaugcauuggauaaucuuguuauguuacacaacucggaacaaggagggagagcauaccgccacgcuauggaagaacuuccagacacgaucgaaacucugaugcuacuugcguugauugccguauuaacaggagguguuacacuauucuuuuuaagcggccgggggcuuggaaagaccucgauagggcuucuaugcguuauggcuagcaguguucuccucuggauggcaagcguagaaccacacuggauagcugcaucaaucauauuagaauuuuucuugaugguacuacuaauaccggaaccagaucgacaaagaacuccgcaagauaaucaacuagcguauguagucaucggccuccuguucaugauacucaccguugccgcuaaugaaaugggcuuauuagaaacuacuaagaaagaucugggaauagggcacgucgcuguggaaaaccaucaucaugcggccaugcuagauguagacuuacacccugcaucagccuggacucuguaugcuguugcaacuacaauaauaacgccgaugaugagacauacuauugaaaauacaacugcgaauauaucccuaacagcaauagcgaaccaggcagcuauacuaaugggacuagacaaaggcuggccgaucagcaagauggauauuggcguuccccuucuugcauugggcugcuauucucaaguaaauccucuaacacucacggccgcuguacucauguugguagcgcacuacgcgaucauuggaccaggacuacaagcaaaggcuacaagagaggcucagaaaagaacugcagcuggaaucaugaaaaaucccacggucgacgggauaguagcaauagaccuagauccagucguauacgaugcuaaauuugaaaaacaacucggucaaauaauguuauuaauucuguguaccagucaaauccuacugaugcgaacuacgugggcucuuugcgaaucaauuacacuggcuacaggaccgcuaacaacccucugggaagguagcccagggaaauucuggaauacuacuauagcuguaucgauggccaacauauuuagagggaguuaccuagcaggggcagguuuagccuuuucuuuaaugaaaucacucgguggaggaagacguggaaccggggcacaaggugaaacauugggggaaaaguggaaaagacaacuaaaucagcucucaaaaucggaauuuaauacauauaagagaucuggaauuauggaaguugaucgaucagaagccaaagaaggguuaaaaagaggagaaacgaccaaacaugcugucagcagagguacagcgaaacuaagaugguuuguggaacgaaacuuggucaaaccugaagggaaagucauagauuuaggauguggucguggagguuggaguuacuauugcgcaggucuaaagaaagucacugaagucaaaggauacacuaaaggggguccuggacacgaagaaccuauaccuauggcuaccuacggguggaaucucguaaagcugcauuccggaaaggauguuuucuuuauaccgccugagaaaugugacacauugcucugugauaucggggaauccucacccaauccaaccauagaagaagggcgaacauuaagaguacuuaaaaugguagaaccaugguuacguggcaaccaauucuguaucaaaauacuuaaucccuacaugccaucagugguggagacguuagaacagaugcaaaggaaacauggcggaaugcugguaaggaauccccugucgagaaacagcacgcaugaaauguauuggguuucuuguggaacaggaaacauuguuagcgcgguaaacaugacgaguagaauguuacuuaaccgauuuacuauggcccacagaaaaccaaccuacgaacgcgauguugaccucggagcagggacuaggcaugucgccgucgagcccgaaguagcuaaccuugacaucauaggccaacgaaucgaaaauauaaaauacgaacacaaauccaccuggcauuaugacgaagauaauccauacaaaaccugggcauaucaugggaguuacgaagugaaaccaaguggaagcgcgagcucaauggugaauggaguagugaaacuucuuacgaaacccugggauguaauaccaaugguuacacaaauagccaugaccgauacgacacccuucggucaacaacguguuuuuaaggagaaggucgauacgagaacacccaaagcgaaaagagguacggcucagauaauggaaguaaccgccagauggcuuuggggauuccuuagcagaaauaagaaaccaagaaucuguacuagggaagaguucacgcgaaagguacgguccaaugcagcuauuggugcaguauucguugacgaaaaccaguggaacagcgcaaaggaagcuguggaagacgaacgcuuuugggaccucguacaccgggaaagagaauugcacaaacaagguaaaugugcaacuuguguauauaauaugaugggaaaacgcgaaaagaaacuuggggaguucgguaaggcaaaaggaaguagagcaauuugguauauguggcuuggugcgagauuuuuagaauuugaagcacuggguuucaugaaugaagaccauugguucucucgagaaaauucuuugucagguguugaaggugaaggcuuacauaaguuaggauauaucuugagagauauaagcaaaauaccaggcgggaauauguaugccgaugacacagccggaugggauacgaggaucacugaagacgacuuacaaaaugaagcuaaaauaacagauauuauggaaccugagcacgcacuuuuagccaaggcuguguuuaaacucacguaucaaaauaaagugguacgcguacaacgcccugccaaaaauggcacuguaauggauguaauauccagaagagaucaaagaggaucaggacaaguagguacguacggguuaaauacauuuacuaacauggaagcacaauuaauaagacagauggagucagaggggauauucucgcccucagaguuagaaaccccgaacuuagcagagcgcgucuuguacuggcuagaaaaguauggaguugagagguuaaaaaggauggcaauuucaggagaugauuguguaguuaaaccuauugacgaucguuucgcaacggcccugacagcuuuaaacgauauggggaaagucagaaaagacauaccucagugggagccaagcaaagguuggaaugauuggcaacaaguuccauucugcucucaccauuuucaccaauugauuaugaaagaugggcgagagauaguaguaccuugcagaaaucaggacgaauuggugggacgggcgagggucucucaaggagcagguuggucacuccgggaaacggcaugcuuaggaaaaucauaugcucagauguggcaacuaauguauuuccaucgcagggaucuaaggcuagcugcaaaugcgauauguucugcagucccaguugauuggguuccaaccagccggaccaccuggucaauucacgcccaccaccaauggaugaccacagaagacaugcuaucuguauggaauagaguauggaucgaagaaaaucccuggauggaagauaagacucauaucaguucaugggaagauguacccuauuugggcaaaagagaggaucaaugguguggcucauuaauuggucuaacggcaagagcaacuugggcuaccaacauacagguugccauuaaccaaguucgaagauugauugguaacgagaacuaucuagauuauaugacuucaaugaagagguuuaagaaugagagugauccagagggugcuuugugguaa

SEQ ID NO: 22075 - RNA, 9879 nt, Artificial Sequence
  derived and/or modified CDS sequence (opt6) from DENV-1__JQ915077__SS-prME
uccguuacaaugcuacugauguuacuuccuacuguacuaacuuuccauuuaacaacacguggaggagaaccccauaugauugugucgaaacaagaacgaggaaaauccuuacuauucaaaacgagugccggugugaauauguguacguuaauagcaauggacuugggggaauuaugugaugauacaaugaccuacaaaugcccucgaauaacagaaacagaaccugacgauguagacugcugguguaacgcgacugaaacgugggucacauauggaacauguagccaaacgggugaacaccgucgugauaaacgaagcgucgcgcuagcuccccaugugggacuuggucuugaaacucgcaccgaaacguggaugagcucagaaggggcauggaggcaaauccaaaaaguagaaacaugggcauugaggcauccaggauucacaguaauugcauuauuucuagcucaugcuaucgggaccucaauaacccagaaaggaauaaucuucauucuauuaauguuagucacuccuucgauggcgaugagaugcguaggaauaggaaacagggauuuuguugaaggucuaucgggggcaaccuggguagauguugucuuggaacacggcucuuguguaacaacaauggcaaaagacaaaccaacccuggauauagaacugcuuaaaaccgaaguuacaaacccagcaguauuaaggaaacuaugcauagaagccaaaaucucgaauacaacaaccgauagcagaugcccuacucaaggagaagcaacucuaguugaagaacaagacaccaacuucgugugucgaagaacguucguggacagaggaugggguaacgguuguggacuauuuggcaaaggaagucuaaucacgugcgcuaaauucaaguguguaacgaaacuugaaggaaaaauagugcaauaugaaaauuugaaguacaguguuauuguuacgguacauacuggagaccaacaccaaguaggcaaugaaaccacugaacaugggacuauagcgacuauaacaccgcaagcgccuacuucugaaauucagcuaacagauuauggagcacuuacacuugauugcucuccaaggaccggacuggacuucaaugaaaugguuuuauuaacuaugaaagaaaaaucauggcuaguacauaaacaaugguuccuagaucuaccccuaccauggacaagcggcgcaucuacaagucaagaaacauggaauagacaagaccucuuagucacauucaaaacagcacaugcgaaaaagcaggaagugguuguccuaggaagccaggaaggggcaaugcacacugcauuaacgggagcaaccgaaauucaaacaaguggcacaacgacaauauucgcuggacacuuaaaaugcagacuaaaaauggauaaauuaacacugaaaggaauaucguauguaaugugcacugggaguuucaaguuggagaaagaaguagcugaaacacagcacggcacuguuuuaguacaaguuaaauacgaaggcaccgacgcaccuugcaagaucccauucucuucucaagaugaaaaaggcgucacgcagaauggaagauuggucacagcaaauccaauagugacggauaaagagaaaccagugaauauugaagcagagccuccauucggugaaaguuacauaguaguaggggcgggugagaaagcacuuaaacuaucgugguucaagaaaggaucuuccauugguaaaauguuugaggcaacagcuagaggagccagacggauggccauacuaggagauacggccugggacuuuggauccauaggggguguauucacaaguguaggcaaacuuguucaucaaaucuucgguacugcauacgguguuuuguuuucaggaguaucuuggacgaugaaaauugguauagggauucucuugacaugguuagguuugaacagccgcucaacuucgcuaaguaugacuuguaucgcugugggcaugguaacccuauacuuaggcgucaugguucaagcagacucaggaugcguuauaaauuggaaagguagagaauuaaaguguggguccggcauuuuuguuacaaaugaaguccauacauggacagaacaauacaaguuucaagccgauucuccaaaaaggcuaagugccgcaaucgggaaagcaugggaggaagguguuugcggaaucagaagcgcaacaagauuagaaaauauuauguggaaacaaaucucaaaugaauugaaucauauacucuuagaaaacgauaugaaauucaccguagucguaggcgaugucuccggaauacucgcucaaggaaagaaaacgauaagaccucaaccuauggaacacaaauacaguuggaaaucauggggaaaagccaaaaucaucggggcugauguucaaaauacuaccuucauuauugauggcccgaauacgccagaguguccugaugaccaacgugccuggaacauaugggaaguggaagauuauggauuuggaauauucacuacaaacauauggcuaaaacuuagagauucuuacacccaggugugcgaccacagacucaugucagcugcaauaaaggauucaaaagcuguucacgccgacaugggcuauuggaucgaaucagagaaaaacgaaacauggaaauuagcgagagcaaguuuuauagaaguaaaaacauguguguggccaaaaagucacacccuauggucaaacgggguccuugagucagaaaugaucauuccgaagauuuauggcgguccaauuucacagcacaacuacagaccagguuauuuuacacaaacagcugggccguggcaucuagguaaguuagaauuagauuucgaccuaugcgagggcacaacgguagucguggaugagcauuguggaaauagaggacccucuuuaagaacuacgacagucacggguaagauaauccaugagugguguugucgcucuugcacuuuaccgcccuugcgauuuaagggugaggauggaugcugguacggaauggaaauuagaccgguaaaagaaaaagaagaaaauuugguaaaaagcaugguuagugcugggaguggagaaguugauucuuuuucucuaggucuguuaugcaucagcauaaugauagaggaaguaaugcguuccagguggucaaggaagaugcugaugacaggaacauuaguaguguuuuuguugcucacgcuagggcaacuaacauggaacgaucucauaaggcuauguauuaugguaggagccaacgcuagugauaacauggguaugggcacuacauaucuagcccuuauggcuacguuucggaugcgaccgauguucgcaguuggacuccucuuucguagauuaacaagucgugaagucuuauuacuaacugucggacuuagucuuguggccaguguagagcuaccaaacucccuggaugaacuaggcgacggucuagcuaugggaauaaugaucuugaaacuacuuacugauuuucagucgcaccaacucugggcgauucuacuaaguuuaacuuuuguuaaaaccacauuauccuuacauuaugcguggaaaacaauggcuaugauccuaucaauuguuagucucuugccuuuaugucucagcacaacaucucagaagacaaccugguugcccgugcucuuggguucgcuagggugcaaaccauuaaccauguuuuuaauuaccgaaaauaaaauaugggggagaaagucauggccguuaaaugaaggaauaauggcuguaggaauaguaucaaucuuacuuucaucuuugcuaaagaaugacguaccauuagccggaccccuaaucgcggguggaaugcuuauagcauguuaugucauuagcggauccucugcggacuuaucauuagaaaaagcagcaaaagugagcugggaagaagaagcugagcacagcggugcuagucacaacauauugguagaaauucaggacgacgggaccaugaagauaaaagacgaggagcgugaugacacuauaaccauucuuuuaaaagcaacccuucuagcgauuucaggaguauaccccaugaguauucccgcuacucuuuucguauggcauuucuggcagaagaagaaacaaaggucaggaguauuaugggauacaccuucaccaccagaagucgaaaaggcaguuuuagaugacggaauauauagaauacuucaaagagguuugcuagguagaucccaaguugguguaggaguauuucaagaaggcguguuccauacgauguggcacguaacaagaggagcaguacuaauguaccaaggaaaacgauuagagccgaguugggcaucaguuaaaaaggaccuaauuucuuacggaggaggauggcgguuucaaggaucuuggaauacaggagaagagguucaagugauagcugucgaaccaggcaaaaauccaaagaauguccaaacagcacccggcacauuuaagacgucagagggugaaguaggggcaauagcguuagauuuuaaacccgggacaucaggaagcccaauuguuaauagggaggggaaaauuguuggacuuuacggaaauggugucgucacaacuucagggacauauguguccgcgaucgcgcaagccaaagcuagccaggagggaccauuaccagaaauagaagaugaaguauuucgcaagagaaacuuaacaaucauggauuuacauccagggucaggcaaaacaaggcgcuaucuuccugcaauaguuagagaagcaauaaaaagaaaacuacgaacuuuaguauuagcaccgacaagaguaguggcaucagaaauggcugaggcuuugaaagguaugcccauaagauaucaaacaacagcagugaagucugagcacacagguaaagaaaucgucgauuugaugugucacgcgacauuuacuaugagacuauuaucaccuguacgaguuccaaauuauaauaugauuauaauggaugaagcacacuuuacggauccugcuuccaucgcagcgagaggcuauauaucuacccgaguugggaugggagaagcggcagcaauauuuaugaccgcaacaccaccuggcagcguagaagcauuuccgcaaucaaacgcaguaauucaagaugaagagaaggauauaccggagcggucauggaacaguggcuacgauuggauuacggacuuucccggaaaaacaguaugguucguaccaucaauaaaaagcgggaacgacauagcgaacugucuucguaagaacggaaaacgugucauucaguuaagccguaaaacauucgauacagaguaucagaagacuaaaaacaacgacugggacuacguaguuacaaccgacaucagugagaugggugcuaauuuuagggcugauagaguaauagauccucgaaggugucuaaagcccgucauucuuaaggauggcccagaacgaguaauucuugcuggucccaugcccgucacaguugcuucagcagcacaaagacgaggcagaauagggcggaaucaaaauaaggaaggugaucaauacaucuauauggggcaaccauuaaauaacgacgaagaucaugcucacuggacugaagcaaaaauguuauuggacaacauaaauacaccagaaggaauuauaccagcauuauuugaacccgagagagagaaaagugcggcaauagauggagaauauagauuaagaggagaagccagaaaaaccuuugucgagcuaaugaggagaggggaucuuccaguauggcuaagcuacaaaguugcaucugaaggauuucaauauagcgacaggaggugguguuuugauggagaacgaaacaaucaaguguuagaggaaaacauggauguagaaauuuggacaaaagaaggagaacguaagaaacuaagaccgagauggcuagaugcacgaacguacagugauccuuuagccuuacgugaguucaaagaguucgccgcagggagacgaaguguaaguggagacuuaauacuugaaauugguaaauuaccgcagcacuugacacaaagagcacagaacgcucuagauaaucucguaauguuacauaauucugagcaaggaggaaaagccuauaggcaugcuauggaagaauuaccagacacuauugaaacaauuaugcuauuagcucuuauugcgguuuugaccggaggugugacacuauucuuucuuucuggacguggucucggaaaaacgucuauuggguuacucugcguaacaucaaguagcguccuucuauggauggcaucuguggaaccucacuggauagcagcgucuauaauauuagaguucuucuugaugguucuucuaaucccagaaccagaccgucaacguacaccacaagauaaucaacucgccuacguaguaaucggguuauuauucaugauauugacuguugccgccaaugaaaugggauuguuagaaacaaccaagaaagacuugggaauaggucacgcagcugcagaaaaccaucaucaugcagcaauguuggacguagaccuucacccggcauccgcauggacauuguacgcugucgccacgacuauaauaacgccuaugaugaggcauacgauagaaaacaccacugcgaauauuucacucacagcaauugcuaaccaagcugccauauuaaugggacuagauaaaggauggccaauaagcaaaauggacauaggcguaccacuccuggcacucgguuguuauucucaaguaaauccauuaacgcucacagcugccgugcucaugcugguagcucacuaugcgauaauaggaccugggcuacaagccaaagcaacuagggaggcccaaaagagaacagcagcagggauaaugaaaaauccaacgguggauggaauuguugcuauagaucuugauccaguaguguacgacgcaaaguuugaaaagcaauugggccaaauuaugcuucuuauacuguguacgucgcagauccugcuaaugcgcacuacgugggcacuuugcgagagcaucacacuagcuacugggccguuaaccacucuaugggaaggcucuccaggcaaguucuggaacacgacgauagccgugucuauggcaaauauuuucaggggaucuuaucuagcuggggcagguuuggcuuuuaguuugaugaaaagccuagggggcggucgcagaggcacaggugcgcagggagaaacccugggcgaaaaguggaaaagacaacuaaaucaacugaguaaaagugaauuuaacacuuauaaacgcucgggcauuauagaaguggauagaagcgaagcaaaagaggguuugaaaagaggugaaaccacuaagcaugcaguaucccgcgggacugcaaaacuaagaugguuuguagaaagaaauuuaguuaagccagaagggaaggugauagaucuaggcugcgguagaggugguuggagcuacuacugugcaggucuaaagaaagugacagaagucaaagguuacaccaaaggagguccuggacacgaagaaccaauuccuauggcaacuuacgguuggaaccuagucaagcuacacucuggaaaagauguguucuucaucccgccagagaaaugcgacacccuauuaugugauaucggagaauccucacccaaccccacaauagaagaagggcgaacgcuacguguacuuaaaaugguugaaccauggcuaagagggaaucaauucuguauaaaaauacuuaaucccuacaugccuucgguaguagagacacuggagcaaaugcaaagaaaacaugguggaaugcuaguacgcaaucccuuaucuagaaauuccacacaugagauguauugggucucaugcgguacuggcaauauagugucugcggugaacaugacuucgaggaugcugcuaaaucguuuuacaauggcacauagaaagccgacuuaugaacgcgacguugaccuaggagcggguacacgacaugucgcaguagagccagagguugccaaucuagauauaauuggacaaagaauugaaaacaucaaaaacgaacauaaaucaacauggcauuaugacgaagauaaucccuacaaaacaugggcauaccaugguaguuaugaggugaaaccaagcgguucagcaucaaguauggucaacggaguaguacgucuucugacuaaaccgugggacguuauaccuaugguuacgcagauagccaugacugauacuacaccauucgggcaacaaagagucuucaaagaaaaagucgacacgagaacucccaaagcgaaacguggcacagcgcaaaucauggaagucaccgcuaaauggcuuuggggauuccuaucacgaaacaagaaaccccgaaucuguacccgugaagaauuuacaagaaaaguaaggucaaacgcugcaauaggcgccguauuuguugacgaaaaccaauggaacucugcaaaagaggcaguagaggacgaaagauucugggaccuuguuagacgagaacgagaauuacauaagcagggcaaaugcgccacauguguauacaacaugaugggaaaaagagagaagaaauuaggcgaguucggaaaagcaaaagguucgagagcuaucugguacaugugguuaggcgcuagauuucucgaauuugaagcauugggguucaugaacgaagaucacugguucagccgagaaaauucgcuauccggaguagaaggagaaggucuacauaaauugggguauauauugcgagacauaucgaagauaccuggagggaauauguaugcugaugacacagcgggcugggauacuagaaucacggaagaugauuuacaaaacgaagcgaaaauaacugauauaauggaacccgaacaugcguugcucgcuacaagcauauuuaaacuaacguaucaaaacaaaguaguuagagugcagaggcccgcuaaaaauggcacagucauggacgucauuucaagaagagaccagcgagggucuggacaagucgguacuuacggccuaaauacauuuacaaauauggaagcccaauuaauacggcaaauggaaagugaaggaauuuucucaccauccgaacucgaaaccccaaauuuagcuggcagaguccucgacuggcuugagaagcaugggaccgagcgucuaagaagaauggcuauaucuggggaugauuguguagugaagcccauugacgacagauucgcgacagcgcuuacugcacuaaaugauaugggcaaaguaagaaaagauauuccacaaugggaaccaucaaaggguuggaacgauuggcaacaaguaccuuuuugcucccaucauuuucaucaauuaauaaugaaagauggaagggagaucguggucccguguagaaaccaggaugaacuggucgguagggcgcgagucucucaaggcgcgggguggucauuacgugaaaccgccuguuuggggaaaaguuacgcacaaauguggcaauugauguauuuucauaggagggaccuacgauuagcagccaaugcuauuuguagcgcuguacccgucgauuggguuccgacaagucgcacuacaugguccauucacgcgcaucaccaguggaugacaacugaagauaugcuaucagucuggaauaggguguggauagaagaaaauccauggauggaagauaaaacgcacguaaguucaugggaggauguaccauaccuugguaaaagggaggaccaaugguguggaagucuaauaggccucacggcacgugcaacgugggcaacuaacauacaaguagcaauaaaucaggugagaagacugauaggaaaugaaaauuaucuggauuauaugacaaguaugaagagauuuaaaaaugaguccgacccugaaggcgcccuaugguga

SEQ ID NO: 22076 - RNA, 9879 nt, Artificial Sequence
  derived and/or modified CDS sequence (opt6) from DENV-1__JQ915079__SS-prME
agcgugacaauguuacuuauguugcuuccuacaguacuaacauuucaccuaacaacgcgggguggagaaccucauaugauuguuaguaaacaagaaagaggcaagaguuugcuuuucaaaacgucugcgggugugaauauguguacacuuauugcaauggaucuaggagaauuaugcgaugauacuaugacguacaaaugcccaaggauaacagaaacugaaccugaugauguugacuguuggugcaaugcaacagaaacauggguaacuuauggaacaugcagucaaacgggcgaacacaggagagauaagagaucgguagcauuagccccucacguaggauugggauuagaaacgagaacagaaacauggaugucaucggaaggugcguggagacaaauucaaaaaguagaaacaugggcauuaaggcacccggguuuuacaguaauugcguuauuucuagcacacgcgauaggaacaucaaucacacaaaagggaaucauauucauacugcuaauguuaguuacaccaucaauggcuaugagaugcguggguauaggaaauagagauuucguagaaggcuuaaguggggcaacauggguagaugugguucuggaacacgguucaugcguaaccacaauggcuaaagacaaaccuacgcuagauaucgaauuguuaaaaacugaaguuacaaauccagccgucuugaggaaauuaugcauagaagcuaaaauauccaauaccacgacagauucaagaugcccaacgcagggugaagcuacccuaguagaagaacaagauacaaacuucguauguaggagaacauuuguagauagaggauggggcaacgggugcggauuauucgggaaagggucuuuaaucacgugcgcaaaauucaagugugugacaaaauuggaaggaaaaaucguucaauacgagaaccuuaaguauagugucauuguaacgguacacaccggagaucaacaucaaguaggaaaugagacaacugagcaugggacgauugcuacaauuacaccacaagcgccuacaucugagauacaacuaacagauuauggugcauuaacuuuagacugcagucccaggaccggacuagauuuuaaugagaugguguuacuaaccaugaaagagaaguccugguuaguucacaagcagugguuucuagaucuuccacuuccuuggaccacaggugcuagcacaagucaagaaacuuggaauagacaggaucuacuuguaacauuuaaaacggcccacgcaaagaagcaagaggugguagucuuagguucccaagaaggagccaugcacacugcacuaacaggagcaacugaaauccaaacaaguggaacaacaacuauauucgcuggucaucuaaaauguagacucaagauggacaaacugacauugaaaggaaucucauauguuauguguacggguaguuucaaauuagaaaaagaagucgcugaaacucaacaugggacaguguuaguucaaguaaaauaugaagguacggaugcgccauguaaaauuccauucucuucgcaggacgagaaagguguaacacaaaauggacguuuaguaacagcaaacccgauuguaacagacaaggaaagaccgguaaauaucgaagcggaaccaccguucggggaaaguuacauaguaguaggugcgggugaaaaggcauuaaaauugucaugguucaaaaaggguucuuccauuggaaaaauguucgaggccacagccagaggagcgagaaggauggcgauauuaggagacacagcuugggacuuugguucaauuggcggaguuuuuacgucagugggaaagcucguacaccaaauauuuggcacggcauauggagucuuauuuaguggaguauccuggaccaugaaaauuggaauaggaauuuuacugacuuggcucggucuaaauaguagaucuacaagucuaaguaugacguguaucgcagucgggauggucacauuauaccuugguguuaugguucaagcugauagcggauguguaauuaacuggaagggaagggagcucaaauguggaucagguauauucguuacuaaugaaguacauacauggacugaacaauacaaauuucaggcagacucgccaaaaagauugucggcugccaucggaaaagcaugggaagagggaguuugcgguauacggucggcuaccaggcuugaaaacauaauguggaaacaaauaucuaaugaauuaaaucacauucuacuugaaaaugacaugaaauucacgguugucguuggagacguaagugggauucuagcccaagguaaaaagacuauuaggccccaaccuauggaacacaaguauaguuggaaaaguuggggaaaagcuaaaauaauuggugcagacgugcaaaauacuacauuuauaauagauggacccaauacuccugaauguccagaugaucagcgagcauggaauauuugggaagucgaagacuacggauuugggauauucaccacuaacauuugguuaaaacuaagagauagcuauacacaggugugcgaucaccgauuaaugucggcagccauuaaagauuccaaggcuguucacgcagauauggguuauuggauagagucagaaaagaacgaaacauggaaguuagcucgagcuucuuuuauagaggucaaaacauguguauggccaaaaucacacaccuuguggucaaaugggguacuggagagcgagauggugauaccgaaaauauauggaggaccaauaucucaacauaauuaucgacccggcuauuuuacucagacagcagggccauggcaccucgggaaguuggaauuagauuuugauuuaugugagggaacaacaguaguuguagacgaacacugugggaacagggggccaaguuuacgaaccaccacagucacagguaaaauaauacacgaaugguguugucgaaguugcacgcuaccaccacuaagauuuaaaggggaagauggaugcugguacgguauggagauacgacccguaaaagaaaaagaagaaaaccuaguuaaauccauggugucagccggaaguggcgagguagacaguuucucacuuggauuauuauguauaucuauuaugauagaagagguaaugaggucuagguggucaaggaaaaugcuaaugacaggaacccuuguggucuucuuguuacuaacauuggggcaguuaacauggaaugaucuuauaagauuaugcauaauggucggagccaacgcauccgauaauaugggaaugggcacaacuuaucuggcauugauggcaaccuuucgcaugcguccaauguuugcagugggauuauuguuucgcagauuaaccucuagagaaguucuauuacugacaguaggucucucuuuaguugcaagcguagaauuaccuaacucacuagacgagcucggggauggcuuagcaauggguauaaugaucuugaagcugcucaccgauuuucaaucacaccaguugugggccacacuccucucauugaccuuuguuaagacuacucuguccuuacauuacgccuggaaaacuauggccaugaucuuaucaauuguaagccuacuuccauuauguuugaguacuacaagccagaaaaccaccugguuaccagucuuacuggguucacuugguugcaagccccuaacaauguucuuaauuaccgagaauaagaucuggggcaggaagucuuggccguuaaaugaagggauaauggcuguugggauaguuucgauacuuuuaucaaguuuauugaaaaaugauguuccauuagcaggaccucuuauagcaggggguauguuaaucgccuguuauguaaucucaggaucaucggcagauuuaagucuagagaaagcagcuaaaguaucuugggaagaagaggcagaacacucaggugcuagucauaauauuuugguagagauacaggacgaugggacaaugaaaaucaaagacgaagaaagagaugacacaauaacaauauuauuaaaagccacguuauuagccauaagugggguuuauccgaugaguauaccggcaacauuauuuguuuggcacuucuggcagaaaaagaaacaaaggagugguguucuaugggacacuccaucacccccggaggucgaaaaagcagucuuagacgauggaauuuauagaauacugcaacguggauuacuugguagaucgcaaguaggaguaggugucuuucaagaaggcgucuuucacacaauguggcacgucacuagaggugcagucuuaauguaccaggguaaaaggcucgaaccguccugggccucggucaagaaagaucugauuaguuauggaggaggauggcgauuccaaggaucguggaacaugggugaagagguccaaguuauagcugucgagccgggaaagaaucccaaaaauguccaaacagccccagguaccuucaaaacgagugagggagaaguuggagcuauugcauuagacuuuaaaccagguaccucggguaguccuauuguaaacagagagggaaaaauaguagggcuuuacgguaacgguguaguaaccacaucagguaccuaugucagcgcaauugcacaagcaaaagcaagccaagagggcccucuuccagagauugaggaugaaguguuucgaaagcgcaauuuaacuauaauggacuugcauccugggucuggcaagacuaggagauacuugccggcgauaguuagggaggcaaucaagcggaaauugagaacguuaguuuuggcuccuaccaggguaguggcgucagaaauggcagaggcauuaaaagguaugccaauccgguaucagaccacugcggugaaaucugagcauacagguaaggaaauaguggaccucaugugccaugcaacguucacgaugcggcugcuaucaccuguaagaguaccgaauuauaauaugauaaucauggacgaggcucauuucaccgauccagcaucgauagcggcaagaggauacauaucaacucgaguaggaaugggugaagccgcagcgaucuuuaugacggcuacuccucccggaucaguagaggcauucccucagagcaacgcaguaauacaggaugaagaaaaagauauaccagaaagaaguuggaacuccgguuaugauuggauaacagauuuuccaggaaagacaguaugguuugugccaucgauuaagagcggaaaugauauagcuaauugucucaggaaaaaugggaaacgagucauucaauugucaagaaaaacauucgauacugaauaucagaaaacuaaaaacaaugacugggacuacgugguaacaacagacauuucugagaugggagcaaauuuucgcgcagaucguguuauagauccgcgacgcuguuugaaacccguuauuuuaaaggauggaccagaacggguaauauuagcagggcccaugccuguuacagucgcgucagcggcccagagacgggguagaauagguagaaaucagaauaaggaaggagaucaguauauauacaugggccagccauuaaauaacgacgaagaucaugcacauuggacugaagcaaagaugcuuuuagauaauauaaauacuccugaaggaauuaucccugcauuauucgaaccugagagagaaaaauccgcagcuauugacggugaauaucguuugaggggagaggcucgaaaaacguucguggaacugaugcggagaggugauuugccaguaugguugucauauaaaguagcaagcgaaggauuucaauacucugauagacguugguguuucgauggagaaaggaauaaccaaguuuuagaggagaauauggauguagaaauauggacuaaggagggagaacgcaagaaacuaaggccgaggugguuagacgccaggacauauagcgaccccuuagcacuaagagaauuuaaggaauuugcagcaggcagacgcuccguaaguggggacuuaauauuagagaucgguaaauugccgcaacauuugacacagagagcacaaaacgcacuggacaacuuaguaauguuacauaauagugaacagggaggaaaggcuuauagacacgccauggaagaacugcccgauacgauagaaacaauaaugcuccuagccuuaauugcagucuugacagggggaguuacauuguucuuucuaaguggacguggguuagguaaaacgaguauaggcuuacuauguguuacaucaucaucagcauuauuauggauggccuccgucgagccgcauuggauugcagcuucaaucauacuugaauuuuucuuaaugguauuacuuaucccagaaccggaucgccaaagaacgccucaagauaaccaguuagcguacguaguuauaggucuucuauuuaugauucuaacaguugcagcaaaugaaaugggucuucuagaaaccacaaagaaagaccugggaauuggacauacagcggcagaaaaccaccaucaugcagcuaugcuagaugucgaucugcacccggcaucugcguggacguuauaugccguugccacaacgauaauuacacccaugaugagacauaccauagaaaacacaacugcaaacauaucucugacagcgauagcaaaccaggcugcgauuuuaaugggucucgauaagggauggccuauuucaaagauggauaucggaguucccuuacuagcguuaggguguuacucgcaaguuaacccucugacauuaacggcugcaguucucaugcuuguagcccacuaugcuaucauaggaccaggguuacaggcgaaagcaacccgagaggcccaaaaacguacggcugcggguauaaugaagaacccaacuguugauggaauugucgcaauagaucuugacccagugguuuacgacgcaaaguuugaaaagcaacugggacaaauaaugcuacuaauacucuguacaucccaaauucuguuaaugagaacgacaugggcguuaugugaaucaauuacgcuagcuacagguccuuuaacaacgcuaugggaggguucaccuggaaaauuuuggaauacuacgauugcggucagcauggcgaauauauuucgagguucauacuuggcgggagcgggauuagcuuuuaguuugaugaaaucauuaggagggggacgacgugguacuggugcacaaggcgaaacgcuuggugaaaaauggaaacgacaauuaaaccaacuuagcaagucucaauucaauacauacaaaaggaguggaaucaucgaaguggaucggagugaggcaaaggaagggcucaagagaggggaaacgacuaaacaugcuguaagucgagggacagcgaaauuacguugguucguugaaagaaaccuaguaaagcccgagggcaaagugauagaccucggaugcggacggggcgguuggucuuauuacugugcaggacuuaagaaaguaacugaggucaagggguacacgaaagguggcccaggucacgaggaaccaauaccaauggcgaccuacggguggaauuuagugaaacuacauucaggcaaggauguauucuuuauaccaccugaaaaaugugauacacuucuuugcgacauaggcgagucaagucccaauccgacaauagaagaagggcguacucuuagaguacuuaaaauggucgaaccuuggcuccgcgguaaucaauuuuguauaaaaauacuaaauccauauaugccaagugugguugaaacuuuagaacagaugcagaggaaacauggaggcauguuaguccgaaacccuuuaucgagaaacaguacacacgagauguacuggguaucauguggaacaggaaauaucgugucugcgguaaacaugacuucccgaauguuacuaaauagguuuacaauggcacauagaaagccgaccuaugaaagggauguagacuugggagcugggacuaggcacguugcagucgaacccgaaguagccaaccuagacauuaucgggcagaggauugaaaacauaaagaacgaacauaaaucuacuuggcacuaugaugaagacaauccguauaaaacaugggcuuaucacgguucuuaugaggugaagccuucagguucugcaaguucaauggucaacgggguaguaagauuauuaaccaaaccuugggauguuauaccaaugguaacacaaauagcgaugaccgacacuacaccuuucggacagcaaagaguguucaaggagaaaguagacacacgaaccccuaaagcuaaaagaggaacugcacagauaauggagguuaccgcaaaaugguuguggggcuuuuuaagucgaaacaagaaaccacguauauguacuagagaagaguucacucgaaaggugcguaguaacgcugcgaucggcgcgguauucguugaugagaaucaguggaacagugcaaaagaagccguggaagacgaacguuucugggauuuaguaaggcgugaaagagaacuccauaagcaaggaaagugugcgacguguguauacaacaugauggguaagcgugagaagaaacuaggagaguuugguaaagcaaaagguagcagagcaaucugguacaugugguugggagcucgcuucuuagaguuugaagcccuaggcuuuaugaaugaagaucacugguucucaagggaaaauucacugagugggguggagggcgaagguuugcacaaacuuggguauauccuaagggauauaucgaaaauaccagguggcaauauguaugcugacgacacugccggcugggauacacggauaacugaggaagauuuacaaaaugaggcaaaaaucaccgacauuauggaaccggaacacgcguuguuagcuaccuccauauucaaacuaacuuaucaaaacaaaguagucagaguucagaggccggccaaaaauggcacuguaauggacguaauaagcagacgugaucaacggggaucugggcagguaggaaccuacggauuaaauaccuuuacaaacauggaagcucaacuuaucagacaaauggaaagugagggaauauuuucuccaagugaguuagaaaccccgaaccuugcggggaggguauuagacuggcucgagaaacaugguauagaaagguuaagacgaauggcgauuucuggcgaugacugcguagugaaaccuauagacgacagauucgccacagcacuuacagcccuuaacgauauggguaagguucgaaaggacauaccacaaugggaaccaucuaaaggauggaaugacuggcaacagguuccuuuuugcagccaccauuuucaccagcuaauaaugaaggauggcagagaaauaguagugccaugcaggaaucaggacgaacuuguaggacgcgcaaggguaagucagggggcggguuggucacuaagagaaaccgcaugcuuagggaaaagcuacgcacaaauguggcaacuaauguacuuccacaggcgcgaucuuagguuagcggcuaacgcuauaugcucagccgugccaguagacuggguaccaacguccaggacgacuuggucaauacaugcucaucaucaauggaugacuacugaagauaugcucaguguguggaauagggucuggauugaagagaauccuuggauggaagauaaaacucacguuucuucaugggaggacgugcccuaccuaggcaaaagagaggaccaauggugcgggagccuaauaggauuaacugcaagagcgacuugggcuacgaauauucaaguagccauaaaccagguacggcgauuaauaggcaaugaaaauuaccuagacuauaugacaucuaugaaaagguucaaaaaugaguccgacccugagggagcacugugguaa

SEQ ID NO: 22077 - RNA, 9879 nt, Artificial Sequence
  derived and/or modified CDS sequence (opt6) from DENV-1__JQ915080__SS-prME
agugugacaaugcuacuaauguuauuaccgacaguauugacguuucaucucacaacacgcggaggggagccccauaugauuguuucgaaacaagaaaggggaaaauccuuacuguuuaaaacuucagcuggaguaaauaugugcacucugauagcuauggauuuaggggaacuuugugaugacacaaugacuuauaaauguccaaggauaacggaaacagaaccugacgacguggacuguugguguaaugcgacagagacaugggucacuuaugggacauguagccaaacaggagaacaccgucgggauaaacgcaguguagcauuggcuccacacguaggauuaggucuagagacucggacugaaacuuggaugagcucggaaggagcguggcgacaaauacaaaaaguggaaacuugggcgcuccggcacccaggauuuacgguuauugcucuuuuucuggcucaugcaauugguacuagcauuacacaaaaagguauaaucuucauacuucuaaugcuaguaacaccaagcauggcaaugagauguguaggaaucgguaaucgagauuucgucgagggccugagcggagcaacuugggucgauguuguacuggaacauggaagcugugucaccacuauggcaaaagauaaaccaacauuagauauugaauuacuaaaaacugaaguuacaaaccccgcaguucuacgaaaguuauguauugaagcaaaaauaucaaauaccacaacagauucaagaugcccuacucaaggagaagcaacguugguagaagaacaagacaccaauuuugucuguaggcguaccuuuguagaucgugguuggggaaaugguuguggauuauucgggaaagguucauuaauaaccugcgcaaaguucaaaugcguaacuaaauuagagggaaaaauaguucaguaugagaaccuuaaauauucuguaauaguaacggugcauacuggcgaucaacaccagguaggaaaugaaacgacugaacauggaacaauugcaacaauuacaccgcaagcgccaacgagugaaauccaacuaacggauuauggagcuuugacauuggauuguuccccaagaacaggguuagacuuuaaugaaaugguacucuuaacaaugaaagagaaaucauggcucguucauaaacaaugguuccuggaccuacccuuaccguggaccacuggagcaucgacaagucaagagacuuggaaccggcaagauuugcucguaacuuuuaagacugcacacgccaagaaacaagaagucguaguacuaggaucacaagaaggggccaugcacaccgcauuaacuggggcuacagaaauacaaacaaguggaacaacaacaaucuuugcggggcacuugaaauguagauuaaaaauggauaaguugacauuaaaaggcauuucauacguuaugugcaccgggagcuuuaaauuagagaaggagguugcggagacgcaacacggaacaguucuuguucaagucaaauacgaaggcacagaugcuccuuguaaaauaccauucucgucacaagaugagaaaggugucacucaaaacgggagauugguaacggcaaacccgauaguuacggacaaggaacguccaguaaauauagaagcagaaccaccauuuggagagucuuacauaguuguaggggcaggagagaaagcacuaaaacuuaguugguucaaaaaggggagcagcauaggcaaaauguuugaagcaacagcuaggggagcaagacguauggccauacuaggagauacggcaugggauuuugggucgaucgguggaguauuuaccaguguugguaagcuaguacaucaaaucuuuggcacagcauauggaguacuauuuucuggagucagcuggaccaugaaaaucgggauagguauauuacuaacuuggcucggacuuaacucaagaucuacaucucuaucgaugacauguaucgcugugggaaugguaacuuuauaucuuggcgugauggugcaagcggauucugggugugucauaaacuggaaagguagagaauuaaaaugugggagugguauauucguaaccaaugagguccacacguggacugaacaauauaaguuucaagcggauagcccuaaaagacugagcgcagcuauagguaaggcuugggaggaaggcguuugugggauucggucagcaacccgauuagaaaauauuauguggaaacaaauuaguaaugaauugaaccacauacuuuuagaaaacgauaugaaauucacaguaguagucggugacguaaguggcauauuggcccaagggaagaagacaauaagaccucaaccuauggaacauaaguauucauggaaaucuuggggaaaggcaaaaauaauaggugcugauguucaaaauacaacguucauaaucgauggacccaauacuccggagugucccgaugaccaaagagcauggaauauaugggaaguagaggauuauggcuucggaauauucacuaccaacauuugguuaaaacuucgugauucguacacucaggugugcgaucacagauugaugagcgcagcgauaaaagacucuaaagcaguucaugcagacauggguuacuggauagaaagugagaaaaacgagacauggaaauuagcacgggcauccuuuaucgaaguaaaaacauguguauggcccaaaucccauacauuauggucaaacggaguucuagaaagugagaugguaauccccaaaaucuauggugggccuauaagucaacacaauuaccgcccaggcuauuucacacagacugccggaccuuggcaccucggaaaauuggaacuagauuuugacuuaugugaggguacaacaguaguagucgaugagcacuguggaaauaggggacccagcuuacgaacaaccacgguaacgggaaaaaucauacaugaaugguguugucggucuuguacccuuccaccauuaagauucaagggggaggacgggugcugguauggaauggagauuaggccuguuaaagagaaagaagagaauuuaguuaaaagcauggucagugcuggguccggagaagucgauaguuucagucuuggucuacuuugcauuaguauuaugauagaagaaguaaugaggucuagauggucucggaaaauguugaugacaggaacucucguaguguuucuacucuuaacguuaggacaguuaaccuggaaugacuuaauaagacuuuguauaaugguuggagcaaacgccagugacaauauggggaugggaacgacguauuuagcuuuaauggcuacguuccgaaugagaccuauguucgccguagguuuacuuuuucggagauugacaucacgagagguauuguuacugacaguaggccuuucguugguugcgucgguggaacucccuaauagcuuagaugaacuaggugacggacuagcuauggggauaaugauccucaaauugcugacagauuuucaaagucaucaguuaugggcgacguugcuuagcuugacuuucgugaaaacaacccugucuuuacacuaugcauggaaaaccauggcaaugaucuugucaauugucagucucuugccucuaugucuuagcacaacgucccagaaaacuaccuggcucccuguauuacugggguccuuagguugcaagccuuuaaccauguuccugaucacagaaaacaaaauauggggaagaaaaucauggccguuaaacgaggguauuauggcuguggggauaguauccauucuuuuaagcucauuacucaaaaaugaugugccacuagcugggccccuuauagcaggagggauguuaauagccugcuauguaauuagcgguucgucggcggauuugucauuagagaaagcagcgaaaguuucaugggaagaagaagcagaacacuccggagcaucucauaauauauuaguagaaauacaggacgauggcacgaugaaaauuaaggaugaggaacgagaugacacaauuacaauccuacuaaaggccacacuuuuagcuaucucuggaguguauccgaugucaauaccagcuacacuauucguauggcacuuuuggcagaaaaagaaacaaagaucuggagugcuaugggauacacccagcccgcccgaaguugaaaaagcaguucucgaugauggcauuuaccgaauacugcaaagagggcuacuugguagaucucaaguagguguagguguuuuucaggaagggguauuccacaccauguggcaugucacuagaggggcaguacucauguaucaagggaaacgguuagaaccuucaugggcgucgguuaagaaagauuuaauuucauaugguggcggcuggagauuucagggaucauggaacaugggugaagaaguucaggugauagcuguugagccugggaaaaauccuaaaaauguacaaacggccccuggaacauuuaaaacgucagaaggagaaguaggcgcuaucgcacuugauuucaaaccaggcacuucuggaucaccaauaguaaaccgggaaggaaaaaucgucggucuguaugguaacggcguugucacaacaucagggacguacguuagugcuauagcgcaggcgaaggcaucgcaggaaggucccuuaccagaaauagaagacgagguuuuccgaaaacggaacuuaacaaucauggacuugcaucccggcagugggaagacacggagguaucuaccagcuaucguaagagaagccaucaagaggaaacugcgaacccuaguuuuagcaccaacgaggguaguagcaucggaaauggcagaggcuuuaaaagggaugccuauccguuaucaaaccacggccguaaaaagcgaacauacuggaaaagaaauaguagauuuaaugugucaugcgacuuuuacaaugagauuacuuucccccguaagagucccuaauuauaacaugauaauaauggaugaagcacauuuuaccgacccagcaagcauugccgcgcgugguuacauuagcacucggguagguaugggagaagcagcugccauauucaugacugccacuccuccuggcucgguagaagcauucccccagagcaacgcggugauacaggaugaagaaaaagauauuccggaaagaucguggaauagcggauaugauuggauaacagauuuuccuggcaagacaguaugguucguaccuuccaucaaaucugguaacgauauugcuaauugucuacgcaaaaacgguaaaagagucauccagcuauccagaaaaacauuugacacagaauaucagaagaccaaaaauaacgauugggauuauguuguuacgacagacauaagcgaaaugggggcgaauuuuagagcagauagagucaucgauccaagaagaugcuugaaacccgugauacuaaaggauggaccagaaagaguaauacuugccgggccgaugccuguaacaguagcaucggcagcccagcgaagaggacgaauaggaaggaaccaaaauaaagaaggagaccaauauauauauaugggccaaccacuaaauaacgacgaagaucaugcacauuggaccgaagcuaaaauguuauuggacaacauaaacacgccagaaggaaucauuccagcacuauucgagccugagcgugaaaaaucggcggcaauugacggugaauaucgacucaggggagaggcacggaaaacauuuguggaacuuaugcgccgcggagaccuaccagugugguuaucguauaaaguggcgagcgaaggauuccaauauucagaucgcagauggugcuucgauggggagcgcaacaaccagguacuagaagagaauauggacguggagaucuggacaaaagaaggagaaagaaagaaacuaaggccccguugguuagaugccaggacauacuccgauccauuagcauuaagggaauuuaaagaauuugcagcuggucguagaucgguuaguggagauuuaauucuugaaauagguaaacuaccacaacaucuaacucaacgugcacagaaugcucuagacaaucucguaauguuacauaacagugaacagggaggcaaagcauaucgucaugcaauggaagaacuaccggacacaaucgaaacuauaauguuauuggcccucauagcaguauugacaggcgguguuacauuauuuuuccuaagcgggaggggacuuggaaaaacgaguauaggucuccuuuguguuacaucauccucggccuuauuauggauggcaagcguugaaccacauuggaucgcugcaagcaucauuuuagaguucuuucuaaugguuuuacuaauuccagaaccggauaggcaaagaacaccgcaagauaaucagcuagcauaugugguaauagguuuauuauuuauaauacugacgguagcugcgaacgaaauggggcuacuugaaacuacuaagaaagaucuagguauuggccauacggcagccgaaaaucaucaccaugccgcaaugcuggaugucgaccuccauccagcaucugcauggacgcuauaugccguggcaacgacaauaauaacacccaugaugcgccauaccauugaaaauacgaccgccaauauaucucuuacggcgauagcaaaccaagcggcaauccugaugggacuugacaaaggguggccaauaucuaaaauggauauuggugucccccuguuagcacuaggcuguuacucacaaguaaacccuuuaacauuaacagcagcuguauuaauguuggucgcacauuaugcaauaauuggucccggccuccaagcaaaggcuacacgugaagcccagaaacgaaccgcugcaggaaucaugaaaaacccaacgguagauggaauagucgccauagauuuagauccuguaguuuacgacgccaaauuugaaaagcaacuuggacaaauaaugcuacucauacugugcacgucacagauucuacucaugagaacaacuugggcacuaugugagucaauuacacuagccacagggccucuuacuacuuuaugggaagguuccccaggaaaauuuuggaacacaaccaucgccguuucaauggcaaauauauuccgugguagcuacuuagcaggggccgggcuugcuuucuccuuaaugaaaucauugggagguggcagaagaggaacuggggcucaaggugaaacuuuaggagagaaguggaaaagacaacucaaucaguuaucaaaaucccaauucaauacauauaagagaagcgguauaauugagguggauagaagugaggcaaaagaaggcuuaaaaagaggggaaaccacaaaacaugcaguauccagagggacagcaaaacuacgaugguucguagaacgaaauuuaguaaaacccgaggguaagguuauagauuuaggaugugguaggggcgguuggucauauuacugcgcuggacucaagaaaguaacugaaguaaaaggguacacaaaaggaggacccgggcaugaggaaccaauuccuauggcuacauauggauggaaucugguuaaacuccacucaggaaaggacgucuuuuucauuccucccgaaaagugcgauacucuguuaugugauauuggugagucauccccuaauccgaccauugaagaggggagaacauugcgaguucugaaaauggucgaaccaugguugcguggaaaucaauuuugcauuaaaauauuaaauccauauaugccaagcguaguagaaacacucgagcaaaugcaaaggaaacaugguggaaugcuggucaggaaccccuuaagccgaaacucuacacaugagauguauuggguaucguguggcacaggcaacauuguuagcgcugucaauaugacuucacgaaugcuuuuaaaucgauuuacgauggcgcaccgaaaaccuacauaugaacgagacguagaucucggugcggggacccggcauguagcggucgagccggaaguggcaaaucucgauauaauagggcaaagaauagagaacaucaaaaacgaacauaagagcacauggcauuacgaugaagauaauccauacaagacaugggcauaucauggaagcuaugaaguaaaaccuaguggaagcgcuuccucuaugguuaaugggguagugcgauugcuuacuaagccgugggauguaauucccaugguaacacaaauugcaaugacggauacaaccccauucgggcaacaaagaguauuuaaggaaaaaguagacacgcgaacccccaaggcuaaacgaggcacagcucaaauuauggaaguaacagcaaaaugguuauggggcuuucuuucccgaaauaagaaaccgaggaucugcacacgggaggaauuuacaaggaaaguacgaagcaaugcagccaucggugcgguauucguugacgaaaaucaauggaacucugcaaaagaagcuguagaagaugaaagguuuugggaucuugucaggagagaaagagagcuacauaaacaaggaaaaugcgcuacaugcguauauaauaugauggggaaacgggagaagaaauuaggugaauuugggaaggccaaaggauccagggcaauaugguauaugugguugggagcccgauuccuggaauuugaagcucuugguuucaugaaugaagaucauugguuuucuagagaaaacucccuaucuggaguggaaggggaaggucuccacaaacucggauauauucuuagggacauaucuaagauuccuggaggaaacauguaugcagacgacacagcugguugggacacaagaauuacugaggaagaccugcaaaacgaagcaaaaauaacggauauaauggaaccggaacaugcgcuauuagcaacgaguaucuucaaauugaccuaccaaaauaagguaguuagaguucaacgaccggcaaagaauggaaccguuauggauguaaucagcagacgggaccaacgugguucgggucagguuggaacguaugggcuuaauacauuuacgaacauggaagcccaacugauuaggcaaauggaaagugaaggcaucuuuucaccuagugaauuggaaaccccgaaucuagccggaagaguacucgacugguuagaaaagcacgguaucgaaagacugcgaagaauggccauuuccggggacgacugugucguaaaaccaauagacgauagauuugcuacugcucucacugcgcuaaaugacaugggcaaaguuagaaaggauauaccucaaugggagccgucaaaggguuggaacgauuggcaacaggucccauucuguucacaccacuuucaccaauuaauaaugaaggaugggcgugaaauuguaguuccaugucgaaaccaagaugaguugguaggaagggcaagaguaagucaaggggccgguuggucucuccgugaaacugcuugccuugguaaauccuacgcucaaauguggcaacuaauguauuuucacagacgagauuuaagacuugcagcgaacgcuauaugcucagccguuccagucgacuggguuccuacaucaaggacuacuuggaguauucaugcacaccaccaauggaugacuacagaagauaugcuaucugucuggaaucgaguuuggauagaagaaaauccguggauggaggacaaaacucauguaaguaguugggaggauguaccuuaucucgggaaaagagaggaucaaugguguggcucucuuaucggauuaacggcccgugcaacuugggccaccaauauucaaguagccauuaaucaaguuaggagauuaauugggaaugagaauuaucuagacuacaugaccucuaugaaaagguucaaaaaugaaagcgauccagaaggggcuuuaugguag

SEQ ID NO: 22078 - RNA, 9879 nt, Artificial Sequence
  derived and/or modified CDS sequence (opt6) from DENV-1__KJ755855__SS-prME
uccgugacuaugcuccuaauguugaugccuacggcucuagcguuccacuugacuacaaggggaggagaaccgcacaugauuguaucaaaacaagaacggggaaaaagccuguuguuuaaaacaagugcuggaguaaauauguguacacuaauagcgauggaucugggugaacucugugaagacaccaugacauacaaaugcccuagaauaacagaagcagaacccgaugauguggauugcugguguaaugcuacugacacgugggucacauacgguacaugcagucagaccggugaacauaggagggauaaacguagcguugcacuagcaccacauguagguuuaggucuggaaacaagagccgaaacauggaugucgucugaaggcgcuuggaaacaaauucaacguguugaaacaugggcacuaaggcacccaggcuuuacugugauagcacuauuccuugcucaugcaauaggcacuucaauaacacaaaaagggauaauuuuuauacuauuaauguuaguaacgcccucuauggcaaugcgauguguagggauagguucaagagauuucguugaaggccuaaguggcgcuacauggguagauguagaacuggagcacgggaguugugucacuaccauggcaaaagauaaacccacgcuagacauugaacugcuaaaaacagaggucacgaauccggcaguucuuagaaaacucuguauugaggcaaaaaucucaaacacgacaacagauucucggugcccaacacaaggagaggcaacauuaguagaggaacaagaugcaaauuuugugugucggagaacauuuguugaucgcggauggggcaauggaugugaacuguucgguaaagguagcuuacuaacuugcgccaaguuuaaauguguaacaaaacucgaggguaaaauagugcaauaugaaaacuugaaauauucagucauaguaacgguacacauugcagcucaacaucagguaggaaacgaaagcacugaacaugggacaacggcgaucauaacaccacaggcaccaacgacagaaauucaacuaacugauuacggagcacuaacauuggacugcaguccacggacaggccuagauuuuaacgagauggucuuauugacaaugaaggaaaaaucaugguuaguucacaaacaaugguuucuggaccuuccccucccauggacaucuggugcauccacaucacaggaaacuuggaauagacuauuccucuuagugacguucaagacagcacacgcuaagaaacaggaaguaguaguacugggaucacaagaaggagcgaugcauacggcucuaacuggagcaacugcauuacaaaccuucgguacuaccacuauauuugcaggacaucugaauaucagacugaaaauggacaagcucacccugaagggaaugucuuauguuaugugcacuggcagcuuuaaacucgaaaaggaaguugccgagacacagcaugguaccauauugguacagaucaaguaugaagguacugaugcaccuugcaagauuccauuuucuacccaggaugaaaaaggagugacucaaaaugggcgauuaauaacugccaacccaaucguaacggacaaggaaaaaccgguuaacauagaagccgaaccgccauucggugaaucauacauaguuauuggagcaggggaaaaggcauuaaagcuaaguugguuuaagaaagguucaaguauuggcaagauguucgaagccaccgcaagaggggccagaagaauggcuauacuaggugacacagccugggauuucggcaguauaggagguguauuuacaaguguuggaaaacuuguccaucaaauauucggaacagcguauggaguacuuuucuccggcgucagcuggacuaugaagauagggaucgguguuuuacuaacuuggcugggauuaaauucgcgguccacaaguuuaaguaugaccuguauagccguggguuuagugacacuuuaccuaggaguaauggugcaggcagauucuggaugcguaaucaacuggaagggccgcgaguuaaaauguggaagugguauuuuuguuacaaacgaaguucacacuuggacugaacaauacaaauuccaagcggacagcccaaagcggcuuucugcugcaaucgguaaggcuugggaagaagguguuugcggaauuagaucagcaacaagguuggaaaauauaauguggaaacaaaucagcaacgaguuaaaucauauuuuauuagagaaugacuuaaaauuuacaguuguugugggugacguagcgggcaucuuagcucaagggaaaaagaugaucaggccccagccuauggaacauaaguauucguggaaaaauuggggcaaagcaaaaauuauuggugcagauguacaaaauucaacauuuauuauagauggaccuaauacccccgaaugcucugacgaccagcgggccuggaauauuugggagguugaggacuacggauucggaauauuuacgaccaacaucugguuaaagcuacgugauagcuacacccaggugugugaucaucgacuaaugucagcagccauaaaagacucaaaagccguacaugcagauauggguuacuggauugaaucagagaaaaacgaaacauggaaguuggcaagagcgagcuuuauugaaguuaaaacguguacuuggccaaaaucgcacaccuuauggucaaauggaguauuagagagugaaaugaucauucccaaaauauacggaggaccgauuucacaacauaauuacucgcccggauauuuuacucaaacggccggaccuuggcauuuaggcaagcucgaguuagacuucgaccucugcgaggguacaacggucguggucgacgaacacugugguaaccgcggacccucacuaaggacuacuacuguuaccggcaaaauuauacaugaauggugcugucggagcugcacauuaccacccuuacgguuuagaggagaggacgguugcugguacggaauggaaauccgacccguaaaagaaaaagaagagaaucuagucaaaucaauggugagugcugguaguggagaaguuguuucauuaaguuuaggauuauuaugcauaucaauuaugauagaggaaguuaugagaagucggugguccaggaagauguugaugacaggaacgcuugcaguauucuuuaggaaaauccguggucaacuaacuuggaacgaucucauuagauuauguauuauggugggcgcuaaugcuuccgacagaauggggacaagaacaacauaccucgcccuaauggcaacauuuaaaaugcggccaauguuuucuguaggucuccuuuuuaggcgacuaacaaguagagaagugcuauuguuaacgauuggauugagccuaguagcuaguguagaauuaccaaauucguuagaagaacucggaguuuuauuggccauggguauaaugauucuaacauuauugaccgacuuucagucucaccaacuaugggcaacauuauuaucaaugacauuuauaaagacaacauuuucucuccauuauacuuggaaaacaauggcaaugguccucucgauuguauccuuauuuccauuaugccugaguacuacaucccaaaagacaacauggcuaccagucuuacuaggaagucuagguugcaagccacuaacaauguuucuaauugcggagaacaaaauaugggggcgaaagucuuggccuuugaacgaggguauaauggcugucggcaucguuuccauuuuguugucaucauuauugaaaaaugauguuccauuagcaggaccacugauugcaggcggcauguuaaucgcuuguuauguuauuucaggaucaagugcugacuuaagccuugagaaagcugcugaagugagcugggaggaggaagcggagcauuccggagcaagccacaauaucuuaguagagguucaagacgacggcacaaugaagauaaaagacgaagaacgggacgacacacucaccaucuuguuaaaagccaccuuacuugccguaaguggcguuuauccucuaagcauccccgccaccuuauucguaugguacuuuuggcagaagaaaaagcaaaggagcgggguauugugggauacucccaguccuccaaaagucgaaaaagccguacuggacgauggcauuuauaggauuaugcagagagguuuacucggucguucccaaguagggguggggguauuucaagaaaauguguuucauaccauguggcacguaacaaggggcgcaguccucauguaucaagggaaaagauuagaacccucuugggguagagucaagaaagacuugauaaguuauggagguggauggggauuaaaaggcucauggaacacgggagaggaaguacagguaauagcaguugaaccaggcaaaaauccgaagaacguacaaacggcuccggggacauuuaaaacuccagaaggagaggucggagccaucgcacucgauuuuaaaccgggaacaucuggauccccaauaguuaacagggaaggcaaaauuguaggucuuuauggaaauggaguuguuacgacuucaggcacauaugucagugcuauagcacaugcgaaagcaucacaagaaggcccuuuaccagagacagaaguugaggcauucagaaaaagaaauuuaacgauuauggaucuacauccagguagugggaagacgaggcgauauuuaccagcaaucguuagggaagcaauuaagcguaagaugagaacuuugaucuuggcuccaacgagaguuguagcaucugaaauggcagaggcuuugaaaggcaugcccauuagauaccagacgacugccguuaagagugaacauacaggaaaggaaaucguagauuuaaugugucaugcaacauuuacaaugaggcuucucaguccgguucgaguaccgaauuauaauaugauaauuauggacgaggcucacuuuacggaccccuccagcuuagcggcacgggguuauauaucaacaagaguuggcaugggcgaagcugcagcaauauucaugacugccaccccgccaggcucugucgaagcguuuccacaaaguaacgcaguaauacaggaugaggagcgagacauucccgaacgcucuuggaacucuggauacgaguggaucacagauuucccugggaaaacagucugguucguaccaucuauaaaagccgguaaugauauugcgaauuguuuaagaaagaaugguaaacgaguaauucagcugucgcgcaaaaccuucgacacugaauaccagaaaacuaaaaauaaugauugggacuacguaguaacaacugauauaucggagaugggugcaaauuuuccagcagacaggguaauagacccucggcgaugucuaaauccugugauacuuaaggacggacccgaaagggugauacuggccgggccaaugccaguaacagucgcuagugcaaaccaaaggagagggagaauaggucgcaaucauaacaaagagggagaucaauauauauacaugggccaaccguuaaauaaugacgaggaucacgcacacuggacagaggcgaaaaugcuacuugauaauauuaauacuccagaaggaaucauaccagcauuauucgagccagaaagggaaaaaucagcggcgauagacggagaauauagauuacggggugaagcaagaaaaacguucguagaacuaaugcgaagaggagaucuuccuguuugguuaucguacaaagucgcauccgaaggauuucaguauagcgacagaaggugguguuuugauggagaaagaaacaaccaaguauuagaagaaaauauggacguagaaaucuggacaaaagaaggagaacgaaagaaacuucgaccacgauggcuagaugcuagaacauacagugaucccuuggcacuccgugagaagaaagaguucgcagcugguagacgaucaguaucaggugaccuuauucuugagauuggaaaauuaccgcaacaccuuacacaaagagcucaaaaugcauuagauaaccuaguaaugcuacacaacucggagcaaggaggaagggcauaucggcaugcaauggaggaguugccggauaccauagagacguuaaugcuguuggccuuaauagccguauuaacagguggggucacccuguucuuccugaguggaaaagggcuaggaaaagcaggaaauggauuacuauguguaauggccucuagugcgcuccucuggauggcuaacguagaaccccauuggauugcagcuucuauuauacuagaguucuuucuuaugguauuacugauaccagaaccagaccgacaaagaaccccacaagacaaucaacuagcuuacgucguaaucagacuuuuauuuaugaucuugacaguagcggcaaacgaaauggguuuacuugaaacuacgaagaaagaccucggaaucggucaugcugcuguugaaaaucaucaccacgcagcaauguuagauauagaucugcauccugccagugcauggacucuuuaugcaguugcuaccacaauaauuacgcccaugaugcgccauacaauugaaaauacgacagcuaauauuaguuuaacagcuauugcgaaccaggcugcuauauuaaugggucuugauaaaggauggccuauuucaaaaauggauauaggaguccccuuacuugcauugggguuccuaagucaagucaauccauuaacacuuaccgccgcaguucuaauguuaguagcgcauuaugcaauaauuggcccuggauuacaagccaaggcaacaagagaagcacaaaaacgcacagccgccggaauuaugaaaaaucccacaauagaugguauugucgcaauagaccuugauccugucguguaugaugcaaaauuugaaaaacaguuaggucagauuaugcuuuuaauucugugcacaucgcaaaucuuguugaugcggacaacaugggcccuaugugagucuaucacuuuagcuaccggaccuuuaucaccccuaugggaagggagucccgggaaaucauggaauacuacuauagcaguaucuauggcaaacauauucagaggcagcuaucuugccggggcgggauuagcuuuuagcuuaaugaaaagccuugguggcggacgaagagggacaggugcacagggugaaacuuuaggagaaaaguggaaacgacaacuuaaucaacuaucuaagacagaguucaacacauauaagaggucagguaucauggagguugauaggucagaagcuaaagaaggucuaaaaagaggagaaacaacaaagcacgcuguaucaagaggaacugcaaaacuacgaugguuuguggaacggaaucugguaaaaccggaaggcaaaguuauugaccugggaugugguagaggugguuggucuuacuauugugcugguuuaaagaaagucucugaaguucgcggauacacuaagggaggacccggacaugaggaaccaauaccaauggcaacauacgguugggaccuccucaaacgaugcucuggaaaggaguucuucuucauaccuccagaaaaaugugauaguuucuugggugacauaggggaaucuucuccaaacccuacgauugaagaaggaaggacggugcgcgugcuaaagaugguugagccaugguuacgagggaaucaauucuguauuaaaauauuaaaucccuacaugccgagcguaguugagacauuggaacaaaugcaaagaaagcaugguggaaugcuaguacgcaacccacuuuccagaaauuccacucaugagauguauugggugucgugugguacuggcaauauagugucagcugucaacaugacaagucggaugcuucugaauagauuuaccauggcacauaggaagccgacauacgagagagaugucgauuugggagccggaacccgccacgucgcugucgaaccggaaguugcuaaccuugacauaauuggacagcggauagaaaauaucaagcaugaacauaaaucgaccuggcauuacgacgaagauaacccauacaaaacuugggcauaucacggaaguuaugaaguaaaaccaagcgguagcgcuucuucgaugguaaacggaguagucaaacuuuugacuaaaccaugggacgugauucccaugguaacccaaauagcaaugaccgauacaacuccauuuggucaacaaaggguauucaaagagaaaguggauacucgcacuccaaaagcaaaaagagguacagcucagaucauggaagugacagcccgcugguuaugguccuuucuaagccgcaauaagaaaccacgaauaugcacgagggaagaguucacacgaaaggugaggucaaacgcagcgauaggcgcaguauuugucgaugaaaaucaauggaacucugcgaaagaagccguagaagacgaucgcuuuugggauuuaguacauagagagcgugaauuacauaaacaaggaaaaugugcgacauguguguauaauaugaugggaaagcgagaaaagaaacuuggagaguuugguaaagcaaaaggcucaagagcaauaugguauauguggcuaggcgccagauuucuugaauuugaggcccuaggauuuaugaaugaagaucauugguuuucccgggaaaauucccugucgggaguagaaggugaagggcuucauaaacuaggauauauucuacgggauaucucuaaaauacccgguggaaacauguacgcggacgauacugcaggaugggacacacggauuaccgaagaugauuuacaaaaugaggcaaaaauaaccgauauaauggaaccagaacaugcauuacuagcaaaaaguauauucaaauuaacauaucaaaacaaaguaguaagaguucaaagaccagccaaaaauggaacuguaauggaugugauuucaagaagagaccaacgcggcaguggccagguagguacauauggccuaaauacauucacgaauauggaagcacaacugauuaggcaaauggagagcgaggaaauauucaguccaaaugaguuggagaccccaaaccucgcagaaagaguauuagacugguuagaaaaauauggcguggaaagacugaaacguauggcgauuagcggggacgacuguguaguuaagccuauugaugacagauuugcaaccgcguuaaccgcguuaaacgauaugggaaaagucaggaaagauauuccucaaugggaacccucuaagggguggaaugauuggcaacaagugccauucugcucacaucacuuccaucaacuuguaaugaaggacggcagagaaaucguagugccuuguagaaaccaagacgagcuaguuggucgugcucgagugagucagggagccggauggagucuccgagaaaccgcaugccuagggaaaucauacgcacagauguggcaauuaauguauuuucaccgaagagauuuaagacuugccgccaaugcgaucugcucugcaguccccgucgacuggguacccacuucaaggaccacuuggucaauccaugcacaccaccaauggaugacuacggaggauaugcuuagcgucuggaaccguguguggauugaagaaaauccauggauggaagacaagacuagaguaagcaguugggaagaugucccauacuuaggcaaacgcgaagaucaguggugcgggaguuuaauaggacuaacugcuagagcuacaugggcgacaaauauacaggucgcuauaaaccaaguuaggcguuuaauuggcaaugaaaauuacagcgauuauaugaccaguaugaaaagauuuaaaaacgaguccgaacccgaaggggcacuaugguag

SEQ ID NO: 22079 - RNA, 9879 nt, Artificial Sequence
  derived and/or modified CDS sequence (opt6) from DENV-1__KF289073__SS-prME
aguguuacuaugcuauucaugcuuuuaccaacggcgcucgcguuucauuuaacaaccaggggaggugaaccacauaugauaguuagcaaacaagaacgcgguaaaucccuucuauuuaaaacuucugcaggcgugaacauguguaccuuaauagcaauggaucuaggugaacugugcgaagacacaaugacauauaaauguccaagaaucacugaagcggaaccagacgauguugacugcugguguaaugcaaccgauacaugggucacauacggaacuuguucacaaacaggagaacauagacgagacaaaagaucaguagccuuggcaccacacgucggguuaggauuagagacaagaacagaaacguggaugucgagugagggagcauggaaacaaauacaaaaaguggaaacaugggcauugcgucacccaggcuucacaguuauagcuuuauucuuagcgcacgcuauaggaacgucaaucacccaaaaagguauaauuuuuauccuucuaaugcuagugacaccuucuauggcuaugagauguguaggaaucggaaauagagauuuuguugaaggucugagcggggcaacuuggguggauguagugcuagaacaugggaguugugugacgacuauggccaaaaauaaacccacuuuagauauugagcuauuaaaaacugagguaacuaacccugcugugcucagaaaauuaugcauugaagcaaaaauaucaaaaacuacaacugauagucgauguccgacacaaggcgaagcgacauuaguagaagaacaagaugcgaacuucguuuguaggagaacuuuugucgaucgugggugggggaauggcuguggucuguucggcaaagggucuuuacuaaccugugcgaaauucaaaugcguuacuaaauuagaaggcaagaucgugcaauaugaaaauuugaaauauucaguaauaguaacuguccauacaggcgaucaacaccaagugggaaaugagacaacggaacacgguacaauagcaacaauuacaccacaagcuccuacaucugaaauacaguuaacugauuauggagcacuaacacuugacuguaguccucguacgggccuagauuuuaacgaaaugguccuccuaacaaugaaagagaaaagcuggcuaguccauaaacagugguuuuuggaccuaccuuugccguggacaaguggagcuucuacaucacaggagacauggaaccgacaagaucuucugguuacguucaagacagcccacgccaagaaacaagaaguagugguacuuggaucgcaggaaggagcaaugcauaccgcgcuaacgggcgcaacggaaauacaaacaucugguacaacaacaauauuugccggacacuuaaaaugccgucuaaaaauggauaaguuaacucuaaagggcaugucauacguuauguguacagguuccuucaagcucgaaaaagaaguagcagaaacccaacauggaacaguacuuguacaagugaaauaugaggguacagacgccccuuguaaaaucccaauaucuacucaggaugaaaagggaguaacacaaaacgggcgcuuaauuacagcgaaucccauugugacagacaaagaaaaaccuguaaacauagaaacugaacccccguucggugaaucauacauuguuauuggagccggugagaaagcccugaaauuaucaugguuuaagaaagggucgucgaucggaaaaauguuugaagcuacugcgagaggagcuaggaggauggcuauauuaggagacacugcaugggacuucgguagcauaggcggcguguucacaagcguugguaagcugguucaccagguuuuuggaacagcuuacggaguuuuauucaguggcguuucuuggaccaugaagaucggcauugggguucuauugacgugguuaggcuuaaauucacgaagcacgucacuaaguaugacuuguauugcaguaggaauggugacgcuguacuuaggcgugaugguccaggcggacuccggauguguuauuaauuggaaaggccgagaacuaaaguguggaucggguauauucguaacuaaugaaguucauacuuggacagaacaguacaaauuccaggcggacucuccaaagcggcuaagugccgccaucgggaaggcaugggaagaaggagugugcggaauaagaucugcaacucgacucgagaauaucauguggaagcaaauaaguaaugaacuaaaccauauccuauuagagaaugauaugaaguucaccguaguaguuggugacgcuaauggaauacuugcacaagguaagaaaaugauucgaccucagccaauggaacacaaguauagcuggaaaaguuggggaaaggcaaaaaucauaggugcagacauucaaaauacaacuuuuauaauugaugggccggauacccccgaguguccggacgaccaucgagccuggaauauaugggagguggaagacuaugguuuuggaaucuuuacaacaaauauaugguuaaaguuaagagacucauauacccaaaugugcgaccauagauuaaugucugccgcaauaaaagauaguaaggcaguccacgccgacaugggauauuggauugagucggagaaaaaugaaacuuggaaacuugcccgugcuuccuucaucgaagucaaaaccuguauauggccaaaaucucauaccuuauggagcaacgguguuuuagaaagcgaaaugauuauaccuaaaaucuacgggggaccuauuucacagcauaacuauagacccgguuauuuuacgcaaacagcaggaccauggcauuugggcaaauuggaacuagauuuugauuuaugugagggaacgacgguaguaguagaugagcauuguggaaaucgugguccgucacuucgaacuacaacgguaacaggaaaaaucauacaugaaugguguuguaggucauguacccuaccaccacuaagguucaaaggggaagauggauguugguauggaauggaaauaagaccgguuaaagaaaaagaggaaaaccuuguucgcaguaugguaagugcugguucuggagagguagacaguuucuccuuagguuuacucugcguaucuauuaugauagaggaaguaaugcguagcagauggucaagaaaaaugcucaugacuggaacacuagcaguauucuuacuacuaauuaugggacaauuaacauggaacgauuuaauaaggcuauguauaauggucggugcaaacgcgagugauagaaugggaaugggaacaacauauuuagcacuuauggcuacauuuaagaugcgccccauguuugcgguagguuugcuauucagacgguugacgucaagagagguauuguuauugacaaucggacuuucguuaguagcaucaguugaauugccaaauucucuagaagaacuuggagauggucuugcaaugggaauuaugaugcuaaaacucuuaacugacuuucaaagucaccaacuauggacaaccuuauuaagucuuacauuuauuaaaaccacucuaagccucgauuaugcuuggaaaacaauggcuaugguccuaaguauuguuucacuuuuccccuuaugccucaguacaaccucucagaaaacaaccuggcuaccaguacuucuggguucauucggaugcaaaccauuaacaauguuccuuauuacagaaaauaaaauauggggaagaaaauccuggcccuuaaaugaagguauuauggcaguuggaauaguuagcauccuacuaucgucucuauugaaaaacgauguaccacuggcaggcccguuaauagcggguggcaugcucauagcauguuaugugauaagcggcucauccgcagauuugucauuggaaaaggcagcagaaguaucuugggaagaggaagcugaacacaguggggccucgcauaauauauuaguagaagugcaagacgacggcaccaugaaaauaaaggaugaggaaagagaugauacccugaccauauuauuaaaggcaacauuacuggcggucucggguguguauccaaugaguauaccagcaacucuauucguuugguauuuuuggcagaaaaagaaacaaagaaguggaguuuugugggauacacccaguccaccggagguagaaagggcaguauuagacgauggaauauaucgaauauugcaaagaggccucuugggacgcagucaaguugguguuggaguuuuucaagacggagucuuucacacgauguggcaugugacacgaggugccguuuuaauguaucaaggaaagagacuggaaccaucaugggcaucggugaagaaagaccuuaucaguuacggaggaggcuggagauuucaaggauccuggaauaugggagaagaaguacaaguaauugcagucgaaccggguaaaaaucccaaaaauguacaaaccacaccugggacauucaagacuccagaaggagaagugggagcgaucgcgcuagacuuuaaaccuggaacuucagggaguccaauagugaaucgcgagggcaagauuguuggauuguacggcaaugggguuguaaccacaagugggacuuacguaucugcuauagcacaagcuaaagccagucaggaaggaccacuaccugagauugaagacgagguauuuagaaaaagaaaucuaacuauaauggacuugcauccaggcucaggaaaaacuagaagauaucuaccagcaauuguacgagaagccauaaaaagaaaacucagaacucugauacuugcuccaacuagaguaguagcgagugaaauggcagaggcauuaaaaggaaugcccauucguuaucaaacaacagcagucaaaagugaacacacuggacgagaaauaguugaccugaugugucacgccacauuuacaaugagauuacuaucaccgguaagaguacccaacuauaacaugaucauaauggacgaagcgcauuucacagaccccgcgaguauagcugcacgaggguacauuagcaccagggucgguaugggagaagcggcggccauuuucaugacagccacucccccaggcucaguggaagcauuuccacaaucaaacgcaguaauccaagaugaagagagagacauuccugagaggucguggaacaguggauacgauuggauuacagauuuuccagguaagacaguaugguuugugccgucgaucaagagugguaacgacauagcgaauugccuaaggaaaaauggaaaacguguuauccaauuaaguagaaaaacauucgacacggaguaucagaaaaccaaaaauaacgacugggauuauguaguuacuaccgacauaagugaaaugggagcaaauuuucgcgcagaucggguuauagaccccagacgcugucuuaaaccaguuauauuaaaggacggccccgagagggucauacuagcgggcccuaugccagugacuguggcuuccgcagcacaacggagaggaagaauaggccggaaccaaaauaaagagggagaccaguauguuuauaugggucagccgcuuaauaaugaugaagaucacgcacauuggacugaagcaaagaugcuacuggauaacauaaauacccccgaagguaucauucccgcucuauuugaaccugaacguaagaaaucugcagcuauagauggggaauacagauuacgcggagaggcaagaaagacuuucguggaauugaugcgacggggcgaccuaccggucuggcucucauauaaaguugcuucagaaggauuucaauauucugacaggagaugguguuucgauggcgaaagaaacaaucaaguacucgaagagaauauggauguugagauauggacuaaagaaggagagagaaagaaguuacgaccuagauggcuagaugcaagaacauauucagaucccuuagcccugagagaauuuaaggaguucgcggccggaagacgcucagucaguggcgaucuuauauuggaaauuggcaaauuaccacagcauuuaacacuuagagcacaaaaggcauuggauaaucucgucaugcuccauaauucugaacaaggugggaaagcguacagacaugccauggaagaauugccugauacuauagaaacucuaauguuacuagcacuuauugcaguguuaaccgguggagugacauuguucuuucuuagugguaaaggucuagguaaaacgucuauaggcuugcugugcgugauggccucaucagcucuccuauggauggcaucaguagaaccacacuggaucgcagcuucgauaauacuagaguucuuucuaaugguacuacugaucccggaaccggacagacaacguacaccacaagauaaccagcuugcuuauguaguaaucggacuucuauuuaugauacuaacuguugcggcuaaugagauggggcugcuugaaacuaccaagaaagaucuaggcauaggucauguugcagcugaaaaccaucaucaugcaacaauguuagauguagauuuacgaccggcgucagcauggacacuauacgcaguugcaacaacgaucauuaccccaaugaugcgucacacaauagagaauacaaccgccaauauaucauuaaccgcgaucgcaaaccaggcagcgauucuaauggggcuugauaagggauggccgauaaguaagauggacauugguguaccguuacuagcuuuaggaugcuauucucaagucaauccuuugacuuugacggcggcaguucuaaugcuaguugcacauuaugccauuauaggaccgggacuacaagccaaggcuacucgggaagcccaaaagcgaacagcagcggggauuaugaaaaauccuacaguggacggaauagucgcaauugacuuagauccugucguauaugacgcgaaauuugaaaagcaguuggggcaaaucaugcuuuuaauucuuuguacuucacagauuuugcuuaugagaaccacuugggcguuaugugagucgaucacuuuagcuacuggcccucuaacaacgcugugggaaggaaguccuggaaaauuuuggaacacaacuauagcuguaucuauggcaaacauauuuagaggaaguuacuuggcaggagcagguuuagcauuuucauugaugaaaagucuagggggugggcguagggguaccggagcgcaaggugaaacacugggugaaaaguggaaacgccaacuuaaccagcucaguaagucggaauuuaauacauauaaacguuccggaauuauggaaguagaucguucggaagcaaaagagggauugaagagaggugagacaacuaaacaugcaguuagucgcggaacagcaaaauugcgaugguucguggaaagaaauuuggugaaacccgaaggaaaaguuaucgaucuaggaugcggaagaggaggcuggucauauuacugcgcaggacucaagaaaguaacagaagugaaaggauauaccaaaggagguccuggucaugaagaaccgauuccgauggcgacuuacgguuggaaucuuguaaagcuacauucgggcaaagacguauucuucacuccaccugaaaaaugcgauacauuacugugugacauaggagagagcucuccaaaucccacaauagaggaagguaggacucucagaguguuaaaaaugguagagccuuggcuucgaggcaaucaauucuguauaaagauauuaaauccguauaugcccucaguuguugaaacauuagaacaaaugcaacguaagcauggagguaugcuaguccguaauccccuuagcagaaauucuacacaugagauguauuggguaucuugugguacggggaacauuguguccgcaguaaauaugacaucaaggauguuguugaaucgauucacaaugacacauaggaaaccaacauaugagagagacgucgaucuuggagcaggcacaagacauguggcaguugaaccagagguugcaaaccuggauaucauaggccaacgcauagaaaacaucaaaaaugaacauaaaaguacguggcauuaugaugaagauaaccccuauaagaccugggcuuaucauggcaguuaugaaguuaagccuucaggcagugcaucgaguaugguuaacggcgugguacgccuacuaacgaaaccaugggauguuauuccuaugguaacccaaauugcgaugacagauacaacgccauucggucagcagaggguuuucaaagagaaagucgauacaagaacaccacgggcaaaaagggguaccgcacagauuauggaagugacagcuaaguggcuauggggauuucuaucacguaacaagaaacccaggauaugcacccgugaagaguuuacaagaaagguaaggaguaaugcggccaucggagcuguauuuguagacgaaaaucaauggaauagcgcaaaagaagcaguagaagaugaaagauucugggacuuaguucauagagagcgagaacuccauaaacaagguaaaugcgcaacauguguguacaacaugauggguaagcgagagaagaaacuaggagaguucgggaaagcgaaagggucgagggcaauaugguacauguggcuaggugcucgguucuuagaauuugaagcauuaggauuuaugaacgaagaucauugguuuucgagagaaaauucuuuaaguggcguugaaggcgaaggucuacauaaacugggauacauacugagagauauuaguaaaauccccgguggaaacauguaugcagaugauacaacggggugggacacuaggaucacagaagacgacuuacaaaaugaggcuaaaauuacagauaucauggaaccagaacaugcuuuguuagcaacaucgauuuuuaaauuaacauaccaaaauaaagucgugaggguucagcgaccugcuaaaucggguacaguaauggauguaauaagcagacgagaucagcgagggagcggacagguggguacauauggucuuaauacguuuacuaauauggaaguacaauuaauaagacagauggaaucagagggaauauuucuaccauccgagcuugaaaccccaaacuuagcagaaaggguccuugacuggcuagaaaagcauggaguggagagacuuaaaagaauggccauuucuggggaugauugugugguaaaaccuacugaugauagauucgcaacagcauuaacagcgcugaacgacauggguaagguacguaaggacauaccgcagugggagccuucaaaaggcuggaacgauuggcaacaagugccuuuuuguucgcaccacuuucaucaacugauaaugaaagauggacgagaaaucguaguacccugucgcaaccaagaugaacuuauggggagggcaagaguaagccaaggugcgggauggucccuuagagaaacagcaugccuuggaaaaucguacgcgcaaauguggcaauuaauguauuuccauaggcgugaucucagauuagccgcuaacgccauuuguagugcggugccgguugacuggguucccacgagcagaacaacauggucgauucaugcacaucaccaguggaugacgacugaagauauguugaguguuuggaaucgaguauggauagaagagaauccauggauggaagacaagacccauguuagcucaugggaggauguaccuuauuuggggaaaagagaagaucaauggugcgguucguuaauaggauuaaccgcacgugcuaccugggcuacuaauauccaagucgccauaaaccaaguuagacgacuuauuggaaaugaaaauuaccuagacuauaugacgagcaugaagagauuuaaaaaugagagugacccugaaggagcacuaugguaa

SEQ ID NO: 22080 - RNA, 9879 nt, Artificial Sequence
  derived and/or modified CDS sequence (opt6) from DENV-1__JQ915072__SS-prME
aguguuacaaugcuuuuaaugcuucugccuacaguauuaacguuccaucucacuacuagaggaggugagccacacaugauaguaaguaaacaagagagaggaaaaucguuacuuuucaaaacgucagcuggggugaauauguguacacuuaucgcaauggacuuaggagaguuaugcgaugauacuaugacauauaaauguccaagaauaacugagacagaaccggacgacgucgacugcugguguaaugcaacagaaacgugggucacauaugguaccuguucgcaaacaggcgagcaucgccgcgacaaaaggaguguagcacuagcgccacauguggggcuaggucuagagacucggacagagacauggaugagcagcgaaggagcguggcggcaaauucaaaaaguagaaacaugggcacuaagacacccggguuuuacaguaauagcuuuguuucuugcgcaugcaauuggaacaucaaucacgcaaaaaggcaucauuuuuaucuuacugaugcuuguaacaccuucaauggcaaugagaugcguugguauaggcaauagagacuucguagagggauuaagcggggcuacauggguugauguuguacucgaacacggcaguuguguaacaaccauggcuaaggauaaaccuacguuggacaucgaauuacuaaaaaccgagguaacaaacccagcaguguuaagaaaauuauguauagaagcaaaaauaagcaauacaacuacagauagucgauguccuacacaaggcgaggcaaccuuaguagaagaacaagauacgaacuucgugugucgucgaacguuuguagacagaggcugggguaaugggugugguuuauuuggaaagggauccuugauaacuugugccaaauucaaaugcgugacgaaguuagaaggaaagauuguucaauaugaaaauuuaaaguauuccguaaucguuacgguucauacgggagaucaacaucaggucgguaacgagacaacagagcaugggacaauagcaacgauaaccccucaagcaccgacaucugaaauucaauuaacagauuacggggcacuaaccuuggauuguaguccgagaacaggacuagacuuuaaugaaaugguuuuacuuacuaugaaagaaaaaucuugguuaguucauaagcagugguuucuugaucuaccacuuccuuggacaacaggagcaagcacgucucaagaaaccuggaaucggcaggacuuacuugugaccuucaaaacagcucaugccaaaaagcaggaagucguaguucuagguagccaagaaggggcaaugcauacagcucugacaggcgcuacggagauccaaacauccgguacgacuacaauuuuugccggucauuugaagugccgucugaaaauggauaaacuuacuuugaaaggaaucucauauguaaugugcacagggucuuucaaauuagagaaagaaguagcggagacccaacauggcacgguguuaguacaaguaaaauaugaagguacagaugcccccugcaaaauccccuucuccucgcaagaugagaaaggagucacgcaaaacgggagguuagugacagcuaauccaauugucacggauaaagaaaaaccggucaauauagaagccgaaccaccauuuggagaaaguuauauugucguaggagccggcgaaaaggcucugaagcucucuugguucaagaaaggaagcucuauugggaagauguuugaagcuaccgcacggggcgcccgucguauggcgaucuugggugauacagcaugggauuucggaucgauuggugguguauuuacaucugucgguaaauuaguacaucagauuuucggaacugccuacggaguucuuuuuaguggaguuuccuggacaaugaagauugguauagguauuuugcuaacuugguuaggacuaaauuccagaucaacgucucucucaaugacguguauugccguaggaaugguaacgcuauauuuaggcguaaugguacaagcugauuccggaugugucauaaacuggaagggaagagagcugaagugcgguuccggaaucuuuguaacaaacgagguacauacauggacggaacaauauaaauuucaggcagacuccccuaaacgucucucagcagcuauagguaaggcaugggaagagggcguaugcggaauaagaagcgcaacacgucuugaaaauauuauguggaaacaaauaucaaacgaacuaaaucauauauuauuagagaacgauaugaaauucacagucguaguuggcgaugugagcggaauacuagcucaggggaagaaaacaauacgcccccagccaauggagcauaaauacaguuggaagucauggggaaaagcaaaaaucauaggcgcugaugugcaaaacacaacauuuaucaucgacggaccaaauacaccagaaugcccugaugaucaaagagcauggaauaucugggaaguugaagauuacggauucgggaucuuuaccacuaauauuugguuaaaauuaagagauucauacacucaaguuugugaccaucguuuaaugagugcugcgauaaaagacuccaaagcaguacaugcugauaugggauauuggaucgaaucugagaaaaaugaaaccuggaagcuggcgcgcgcauccuuuauugaaguaaaaacaugugucuggccgaaaucucauacacuauggucaaaugguguguuagaaucggaaaugaucaucccuaaaauauauggagggccuauaucgcagcauaauuacagaccaggguauuuuacccagacagcagguccuuggcauuuaggaaaacuugaauuggauuucgacuuaugugagggaacuacaguagucguggacgaacauugugggcaccgaggacccagcuuaaggaccacuaccguaacuggaaagauaauucacgaguggugcugcaggagcuguacgcucccaccccucagguucaaaggagaggacggauguugguacggaauggaaauuagaccugucaaagaaaaagaagagaaccuaguaaaaucuauggugucagcugguaguggagaaguggauucuuuuaguuuaggacucuuauguauaucaauaaugauagaggaaguuaugaggagccgcuggucacguaaaaugcuaaugacagguacauugguaguauuuuuauugcuaacuuugggccaguuaacguggaaugaccuuauuagguuguguauaaugguaggcgcuaaugcaucagacaacaugggcauggguacaacuuauuuggcacuuauggcaaccuuuagaaugaggccaauguucgcuguaggauuacuauuuagaagacuaacaaguagagaagugcucuuauuaacaguaggauuaucgcucguugcaucaguagagcuaccaaauucauuagaugagcuaggugacggucuagcaauggggaucaugauacuuaaacuuuuaacugacuuucagucacaucaacuuugggcgacucuauugaguuuaaccuucguaaaaacaacgcuaucuuuacauuaugcauggaaaacgauggcuaugauucuuuccauuguaucacuauuaccacucugucuauccacuacaagucagaaaacuaccugguuaccggucuugcuagggucacucgguuguaaaccacuaaccauguuucuuaucacggaaaacaaaauauggggacggaaaaguuggccacucaaugaaggcaucauggcgguggggauagugucaauccuucucagcucauuauugaaaaaugacgucccucuagccggccccuuaauagccggugguaugcuuaucgcauguuacgucauauccggaucuucugcggaccuaucccuagaaaaagcggcaaaagucucaugggaagaagaagcugagcacaguggagccagucacaacauauuagucgaaauccaagacgacggaacgaugaagauaaaggaugaggagagagaugacacgauaacuauuuugcuuaaagccacucugcucgcaauaucgggcguauauccaaugucgauaccagcuaccuuguuugucuggcauuucuggcagaagaaaaagcagaggucagguguuuuaugggauacaccuagcccaccagagguagaaaaagcaguacuugacgacgguauuuaucgcauucuacagcggggacuacuuggucguucucaaguagguguaggaguauuucaagagggcguauuccauaccauguggcacgucaccaggggagcaguacuuauguaucaaggaaaacguuuggaaccgucuugggcuucaguuaaaaaggacuuaauuaguuauggcgguggauggcguuuccaaggaucauggaacaugggggaagaaguccaaguaauagcuguugaaccagguaaaaaucccaaaaauguacaaacggcccccggcacuuucaagacaucagaaggugaaguuggcgcuauagcgcuagauuuuaaaccaggaacuucuggaucuccaauaguuaauagagagggcaaaauaguuggacuauaugggaauggaguaguaacaacaagcggaacuuacgugucugccaucgcacaagcuaaagcaucacaggagggaccacuaccagagauagaagaugaaguauuuaggaaaagaaacuugacuauaauggaucuacaccccgggucgggaaaaacuagaagauaccuaccagccaucgucagagaggcuauuaaaagaaaauuaagaacccuaguauuagccccaacuagaguaguagcgagcgaaauggcagaggcuuuaaaaggcaugccgauccguuaccaaacgacugcuguuaaaagcgaacauaccgguaaagaaauuguggauuuaaugugccaugcaacuuucaccaugaggcuacuaucaccaguuagaguuccgaacuacaacaugauuauuauggaugaagcacauuuuacagauccugcuucaauagcggcaagaggcuauaucuccacacgcgucggcaugggagaagcagcugcaaucuucaugacagcaacuccaccuggaaguguagaagcauuuccacagucuaacgccguaauacaagacgaagaaaaagacauuccugaacggagcuggaauagcggauacgacuggauaacagauuucccugggaaaacugucugguuuguuccaucaauuaagaguggaaaugauauugcgaacugucuccguaagaacggaaagcgaguaauacaguugucccgaaagacguucgauacagaguaccagaaaacuaaaaacaaugacugggauuacguagugacgacagauauaucugaaaugggcgcuaauuucagagcugaucgagugauagaccccaggcgaugcuugaaaccagucauacuuaaagacggaccggaacggguuauacuggccgggccgaugccgguaacagucgcaucagccgcacaaagacguggaagaauaggccguaaucaaaauaaagaaggcgaucaauauauuuacaugggucagccucuuaauaaugacgaagaccaugcccauuggacugaggcgaaaaugcucuuagacaauauuaacacgcccgagggcauaaucccugcccuauuugaacccgaaagagagaaaucggccgccauugauggagaguaccgucuucgaggagaagcgcggaaaacauucguagaacuaaugagaagaggcgacuugccggugugguugucguauaagguggcgucagaaggauuucaauauucagaccgacguuggugcuucgacggagaacgcaacaaucaaguacuagaagagaacauggacguagaaauauggacuaaggaaggagaacgaaagaaacuaagaccccgcugguuagacgcuagaacauacucugauccacuugccuuaagggaguuuaaagaauuugcagccggacguagaagcguuuccggcgaccuaauccucgaaaucgguaaacuaccucaacacuugacgcaacgagcccaaaacgcacuugacaaucuuguuauguuacauaauagcgagcagggagguaaagcauauagacacgccauggaagaauugcccgacacaauagagacaauaaugcuucuagcauuaaucgcuguauuaacaggaggagugacacucuucuuuuuaagcggccguggucuaggaaaaaccaguauaggccuauuaugcguuacaagcaguagugcauuauuauggauggcaaguguagaaccacauuggauugccgcaucuauaauuuuagaguucuucuugaugguauugcuaauaccagaaccagaccgacagcgaacgccacaggauaaucaauuagcauauguaguaaucggauugcucuuuaugauucugacaguagcagcgaaugaaaugggcuugcuagaaacaacuaagaaagauuuagguauaggccauacagcggcagaaaaccaucaucacgcagcgaugcuagauguugaucuucauccagccuccgcguggacacuauacgcaguugcaacaacaauaaucaccccuaugaugagacauacaauagaaaauacuacagcuaauauuagcuugacugccauagcaaaucaagcugcgauacuuaugggccuugacaaaggauggccuauauccaaaauggauauaggcguucccuuacucgcacuaggauguuacagccaggucaauccccuaacuuugacugcugcaguauuaaugcuaguggcacacuaugccauuauagggccaggauugcaagccaaggcgacuagagaagcacagaagcgcacagcugcagggauaaugaaaaacccaacaguagaugggauaguagcaauagauuuagacccgguuguguacgaugcgaaauuugaaaaacaauuaggacaaauaauguugcuaauacuaugcacaucccaaauacuguugaugagaacaacaugggcucuaugugagaguauaacucuugccacaggaccauuaaccacauuaugggaaggaagcccaggaaaguucuggaauacuacgauagccgucucgauggcaaauauauuuaggggaaguuaucuugccggugcagguuuagcauucucuuugaugaaaagucucgguggaaguagaagaggcacgggagcucaaggcgagacucugggcgagaaguggaaaaggcaauuaaaucaauuaucuaaaagugaauuuaacauauacaaaagaaguggaauaauagagguagacagauccgaggcuaaagaaggacuuaaaagaggugagacgacaaagcaugcuguuucaaggggcacugcaaaguuacgaugguuuguggaacggaaucuagugaaaccugaaggaaagguaauagauuugggaugcgggagagguggauggaguuacuauugcgccggacucaaaaaggucacugaaguaaagggauauacaaaagguggaccaggccacgaagaaccaauuccaauggcuacuuacggauggaaucuagugaaacuucacucaggcaaagacgucuucuucauuccaccagagaaaugugauacccugcucugcgauauaggagagagcaguccaaauccaacaaucgaggaaggucgaacguugcguguccuuaagaugguagaacccugguuacguggcaaucaauuuugcauaaaaauacuaaauccuuacaugccuaguguaguagaaacuuuagaacagaugcaaagaaaacacggaggaaugcuuguucguaauccuuuaucgagaaacaguacccaugaaauguauugggugaguuguggaacgggaaauauaguaucagcgguaaacaugacaucacgaauguuauuaaaccgcuucacuauggcucaccggaaaccuacguaugaaagagauguagaccugggagccggaacuaggcauguggcgguggaacccgaaguggcaaaucuugacauaauuggacaacgaaucgaaaauaucaaaaaugaacacaaaagcacuuggcauuacgaugaggauaauccauacaaaacgugggcguaucacggcucauaugaagucaaaccaucagggagugcgagcucaaugguaaacggaguagucagguuacuuacuaaaccaugggauguuauaccaaugguuacucagauugcaaugacagauacgacuccuuucggccaacaacgcguuuucaaagaaaaaguugacacuaggacuccaaaagcaaaaaggggaacggcucaaauaauggaggugacagcuaaaugguuaugggguuuccuaagccggaacaagaaaccccgaauuuguacccgcgaagaguucacaagaaaggugcguagcaacgcagccauaggugcagucuucguagacgaaaaucaauggaacucggcgaaagaagcagucgaagaugaacgauucugggacuuagugcgacgggaacgcgaauuacacaagcaggggaaaugcgcaacgugcguguacaauaugauggguaaaagagagaagaaacuaggggaguucggcaaagcuaagggcucuagagcaauuugguauaugugguugggagcaagauuucucgaguucgaggcccuugguuuuaugaaugaagaccacugguuuucgcgagaaaacucuuugagugggguagagggagaagguuuacauaaacuugguuacaucuuacgagauauaucaaagauaccaggaggaaacauguacgccgaugauaccgcgggcugggauacgaggauuacggaagaagacuuacaaaaugaagccaaaauuacggacauaauggaaccugaacaugcuuuacuagccacaaguauauuuaaacucacauaccagaacaaagucgugcgagugcaaaggccagcuaaaaaugggacaguaauggacgugauuucgaggagagaucaacgcggguccggccaaguagggacauacgggcucaacacguuuacgaauauggaagcacaauuaauucgacaaauggagucagaagguauauucucgccaucugagcucgaaacuccaaaucucgccgggcggguguuggauuggcuagaaaaacacggaauagaaagacuaaggcgcauggcaauaucuggugaugauugcguagucaaacccauagaugacagauucgcuacagcccuuacagcauuaaaugauaugggaaaaguucgcaaagacaucccccaaugggaacccaguaagggguggaacgacuggcaacaaguucccuuuuguucucaucauuuccaucaacucauaaugaaagacggacgggaaauuguaguaccuuguagaaaucaggacgaauugguuggucgugcaagaguaagucagggugcuggcuggagccugagagagacggcuugucuaggaaagagcuaugcacaaauguggcaacugauguauuuucaucgaagagacuuacgacucgcugcaaaugccauauguucagcagugccuguugauuggguuccaacaagccgcacaacguggaguauacaugcccaucaucaguggaugacgacggaggacaugcuaaguguuuggaaccgaguuuggauugaagaaaaucccuggauggaagacaagacacauguaaguaguugggaggauguaccguauuugggcaaaagggaggaucaguggugugggagucucaucggauuaacagcucgagcaacuugggccacaaauauacaaguggcuauaaaacagguucgaagauuaauaggaaaugaaaacuaucuugauuauaugacuucgaugaaacgauucaaaaaugaguccgacccagaaggagcacuaugguga

SEQ ID NO: 22081 - RNA, 9879 nt, Artificial Sequence
  derived and/or modified CDS sequence (opt6) from DENV-1__JQ915071__SS-prME
agugucacuauguugcuaaugcuucuaccuacgguucuaacauuucauuuaacaacuagaggaggagaaccccacaugauuguuaguaaacaagaacgagguaaaaguuuacuauucaaaaccagcgcaggagugaacauguguacuuugauugcaauggacuugggcgaauugugugacgacaccaugaccuacaaauguccgagaauuacagaaaccgaaccugacgacguggauuguuggugcaaugcuaccgaaacgugggucaccuacgguacauguagccaaaccggagaacacagaagagauaaaaggucaguugcacuagcaccccacguuggguuagguuuagaaacgaggacagaaacguggaugagcagcgaaggcgcauggaggcaaauacaaaaaguggaaacuugggcccuuagacauccaggguucacuguaauagccuuguuucucgcacaugcgauagguaccaguauaacacaaaaagguauaauuuuuauucuucuaauguugguuacaccgagcauggccaugcguugcgucggaauaggcaaccgcgauuucguugaaggguuaagcggugcuacgugggucgacguaguauuagaacacgggucuugcguaacaacaauggcaaaagauaaaccaacuuuagauauugaacuccucaaaaccgaaguaacaaaucccgcaguuuugcgaaaauuaugcauugaagcaaaaauuucuaacacuacgacagauucaaggugucccacgcaaggagaagcaacacugguugaagaacaagauacaaauuucguuugccgcagaacuuuuguagacagaggauggggaaauggauguggucucuuuggaaaaggaagucuaauaacuugugcaaaauuuaaaugugcgacaaaauuggaaggcaaaauuguucaauaugaaaacuuaaaauauagugugauaguuacaguccauacaggugaucaacaccaaguaggaaaugaaacaaccgaacauggaacaauagcgacaauuacgccacaagcaccaacuucugaaauacaacugacagauuacggagcuuuaacauuagacuguagcccaagaacagggcuagacuucaacgagaugguccuacugaccaugaaagagaaaaguugguuaguacacaaacaaugguuccuggaccuaccacuaccauggacaacuggcgcuucaaccagucaagaaacuuggaaucggcaggaccuauuaguaaccuucaaaacggcgcaugcuaagaagcaagaagucguuguucugggaucacaggaaggggcuaugcacacagcguuaacaggagcaacugaaauccaaacgucaggaaccacaacaauuuuugcaggacacuuaaaaugucgguuaaagauggacaaauugacuuugaaaggcauaucguaugugauguguaccggaucauuuaaacuggaaaaagaaguugcggaaacgcaacacgguacuguauugguacaaguuaaauaugaaggaaccgacgcgccauguaaaauccccuucaguagccaagaugaaaaggguguuacacaaaacgggagacuuguaacggcuaaccccaucguaacggauaaggagagacccgucaacauugaagcugaacccccauucggggaaucauauauaguugucggagcaggggagaaagccuugaaacuaucaugguuuaaaaaggggagcagcauagguaaaauguuugaggcaacagcucggggagcaagaagaauggcgauucuuggugauacagcaugggauuucgguaguauaggagggguauuuacaucaguuggaaaacuugugcaucagauauuugguaccgccuaugguguacuauuuucgggugugagcuggacuaugaagauuggcauagguaucuuauuaacuuggcuaggauuaaacucacgaagcaccucauuauccaugacaugcauugccguagguaugguaacuuuauaucuaggaguuaugguccaagcagacucaggauguguaauaaacuggaaaggcagagaauugaaaugcgguucuggaaucuuuguaaccaaugaaguccauacguggacggagcaauauaaguuucaagcugacucuccaaaacguuuaucugcugcaauaggcaaggcuugggaagaagguguaugcgguauacgaucagcaacuagauuggaaaauauaauguggaaacagauaaguaacgaacugaaucauaucuuauuagagaaugacaugaaauucacaguaguuguaggcgaugugucuggcauccucgcacaggggaaaaagacaauaagaccacaaccaauggagcauaaauacucauggaaaucguggggaaaggcaaaaauuaucggagcugauguacaaaauacgacguuuauaauugacgggccuaauacgccugaaugcccugaugaucagagagcuuggaauauaugggagguagaagauuauggcuuuggaauauucacgaccaacauauggcuaaagcugcgugauaguuacacucaaguuugcgaccauagauuaaugucugcugcaauaaaagacucaaaagcagugcacgcagacaugggcuacuggauugaaagugagaaaaaugagacauggaaauuggccagagcaucguucaucgaaguaaaaacauguguguggcccaaaagucauacguuauggucaaacggaguacuagaaucagaaaugauuauaccgaaaauauauggggguccaauuucgcaacacaacuacagaccaggguauuucacacaaaccgcuggaccuuggcacuuaggaaaacucgaacuugauuuugaccuaugugagggaacaaccguaguaguugacgagcauugugguaauagaggcccaagccuuagaaccaccacagucaccggcaagauuauucaugagugguguugcagaucauguacauuaccuccacuccgauucaaaggugaagaugguugcugguacgguauggaaauaagaccuguuaaagaaaaagaggaaaacuuagucaaaucuaugguaagcgcaggaucaggagaaguagauagcuuuagucuaggacuacuaugcauaucaauuaugauugaggagguuaugaggucaagauggucgcgcaaaaugcucaugacagguacccuuguggucuuuuugcuccuaacucuugggcaauuaacguggaaugaccuaauuaggcuguguauaauggucggggcaaacgcaucugauaauauggguaugggcaccacauauuuagcccuuauggccacauucagaaugagaccgauguuugcgguaggauuauuauuucgucgacucacgucacgagagguacucuuacuaacaguuggccuaagucuaguagcuagcguagagcuuccaaauagccuggaugaacucggagacggucuagcaaugggaauaaugauccucaaacugcuaaccgacuuccaaagccaucaauuaugggccaccuuacugucauuaacuuucgugaagacaacucuuucacuacacuaugcguggaaaacuauggcaaugauuuuaucgauaguuagcuuacuacccuuaugcuuaucuacaaccucacagaaaaccacauggcuaccuguucuccuugguagccucggauguaaaccuuuaacaauguuucuuauuacagagaauaaaauaugggguagaaaaucguggccacuuaaugaaggaauaauggccguaggcauaguaucaauauuacuuucaagucuacucaaaaaugaugucccauuagcaggacccuuaaucgcgggugggaugcucauugcauguuacguuauaucaggaagcucagcggauuuaaguuuagaaaaagcagcgaagguaucaugggaagaagaggccgagcauucuggugcaagucauaacauccuaguagaaauccaggaugacggaacuaugaaaauuaaagacgaggagagagacgauacuaucacuauacuccucaaagcuacccuucuagcaaucagcggcguuuauccgaugucaauaccggcuacacuguuuguauggcauuucuggcagaagaagaaacaaagaaguggggugcuaugggauacaccaaguccgccugaaguagagaaagccgugcucgaugauggaauauaucguauucuacagagagggcuuuuaggacguucgcaaguggggguggguguuuuucaagaaggaguguuucauaccauguggcauguaaccagaggagcaguauuaauguaucaagggaaacgucuugaaccaucuugggccagugucaagaaagaccugauaucauauggagggggcuggagauuccagggaaguuggaacacaggagaggagguccaaguaauagccguugaacccggcaaaaaucccaaaaacgugcagaccgccccgggcacauucaagacgagcgaaggugaaguuggagcaauugcacuagacuucaaacccggaacaagugguucaccaauaguaaacagggaggguaagauuguaggauuauauggcaaugguguuguaacaacaucuggaacguauguaagugcuauagcacaagcaaaagcaagucaggaagguccuuuaccagagauagaagaugaaguuuucagaaaaagaaacuuaacgauaauggauuuacauccaggcuccgguaaaaccagacgauacuugccagcgauaguuagagaggcaaucaagcguaaguuaagaacuuuaguacucgcuccuacaagggugguugcauccgaaauggcagaggcuuuaaaaggaaugccuauaagguaucaaacaacagcgguaaaauccgaacacacagggaaagagauaguagacuuaaugugccacgcaacuuucaccaugagauuacuuaguccgguuagagugccaaacuauaauaugauaauaauggacgaggcacacuucacagaucccgcaucuauagcagcccgggguuacaucucaacgagaguaggaaugggcgaagcagcagcaauuuuuaugacagccacuccacccggaucuguagaggcauucccacaaaguaaugccguaauacaggaugaagagaaagauaucccugaacgguccuggaacuccggauaugauuggauuacagacuucccagggaagacuguaugguuuguuccaucgaucaaaucgggaaaugacaucgcaaauuguuuaaggaaaaaugggaaaagaguuauucaacuaagcaggaagaccuuugauacugaauaccaaaagacuaaaaacaacgacugggauuaugugguaacgacagauaucucagaaaugggugcaaauuucagggcugaccgaguaaucgacccgcgacguuguuugaaaccaguuauccuuaaggauggacccgaacgggucauacuagcgggaccuaugcccguuacaguagcgucagcagcacaacguagagguaggaucggccgaaaucaaaacaaagagggagaucaguacauuuacaugggacaaccacuaaauaacgacgaagaccacgcacacuggaccgaagcaaaaaugcuccuugacaauauaaauacacccgagggcauaauaccagcgcuauucgaaccggaaagagagaaaagcgcugcuauagauggugaauauagguugagaggggaagcacgaaaaaccuuuguugaacuaaugcggagaggcgaucugccaguguggcuaaguuacaaaguggcaagugaaggauuccaauacagcgacagacgauggugcuuugacggagaacguaauaaucaaguguuggaggaaaauauggauguagagaucuggacuaaagagggagaaaggaagaaauuaagacccagguggcuagaugcgcguacauauucagauccgcuagccuuaagagaguucaaagaauuugcagcggguagaagaucgguaucaagugaccuaauacuagaaaucggaaaauuaccgcagcaccugacgcagcgcgcucagaaugcacuagauaauuuaguuaugcuccauaauucagagcaaggaggaaaggcuuaucggcacgccauggaggagcuacccgauacuaucgagaccauaaugcuauuagcgcuaauugcaguauuaaccggcgggguuaccuuauucuuuuuaucgggcagagguuuagguaaaaccagcauuggacuacuaugcguaacauccaguagugcucucuuauggauggcuaaugucgaaccgcacuggauugcugcaaguauuaucuuggaguuuuucuuaaugguacuccuaauaccugaaccugacaggcagcgaaccccucaagacaaccaguuagccuauguaguaauaggccuucuuuucaugauuuuaacaguagcagccaacgaaaugggauuauuagaaacaacaaagaaagaccuagguauaggucauacggccgccgaaaaccaucaucaugcagcaaugcuagauguugauuuacauccugcauccgcauggacacuuuaugcugucgcaacaacgauaauuaccccgaugaugcggcauacaauugaaaauacaacugcuaauauaucguuaacugcaauagccaaccaggcugcaauucuaaugggauuggauaaaggguggccuauuucuaaaauggauauuggagugccacucuuagcguugggauguuauucacaaguaaacccccuuacuuuaacagcggcagucuugaugcuaguagcacauuaugcuauaauaggaccaggucuacaggcaaaagccacaagagaagcgcagaaaagaacugcggccgggaucaugaaaaacccgacaguugauggaauuguagcaauugauuuggauccuguugucuaugacgcaaaguucgaaaaacaacucggucaaauaauguuacuaaucuuguguacuucccaaauacuucucaugagaacaacuugggcuuugugugaaaguauaacguuggcaacaggaccucuaacaacccugugggaagggucgccggggaaauuuuggaauacuacaauagcugucucuauggcuaacauauucagagguucauacuuagccggugcagguuuagcuuucucccuuaugaaaucacuagguggugguagacgaggaacaggugcacaaggugaaacuuugggcgaaaaauggaaaagacaauuaaaucaacugucgaaaagugaguuuaacacguauaagagaagcggcauaauagaagucgacagaagugaagcaagggagggccucaaaagaggagaaacaacgaaacacgcaguaucaagaggcacugcaaaauugaggugguuugucgaacguaaucugguuaagccagaaggaaaagugauugaccugggaugugggcgugguggguggucauauuacugugccggacucaagaaaguaaccgagguuaaaggauauacuaagggcggacccggccacgaagaaccaauaccaauggcaacuuacgguuggaaccuaguaaaauuacauagcggaaaagacguauucuuuauacccccagaaaagugcgauacccuucugugugauauaggggagucuucaccuaaccccacgauagaagaaggaaggacauuacgaguacucaaaaugguagagccaugguugagggguaaucaauuuugcauaaaaauacucaacccguacaugccuucaguuguagaaacacuggaacaaaugcaaaggaaacacggaggaaugcuuguacgaaauccccuaucacguaacaguacucacgagauguacuggguaagcugugggacuggaaacauaguuuccgcggugaauaugacaaguagaaugcuacuaaacagauuuacaauggcacauagaaaaccgacauacgaacgugacgucgaucuaggugcggguacaaggcauguugcagucgaaccggaaguagccaaucuggacauuauagggcaaagaaucgaaaacaucaaaaacgaacacaaaucaacauggcacuaugaugaagauaacccauacaaaacgugggcauaccacgguaguuacgaaguuaagccuucuggaagcgcaucaucaauggucaauggagucguuagauuacugacuaaaccuugggauguuauuccgauggucacgcaaaucgcuaugacggacacaaccccauuuggucagcaaaggguauuuaaagaaaaaguagacacgcgcacgccgaaagcuaaacggggcacagcgcaaauaauggaaguuacagcaaaauggcucuggggguucuuaucucgaaauaagaaaccucgaaucuguacacgagaggaguucacuagaaaagucaggagcaaugcagcaauaggugcggucuucgucgaugaaaaccaguggaacucugcaaaggaagcagucgaagaugaaagguucugggacuuaguuagacgggaaagagaacugcauaagcaaggaaaaugcgccacaugcguauauaacaugauggggaaacgagagaagaaauuaggagaguuugguaaagcgaaggguagccgcgcaauaugguacauguggcuaggugcaagauucuuagaguucgaggcgcucggcuuuaugaaugaagaccauugguuuucaagagaaaacagccuaucuggaguggaaggugagggucuucacaaacuaggcuauauacuacgagauauaucaaagauaccaggagguaauauguacgcggacgauacugccggaugggacaccagaaucacugaggaggacuuacaaaaugaagcaaaaauaacagacauaauggagccagaacacgcccuacuggcaacaucaauuuuuaaauuaacauaccagaauaaaguuguuagaguucaacgcccggcuaaaaauggaacugugauggaugucauuaguagaagagaccaaagagguucaggacaagucgguacuuauggacuaaauacauucacgaauauggaggcacaacuaauccgacaaauggaaucagagggaauauucucuccaucagaauuggagacuccuaaccuagcuggcagaguacuagacuggcuggaaaaacauggaauugagcgacuacgacguauggcgauaaguggggaugacuguguaguaaagccgauagaugacagauuugccaccgcuuuaacggcucuaaaugauaugggaaaaguuagaaaagauauuccacaaugggagccaucaaaaggguggaacgacuggcaacaaguaccuuucugcucucaucacuuucaccaacucauuaugaaagacggaagagagauugucguuccaugucgcaaccaagaugaauuagugggcagagcaagaguuagccaaggugcgggauggucacugagagaaaccgcaugcuuaggcaagucuuaugcacaaauguggcaacuuauguacuuucacaggagagaccuacguuuggcggcuaacgcgauaugcucugcaguaccggucgauugggugccaacaucgcgaaccacguggucaauccaugcgcaucaucaguggaugacaacagaggauaugcucucaguuuggaacagaguuuggauugaggaaaauccauggauggaagauaaaacgcauguaucgucaugggaggacgucccauaccuaggaaagagagaagaccaguggugugguagccucauaggcuuaacagcacgcgcaacaugggcgacuaacauucaaguugccaucaaucaggugaggagguuaauaggaaacgaaaauuauuuggacuacaugacuagcaugaaaagauuuaaaaaugaaagugacccagaaggggcacugugguaa

SEQ ID NO: 22082 - RNA, 9879 nt, Artificial Sequence
  derived and/or modified CDS sequence (opt6) from DENV-1__JQ915073__SS-prME
ucagugacaaugcuacuuauguuacucccgacaguucucacauuccaucuaacaacacgugguggggaaccacacaugaucgucucuaaacaagaaagaggaaagagcuuauuauucaaaacaucugccggagugaacauguguacuuugauugcuauggaucuaggagaauuaugcgaugacaccaugacuuauaaauguccaagaauuacugagaccgaaccagacgaugucgauuguuggugcaaugcuacggaaacaugggugacauaugggacauguuuucaaacaggagagcaucggcgagauaaacgaagugucgcguuagccccucacguaggauuaggacuagaaacaagaacagaaaccuggaugucuucggaaggggcauggagacaaauacaaaaaguggaaacaugggcucuaagacacccggguuuuacugucauagccuuauucuuagcccacgcaauaggaacuucaauaacucaaaaaggaauuauauucauccuuuuaaugcuagugacaccaaguauggcaaugagaugcguuggcauaggaaauagagauuuuguugagggacuaucuggugcaacuuggguagauguaguccuagagcacggaucauguguuacuaccauggcuaaagauaaaccuacguuagauauugaguuacuuaaaacagaaguaacuaacccagcaguacuccguaaacuuugcauagaagccaaaauaucaaacacgacaaccgauagccgguguccaacucaaggugaggcgacucugguugaagaacaagacacuaauuuuguaugccgacguaccuuuguagauaggggcugggguaacggauguggauuguucgguaaaggaagucuuauaacuugugcuaaauuuaaaugugucacaaaacucgaaggaaaaauaguacaauaugaaaauuugaaauauucgguaauuguaacaguacauacaggagaucaacaucaaguuggaaaugaaacaacggaacaugguacuauagcaaccaucacuccacaagcgccuacuucagaaauacaauuaacggauuacggggcgcuuaccuuggauugcaguccaagaacuggccuagacuuuaaugaaaugguacuacuuacgaugaaagagaagucuugguugguacauaaacaaugguuuuuagaucuacccuuaccauggacgacaggagcaucgacaucacaagaaacuuggaacaggcaagaucuccuaguaacauucaaaaccgcacaugccaaaaagcaagaggugguugucuuaggaucacaagaaggugcaaugcauacugccuuaacuggagcaacagaaauacaaacaucagggacuacaacuauuuuugcaggccaucuaaagugucgauuaaaaauggauaaauuaacgcuaaaaggaauaaguuacgucaugugcacuggaaguuuuaaguuggaaaaagagguggcagaaacucaacacggaacgguacuuguucagguaaaauacgaaggaacagaugcuccguguaaaauaccauuuaguagucaagacgaaaaaggaguaacacagaacggaagacuuguaacagcgaauccuauaguaacagauaaagaaaaaccugugaacauagaagcggaaccaccguucggagagaguuauauuguugucggugcgggcgaaaaagccuuaaaguuaucgugguucaagaaaggaaguaguauaggcaaaauguucgaagcaacugcgcguggggcacgacgaauggcaauccuaggugauaccgcuugggauuucgguaguauaggcggcguauuuacgagugucggcaaacugguacaucaaaucuuugguaccgccuacggagugcuguuuucagguguaucauggacuaugaaaaucgguauuggaauacuucuuacauggcuugggcucaacucucgcagcacgucuuuguccaugacauguauagccgucggcaugguuacucuauaucucggcguaaugguacaagccgauucaggauguguaauaaacuggaaaggucgggaauuaaaauguggguccgguauauuuguaaccaacgagguacauacauggacagaacaauauaaguuccaggcagauuccccuaagagauuaagugcugcaauugguaaggcuugggaagaaggcguaugugggauaagaagcgcaacucggcuugaaaauauaauguggaagcagaucaguaacgaacuaaaucacauccuauuggagaacgauaugaaguuuacugucguagugggagauguaagugguauauuagcucaaggaaagaaaaccauccggccccaaccaauggaacacaaauacucuuggaaaucauggggaaaagcuaaaauaaucggugcagauguccaaaacacaacuuuuauuaucgacgguccaaauacacccgaauguccagaugaucaacgagccuggaauauaugggaaguagaagauuacggauuuggcaucuuuacuacaaauauuuggcugaagcuaagagacucguacacgcagguuugcgaucaccguuuaaugagcgcagcaauaaaagauucgaaggcuguucacgccgauaugggcuauuggauugaaagugagaaaaaugaaaccuggaaguuagcuagagcuucauuuauugaagugaaaacaugcguauggccuaaaagucacacguuguggagcaauggcguacuugagagugaaaugauuauaccgaaaauuuauggaggcccaauaucacaacauaacuacaggccagguuacuuuacccagacggccggaccuuggcauuuagguaaauuagaguuggacuuugacuuaugcgaagguacuacggucguaguagacgaacauuguggucaucgagggccauccuuacgaacaaccaccgugacggguaaaauuauacaugaguggugcuguagaaguugcacacugcccccauugagauuuaagggcgaagauggcuguugguacggaauggaaauacguccagugaaggaaaaagaagaaaaucuuguaaaaaguaugguauccgcgggaagcggcgaaguagauucauuuagccuuggauugcugugcauaaguauaaugauagaagaagugaugcgaucgagguggagucgaaaaaugcuaaugacgggaacucuuguagucuuccuuuuacuaaccuuaggccagcuaacguggaaugacuugauuagacuauguaucaugguuggugcaaaugccucggauaauauggguaugggaacaacuuaucuggcauuaauggcaacauuccgcaugcgccccauguucgcaguaggauuauuguucagacgauuaacaagcagagaggugcuauuauuaacuguaggacuuucuuuaguagccagcgucgaacucccuaauagucuagaugaguuaggagauggcuuggcuaugggaauuaugauuuuaaaguuauuaacagacuuccagucucaucaauugugggcaacccuucuaucguuaacuuuuguaaaaaccacacugucccuacacuaugcauggaaaaccauggcuaugauauuaucuauaguaucgcuuuuaccacuaugccuuuccaccacgucucagaaaacuacauggcuccccguacuguugggaagucuaggaugcaaaccacucacuauguuuuugaucacggaaaacaagaucuggggaagaaaaucuuggccgcuaaacgaagguauuauggcgguagguauagugucuauucuguuauccucucuccucaaaaacgacguaccauuagcuggaccuuuaauugcaggagguaugcuuauugccugcuacguaauaaguggcucaucagcagaucuaagucuugaaaaagcugcaaaaguuagcugggaggaggaagcagaacauucuggcgcgucccauaacauccugguagaaauccaagaugaugguacaaugaagaucaaagacgaggaaagggaugauacgauuacaauacuauuaaaagcuacacugcuagcuauaucagguguauauccuaugucgauacccgcuacauuauucguauggcauuuuuggcagaagaagaaacaacgaucugguguucucugggauacaccaucucccccugaaguagaaaaagcuguucuggaugauggaauuuaucggauuuuacaacgaggauuacuuggccgaucucaggugggagucggaguauuccaagaaggaguuuuucacaccauguggcacgugacucguggggccguccucauguaucaaggaaaacgucuggagccauccugggcuagcgugaagaaagaucuaauuuccuauggcggggguuggagauuucaaggaagcuggaauacuggugaagaagugcaagucauagcagucgaaccuggcaaaaaucccaaaaaugugcagacaaccccagggacauucaaaacuuccgaaggagaaguaggcgcaauagcccuugacuuuaagccaggaacaucaggaucaccaaucguuaauagagaaggaaagauaguaggauuauacggaaacggugucgucacaaccucaggaacauauguaucugcuauagcccaggcuaaagcaucucaggaaggaccuuuaccagaaauagaagacgaagucuuucguaaacgaaaucuaacuauaauggauuuacauccugguucgggcaaaacucgaagauaccugccagcuauaguaagagaagcuauaaaaagaaaauugagaacguuagugcuugcgccaacaagaguuguugcaagugaaauggcugaagcacuaaaagguaugcccauaagauaucaaacgaccgcgguaaaaagcgaacacacaggcaaggaaauaguugaucuuaugugucaugcuacguucacuaugcgauuguugagcccuguaagaguaccuaauuacaacaugauaaucauggaugaggcucauuucacugauccagcuucaauagcggcaagaggauauaucagcacuagaguaggcaugggggaagcagccgcuaucuuuaugacugccacaccuccugguucggccgaagcguucccacaaagcaacgcaguuauacaagaugaggagaaagacauaccagaaagaucguggaacuccggauaugauuggauaacagauuuuccagggaagacgguuugguuuguucccagcauaaagucagguaaugauauagccaacugucuacguaaaaacgggaaaagagugauacaacuuucucgaaaaacauuugacacugaguaucaaaagaccaaaaauaaugacugggauuacgugguuaccacugauaucagcgagaugggugcaaacuuccgggcggaucgugugauagaccccaggagguguuuaaaaccaguuauacugaaagauggaccagagagagucauucuagcaggaccaaugccgguuacaguagcgucagcagcgcaacgcaggggucgcauaggaagaaaccagaauaaagaaggugaucaauauauauauauggggcaaccuuugaauaaugacgaagaccaugcgcauuggacugaagcuaaaaugcuauuggauaacaucaauacacccgaaggaaucauuccugcccuuuuugaaccagaacgcgagaaaucagccgcuauugauggcgaauaccgucugcguggagaagccagaaaaacguucguagaacuuaugagacgcggcgaccuacccguauggcuaagcuacaagguagccuccgagggauuccaauacagcgaucguagguggugcuucgauggagagcgaaacaaccaaguguuagaagaaaauauggacguugagauauggacuaaagaaggagaaaggaagaaauuacgaccaagauggcuagaugcccguacuuauagcgacccacuagcuuuaagagaauuuaaagaauuugccgcgggucgaaggaguguaucgggcgauuuaauccuugaaauaggcaaauuaccccaacauuuaacgcaaagagcacaaaacgcuuuagacaauuuaguuauguuacacaauucugagcaaggaggaaaggcuuaccgacacgccauggaagaauuaccugacacgauagaaaccauaaugcuacucgcuuuaauagccgugcucaccggaggcguuacccuauucuuucucaguggcagaggacuaggaaagacaagcauuggccuacugugcguaacuucaaguagcgcacuguuauggauggcgaguguugaaccccauuggauagcagcaucaauaauacuggaauuuuuccuuaugguacuauugauaccugaaccggaccgacaaagaacaccacaggacaaccaacuggcauauguugucauuggauuauuauuuaugauacucacuguugcagcaaaugaaaugggacuacuagaaacaacaaagaaggaucuggguauaggccauacggccgccgaaaaucaccaccaugccgcaaugcuagacguugauuuacaucccgcaucagcuuggacucuauaugcaguugcuacaaccauaaucacuccuaugaugaggcauaccauagagaacacuacagcaaauauaagccuuacagcaauugcuaaucaagcagcgauacuaaugggguuagauaagggauggccuauauccaaaauggacauuggaguaccacuucuagcacuaggguguuacucacaaguuaauccguuaacuuuaacagcagccguucuuaugcuaguagcacauuacgcaauaauagguccuggacugcaagccaaagccacaagagaagcccagaaaagaacugcggcaggcaucaugaaaaacccaaccguagauggaauaguggcuauagaucuugauccaguaguauaugaugcuaaauuugaaaagcaauuaggucaaauaaugcuacuaauauuaugcacaucucaaauacuuuuaaugcggacgacuugggcgcuuugcgagagcaucacguuggcgaccggcccucuuacaacuuugugggaaggauccccuggcaaauucuggaacacuacuauagccguaucaauggccaauauauuuagaggaucauauuuagcuggugccggucuagcuuuuucacuaaugaaaagucuaggagggggacgacgagggacaggagcucaaggugaaacccuuggagaaaaguggaagcgacaauuaaaucaguugaguaaaucugaguucaauacauauaaaagaucaggaaucauugaaguugauagaucggaagcgaaagaaggacuaaaaagaggagaaacaacaaagcaugcuguuucacgcggaacagcuaaguuaagaugguuuguagaaagaaauuuagucaaaccagaaggaaaagucauagaccugggauguggaagaggaggauggucauauuacugugcaggacugaagaaaguuaccgaaguuaaaggauauacuaagggugguccgggucacgaagaaccaauuccuauggcuacuuauggauggaaccuuguaaaauugcacucugguaaagauguauucuuuauuccaccugaaaaaugcgacacguuguuaugcgacauuggagagagcuccccaaacccaacgauugaggagggacgcacccuaagaguccuaaaaaugguugaacccuggcucaggggaaaucaauuuuguauuaagauauuaaaccccuauaugccuuccgucguagagaccuuggaacagaugcaaagaaagcauggcggaaugcuugugagaaacccuuuaucucgaaauucgacucaugaaauguauuggguaaguugugggaccgguaacauaguaagugcuguaaauaugaccucuagaaugcucuuaaauagauucacuauggcacauaggaaaccuacuuaugagcgcgacguagacuuaggcgcuggaacucgccauguagcaguugaaccggaagucgcuaacuuagauauuauuggucaaagaauugaaaauauuaaaaacgaacauaaaagcacuuggcauuacgacgaagacaauccuuauaaaacgugggccuaucaugguucauacgaaguaaagcccucgggcucagcauccucaauggugaauggggucguaagacuccuuacaaagccaugggaugugauuccaauggugacacaaauugcgaugacagacacuacaccuuucggacaacagagaguguucaaagaaaaaguugauacgaggacaccuaaagcuaaacguggcacagcccaaaucauggaaguaacagcaaaauggcuuuggggauuuuuauccaggaauaagaaaccacgaauauguacaagggaagaguucacgcguaagguaaggagcaaugcggcuaucggcgcuguuuucgucgaugaaaaucaauggaacagugccaaggaagcaguagaagaugaaagauucugggaccugguaagacgggaacgcgaguugcauaaacaaggaaaaugugcuacaugcguuuauaacaugaugggaaaacgagaaaagaaauuaggagaguuugguaaggccaaaggaagucgagccauuugguauaugugguuaggugcaagguuccuggaguucgaagcguuggguuuuaugaacgaggaccauugguuuuccagagagaacucacuaagugggguugagggagaagggcuccauaaauugggauacaucuuacgcgauaucucuaagauaccuggagggaauauguacgcagacgauacagcaggcugggacacacgaaucacugaagaagacuugcaaaaugaagcaaaaauuacugauauuauggaaccugaacaugccuuauuagccacgucgauauuuaaacuaacuuaccaaaauaaaguugugagaguacaacggccagccaaaaacgguacaguuauggacguuauaucgaggcgagaucaaagggggucaggucaaguuggaacauacggccuaaacacuuucaccaacauggaagcccaacugauacggcaaauggaauccgaaggaauauuuucaccuagcgaauuagaaacuccuaaccuugcaggacgaguuuuagacugguuagaaaaacacgguauugaaagauuacgacggauggcaauuaguggagaugacuguguaguuaagccuauugaugaucgauuugcuaccgcccuuacggcauuaaacgauaugggaaaaguacgaaaggauauaccucaaugggaaccuucuaaagguuggaacgacuggcaacagguaccauucugcucacaccauuuccaucaacuuauuaugaaagacggacgagagauagugguaccaugucggaaccaagacgaauuagugggucgggcgcguguaucucaaggugccgggugguccuugagagaaaccgcuuguuuaggcaagaguuacgcacaaauguggcaacucauguacuuucacaggcgcgaccuccgccucgcggcaaacgcaauaugcagugcggugccaguggauuggguuccgacuucucguacaacguggagcauacaugcucaccaccaauggaugacuacggaagauaugcucucgguauggaacagaguguggauugaagagaauccauggauggaagacaagacccauguauccucaugggaagaugucccauauuuagggaaaagggaagaccaauggugcgggagucuaaucggucuaacugcgagagcaacgugggcuacaaauauccaaguagcgauaaaccagguacgacgauugaucggcaacgaaaauuaccuggacuauaugacguccaugaagagauuuaagaaugagucagauccugagggugcguuaugguaa

SEQ ID NO: 22083 - RNA, 9879 nt, Artificial Sequence
  derived and/or modified CDS sequence (opt6) from DENV-1__JQ915075__SS-prME
ucgguaacgaugcuacuaauguuacugccuacaguuuuaacuuuucauuuaacuacuagagggggagaaccacauaugauaguguccaaacaagaacgaggaaaaucacuguuguucaaaacuucugcuggggugaauaugugcacacugauagcuauggaucuuggagaacugugugaugacacgaugacauauaaaugcccuagaauaacagaaacagaaccggaugaugucgacugcugguguaaugcaacagaaacaugggucacguaugguacuuguucacaaaccggugaacauagacgcgacaaaagguccguagcucuugcaccccauguaggucuugguuuagaaacuaggacagaaacauggaugucauccgaaggggcguggcgccaaauucaaaaaguugaaaccugggcuuuacgacaucccggguucacaguuauagcauuauuccuggcacacgcaauaggcacaaguaucacccaaaaagguauaauauucauuuugcuaauguugguuacuccaucuauggcuaugcgauguguaggcauugggaauagagacuucguagaaggguugagcggagcaacaugggucgauguaguucucgaacaugguaguugcguuacaacaauggcaaaagauaaaccaacuuuagauauugaguuacuuaaaacugaaguaacaaauccagcagucuuaagaaaacuaugcauagaggcgaaaauaaguaauacaacaacagacucgcgauguccuacccaaggagaagcaacguugguugaagaacaagacacuaauuucguaugucgucguacauucguugacaggggcuggggcaacggauguggauuauuuggaaaagguucguuaauuacuugugcaaaauuuaaaugcgcaacuaaauuagaagguaaaauuguucaauacgagaauuuaaaauauucugucauaguaacuguucacacaggggaucaacaccaaguaggaaaugaaacaacggagcaugguacaauugcuacgaucaccccacaagcaccuaccucggaaauacaacuaacagauuauggugcccuuacauuggacugcucaccuagaaccggacucgauuuuaaugaaauggucuuauuaacuaugaaagaaaaaucuugguuaguacauaaacaaugguuucuugacuuacccuuaccauggacaacaggcgccucaacaagccaggaaacguggaacagacaagauuuguuagugacauuuaaaacugcacaugcaaagaaacaagaagucguaguuuugggaucgcaggaaggagcuaugcauaccgcauuaacuggagcuacagaaauccaaacgaguggaacuacaacuauuuucgccggacaccuaaaaugcaggcuuaaaauggacaaauuaacauuaaaagguauaaguuacgucauguguacgggcucuuuuaaacuagaaaaagaaguugcagaaacacaacauggcacuguauuaguucaaguaaaauaugaaggaacugaugcaccauguaaaauaccuuuuaguagccaagaugaaaaagggguaacacaaaauggaagguuaguaaccgcaaacccaauagucaccgauaaagagagaccuguaaauauagaagcugaaccaccauucggcgaaucauacauaguggugggugccggugaaaaagccuuaaaauuauccugguucaagaaaggaaguagcauaggcaaaauguuugaagcaacugccagaggagcaagacguauggcgauuuuaggagauacagcaugggacuuugguucaauaggaggggucuuuacaucuguuggcaaacugguacaccaaauuuucggcacagcuuacggaguucuauuuuccggugugucguggacgaugaaaaucgggaucggaauauuacuuaccugguuaggauugaauagucgauccacaucguuaucaaugacaugcauagcuguuggcaugguuacccucuaccucgggguaauggugcaagcagauagcgguugcguuaucaacuggaaaggcagggaauuaaaaugcggaaguggaauauuuguaaccaacgaaguccacacguggacagaacaguauaaauuucaagcugacagcccgaaacggcuauccgcagcuaucgggaaggcuugggaagaaggaguuugcggaauaagaucagccacccgucucgaaaacaucauguggaaacagauuucgaaugaauuaaaccauauuuuauuggaaaaugauaugaaauuuacggugguugucggagauguaaguggaauauuagcgcaagggaaaaagacgauccguccucaaccaauggaacacaaauauaguuggaaaucuugggguaaagcaaagauaauaggggcagauguucaaaauacaaccuuuauaauagacggcccuaacacuccagaauguccggacgaucaacgagcauggaauauuugggaagucgaggacuauggauuugggauuuuuacuacaaauauuuggcuuaaauugagagauucguacacccaagugugugaucacagacuaaugucagcggcaauuaaagauuccaaggccguacacgcagacaugggauauuggauagaaagcgagaaaaaugaaacauggaaacuagcacgggcgucuuuuauagaaguaaaaacguguguuuggcccaaaucacauacuuuauggucgaaugggguucuggaaagcgaaaugaucauaccgaagauauacggugguccaauuucacaacacaauuaccgucccggauacuuuacacagacagcaggaccuuggcacuuaggaaaauuggaacuagauuuugacuuaugugaggggacgacaguaguuguagaugaacauuguggaaaucgagguccuucgcugagaacaaccacuguuacgggcaagauuauucaugaauggugcugccguuccuguacacuaccaccccuucgcuuuaagggagaagacggcuguugguacgguauggaaauuaggcccguaaaagagaaagaagagaaccuaguaaaaagcaugguuucagccggcucgggugaagucgacucauuuuccuugggucuuuuguguauauccauaaugauagaagaaguuaugcggucaagguggaguagaaaaauguugaugacagguacgcuagucguauuuuuacucuugaccuuaggccaacuaacuuggaacgaccuaauucgucuuuguauuaugguuggagcaaaugcauccgauaauauggggaugggaacuacguaucuagcauuaauggcaacguucagaaugcgucccauguuugcuguuggacugcuauuccggagauugacaucacgcgagguauugcuucugacaguuggauuaagccuaguugcaucaguagaacugccaaauagucucgaugagcuaggugauggccuugcuaugggaauaaugauuuuaaaauuacuaacugauuuccaaucacaucaguuaugggcaacacuuuuaucgcucaccuucgugaaaacuacauuaucacuacauuacgcauggaaaacuauggcgaugauccuauccauaguaucacuguucccacuuugccugaguacuaccucgcagaaaacaacauggcuacccguacuuuuagguucguuggguuguaaaccacuaacaauguuucucauaacugaaaauaagauaugggggcguaaaucauggccauugaaugaaggaauuauggcuguugguauagugaguauucuuuuauccucacugcucaaaaaugacguuccguuagccggcccacuuauagcuggggguaugcuuauugcuuguuaugugauaagugguaguuccgccgacuugagucuugaaaaagcagcgaaaguuaguugggaagaagaggcagaacauagcggugcuucacacaacauauuaguagaaauacaggaugaugguacgaugaaaauaaaagaugaagaaagagacgauacaaucacaauucuacuuaaagcgacucuacuagccauuuccgguguauaucccaugucgauaccagcgacuuuauucguuuggcauuucuggcagaagaagaaacaaagaucgggaguucuuugggacaccccuucaccaccagaaguagaaaaagcgguauuagacgacggaauauaccgaauauuacagcgugggcuacucggucguucacaaguuggaguaggagucuuucaagaaggagucuuucauaccauguggcacguaacgcgaggugcugugcuaauguaucaagguaaaagacuggaaccgagcugggcaucuguaaagaaagaucuaauaagcuauggugggggcuggcgcuuucaaggcucuuggaacacgggugaagaaguucagguuauagcuguagagccaggcaaaaauccuaaaaaugugcaaacugccccgggcaucuuuaaaaccagugaaggggaagucggagccauugcuuuagauuuuaaaccagggacuucuggaagcccgaucguuaaucgagaagguaaaauaguugggcuuuaugggaauggagucgucacaacgucaggaacauacguuagugcaaucgcccaagccaaagcaucucaggaagguccguuaccugaaauagaagaugaaguauuuagaaaaagaaacuuaacaauuauggaccuccauccuggguccggaaaaacucgaagguauuuaccagcaauuguucgcgaagccauaaaaagaaaacuacgcacuuugguauuggcucccacuagaguuguagccagugaaauggccgaagcccuuaagggaaugccaauacgcuaucagaccacugcagucaaaagcgaacauacugguaaagaaauaguggaucuuaugugucaugcuacauucaccaugaggcuauugucaccugugagaguuccaaacuauaacaugauaauaauggaugaagcacauuuuaccgaccccgcaucgauagcugcgagaggauauauauccacaagagucggcaugggugaagcagcggccauuuuuaugacugccacuccgccugguagcguagaagcguuuccccaaaguaaugcaguuauucaggacgaagagaaagauauuccagaaagaucuuggaacucuggauacgauuggaucacagauuuuccaggaaaaacagugugguuuguaccaaguauuaaaagcggaaaugauauagccaauugcuugaggaaaaauggaaaacguguuauccaauugucccgcaaaacuuucgauacugaauaucagaaaaccaaaaauaacgacugggacuaugugguaacgacggacaucucagaaaugggggccaauuuuagggcagacagagucauagauccacgccgguguuuaaaaccgguuauauuaaaagacggaccugagagagugauauuagcugguccaaugccagugacuguagcuucagcagcccaaagaaggggucgaauaggacgcaaucaaaauaaggaaggagaucaauacaucuauaugggacaaccacucaauaaugaugaggaccaugcacauuggacugaagcuaaaauguuacuugauaacauuaauacuccggaagggaucauuccugcauuauuugaacccgagcgagaaaagucagcugcuauugacggagaauauagacuucgcggggaggccagaaaaacuuuugucgagcuuaugcguagaggggaccucccaguuuggcuaucuuacaaaguagcaucagaaggcuuccaauauucggacaggagguggugcuuugauggagaacgcaauaaccaaguccuugaggaaaacauggacguagaaauauggacaaaggaaggcgaaaggaagaaacuuagaccuaggugguuagaugcucguacuuauagugauccacuagcacuuagggaguuuaaggaguuugcagcugguaggcgaucuguaagcucggauuuaauacuugagauuggaaaguuaccacaacauuuaacacaaagagcccaaaacgcacuagacaaucuaguuauguuacauaauuccgagcaggguggaaaggccuaccgucaugcuauggaggaguugccggauacuauugagaccauuaugcuauuagcucuuauugccguuuuaacagggggagucacccuauucuuucugaguggaagaggccuugggaaaacgaguauuggguuacuauguguuacuucgucuucagcuuuacuauggauggcaaauguagaaccccauuggauagcagcaucaauuauuuuggaguucuuucuuaugguauuguuaauaccggaaccugaucggcaaagaacaccacaggauaaucaacuggccuaugucguaaucgguuuacucuuuaugauucuaacgguggcagcgaaugaaauggguuuacuugaaacaaccaagaaagauuuaggaauuggucauacagcagccgaaaaccaucaucaugcugccauguuagaugucgaucuacauccugcuucagccuggaccuuauacgcuguggcgacaacaaucauuacccccaugaugcgucauacuauagaaaauaccacggccaauauaucucuaacugcaauggcaaaucaggcugcuaucuuaaugggcuuagacaagggcuggccaauaaguaaaauggauaucggggugccucuuuuggcucuaggauguuauucucaaguaaauccgcugacgcugacagcagcaguuuugauguuaguugcacauuaugcaaucauagguccgggccuccaagcaaaagcgacgcgugaagcacaaaaacggacagcugcugguaucaugaaaaauccaacaguagacggaauuguagcgauagaccuggauccaguuguuuaugaugcuaaauuugaaaaacaauuggggcaaauuauguuacuuaucuuauguacaagccaaaucuuguuaaugaggacaacuugggcacuaugugaaucaauaacuuuagcaacgggacccuuaaccacgcuaugggaagggucuccuggcaaguucuggaauacuacaaucgcagugucuauggcuaacauuuuuagaggaaguuaucuagccggagcagggcuagcguuuucucuuaugaaaucacuggguggugggagaagaggaaccggagcucaaggcgaaacacuaggggaaaaauggaaaaggcaauugaaccaacuuucaaaaucugaauuuaauaccuacaaaagaucggguauaauagaagucgaucgcucugaagcucgugaaggucuaaaacgaggcgaaacuacaaaacaugcagucagccgagguacagcgaaacuaagaugguuuguagaaagaaaccuaguuaagccagaagggaaagucauagaccuuggcugugguaggggcggcuggaguuauuacugugcugggcucaagaaaguuacggaggugaaaggguauacaaaaggaggaccggggcacgaagaaccuaucccgauggcuacauacgguuggaauuuaguuaaacuccacuccgggaaagauguguucuucauaccuccugaaaaaugugacacauuauuaugugauaucggagaaaguucuccaaauccgacaaucgaagaaggacggacacuccgaguacugaaaaugguagagccaugguugcgaggcaaucaguucugcaucaagauccuuaaucccuacaugccgaguguagucgaaacauuggagcaaaugcagcgcaaacauggugguauguuaguuaggaacccuuugagcaggaacucaacgcaugagauguauuggguaagcuguggaacaggaaacaucguaucagccguuaacaugacaagccggauguuauuaaauagauuuaccauggcgcaccgaaaaccuaccuaugaaagagacgucgaucugggcgcagguacgagacauguagcuguagaaccggagguugccaaucuugauauuaucggacaaaggauugaaaacaucaaaaaugaacauaaaagcacuuggcacuacgacgaagauaaccccuauaaaacaugggcauaccauggaaguuacgaaguaaagccaucgggaucggcgagcaguaugguaaacggcguaguucgguuacuuacaaaaccuugggacguaauaccaaugguaacacaaauagcgaugaccgauacaaccccuuuuggacaacaaaggguauuuaaggaaaaaguagauacccgaacaccuaaagcgaaaagagguaccgcacagaucauggaaguuacggcuaaaugguuauggggauuuuugaguagaaacaagaaaccgcguauuugcacacgugaggaguucacuagaaaagugaggagcaaugcugccauuggggcuguuuuuguugacgagaaccaauggaacucugcaaaagaagcaguggaagaugaaagguuuugggacuuggugaggagggaacgagaacuccacaagcagggaaagugcgcgacuugcguauauaacaugaugggaaaaagggagaaaaaguuaggcgaguuugguaaagcaaaaggcagccgugcaauuugguauauguggcuuggcgcaagauucuuagaguucgaagcacuaggcuuuaugaaugaggaucacugguuuucacgggaaaacagcuuaagcggaguggagggagaggguuuacauaagcuaggauacauacugagagauaucucgaaaauaccaggaggaaacauguaugcugacgacacugcuggaugggacacucgcauaacggaagaggacuuacagaacgaggcgaaaauuacagauauuauggaaccugaacaugcauuguuggcgacaaguauauucaaacuuaccuaccaaaauaaaguggugaggguucaaaggccagcuaagaacggaacaguaauggauguaauaucaagacgagaccaaagaggaucaggacaagugggaacuuauggucuaaauacuuuuacaaacauggaggcucaauugauuaggcaaauggagucagagggaauuuuuaguccaagugagcuagagacgccaaauuuagcuggaagaguguuagacugguuagagaaacauggaauagaacggcuacggagaauggcuauaucgggagaugauugcguaguaaaaccuauugaugaucgauuugcgacugcacucacugcguuaaaugauaugggaaaaguaaggaaagauauaccccaaugggaaccgaguaaaggguggaaugauuggcaacagguaccauucugcucucaucauuuucaccaauuaaucaugaaagauggucgagaaauuguaguacccugucgcaaccaagaugagcuuguuggacgugcaagaguaagucaaggugcugguuggucguugagggaaaccgcguguuuggguaaaagcuaugcucaaauguggcaguuaauguacuuccaucguagggacuuacgucuugcagcuaacgcgaucugcagugcggugccaguagauuggguaccgacuucaagaacaacauggucaauacaugcgcaucaucaguggaugacuaccgaagacauguuaucuguuuggaaucguguuuggauagaggaaaacccuuggauggaagauaaaacucacguaucaucaugggaagauguaccuuauuuagggaaaagagaagaucaauggugcggcagccuaauagggcuuacggcacgcgcaacuugggcgacuaauauccaagucgcuaucaaucaaguaagacguuuaauaggcaaugaaaauuacuuagauuauaugaccuccaugaaaagauuuaaaaacgagagugacccagagggugcgcuaugguag

SEQ ID NO: 22084 - RNA, 9879 nt, Artificial Sequence
  derived and/or modified CDS sequence (opt6) from DENV-1__JQ915076__SS-prME
agugucacaaugcuacucauguuauugcccacuguucugacuuuucaucuuacaacucgaggaggggaaccgcauaugauagucucaaaacaagagagagggaaaagucuauuauuuaaaacgucagcaggggucaauauguguacgcucauagcuauggaccuuggugaacucugugaugacacaaugacuuacaaaugccccagaaucacugaaacagaacccgaugacguugacuguugguguaaugcuacagaaacgugggugacauauggcacuuguagucaaacaggggagcauaggagagauaaaagaaguguggcauuggcaccccauguagggcuaggucuagagacucgaacagaaacguggaugucauccgaaggagcauggagacaaauacaaaaaguggaaacaugggcccucagacauccaggguuuacuguaauagcguuauuuuuggcacaugccauuggaacgagcaucacgcaaaaagggaucaucuuuauuuuacugaugcuuguaacaccaucgauggccaugcgcuguguaggaauaggaaauagagauuucguagagggacugucuggagcgacauggguagaugucguauuagaacauggcucauguguuacgacaauggcaaaagauaagccaacacucgauauugagcuauuaaaaacagaaguaacgaaucccgcuguccuaagaaaauuauguauugaagcgaagauuuccaauacaaccacggacucaaggugcccuacucaaggggaagcaacccuagucgaggaacaggacaccaauuuuguauguagacgcaccuuuguagaucggggcugggguaauggaugcgggcuguuuggcaaaggcucguuaauuacuugcgcgaaauuuaaauguguaacuaaacucgagggaaaaaucguacaauaugaaaaccugaaauacaguguaauuguaacaguacauacuggagaccaacaucaagucgguaaugagacuacggaacauggcacuauagccacaauuacgccucaagcgccgacaucagaaauucaacugacggauuauggugcgcuuacgcuugacugcuccccaagaacaggucuugauuuuaacgagaugguucuccuaacaaugaaggagaaaagcuggcucguacauaaacaaugguuuuuagauuuaccacuucccuggacgaccggagcuagcacaucucaggaaacguggaauagacaagaccuguuagugacauuuaaaacagcacaugcaaagaaacaagaaguuguugucuuaggaagucaggagggagcaaugcauacggcguuaacaggugcuacagagauacaaacgucgggaacaacaacuauauucgcagggcaccuuaagugccgacugaaaauggacaagcugacucugaaaggaauguccuauguaaugugcaccggaucauuuaaguuagaaaaggaggucgcagaaacacagcauggcacuguguuagugcaagugaaauaugaagguacagacgcacccugcaaaauaccauuuagcucacaagacgaaaaaggcguaacgcaaaacgggagacucgucacagccaauccaauuguaaccgacaaagaaaagccaguuaacauagaagcagagccacccuuuggugaaucauauauuguaguaggagcuggcgaaaaggcauuaaaacuauccugguuuaagaaaggcucaucuaucgguaaaauguucgaagcaacugcgagaggagcgaggagaauggcaauucucggggauaccgccugggauuucgguucaauuggagggguguuuacaucugucggaaaacuugugcaccaaauauucgggacugccuacgggguuuuguuuagugguguuaguuggacaaugaaaauuggaauagguauucuucuaacguggcuuggucuaaauucacguucuacgucauuaaguaugacauguauugcgguuggaaugguuacacuauauuuagggguaauggugcaagcagacucaggcugcguaauaaauuggaaaggacgagaacuuaaguguggauccgguauauucgugacuaaugaaguccauacauggacggaacaguauaaguuucaggccgauucaccgaaacgacuuucagcugcaauuggaaaggcaugggaagaaggcguaugugggauucgaucugcaacaagauuagaaaauaucauguggaagcaaauuaguaaugaacuaaaucauauacuacuagaaaaugacaugaaguuuaccguaguugugggcgauguaucggguauuuuggcacaaggcaagaaaacaauccguccucagccaauggaacacaaauacaguuggaaaaguuggggcaaagccaaaauaauaggagccgauguccaaaauacgaccuuuauuauugacgguccgaacacgcccgaauguccagaugaccagcgcgcauggaacauaugggaaguagaagauuacggcuuugggauauucacaacaaacauaugguugaaauuaagagacagcuauacacaagugugugaucaucgucuaaugucagcagcuaucaaagauucuaaggcuguucaugcugauauggguuauuggauugaaagcgagaaaaaugaaacauggaagcuggcuagagcgagcuucauagaaguaaagacauguguauggccaaaaucucauacacuuugguccaauggaguauuagaguccgaaaugaucauaccuaagauauacggagggccuauuagucaacacaacuaucgaccaggauacuucacacaaacggcaggcccguggcauuuagguaaguuagaacuugacuucgauuuaugugaaggaacaacuguaguaguagacgaacacuguggacacagagggccaucacuaagaaccaccacugugacagguaagauuauacaugaauggugcugucgaaguuguacacugccaccauuaagauucaagggggaggacggcuguugguacggaauggaaauacgaccaguuaaagagaaggaagaaaauuuaguaaaaucuaugguaucagcaggauccggugaaguagacucguucagcuuagguuuauuauguauuucaaucaugauugaggaaguaaugcgcucucgguggaguaggaaaaugcuaaugaccggaacacuugucguauucuuacucuuaaccuuggggcaauuaacuuggaaugauuugauucguuuaugcaucaugguuggagcuaaugcuucugacaacauggguaugggcaccaccuacuuagccuugauggcuacauuccgaaugagacccauguucgcagucggacucuuguuucgacgauugacaaguagagaaguucuacuauugacugugggauuaucacugguagcaucagucgaacuuccuaauucccuggaugaacuuggagacgguuuagcaaugggaauaaugauccucaaauuguugacugauuuccaaucacaccaacuaugggccacuuuacuuucgcucacauuuguaaaaacaacacuaagccuacacuaugccuggaaaacuauggcgaugaucuugucaauugugagccuucuuccccucuguuugucuacaacuucacagaaaacaacaugguuaccuguauuacuggggaguuugggguguaaaccuuuaacgauguuuuugauuacagaaaacaaaauauggggacgaaagucauggccacuuaacgagggcauuauggcuguagggaucgucucgauacuucucaguucccuacucaagaacgacguaccucuagcaggaccguuaauagcuggcgggaugcuaaucgccugcuacgucaucuccggcaguagugccgaccuaagucuagagaaagcggcgaaggugucuugggaagaagaagcagagcacucaggagcaucucacaauauccuagucgaaauacaagaugaugggacgaugaagauaaaagaugaagaacgggacgacacgauaacaauucuuuuaaaagcaacacuccuagcaaucagcggaguauauccgaugucaauaccugccacgcucuuugucuggcauuuuuggcagaagaagaaacagagguccgguguccugugggauacuccaucaccacccgaagucgaaaaagcuguacuagacgaugguaucuauagaauacuacagagagguuuauuaggucgcucccaaguuggugucggcguguuucaagagggcguauuucauacuauguggcacguuaccagaggagcaguauuaauguaccaaggaaaacgucucgaaccaagcugggcuucuguaaagaaagacuuaauaucguacggagggggcuggagauuccaaggaucguggaauacaggagaagaaguucaagugaucgcaguugaaccaggcaaaaauccgaagaacgugcagacggcacccggaacauuuaaaacuuccgaaggugaagucggugcuaucgcccuugacuucaagccgggaacuucaggaagcccaauuguaaacagagaagguaagauaguaggguuauacggaaacggaguaguaacaacgagcggaaccuacgugucggcaauugcucaagcaaaaacaagccaagaaggaccucuucccgagauagaagacgaaguauuccgaaaacguaauuuaacaauaauggauuuacauccagguucggggaagacaagaagguaucuucccgcuauaguacgcgaagcgaucaaacgaaagcuaagaacguuagugcuagcuccuacuagaguagucgccucagagauggcagaagccuuaaaagggaugccaaucagauaccaaacaaccgcaguaaaaagugaacacacggggaaagaaauaguagaucuaaugugccacgcaaccuucacaaugagauuguuaagcccuguaaggguucccaauuacaauaugauuauuauggaugaagcacacuucaccgaccccgcaucgauugcagcaagggguuacaucaguacaaggguugguaugggcgaagcugcugcuauauuuaugacugcaacaccacccggcucgguagaagcauuuccccaauccaaugcugucauacaagaugaagaaaaggauauacccgaacgaaguuggaauagcggauaugauuggauuaccgauuucccaggaaaaacuguuugguuuguaccuaguauaaaguccgguaaugauauagccaacugucucaggaaaaacggcaaaagaguuauucaguuaucgcgaaagacguuugacacugaauaucagaaaaccaaaaauaacgacugggauuaugugguaacuacugauaucuccgaaaugggagccaacuuucgugcugacagaguuauagauccaaggagauguuugaaaccaguuauauuaaaagauggaccagaaagaguuauauuagccggaccuaugccaguuacgguagcaagcgcagcccagaggcgaggaagaauagggaggaaucagaacaaggaaggagaccaguacguguauaugggacaaccacuaaacaacgaugaggaucaugcucauuggaccgaagcgaaaaugcugcuggauaauauaaauacgcccgaaggaaucaucccugcuuuauuugaaccugaacgagaaaaaucagcugcaauugacggcgaauacagauuacguggugaagcuagaaaaaccuucguagaauuaaugcgccguggagaucucccaguaugguuaaguuauaaaguugcauccgaagguuuucaauauucugaucguagguggugcuuugacggagaaaggaacaaucaaguuuuagaagagaacauggauguagaaauuuggaccaaagagggagaaagaaagaaacuacggccccgauggcucgacgccagaaccuauagugauccuuuagcgcuaagagaauuuaaagaauuugcggcggggagacgaucuguaaguggagauuuaauauuggagauagguaaauuaccucagcaccuaacucaaagagcccaaaaugcccuagauaaucuaguaauguuacauaauucagaacaaggagguaaagcauaccggcaugcaauggaagaacuaccagauacuauagaaaccaucaugcuauuagcacuuauagcuguacugacuggaggcguuacauuauucuuucuaucagggcgaggacucgguaaaaccucaaucggacuucuaugcguaacgaguucaagugcacucuuauggauggcauccguggaaccccauuggauagcagcaaguaucauccucgaguucuuuuuaaugguguuguuaaucccagaaccagaucgacaaaggaccccacaagauaaccagcuagcuuauguuguaauuggguuacuauucaugauuuuaacuguagcugccaacgaaaugggacuacuugaaacaaccaagaaagauuugggaauaggccacacagcugcggagaaccaccaucaugcggcaauguuagauguagaucuacauccagcuagcgcguggacucuauaugcaguagcgacuacaauaauaacacccaugaugagacacaccauagaaaacacuacagcaaauauuucuuugaccgccauagccaaucaagccgcaauccuaaugggccuugauaaagguuggccaauuucaaagauggauauaggcgugccccuucucgcacuagguugcuacucccaaguaaauccgcuaacccuaaccgcagcgguuuuaaugcuaguagcccauuaugccaucauaggaccuggucugcaagcaaaggcaacgagagaagcccaaaaacguacagcggcaggaauaaugaaaaacccaacaguggacggaauagucgcuauagaucuugauccaguaguauacgacgcaaaguuugaaaaacaauugggucagauuauguugcuaauuuuguguacaagucaaauuuugcuaaugagaacuacuugggcguugugugagaguauuacauuggcgaccggaccacuaacaacuuuaugggaggggucgccgggaaaauuuuggaauacaacaauagcggucucuauggcaaauaucuuuaggggaucauaccuagcgggggcaggacuagcguucagucuaaugaaaucuuuaggaggcgguaggaggggcacaggggcucaaggggaaacuuugggugaaaaguggaagcgucaauugaaccaguuaagcaaaagugaauuuaacauuuacaagaggagugggauaauugagguagacagaucggaagcuaaagaaggauuaaaaagaggugaaacaacaaaacaugcuguuagucgaggcacagccaaacuacggugguuuguagaaaggaacuuaguaaaaccugagggcaaaguaauugaucucggcugcgggcgcggagguuggaguuacuauugcgcaggacuaaagaaaguuacugaaguaaaagguuauacaaaaggaggcccuggucacgaagaaccuaucccuauggcuacuuauggauggaaccugguaaaacuacauuccggaaaagaugucuucuuuauaccuccggaaaaaugugauacauuauugugugauauaggcgaaaguucaccgaacccaaccauagaagaagguagaaccuuacgggugcuaaaaaugguagaaccgugguuaagaggcaaucaauucuguauaaaaauauuaaacccuuauaugccaucaguaguagagacgcuugaacagaugcagcgcaaacauggcggaaugcugguuagaaauccacuuucuagaaauucaacccaugaaauguauuggguaucuugcgguacuggcaauaucguaucugccguaaacaugacuagcagaaugcuacuaaaucguuuuacaauggcacaccgaaaaccaaccuaugaaagggacguggauuuaggagcaggaacacgucauguagccguugaacccgaaguagcuaacuuggacauuauagggcagaggauagagaauaucaaaaaugagcauaagaguacauggcauuaugacgaagacaauccuuauaagacgugggccuaucacgguaguuaugaaguuaaaccauccggauccgcuagcucaaugguaaacggcgugguaagacuacuaacaaagccaugggaugucauaccgaugguaacccagauagcaaugacugauacaacaccauucggacagcaaagaguuuuuaaagaaaaaguugauacacgcaccccaaaagcaaaaagagguacagcucaaauaauggagguuaccgcuaagugguuauggggauuuuuaucgagaaacaagaaacccagaauuuguacgcgugaagaguucacacgcaagguaagaaguaacgcagcuauaggagcaguauucgucgacgagaaucaauggaacucggccaaggaggcuguugaagaugaaagauuuugggaccuuguucgaagagaaagagaacugcacaaacaagggaaaugugcgacaugcguauauaauaugauggggaaacgagaaaagaaacuaggcgaauuugguaaggcgaaaggaagucgggcgauuugguacauguggcugggugcuagauuucuagaauuugaagcucuugguuucaugaaugaagaucauugguuuucuagagaaaacagcuuauccggaguugagggagaaggcuuacacaaguuaggcuacauucugcgagacaucagcaagauaccagguggaaauauguacgcagacgacaccgcaggcugggauacacgaauaacagaagaggaccuucaaaacgaagccaaaauaacagacauuauggaaccagagcacgcccuucuugcuacgucuaucuuuaaacuuacauaucaaaauaaaguagucaggguacaacgaccggcgaaaaauggaacuguaauggacgugauaaguagaagggaucaaagaggcagcggacaaguaggaacuuaugggcucaacacuuuuaccaauauggaagcacaguuaauccgucaaauggaauccgaaggaaucuuuaguccaucagagcuagaaacuccaaaccuagcaggccgagucuuagacugguuagaaaaacauggcauugaaagauuaaggcggauggcgauuagcggagaugauugcguggucaaaccaaucgacgauagguucgcaacugcccugaccgcguugaacgauaugggaaagguucggaaagauauaccucagugggaaccaagcaaagguuggaaugacuggcaacagguaccauuuugcucccaucauuuccaccaauuaauaaugaaagacgggagggagaucguuguaccguguagaaaccaggacgaguugguuggacgcgcccgggucagucaaggagcagguuggucccuaagagagacggcgugcuugggcaaaaguuaugcacagauguggcagcucauguacuuucaucgucgcgauuugagauuggcagcaaacgccauauguucggcagugccagucgauugggugccuacaagcagaacgacuuggucgauacacgcacaucaccaauggaugacgacagaagacaugcuaucggucuggaauagaguauggauugaagagaauccuuggauggaagauaaaacucacguaagcucaugggaggauguaccguacuuagguaagagggaagaucagugguguggaucuuuaaucggucucaccgcuagggcuacuugggcuacaaacauacaaguugcaauaaaucaggugcgcagacuaaucggcaaugaaaacuaucuugacuauaugaccaguaugaaacgauuuaaaaaugaaucagauccggagggagcacucugguga

SEQ ID NO: 22085 - RNA, 9879 nt, Artificial Sequence
  derived and/or modified CDS sequence (opt6) from DENV-1__KF289072__SS-prME
agcguaacuauguuauugaugcuuuugccuacugcauuggcauuucauuuaacgacgagaggaggagaaccccauaugauuguuucaaaacaagaaagaggaaaaucauuauuguuuaaaacaagcgcagggguuaauaugugcacacuuauugcaauggacuugggugaacuaugugaagacaccaugaccuauaaaugcccgagaaucacagaagcagaaccugacgacguagauugcugguguaacgcuacugauacguggguaaccuauggcacauguucccaaacuggugaacacagaagagauaaaagaaguguugcauuagcgccacacguuggauugggauuagaaacgcgaacggaaaccuggaugucuucugaaggagcuuggagacaaauucaaaaaguugaaacaugggcucuuaggcauccgggguucacugugauagcauuauuuuuagcgcacgcuaucgguacaaguauuacacaaaaaggcauuauauucauuuugcuuauguuaguaacuccgucgauggcgaugagauguguagggaucggaaauagagauuucguggaaggucuuucuggcgcaacuugggucgauguuguacuugaacauggaagcuguguaaccacaauggccaaaaauaaaccuacacuagauauugaauuacuaaaaaccgaagugacuaauccugcuguacuaagaaaacuaugcauagaagcuaaaaucuccaauacaacgacagauucaagauguccaacacaaggugaagccacacuuguagaagaacaagaugcuaauuucguuugucgcagaacguucguugaucgaggauggggaaacggauguggauuauucgguaaaggauccuuacucacgugugcaaaauuuaaaugugugacaaaacuugaagguaaaauuguacaauaugaaaaccucaaauacucagucauagucaccguacacacuggcgaucaacaccagguaggcaacgaaaccacagagcauggcacgauagcaacuauaacaccacaggcaccaacaucugagauucaguuaacugauuauggggcuuuaacacucgauugcagcccacguacaggauuagauuucaacgaaaugguacuauuaacgaugaaagaaaaaucuugguuaguccauaaacaaugguuucuugaucuuccauuaccuuggacaaguggagcaaguacgucacaagaaacauggaaucggcaggauuugcuagucacguucaaaacugcacaugcuaagaaacaggaaguugugguauugggaucacaggagggcgcuaugcauacagcauuaacuggugcaacggaaauacaaacaaguggaacgacuacaauauucgcagggcaccuaaaauguagauuaaaaauggauaaauuaacacucaaagggguauccuaugugauguguacugggaguuucaaauuagaaaaagaaguagcggaaacucaacacgguacaguacucguucaagugaaauaugaagguacagaugcacccuguaaaauaccuauaucaacacaggacgaaaaaggcgugacacaaaauggucgacuaauuacugcaaauccgauaguaacggacaaagaaaaacccguaaacauugagaccgaaccaccauucggagaaaguuacauaguuauuggugcaggcgaaaaagcauuaaaauugaguugguucaagaaagguagcaguauuggaaaaauguuugaagcaacugcucgaggagcgcgcaggauggcaauauuaggagauacugcgugggauuucggaaguaucggugguguuuuuacaucaguuggaaagcuaguucaucaaguuuuugguacagccuacgguguauuauucagcggaguaucuuggaccaugaaaauuggaauugguauauuauuaacuuggcucggcuuaaacagcaggucaaccucucuaucaaugacuugcaucgcugucgggaugguaacauuauaucuaggaguaaugguacaagccgauagcggauguguaauaaacuggaaaggcagagaacuaaaaugcgguucgggcauauucguuacuaacgaaguacauaccuggacagaacaguauaaauuccaagccgacuccccaaaaaggcuaucagcagcaaucggcaaagcaugggaagaaggaguaugugguaucaggagugcgaccaggcuugagaauaucauguggaaacaaauuagcaaugaacugaaccauaucuuacuugaaaacgauaugaaauuuacaguagucguaggagaugcaaacgguauacuuacacaggguaagaaaaugauuagaccacaacccauggaacacaaguacagcuggaaaaguuggggcaaagccaaaauaauuggggccgauacacaaaauacaacauucauuauugauggaccugauacaccagaauguccagaugaccagcgugccuggaauauuugggaaguggaggauuauggcuuugggguauuuaccacgaacauauggcuaaagcugagagauaguuacacccaaaugugugaccauagacuuaugucagcagcaauaaaagauagcaaagcgguccaugccgauaugggauacuggauagaauccgagaaaaaugaaacauggaaauuagcucgagcaucuuucaucgaaguaaagacaugcauuuggccuagaucucauacgcuauggaguaauggcguacucgaaagcgaaaugaucauuccuaagauauacggcggaccaauaagccaacauaacuauagacccggauauuuuacucagacagcaggacccuggcaucugggaaagcuggaauuagacuuuaacuuaugcgaagguaccacuguaguuguggacgaacauuguggaaacaggggaccaaguuuacggaccaccacgguuacaggaaaaauaauucaugaauggugcuguagaucguguacucucccucccuuaagguuuaaaggugaagacgguuguugguauggcauggaaauuaggccuguaaaggaaaaggaagaaaaucugguuagaaguauggugucggcagggucgggagaaguagacagcuuuagccuaggucuacugugugugucaauaaugauagaagaggucaugcgaucaagauggagucgaaaaaugcucaugacaggaacguuagcaguauucuuuuuauugauaaugggacaauuaacguggaaugaccuaauaagacucuguauaaugguuggcgccaaugucucagaccguauggguaugggcacuacuuauuuagcuuuaauggcuacguuuaaaaugaggcccauguuugccguaggucuucucuuccgcagauuaaccagcagagagguucuccuuuugacaauuggacuaucauuaguagcguccguagaacuuccuaauuccuuagaagaauugggugauggccuagcaauggggaucaugauguuaaagcuacuaacagauuuucaaucacaccaauuauggacgacucuucucucacuaacuuuuauuaaaacaacacuaagucuagacuaugcauggaagacaauggcaaugguacuuaguauaguaucucuauucccacugugucugaguacaacuagccagaaaacaacaugguugccuguucuacuuggcucauuugguuguaagcccuugacaauguucuuaauaacagaaaacaaaaucuggggcagaaaaucuuggccucuaaaugagggcaucauggcuguagguauagucucuaucuuacuaucaucguuacuuaaaaacgaugucccuuuagcagguccauuaauagcugguggaaugcuaauagcauguuaugucauaucuggaaguagcgcagacuuauccuuagaaagagcagcugagguuaguugggaagaagaagcugaacacuccggagccucucauaauauauuaguggaaguccaagaugacggaacuaugaaaauaaaagaugaagaacgugaugauacccuaacaauacuacuaaaagccacacuuuuagcaguaagcggcguauacccaauguccauuccagcaacucuuuucguaugguacuucuggcagaagaagaaacaacgaagugguguguuaugggauacucccucaccuccagagguggaaagagcaguacuugacgauggaaucuauaggauauuacaaagggggcuauugggacgaucacagguuggugugggaguguuucaagaugggguuuuucacacgauguggcacguaacaagaggagcgguccuuauguaucaagguaaacgacuggaaccaaguugggcaagugucaaaaaggaucugaucagcuauggcggcggguggcgcuuucaaggcaguuggaauacaggagaagagguccaaguaauagcgguagaaccaggcaaaaauccuaaaaacguacaaaccaccccggguacuuuuaaaacgccugaaggcgcuguaggugcaaucgcgcuugacuuuaaaccuggaacaaguggcagcccuaucgucaauagagagggcaagauuguaggucuauacgguaauggagugguaaccaccucaggcacauauguguccgcaaucgcacaagcaaaagcaagucaagaaggaccacuacccgaaauugaagaugaaguauucaagaaacgaaaucugaccauuauggaucuacauccuggaucuggaaaaacucguagauaccucccugcaauaguccgugaagcaaucaaaagaaaacuacgaacacugauccuagcgccaacaagagucguugcgucagaaauggcugaggcccugaaaggaaugcccauucguuaucaaacuacagcggugaaaucagaacauacaggaaaagaaauaguugaucuaaugugccaugcgaccuucacuaugagauuacuuucuccggugagaguaccuaacuacaauaugaucauaauggacgaagcccauuuuaccgauccggcauccauugccgccagaggauacaucucuacaagggucggaaugggcgaagcggccgcgauauucaugacugccacuccacccggaucaguagaggcuuuuccacaguccaacgcuguaauacaagaugaagaaagagacauaccagaaaggucauggaacucagguuaugacuggauaacugacuuuccuggaaaaaccgugugguucgugccaaguauaaaauccggaaaugauaucgcaaauugccuaaggaaaaaugguaaacgcgucauacaauugagucguaaaacuuuugauacagaguaucagaaaacuaagaauaaugacugggauuacguuguuacgacagacaucucggaaaugggagcaaauuucagagcagaucguguaauagauccacgacgaugccucaaacccgugauacuuaaagauggcccugaacgcguaauauuagcaggaccaaugccuguaacagccgcaucagcugcacaacgcaggggaaggauagguagaaaucaaaacaaagaaggcgaccaauauauuuauaugggacagccgcuuaacaaugacgaagaucacgcacauuggacggaagccaagaugcuauuagauaauauaaauacaccagagggcauaauaccagcccuauucgaacccgaaagagaaaagucugccgcuauugauggagaauaucgacuuagaggagaggcacguaaaacuuuuguugaauuaaugcgucguggggauuuaccgguauggcugucuuauaaggucgcaucagagggauuucaguacucagauagacgaugguguuucgacggagaacgaaauaaccagguguuagaggaaaauauggaugucgaaauauggacaaaagaaggagagagaaagaagcucaggccucgaugguuagaugcucgaacuuacucagauccucuugcccuaagagaguucaaggaguuugcagcgggacgcagaagcgucucgggcgaucuaauccuagagaucgguaaacugccgcaacaucuuacucuuagagcacaaaacgcucuagacaacuugguuaugcuucauaauucugaacagggcggcaaagcguauagacaugcaauggaggaacuaccugacacgauagaaacuuuaaugcuccuugcuuuaauugcaguacuuaccggcggaguaacacucuucuuuuuaagugggaaaggguugggcaagacgaguauaggauuauuaugcguuauggcuucaaguguauuacuauggauggcuucaguugaaccucauuggauagccgcgaguauuauacuggaguucuuucucaugguacuacuaauuccugaaccagacaggcagagaacuccucaagauaaucaacuagcauacguagucauuggauugcuguuuaugauauuaaccguagccgcgaaugagaugggacuacuagaaacgacuaagaaagaccugggaauuggccauguaguagccgagaaccaccaucacgcaacgaugcuugauauagauuuacacccugcguccgcauggacccucuaugccguggcaaccaccauaauaacaccuaugaugcgacauacgauugaaaacacaacugcaaacauaagccugaccgcgaucgccaaucaggcagcaauuuugaugggguuagacaaagguuggccaaucagcaaaauggauaucggcguaccguuacucgcacuggguuguuauucacaaguuaauccuuuaacucuuaccgcggcuguacuuaugcuaguugcccauuacgcuauaauuggaccaggacuucaggcaaaagcgacgagagaggcucagaaaagaacagcagcugggauuaugaagaaccccacuguagauggaauaguugcuaucgauuuagacccuguggucuaugaugcaaaauucgagaaacaguuaggacaaauaaugcuauuaauuuuguguacgucacaaauucuacuaaugagaacuacgugggcucucugcgaaaguauuacguuagcgacaggaccauuaacgacauuaugggaaggcaguccaggaagauuuuggaauacaacuauugccgucuccauggcuaauauauuucgaggaucauaucuggcuggagcuggucuugcuuuuucauugaugaaaucauuaggcggaggacgaagaggaacaggggcucagggggaaacacuuggggaaaaauggaaaaggcaacuuaaucaacuuaguaagagugaguucaacacauacaaaagauccggaauuauggaaguugaucgaagugaggcaaaagaaggucuaaaaagaggugaaacaacuaagcaugccguaaguaggggaacggcuaaguuaaggugguucguagaacgaaauuuaguaaagcccgaaggaaagguaauugaccuugggugcggucgaggaggguggucguauuauugcgccggcuuaaagaaaguaaccgaaguuaaaggauacacgaaggguggucccgggcacgaggaaccgauaccaauggcgacauaugguuggaauaucguaaaguuacacucaggacgagauguauuuuucacaccaccagaaaaaugugauacauuauuaugugacauuggagaaagcaguccuaacccuacaaucgaagaaggucgaacgcuaaggguacuaaaaaugguugaaccuugguuaagaggcaaucaguuuugcauuaagauucuuaauccauauaugccaaguguaguagaaacucuagaacagaugcaacguaagcauggcggaaugcucguccggaauccauugucgaggaacuccacucaugaaauguacugggugucaugcggaacuggaaacauugugucagcuguaaacaugacaagcagaaugcuacuuaauagauucacaaugacgcaccgaaaacccacauacgaacgcgauguugaucuaggagcgggcacucgucacgucgcaguugaaccugaaauagcgaaucuugacauaauugggcaaagaauugaaaauauuaaaaaugaacacaaguccacauggcacuaugaugaagauaauccuuacaaaacgugggcauaucauggauccuacgagguuaaacccucggggagugccaguagcaugguuaaugguguuguucgccuccuaaccaagccaugggauguaauacccaugguaacgcaaauagccaugacugauaccacgccauuuggccaacaacgagucuuuaaggaaaagguagacacucgaacgcccagaccgaagagaggcacugcccagaucauggaaguuacagcuaaauggcuauggggguuuuuaucgaggaauaagaaaccacgaauauguacuagagaagaguucacucgcaagguuagaucuaaugcugcuauaggagcagucuuugucgaugaaaaucaguggaacucggcgaaagaggcaguggaagaugaacgcuucugggaccugguacauagagagagagaacuccacaagcaaggcaagugcgccacaugcguauauaauaugaugggcaaaagagagaagaaauuaggagaguucggaaaggcuaaagggaguagagcuauuugguauauguggcuaggggcacgcuuuuuagaguucgaagcccucgguuuuaugaaugaagaucacugguuuaguagagaaaauucacuaaguggaguugaaggggagggacuacauaaauugggauacauauuaagagauauaaguaagauuccgggagguaacauguaugccgacgauacugcagguugggauacuagaaucacagaagaugacuugcagaaugaagcuaagauuaccgauauaauggaaccagaacacgcacuacuagccacaagcauuuucaaacuaacguaucaaaauaaggucguuagaguacaacgaccugcaaagucuggaacagugauggauguaauuucuaggcgagaccagcgaggcucuggucaagugggaaccuauggacuaaauacauuuacaaacauggaaguccaacuuauuaggcaaauggaaucagagggaauuuucagcccaucagaauuagaaaacuccaaccuggcugagcggguacuagacugguuagagaagcacggugucgaaagacuaaaacggauggccauuaguggagacgacugcgugguaaaaccuaccgaugaucgauuugcuacggccuuaacggcccucaaugacaugggaaaaguacguaaagauauuccgcaaugggaaccaucaaaaggcuggaaugacuggcaacaaguaccuuuuugcucccaccauuuccaccagcuuauaaugaaagacgggcgugaaauugugguuccguguaggaaccaagaugagcuaguuggaagggcaaggguuagccaaggagcaggauggucuuuaagagaaacagcaugccuaggcaaaucuuaugcacaaauguggcaauuaauguauuuccacagaagagacuugagguuagcagcaaaugcaaucugcucagccgucccaguagauuggguuccaacaucgcgaacgaccuggaguauacaugcccaucaccaauggaugacgacugaagauauguuaaguguguggaaccgagucuggauagaggaaaauccuuggauggaggauaagacacacgugucaagcugggaagauguccccuauuugggcaaacgcgaagaccaaugguguggcucacugauagggcucacggcgcgagcaacgugggccaccaacauucaagucgcuauaaaucaaguuagacggcuaaucggaaacgaaaauuacuuagauuacaugacaaguaugaaaagauuuaagaacgagagugacucagagggggcauuaugguaa

SEQ ID NO: 22086 - RNA, 9879 nt, Artificial Sequence
  derived and/or modified CDS sequence (opt6) from DENV-1__JQ692085__SS-prME
ucaguaacuaugcucuuaauguuauuaccaacugcauuagcauuucaucuaacaacucgaggaggagagccacacaugauaguaucaaaacaagagcgcgguaaaagccuacuuuucaaaacuagcgcugguguaaauauguguacccuaauagcaauggaucuuggugaauugugcgaggauacgaugacuuacaaauguccuagaauuacugaagcggaaccagacgaugucgacuguugguguaaugcaacagauacaugggucacauacgguacauguucacaaacuggggaacauagaagagacaaacggaguguggcuuuggccccacauguuggacuugguuuagaaacgcgaacagagacguggaugagcagugaaggagcuuggcgucaaauccaaaaaguugagacgugggcgcugcgacauccugguuucacagucauagcacuauuuuuggcacacgccauaggaacaaguauaacccagaaagguauuauuuuuauacuuuugaugcuuguaacaccaagcauggcaaugcguuguguaggaauuggaaauagggacuucgucgaaggguuaucuggagcaacguggguugauguaguacuugaacacgggaguugcgugacaacgauggccaaaaauaaaccaaccuuagauaucgaauuauuaaaaacugaaguaacaaacccugcagucuuaagaaaauuauguauagaggcaaaaauaucaaauaccacaacagauucaaggugccccacacaaggagaagcuacuuuggucgaagaacaagaugcaaacuuuguuuguagaagaacauucguagauagaggaugggguaacggcugugguuuguucgguaaagguaguuuacuaacaugcgcgaaauucaaauguguaacuaaacuagagggaaaaaucgugcaauacgaaaacuugaaauacagcgugauagugaccguacauacuggggaucagcaucaagucggaaacgagacgaccgaacacgggacuaucgcaacuauaacaccacaagcacccacaagcgagauacaacugacagacuauggagcccucacguuagauugcucaccccgaacgggucuagauuuuaaugaaauggugcugcuaacuaugaaagagaaaagcugguuaguacacaaacagugguuccucgacuuaccauuaccauggacaagcggggcuaguacuucacaagagacuuggaauagacaggaucucuuaguuacuuuuaaaaccgcccaugcgaagaaacaagaaguaguugucuuaggaucgcaagaaggagcaaugcacacugcuuugacaggagcgacggagauacaaacuucagguacgacuacaauauucgcaggucaucuaaaauguagacuuaaaauggauaaauuaacacugaaaggaguaucauacguaauguguaccgggaguuucaaacuagaaaaagaggucgcggagacucagcauggcacuguucuaguacagguuaaauaugaggggacugacgcaccaugcaagaucccuauuucgacccaagacgaaaaagguguaacacaaaacggacgucuaauaacugcuaauccaaucguaacagauaaagaaaaaccugucaauauugaaacagaaccacccuuuggugaaucuuauauuguuauaggggcaggcgaaaaagcccuuaaauuaucuugguuuaagaagggaucuaguauaggaaaaauguucgaggcaaccgcaagaggggcaagaagaauggcgauucuaggcgauacagcuugggacuuugggaguauugguggaguuuucacgucggugggaaaauuaguucaccagguguuuggaaccgccuaugguguucuauuuucaggcguaucauggacgaugaagauaggaauaggaauccuccuaacguggcuuggauuaaacagucgaucgacaucgcuuuccaugacgugcauugcuguaggcauggucacauuauauuugggagugaugguacaggcagacucagguuguguaauuaacuggaagggaagggaauugaaaugugggucaggcauauuugugacaaaugaaguacacacguggacugaacaauauaaauuucaagccgauuccccuaaacgauuaucagccgccaucggcaaagcaugggaagaaggaguuuguggcauacgcucagccacgagauuagagaacauaauguggaaacagauaucaaaugaacuuaaucauauauugcuugaaaaugacaugaaguuuacuguaguaguuggagaugcaaaugguauucugacgcaaggcaagaaaaugauucggccgcaaccaauggaacacaaguacuccuggaaaaguuggggaaaggcgaaaauuauaggggcugauacccagaauacuacauucauaauagacgguccagauacaccagaauguccugaugaucaaagagcauggaacauaugggaaguagaagauuacggcuucgggguauucaccacaaauaucuggcuaaaacuacgagacucauauacacaaaugugugaccacaggcuaaugagcgcagccauaaaagacucgaaagcaguacaugcagauaugggauacuggauugagagcgaaaagaacgaaaccuggaaacuugcgagagcaucuuuuauagagguaaagacuuguauuuggccacgaagucauaccuuauggagcaacggcguauuagaguccgaaaugauaauaccgaaaauauacggaggaccuaucucucaacauaauuacagaccgggguacuucacccaaaccgcgggaccauggcaucuaggcaaauuggaauuagacuuuaauuuaugcgaagguacgacaguagugguggaugaacauuguggcaaccgcggcccgagcuuacggacaaccaccguuacaggaaagauaauacaugaaugguguugccgcucauguacccuacccccguuaagauuuagaggcgaagacggguguugguauggcauggaaauucgacccguaaaagagaaagaagaaaaucuaguacgaaguaugguaagugcagggucaggagaaguagauucguuuaguuuagguuuacuuuguguaucaauaaugauugaagaaguuaugcgaucaagauggucgcgcaaaauguugaugacagggacuuuagcagucuucuuuuuauuaaucaugggucagcuuacauggaaugaucuaauaaggcuaugcauuaugguaggagcuaaugucagcgaucgcauggguaugggaacgacauaucuugcccuaauggccacauuuaagaugagaccuauguuugcaguaggcuugcuauucagacgauuaacauccagagaaguuuuacuuuugacaauaggacuuucccuuguagccagcguugaacuuccaaacagcuuagaagaacuuggagacgggcuugcaaugggaauuaugauguuaaaauuacucaccgauuuccagagucaucaacucuggacgacuuuauuaaguuuaacguucauaaaaacaacccuaagccucgauuaugcauggaagacuauggccaugguacuaucgaucgucagccuauucccccuaugucuuucuacuacaagccaaaagacuacauggcuaccuguacuacuaggaucuuuuggcugcaaaccacucacaauguuccucaucacagaaaacaaaauauggggaagaaaaucauggcccuuaaaugaaggcauuauggcagucgggauagugucaauacugcuuucgagcuuguugaaaaacgaugugccucucgccgguccgcuuaucgcuggagguauguuaauugcauguuauguaauaucugguucaagcgccgaucuaucauuagagcgagcagcagaaguaucaugggaggaggaagcagaacauuccggagcaucucacaauauccugguagaaguacaggaugacggcaccaugaaaauaaaagaugaggaacgugaugauacauugacuauccuccuaaaggccacacuauuggcuguuucaggaguguauccaauguccauaccagcuacauuguuugucugguauuuuuggcaaaagaagaaacagcggaguggaguauuaugggauacaccgagucccccagaaguagaacgugcgguacuagaugacgguauauauagaauccuacaacgagggcuguuaggccgcucacaaguuggcguagguguauuucaagauggcgucuuucauacaauguggcacguaacacgaggagcugucuuaauguaucaagggaaaagacuggaacccucaugggcuucugugaaaaaggaccuaauaagcuauggaggcggauggagauuucaaggaucauggaauaccggagaagaagugcaagugauagccgucgagccaggcaaaaauccuaaaaaugugcaaacaacacccgggacuuucaaaacaccagaaggagccguaggcgcaauagcucucgauuuuaaaccagguacaucgggaucuccuauuguuaacagagaagggaagauugugggucuauacgguaacggcgugguaacaacaaguggcacauacguaucugcgauugcacaagccaaagccucucaagagggcccacugcccgaaauugaggaugagguauuuaagaaacgaaaucuaacgauaauggacuuacauccagguagcgggaaaacuagaagauacuuaccggcaauagugcgggaagcaaucaagcggaaauuaaggacucuuauuuuagcaccgacacgaguaguagccagcgaaauggcagaagcgcugaaggggaugccaauucguuaccaaacgacugcagucaaaagcgaacacacaggcaaagaaauaguagaccuuaugugccacgcaaccuucacuaugagacuuuuaucaccgguaagagugcccaacuauaauaugauuauaauggaugaagcacauuucacagauccugcgucaauagcagcacgaggauauauaagcacaagggugggaaugggugaggcggccgcaauuuuuaugacagcgacacccccaggaucaguagaagcguuuccacaaucaaaugcagucauacaagacgaagaaagggauaucccagaaagaucguggaacucagguuaugauuggauaacagauuuuccuggaaaaacugugugguucguaccuaguauaaaaucuggcaaugacaucgcaaacugccuacggaaaaaugguaaacggguaauacagcugucccgcaaaacguucgacacugaguaucagaaaacgaaaaacaacgauugggauuauguugucacaacagacauaagcgagaugggugccaauuuucgcgcagaccgaguuauagauccacgucgauguuuaaaaccaguaauccuaaaggauggcccggagagaguaauacuugccggaccgaugccuguaacugcagccuccgcugcucaaaggagaggaagaauaggaagaaaccaaaauaaagagggagaccaauauauuuauaugggacaaccgcuuaauaacgaugaagaccacgcgcauuggacugaggccaagauguuacuggacaacauaaacaccccugaagguauaauaccggcuuuauuugaaccagaacgggaaaaaucagcagcuauagacggugaauauagacuccgaggugaggcacggaagaccuuuguugaacugaugcgacgaggugauuugcccguaugguuaagcuauaagguagcaagcgaaggauuucaauauucagaccgaagauggugcuuugauggggaacguaauaaucaaguauuggaggaaaacauggacguugaaauauggacaaaagaaggagaaagaaagaaacucagaccaaggugguuagacgcgagaacauauuccgauccauuagcgcuaagagaauuuaaagaguuugcugcagguaggcgaucaguguccggagacuuaauacuggaaauaggaaaacucccacaacauuuaacacuccgugcucaaaacgcacuugacaaccugguuauguuacauaauucugagcaaggaggaaaagcauacagacaugcaauggaagaacuuccagacacaauagaaacauugauguuguuagcuuugauagcaguauuaacagguggcgugaccuuauucuuucuaagugggaaagggcuggguaagacuucgauaggguuauuaugcgugauggcaaguagugucuuauuauggauggcgagcguugaaccgcauuggauugccgcaucgaucauccuagaauuuuuccuaaugguucuuuuaauuccggagcccgaccgacagcgcacaccgcaagauaaucaacuggccuauguaguaauagguuuacucuuuaugauccugacuguagcagcgaaugagaugggauuauuggaaacaacgaagaaagaccucggaauuggucaugucguugcagaaaaucaucaccaugcaacuaugcuggacauagauuuacacccugcgagugcauggacauuguaugccguagcaaccacaauaauuacaccaaugaugcgucacacuauugaaaacacuacagcgaacauuuccuugaccgccauagcuaaccaagcugcaauauuaauggggcuggauaaaggcuggccaaucucuaagauggauauagggguacccuuacuggcccugggcugcuacucacaaguaaauccauuaacgcucacagcagcaguacuaauguuaguagcacacuaugcgauaauaggucccggauuacaggcaaaggcuacccgagaagcucagaaaaggacugccgcagggauuaugaaaaauccuacaguagauggaauuguggcaauugauuuagacccagucguauacgaugccaaauucgaaaaacaacuaggacaaauuauguuacucauauugugcacaucucaaauacuuuuaaugaggacaacuugggcgcuuugugaaucaauuacgcuagcaacuggaccauuaacuacacucugggagggaaguccaggaagauuuuggaacacuaccauugcuguaaguauggcaaauauauucagaggcucguaucuagccggugcagggcuugcuuucagcuugaugaagagucugggcggagguaggagaggaacaggagcucaaggagagacauugggagaaaaauggaaacgacaauuaaaccaauuaagcaagagcgaguuuaauaccuacaaaagauccgguaucauggaaguggaccgcucagaagcaaaagaaggacuaaaacggggagaaacaaccaagcaugcuguaagcagagggacugcuaaauugcgaugguuuguggaacgaaauuuagugaaaccugaaggaaaagugauagaucuagggugcgguagaggcggauggucauauuauugugcgggacuaaagaaagucacugaaguaaaagguuauacaaaaggagggcccggccaugaagaaccaaucccaauggcuacuuauggauggaacauagucaaauugcacaguggaagagacguuuucuucacaccucccgaaaaaugugacacuuuacugugugacauaggagaaaguucgccaaaccccaccaucgaagaaggcagaacacuaagaguucuuaaaaugguagaaccgugguuacguggaaaucaguucuguauuaaaauuuuaaauccguacaugccauccgugguagaaacacuggaacaaaugcaacguaagcacgggggcauguugguucgaaacccauuaagccguaauucaacacacgagauguacuggguaucgugcgguacggguaacauagucagugcaguaaacaugacaaguagaaugcucuuaaaucguuuuacgaugacccaucgaaagccaaccuaugaaagagauguagaucuaggagcaggcacaagacauguagccguagagcccgaaaucgcuaacuuagacaucauuggucagcgcauugagaauauuaaaaacgaacauaaauccacuuggcauuacgaugaagauaauccuuacaaaacaugggccuaucaugguaguuacgaagucaaaccaagcgggucagcaucguccaugguaaauggcguuguaaggcuccuuacgaaaccaugggaugucauaccuaugguaacgcaaauagccaugacugacacaacaccauuugggcaacaaagagucuuuaaagagaaggucgauacaagaacgccaagacccaaaagaggcacugcccaaauuauggaggucacugcgaaauggcuuuggggauuucuaucacgaaauaagaaaccacgaauaugcacacgagaagaauuuacaagaaaaguacgcaguaacgcggcuguuggagccguuuuuguugaugaaaaccaauggaacagugcuaaagaggcgguggaggacgagcgguuuugggaucuaguccaucgagaaagagaacuccacaagcaaggaaaaugcgcaacauguguguacaacaugauggggaaacgcgagaagaaacuaggugaauuuggcaaagcaaaagggucuagagcuauaugguacaugugguuaggggcccgguuucuagaguucgaagcauuaggauuuaugaaugaagaucauugguucucgagggaaaacucguuaucaggcguggaaggugaagguuuacacaaacucggguauauccuccgcgacaucaguaagaucccuggugguaauauguaugcggacgauacugcuggcugggauacacgcauaacagaagaugauuugcagaaugaagcuaaaauaacagauauuauggaaccugagcaugcauuacuugcuacaucaauauuuaagcuaacauaccaaaauaaagucguaaggguacaaaggccagcuaaaucgggcacugucauggacguuauaucacgacgugaccaaagaggaucgggucaggucggaacguauggucuaaauacuuucacaaauauggaaguacaacuaauaaggcaaauggaaucagaaggaauauuuucgccaaacgagcuggaaaacucaaaucuugcugagaggguacuugauuggcuggaaaagcacggugucgaaagauuaaagcgaauggcuauuucaggagaugacugcgugguuaaacccacggaugaucgauucgccaccgcacugacagcgcuaaaugacauggggaaaguacguaaagacauaccacaaugggaacccucuaagggauggaacgacuggcaacaagucccguucugcucgcaucauuuccaucagcugauaaugaaagacggaagagagauaguaguaccaugucgaaaucaggaugaauuaguaggacgagcaagaguuucccaaggggcuggguggagucuaagagagacggcuugucuuggaaaaaguuaugcgcagauguggcaauuaauguacuuccaccggagagaucuacgccuugcagcuaaugcuauauguucagcagucccuguugacugggucccaacuucacgcacaacguggucaauacacgcgcaccaucaauggaugacgacugaagauaugcucucuguguggaauagaguuuggauagaagaaaaucccuggauggaagacaaaacgcacgucaguagcugggaagauguuccauaccuuggaaagcgagaagaccaaugguguggcucuuuaauaggccuaacagcacgugccacaugggcaacuaacauacagguagcaauaaaucaaguacgccggcugauaggaaaugaaaauuauuuagauuauaugaccagcaugaaacguuuuaaaaacgaaagugauagugaaggcgcucuaugguaa

SEQ ID NO: 22087 - RNA, 9879 nt, Artificial Sequence
  derived and/or modified CDS sequence (opt6) from DENV-1__JQ917404__SS-prME
agcgucacuaugcuauugaugcuauuaccaacagcauuagcuuuccacuugacaacaagagguggggaaccucauaugauaguaaguaaacaggagagaggcaaaucacuguuauucaaaacaagugcuggaguaaauaugugcacacuaauagcaauggaccuaggugagcugugcgaagacacaaugacauauaaaugcccacgaauuacagaagcagagccggacgauguagacuguuggugcaaugcuacagauacauggguaacauacggaacguguagccaaacuggugaacaucguagagauaaacgaucaguagcucuugcaccacacguuggucuagguuuagaaacaaggacugaaacuuggaugucgucagaaggagcauggaggcaaauucaaaaaguugaaacaugggcccuaagacauccuggguucacagucauagcuuuauucuuagcacaugcaauagguaccuccauaacgcaaaaagguauuauauuuaucuugcuaauguuaguaacgccaucuauggcaaugagauguguuggaauugguaauagagacuucguagaaggguuaucuggcgcaacaugggucgacguaguguuagagcauggaucauguguuacaaccauggccaaaaauaaacccacguuggauauagaauugcucaaaacagaagugacuaacccggcgguacuucgaaaauuauguaucgaagcgaaaauaucuaauacgacgaccgauagcagaugcccaacccagggagaagccacguuaguggaagaacaagacgcaaauuuuguaugccguagaacguucguugacagaggcuggggaaauggaugugguuuguuuggcaaaggaucacuauuaacuugugccaaauuuaaauguguuaccaaguuagaagguaagauaguccaguaugagaacuuaaaauauuccguaauagucaccgugcauacaggagaucaacaccaaguaggaaacgagaccacagaacacgguacaauugcuacaaucacgccgcaagcgcccacaagugaaauucaguuaacggauuauggagcccugacccuagacuguaguccuagaacaggacuagauuuuaaugaaauggugcugcuaacaaugaaagagaaaaguugguugguccacaaacagugguuucuagaccuaccacuaccguggacauccggagcuucgacaucacaagaaacauggaaucgacaggacuuguuaguuacguucaaaacagcucaugcuaagaaacaagaagugguagugcuaggaucacaagagggugcuaugcacacagcucuaacgggcgcgacggaaauucaaacaaguggaacaaccacgauuuuugcuggacauuuaaaaugcaggcuaaaaauggauaaacuuacgcuaaagggaguaucauauguuaugugcacggguaguuucaaacucgagaaagagguagcggaaacgcaacacgguacaguauugguucaagugaaauacgagggcacggaugcacccuguaagaucccaaucaguacgcaggacgaaaagggagugacucaaaacgguagacuaauaacagcgaaccccauagucacugauaaagaaaaaccgguaaauauagagacagaaccuccauuuggagaaagcuauaucgugauuggggcgggcgagaaggcauuaaagcuaaguugguuuaagaaaggaucaucaauaggaaaaauguuugaagcaacagcaagaggggcaagacgaauggccauuuugggagauaccgcuugggauuucggaagcaucggagggguguucacuagcgucgggaaguuaguccaccaaguauucggaacagcguaugguguuuuguucucugguguaagcuggacgaugaagauaggcauaggcauccuacuaacuuggcuuggauuaaauucaagaagcacuucacuaagcaugacguguauagccguagggaugguaacacuauaccuggguguuaugguccaggcagauucuggguguguaaucaacuggaaagggagagaguugaagugcggaucugguauauucguuacaaaugagguacacacauggacggaacaguauaaauuccaggcagacucucccaagaggcucucugcagcuauugggaaagcaugggaagaagguguuugcggaauccgcagugccacgcgcuuagaaaacauaauguggaagcaaauaagcaacgaauuaaaccauauucuguuggaaaaugacaugaaauuuacaguagugguaggggaugcgaaugggauucuuacucaaggaaagaaaaugauucgaccgcaaccgauggaacacaaauauagcuggaaaucgugggggaaagcaaaaauaauuggugcugacacucaaaacaccaccuucauaauugauggacccgauaccccugaaugcccagacgaucaacgggcauggaacauaugggaaguagaagacuauggauucggggucuuuacgacgaauauauggcuuaaacugcgagauucguacacgcagaugugcgaucacaggcuaaugagugcagccauaaaagacucgaaagcaguccacgcagauaugggauauuggaucgaaagcgaaaagaaugaaaccuggaaauuagcucgagcaaguuuuauagaagugaaaacuuguauauggccaagaagucacaccuuguggaguaauggaguacuagagucagaaaugauaaucccaaaaauauauggagguccaauuagucagcauaauuaucgcccgggauauuucacgcaaacggcaggaccuuggcaccuugguaaacuagaauuagauuuuaaccuaugcgaagggacaacaguagugguagaugagcacugcggaaacagagguccguccuugagaacaaccaccgucacaggaaaaauaauacaugaaugguguugcaggucaugcacauuaccaccacugcgauuucgaggagaggacggauguugguaugguauggagauaaggccagucaaagaaaaagaagaaaauuugguaagaucaauggucagugccgggucuggagagguagacuccuuuucuuugggacuauuaugcguaaguaucaugaucgaggaaguaaugagaucgagauggucaagaaagaugcuuaugaccggcacauuagcuguguucuuucuauuaauaaugggacaauuaacuuggaaugaccuaauaagacuauguauaaugguaggagcaaauguaagugaccgaaugggaaugggaaccacuuaucuagcauuaauggcuaccuucaagaugcguccaauguucgcaguaggacuauuauuuagaagacuaacgucaagggagguacuguuauugacaauaggucuaagucuaguugcaaguguagaauuaccaaacagucuagaagaauuaggggaugggcuagcgaugggcauaaugauguuaaaguuacuuacagauuuucaaucgcaccaauuauggacgacauuacuaucuuugacuuuuauuaaaacaacacuuagcuuagauuacgcauggaaaacgauggcuauggucuuaucaauaguaaguuuguuuccacuuuguuuaucuacaacaucucaaaagacgacguggcugccaguauuauuagggagcuuugguugcaaaccacucacaauguuucuuauaacagaaaauaaaaucuggggacgaaaauccuggccucuaaaugagggcauaauggcgguugguauaguaucgauacuauuaaguuccuuacucaaaaacgaugugccguuagcagggccucuaauagcugguggaaugcucauugcguguuaugucauaucggggucgucagcagauuuaaguuuagaacgagcggccgaagugaguugggaagaagaggcugaacacuccggagcuagucauaauauucugguagaaguccaagaugauggcacaaugaagauaaaagacgaggaaagagacgacacgcuaacgauauugcuaaaagccaccuuacuugccguuuccgguguuuaucccaugucaauaccugcaacauuguuuguaugguauuuuuggcagaagaagaaacaaagaucgggaguacuaugggauacgccaagcccaccagagguagaaagagcaguguuggaugaugguauauacagaauacugcagagaggauuacuagguaggucacaagugggaguggggguauuccaagaugguguauuucauacuauguggcaugucacaaggggagccguauugauguaucaagguaagaggcucgagccuucuugggcgagcguaaagaaagaucuaaucucauaugguggaggcuggcgguuccaaggauccuggaauacgggugaagaagugcaaguaauagcgguagagccagggaaaaaucccaaaaaugugcagaccacuccuggcacauuuaagacaccagaaggggaagugggcgcaauugcguuagauuuuaagcccggaaccagcggauccccuauaguuaauagagaggguaagauuguaggacuauacgguaauggagucguaaccacuucugguacauauguuuccgcaauagcucaggcaaaagcgucucaggaggguccgcuaccugaaauagaggaugagguuuucaagaaacggaacuuaaccauuauggacuuacaccccggaucaggaaaaacuaggagauauuuaccagcaauaguaagagaagcgauuaaaagaaaacuucgcacacugauacucgcaccgacaagaguaguggccucugaaauggcagaagcacuaaaaggcaugcccauaagauaucaaacuacugcggugaaaagcgagcauacgggaaaagaaaucguugaucuaaugugucacgcaacauuuacuaugcgccugcuuucaccagugcgagucccaaauuauaauaugauaauuauggaugaggcccacuucacagaccccgcaucuauugcagcacgagguuauauauccacccgaguggggaugggugaagcugcagcaauuuucaugacugcaacaccacccgguaguguggaagcauuuccucaaucaaacgccguaauacaagaugaggaaagagauaucccagaacguucauggaacucuggcuaugauuggauaacagacuucccuggcaaaacgguaugguuuguuccaaguauaaagagugggaaugauaucgcaaauugcuugaggaaaaacgguaaaagaguuauccaauuaagucgaaaaacauuugauacagaauaccagaaaaccaaaaauaacgauugggacuauguaguaacuaccgauauaagugaaaugggugccaauuuucgugcugaucgaguuauugauccucgaagaugucuaaaacccguuauacugaaggacggaccugaaagggucauccuagcagguccaaugccuguaacggccgcaucagcagcccaacgaagagggagaauuggacgaaaucaaaacaaagaaggggaucaauauauauauaugggacaaccauuaaacaaugacgaggaccaugcgcauuggacugaggcuaagaugcuauuagacaauauuaacacaccagaaggaauuauuccagcuuuauuugaaccugaaagagagaaaagcgcugcaauugacggugaauauaggcugcgcggugaagcaaggaagaccuuuguugagcuaaugcggcgaggcgaucuuccaguauggcuauccuauaaaguugcaucagaaggguuccaauacucagaucgaagguggugcuuugauggggagaggaacaaccaaguauuagaagaaaauauggacguagaaauuuggacacgcgaaggcgaacgaaagaaauuaaggccaaggugguuagaugcacgaaccuauucagacccguuggcucugcgagaauuuaaagaauuugcagcuggacgaagaucggucucuggagauuuaauuuuggagauugggaaacuaccacaacacuuaacauuaagagcacaaaaugcccuugacaaucugguaaugcugcauaacucggaacaaggaggaaaagcguacagacacgcaauggaggaauuacccgauacgaucgaaaccuuaaugcucuuagcauugaucgccguccuaaccgguggaguaacacuauuuuucuugucagggaaggguuugggcaaaaccagcaucggauuauugugcguaauggcgagcucuguguuacuauggauggcgagugucgaaccucacuggauagcggcaagcauaauauuagaauuuuucuuaaugguuuuacucauacccgaaccagaccgacaaagaacaccacaagauaaucaacuagcauacguagucauuggacuauuauuuaugauacuuacuguagccgcgaacgaaaugggguugcucgaaacaaccaagaaagacuuaggcauuggacaugucguagcagaaaaccaucaucaugcaacuauguuagacaucgaucuacacccggcaucagcauggaccuuguaugcuguagcaaccacaauuaucacuccuaugaugaggcauacuaucgagaauacuacagccaauauauccuuaaccgcaauugccaaccaagcggcaauacucaugggacuagauaaaggcuggccuauuuccaaaauggacauaggaguccccuuauuagcacucggguguuacucccaagucaauccauuaacgcuaacugcggcggugcuaaugcuuguggcacauuaugcaauuauaggaccaggccuacaagccaaagcgacuagagaggcacagaaaagaacggcagcagggauaaugaaaaauccaaccguugacggaauaguugcuauagacuuggauccaguuguuuacgaugccaaauuugaaaaacaacuggggcagauuaugcuauuaauuuuauguacuucucaaauccuucugaugcgaacaacaugggcauuaugugaaagcauuacacuagcuacuggcccacuuacgacucucugggaaggaaguccuggacgauuuuggaauacaacgauagcgguaagcauggcaaacauauuucgaggaaguuaccuagccggugcugggcuugcguuuagucuuaugaaaucauuaggggguggacguaggggaacaggagcccaaggagaaacauuaggcgaaaaauggaagagacaauuaaaucaauuaucaaaauccgaguucaauaccuauaagcgaaguggaauaauggaaguagaucggagcgaggcuaaagaaggacuuaaacgaggagaaacgacgaaacaugccgugucucgggguacagcuaaguugagaugguuuguagaacgcaacuuaguuaaaccagaagguaaaguaauugauuuaggaugugguagagguggcuggucuuauuauugcgcaggacucaagaaagucacugagguuaagggauauacaaaaggagggccggggcacgaagaaccaauaccuauggcgacuuauggauggaacaucgugaaguuacacuccggaagagacguauuuuucacacccccugaaaaaugcgacacucugcuaugugauauuggggaaucgagucccaauccaacaaucgaagaaggaaggacucucaggguccugaaaauggucgaaccuuggcugagaggaaaccaauuuugcauaaaaauuuuaaacccauacaugccuucaguggucgaaacauuagaacaaaugcaaagaaagcauggcgguauguugguucgaaacccacuauccaggaacucaacacacgaaauguauuggguaucauguggaacugggaauauuguaucagccguaaacaugacgagcagaaugcugcuaaaucgauucacgauggcucaucguaaaccgaccuacgaaagagauguagacuugggagcuggaaccagacacgucgcaguagagccggaaauagcuaaccuugauauuauagggcaacgcauugaaaacauaaagaacgaacacaaaucuacuuggcacuaugacgaagacaacccuuauaaaacaugggcguaccauggcagcuacgaaguuaaacccucugguagugccucguccaugguaaacggcguggucaggcuuuuaacuaagccgugggacguuauacccauggucacccaaauagcuaugacggauacgacaccuuucggacagcaaagaguguucaaagaaaaagucgauacgaggacaccgagaccaaagaggggcacugcgcagauaauggaaguaacagcuaaauggcuuugggguuuucugucaagaaauaaaaagcccagaauauguacuagagaggaauuuacacguaagguccgcucaaaugcugcuauaggagcaguuuucguugacgaaaaucaauggaacucggcuaaagaggcuguugaagacgaacgauuuugggauuugguacaccgugaaagagagcuacacaagcaaggaaaaugugcaacauguguguauaauaugaugggcaaaagggaaaagaagcucggggaauuuggaaaagcuaaaggauccagagcgaucugguauauguggcugggugcaagauuucucgaauuugaagcucuaggcuuuaugaaugaagaccauugguuuucaagggaaaauucucucucagguguugagggagaagggcuccauaaacucggcuauaucuuacgugauauaaguaaaauuccaggaggaaacauguacgccgaugacacugcgggaugggauacacggauaacugaagacgauuuacagaaugaggccaagauuacugauauaauggagccugagcacgcauugcuagcgacuucaaucuuuaaacuaaccuaucagaacaaggucgugcguguacagagaccagcuaagucugggacaguaauggaugucauuucacgucgcgaucaacgagggagcggacagguaggaacuuacggucuuaauacauuuaccaauauggagguacaauuaauaaggcagauggagucagaaggaaucuuuaguccuucagagcucgaaaacuccaaucuagcagaaaggguacuugacuggcuugaaaaacaugggguugaaagauuaaagcguauggcaaucaguggggacgauuguguugugaagccuacugacgaccguuuugcuacagcccuuaccgcacucaaugacaugggaaaaguacggaaggauaucccgcaaugggaaccaagcaaggguuggaacgacuggcaacaaguuccauuuugcucacaccacuuccaccaauuaaucaugaaggacggucgugagauuguuguucccuguaggaaucaagaugaguuaguaggucgagcgcgaguuucacaaggagccggauggucauuacgugaaacagccugccuggggaagucauacgcacaaauguggcaacuuauguacuuccaccggcgagacuugagacuggcugcaaaugcgauuugcucagcagucccaguaaacuggguaccuacuuccaggacgacauggagcauucaugcacaucaccaauggaugacgaccgaggauaugcuuaguguauggaaccgggucuggauagaggaaaauccuuggauggaagauaaaacgcacgucucuagcugggaagacguuccauaucugggaaagagagaagaucagugguguggcucacucauaggauugacggcaagggcaacaugggcuacaaauauacaaguugccaucaaucaaguccggcguuugauaggaaaugaaaauuaucuggauuacaugacaucuaugaaaagauucaaaaaugaauccgaccccgaaggggcacuaugguaa

SEQ ID NO: 22088 - RNA, 9879 nt, Artificial Sequence
  derived and/or modified CDS sequence (opt6) from DENV-1__GU370048__SS-prME
ucaguaacaaugcuucuaauguuaaugccuacagcauuagcauuucaucuaacaacaagaggaggugaaccgcacaugauaguauccaaacaagaaagagguaaaucacuauuguuuaaaacauccgccgguguuaauauguguacauuaauagcgauggacuugggagaacugugugaagacacgcucaccuauaaauguccucgaauaacagaagcugagccagacgacguagacuguugguguaaugcgaccgauacuuggguaaccuacggaacauguucgcaaacgggugaacaucgucgagauaaacgaaguguagcauuggccccacauguaggucucggauuagaaacuagaacagaaacuuggaugagcagcgagggugcuuggaaacaaauacaaaggguagaaacaugggcuuuaaggcauccgggauucacggugauagcccucuuucuagcacacgcaauuggaacuuccauaacgcaaaaaggaaucauauucauacuauugaugcuuguuacacccucaauggccaugagaugcgucggcaucggaagcagagauuuuguggaaggacuuaguggggccaccuggguugacguaguacucgaacauggauccugugugaccacgauggccaaagacaaacccacauuagauaucgaauuacuuaaaaccgaaguaacuaauccagcaguuuuaagaaaauuaugcauugaggcuaaaaucucaaacacaacuacggacagccguuguccaacucaaggcgaagcuacguuaguugaggagcaagaugcuaauuucguguguagaaggacuuucguugaccguggcugggguaauggaugcgguuuauuuggcaaaggaucucuaauuacaugugcaaaauuuaaaugcguaacaaaauuagaagguaaaauaguccaauacgaaaauuuaaaauacucagugauaguaacuguucauacaggcgaucaacaucaagucggcaaugaaagcaccgaacauggaacgacugcaaccauaacaccacaggcgccaaccacggagauacaacuaaccgauuacggggcguuaaccuuagauuguucgccgagaacaggucuuaauuucaaugagaugguuuuauuaacaaugaaagaaaaaucuugguuaguucauaaacaaugguuucuagacuuaccucuccccuggacgagcggugcauccaccacucaagaaacguggaaccgucaagauuugcuugucacauuuaaaacggcccacgccaagaaacaggaagucguaguguuaggcagucaagaaggggcuaugcauacagcacugacuggugcuaccgaaauucagacgucagggacuacaaccauuuuugcaggccacuuaaaaugucggcuuaaaauggauaaacuaacgcuuaaaggaaugaguuacgugauguguacugggagcuucaaacucgaaaaagaaguugcggagacacaacauggaacgguccuaguucaaaucaaauaugaaggaacagaugcacccuguaaaauaccauucucaacucaagaugaaaaagguguuacccagaauggacgacuuauaacggcgaauccuauaguaaccgauaaagaaaaaccugugaacauagaagcugagccaccguuuggugaguccuauauuguuauuggugcuggugaaaaagcgcuaaaacuuaguugguucaagaaaggaaguucuauagggaaaauguucgaagcaacggcuagaggggcccguagaauggcgauacuuggugacaccgcaugggauuucggaaguauaggaggaguguuuacaaguguagguaaauuaguucaccagauuuuuggaacggcuuacgguguacucuuuagcggaguaucuuggacgaugaaaaucggcauagguguguuacuuacuuggcuagggcugaauagcagaagcacaucguuaucuaugacuugcauagccguaggacuugugacccucuaucuaggggucaugguacaggccgauucuggaugcgugauaaauuggaaaggaagagaguuaaaauguggaucugggauuuucguaacuaacgaaguucauacauggacugagcaauacaaauuucaggcugacagcccaagaaggcuuucggcagccauaggcaaggcuugggaggaaggagucugcggaaucagaagcgcuacuagguuagaaaacauaauguggaaacaaauaucaaaugagcuuaaucacauccuauuagaaaacgacaugaaauuuacuguugucgucggggauguagcaggaaucuuagcucaggguaagaaaaugauaaggccacaacccauggaacacaaauauagcuggaagaguuggggaaaggcaaaaaucauaggugcagacguacaaaacacuacuuuuaucauagacggaccuaauacgcccgagugcccagacgaccagagggcuuggaauauuugggaaguggaagacuauggcuuugguauuuuuacaacgaacauuugguuaaaacuacgugauucuuauacccagguaugugaccacagauuaaugagcgcggccaucaaagauagcaaagccguucaugcagacaugggauauuggauugagagugagaaaaacgaaacuuggaaacuagccagagcaaguuucaucgaaguaaaaacuuguaucuggccaaagucucauacccuuugguccaacgguguucuggaaucagaaaugauaaucccgaaaaucuauggagggccaauaucgcaacacaauuaucgaccaggcuauuucacacaaacugccgguccauggcaccuuggaaaacuugaacuugauuucgaucugugcgaaggaacaacaguugucguagacgaacauugugggaacagggggccuucacugcgcacaacgacuguaacaggcaagauuauucaugagugguguugccgguccugcacucuaccuccuuuaagauuuaggggagaggaugguugcugguacggaauggaaauacgcccagucaaagaaaaagaagagaaccuagucaaaucaauggucagugcugguucaggagaaguggauucuuucucguuaggauuacuauguauauccauaaugaucgaggagguaaugcgcucacgauggucgaggaaaaugcuuauaacggguacuuuggcggucuuuuuccuauugauaaugggucagguaaccuggaacgacuuaauucggcuaugcauuauggugggugcuaacgcuucagaucgaaugggaaugggaacuacauauuuagcauugauggcgaccuuuaaaaugcgccccauguuugcuguaggauugcuuuucagacgacucacuagcagagaaguccuccuguuaacaauaggucuaucucuaguagccucaguggaauuaccaaacucacuagaagaacugggagauggccuggcgauggggauuaugauacuaaaacuauuaacagacuuucagccccaucagcuaugggcaacucuacuaucauuaaccuuuauuaaaacuaccuuuaguuugcauuacgccuggaaaacuauggcuaugguauuaaguauaguuucacuauuuccgcuuugcuuaaguacuacgucacagaaaaccacuuggcuaccuguuuuacuggggucacucggaugcaaaccucugacuauguucuuaauugcagaaaacaaaaucuggggccguaagaguuggccacuaaacgaaggcauaauggcuguugguauaguaucaauacuccucucuucauuacugaaaaaugauguaccauuagcaggaccauuaaucgcaggaggaaugcuuauugcaugcuauguaauaucugguucgucagcagaucucagucuugaaaaggcagcugaaguaagcugggaagaagaagcagagcacucaggagcaagccauaauauccuaguugagguacaagaugaugggacgaugaagauuaaagaugaggaaagggaugacacucuaacuaucuuauugaaagcaaccuuauuagccgucagugguguauauccgcuaagcauuccagcaacgcuauucguuugguacuuuuggcaaaagaagaaacaaagaucuggaguguuaugggacacaccuaguccuccagaaguagaacgggccguacucgaugacgguauauacagaaucaugcaaaggggcuuauuaggccgaucacaaguaggcguaggaguguuucaggaaaacguguuccauacaauguggcaugucacuaggggagcaguacuuauguaccagggaaaaagauuggaaccuagcugggcuagcguuaagaaagaucuaauaucauacgggggcggauggcgucugcaaggaucauggaauacaggugaagaaguacaaguuauagcuguugagccugggaaaaaucccaaaaauguacaaacagcucccggaacauuuaaaaccccugaaggcgaaguuggugcaaucgcguuagauuuuaagccaggcacaucaggcucaccaauuguaaacagagaaggaaagaucgugggucuauacggcaacggaguaguaacaacaagugguacguauguuucggcuauagcucaagcuaaagcaucgcaagaagguccauuaccagagauugaagaugaaguauucagaaaaagaaaucuaacaauuauggaccuacauccuggaucuggaaagacaaggcgauaucuaccagcaaucguacgagaagcgauaaaacggaagcucaggacacugauacuagcaccgaccagaguuguagcaagugaaauggcugaagccuugaagggaaugccaauucgauaucaaacaacagcagugaagucggaacauacggggaaagagauaguggaccuaaugugucaugcaacguuuacgaugcgccugcucucccccguacgaguaccaaauuacaacaugauaaucauggaugaagcccauuucaccgauccuuccucaauagcagcaagaggguauauaaguacccgcguuggcaugggagaagccgcagcgauuuuuaugacagcgacaccgcccggaaguguggaggccuucccacagagcaacgcaguuauccaggaugaggaaagagacaucccagaacgcucguggaauaguggauaugaauggauaacagacuuuccaggaaaaaccguaugguuuguuccuucuauaaagucggguaaugacaucgcgaacugccucaggaaaaauggaaaacgagucauacagcucucacgcaaaacguucgacacggaauaccaaaagacuaaaaauaaugacugggauuacgucguaacgacagacauuuccgaaaugggagcuaauuuuagagcugacagagucaucgauccacgaagaugucuaaaaccuguaauucucaaagacggaccugagagagucauuuuggcggguccaaugccuguaaccguggcuagugcugcgcagagaagaggaagaauaggacgcaaccauaacaaagagggcgaucaauauauuuacaugggccaaccuuugaauaaugacgaagaucacgcacauuggacagaagccaaaauguuacuagauaacaucaacacccccgaagggaucauccccgcacuauuugaaccggaacgggaaaagucugcugcaauagacggcgaauaccgcuuaaggggagaagcuagaaaaacauucguugaacuaaugcgaagaggcgaucuaccaguauggcuuuccuauaaggucgcaucugaaggguuucaauauagcgacaggcgcugguguuucgacggagaaagaaauaaccaaguauuagaagaaaauauggauguagaaaucuggacaaaagagggagaaagaaagaaacucagaccuagauggcuggaugcucggacuuauagugacccauuagcacugagagaguuuaaagaauuugcugcuggccgaaggucggucucaggugaucuuauacuugagauaggaaaacuuccacagcaucuaacacagcgugcgcaaaacgcacuagacaaucuaguuaugcuacauaacuccgagcaaggcgggagggcauaucggcaugcaauggaagaacuaccagauacuauagaaacacuuaugcuauuggcguuaauagcuguucuuacugguggugugacauuauucuuuuuaaguggacguggacuaggcaaaaccaguaucggauuauuauguguaauggccaguaguguccuucuauggauggcauccguggaaccacacuggauagcagcuucgauaauacuagaguucuuuuugauggucuuacuaaucccagaacccgauagacaacguacgccucaagacaaucaauuagcauauguugucauaggauuacuauucaugauuuuaaccguugcagcaaacgaaaugggauuguuagaaacuacgaaaaaggacuugggaauuggacauguggcaguggaaaaucaccaccacgcagcaaugcuagacguagauuugcacccagcauccgcguggaccuuauaugcaguagcgacuacaaucauuacuccaaugaugcgucauacgauagaaaauacaacugccaauauaaguuuaacagcaauugcaaaccaggcagcuauauugaugggacucgacaaaggauggccuauaucuaaaauggauaucggcguaccguuauuagcacugggcuguuacagccaaguuaacccucuuacacucacggcagcugucuuaauguuaguagcacauuacgcaauaauugguccgggacugcaggcuaaagcaacuagagaagcgcagaaacggacagcagcgggaauuaugaaaaaucccacaguagaugguauaguagcuauagaccuagauccagugguguacgacgcaaaauuugaaaaacagcuaggacaaauaaugcuacuuauacuuuguacuucacaaauacuguuaaugcgaacaaccugggcucuaugcgagucuaucacccuagcgacagguccgcuuacgacguuaugggaggguucucccgguaaauuuuggaauaccacgauagcgguuagcauggcaaacauauuucgaggguccuaucuugcaggggcaggccuagccuucucauuaaugaagucgcuuggagggggacgucgaggaacaggagcccaaggagagacauuaggggagaaauggaaaagacaguuaaaccaacuuucaaaauccgaauuuaauacuuauaaaaggagugggaucauggaaguagauagaagcgaagcaaaagaaggauuaaaaagaggugaaacuacaaaacaugcaguguccagggggacagcuaagcuacgcugguuuguugaacgaaaccucguaaagccugaagguaaggugaucgacuuagggugugggaggggaggauggucuuauuacugugcagguuugaagaaagugacagaagucaagggauauacuaaggguggaccgggacaugaagaaccgauuccaauggcaacuuacggauggaaucuuguuaaacuacacagcgggaaggauguguucuucauaccuccagaaaaaugcgacacgcuauuaugugauauuggagaaucuucucccaauccgacgauugaagagggaagaacacuucggguacuuaaaauggucgaaccauggcuacgcggcaaucaauuuuguauaaaaauacuaaacccguacaugccaucuguaguagaaacauuagagcaaaugcagaggaaacacggaggcauguuaguuagaaacccucuaucccgcaauuccacacaugaaauguacuggguaagcugugguacagguaauauuguaucagccguuaauaugaccucacgcaugcuacugaauagauuuacuauggcacauagaaaaccaacauacgaaagagauguagauuuaggugccggaacgaggcacguggcaguugagcccgaagucgcaaaucucgauaucauaggucaaagaauugaaaacauuaagcaugagcacaagucaacguggcauuaugaugaggauaacccuuauaagacaugggcauaccacggaucuuaugaaguaaaacccagcggaagugcaucuucaaugguuaacggcguuguuaaauuacuaacaaaaccuugggauguaauacccaugguuacgcaaauugccaugacagauacaacaccauucggucaacaaagagucuucaaagaaaaaguagauacuagaacaccuaaagccaaaaggggcacugcacaaauaauggaagucacggcgagaugguuauggggguuccuuagccgaaacaagaaaccacguauauguacgagagaagaauuuacucgaaagguucguagcaaugcagcgauaggagcaguauuuguggaugaaaaccaguggaacagcgccaaagaagcuguggaagaugaaagauuuugggaccuaguucacagagagcgugaacuccauaaacaaggaaaaugcgccacaugugucuacaacaugaugggaaaaagagagaagaaacuaggagaguuugguaaagcgaagggaucgcgcgcgaucugguauauguggcucggugcaagauucuuagaguuugaagccuugggauucaugaaugaggaucacugguuuucacgagaaaacucucugucggggguugagggagaaggccuucauaaacuuggguauauauugcgggacauuucuaaaauaccagggggaaacauguaugcugaugauacggcgggaugggacacaagaauaacagaagaugauuuacagaaugaggccaagauaacagauauaauggaaccggaacacgcguuguuagcuaaggcaauauucaaacuaaccuaccaaaacaaaguagugcguguucaacgccccgccaaaaacggaacaguuauggauguaauaucacgaagagaucaacguggaagcggacagguuggaacauacggguuaaacacguucacuaauauggaagcacaacuaauucgacagauggaauccgagggaauauucucuccauccgaacucgagacuccuaauuuggcagaaagaguucuguacugguuagagaaguaugguguugagcgcuugaagcgcauggcgauauccggggaugauugcguaguuaaaccuauugaugaccguuuugcgacugcacucaccgcuuuaaacgauaugggaaaaguacgaaaagauauaccacaaugggaaccuaguaaagguuggaaugauuggcaacaaguaccguucuguucccaucacuuucaccaacugauaaugaaagaugggagagaaauagucguuccuugcagaaaccaggaugaacucguggguagagcacgggugucacaaggagcaggauggaguuuaagggaaacagcauguuuaggaaagucuuaugcacaaauguggcaauuaauguacuuucacagacgcgaucuuagacuggcagcuaacgcgauaugcucagcaguaccaguagacuggguacccacaagucguacaacuuggucgauucacgcacaucaucaauggaugacaacagaggacauguugucaguauggaauagaguuuggauagaggaaaacccauggauggaagauaaaacacauaucucgaguugggaagacgucccauacuuaggaaaacgugaagaccaauggugugguagucucauaggauuaaccgcuagagccacaugggcgaccaacauacaagucgcaauuaaccagguuaggagauuaauagguaacgaaaauuaucuggacuauaugacaucuaugaaacgcuucaaaaaugaaucugauccugagggugcacuuugguaa

SEQ ID NO: 22089 - RNA, 9879 nt, Artificial Sequence
  derived and/or modified CDS sequence (opt6) from DENV-1__KM403627__SS-prME
ucaguaacuaugcucuugauguuacuuccgacugcauuagcauuucauuuaacuacccgcgguggagaaccgcauaugauaguaaguaaacaagaaagaggaaaaagccuguuguuuaaaacgucugcagggguuaauauguguacuuugauugcaauggaccucggagaauuaugugaggacacaaugaccuacaaaugccccagaauaacugaagcagaacccgacgacgucgacugcugguguaaugcuaccgacacuugggugaccuacgguacuuguagucaaacuggagaacaucgaagagacaaacgaucaguagcuuuagccccucacguagguuugggacuugagacgagaacugaaacauggaugucaucagagggagcuuggaggcaaauacaaaaaguugaaacaugggcgcuaagacaucccggguucaccgugauagcauuauuuuuggcucaugcuauagguaccuccauuacgcaaaaagguauaauauuuauacuucucaugcucguuacaccgucaauggcaaugagaugugucggaauuggaaauagggauuuuguagagggauuaagcggagcuacguggguagauguugugcucgaacacggcagcuguguuacgaccauggccaaaaauaaaccuacauuggauaucgaacuauuaaaaaccgaaguuacaaacccggcaguauugaggaaacucuguaucgaagcaaaaauaaguaacacaacaaccgauucuaggugcccuacccaaggagaagcaacccucgucgaggagcaagacgcaaauuuuguuugucgacgcacguuuguugaccgcggaugggggaauggguguggucuauucgggaaaggcagcuuacucacgugugcaaaauuuaaauguguaacaaaacuagaagggaagauuguccaauaugaaaauuuaaaauacagugugaucguuacuguucauacaggggaucaacaucaaguugguaacgaaacgacggaacaugguacaauagcaacgauaacaccacaagcaccuacaucagaaauccaauugaccgacuacggggcucugacuuuggacugcucuccuagaaccggauuagauuuuaacgaaaugguauugcuaacgaugaaagaaaagagcuggcugguacacaaacaaugguuuuuggaccuaccauuaccauggacaucuggcgcuaguacaagucaagagaccuggaaucgucaagacuugcuagucacguucaagacagcccaugcgaagaaacaagaaguuguaguacuuggaucacaagagggagcuaugcauaccgcauuaacaggugcgaccgaaauucagacaaguggaacuacgacgaucuucgcaggacacuuaaaaugucgacucaaaauggauaaauuaacguugaaaggaguuagcuacguuaugugcacggggaguuucaaguuggaaaaagagguagcggagacacagcaugggacuguguuaguacagguaaaauaugaagguacagaugcuccguguaaaaucccaaucaguacucaggacgaaaaaggcguaacccaaaacgggagauugaucacagcuaaucccaucgucacagauaaagaaaaaccaguaaacauagaaacggaacccccuuuuggugagagcuauauugugauaggggcgggagaaaaagcccucaaacuaaguugguuuaagaaagggagcucaauaggcaaaauguuugaagcaacagccagaggggcacguagaauggcaauauugggugauacagcaugggauuucggaucuauaggagggguuuucacaagugucggcaaacuuguccaccaaguguucggcacggcauaugguguucuauuuuccggggugucuuggacgaugaagauaggaauagggauucuacuuacaugguuaggacuuaacaguagguccacaagucuauccaugacuugcaucgcagugggaauggucacacuauaccuaggagucaugguucaagcugacucgggaugugugauaaauuggaaaggacgagaacuuaaauguggauccggaauauucgugacuaaugaaguucauacauggacagagcaauacaaauuccaggcugauucuccaaaaagacuaagugcugcgauuggaaaagccugggaagaaggaguuugcggaauaagaucggccacgagauuagagaauaucauguggaagcagauaucaaaugaauuaaaucauauucuacuagaaaacgauaugaaauucacugugguuguaggcgacgccaacgguauacuuacacaagggaagaaaaugauaaggccgcaaccgauggaacauaaauacaguuggaaauccuggggaaaagcgaaaauaaucggugcagauauacaaaauacaacguuuauaauagacgggccagauacgccugagugcccagacgaucaaagagcauggaacaucugggaaguagaagacuacgguuucgguguauucaccacaaacauauggcuaaaauugagggacaguuauacccaaaugugugaucacaggcuuaugucagcugcaauuaaagauagcaaagcgguacacgcugauaugggauacuggauagaaagcgagaaaaaugaaacauggaagcuagcuagagcuaguuucauagagguaaaaaccugcauauggccccggagccauaccuuauggucuaacggagugcuugagagugaaaugauuaucccaaaaauauauggagggccaauaucacaacauaacuaucgaccaggguacuuuacucaaacugcggguccuuggcaucuugguaaauuagaguuggauuuuaaccuuugugaaggaacgacaguuguaguagacgaacauuguggaaauaggggaccaagucuaagaacgacaacuguuaccgguaagauaauacacgaaugguguugucggucaugcacacuuccacccuuaagauuccgaggugaagauggauguugguacggaauggaaauaagaccaguaaaagaaaaagaagagaauuugguaaggaguaugguaucggccggaaguggcgaaguagauuccuucaguuuaggccuauuauguguauccauuaugauugaagagguaaugcggucucgcuggagucgaaaaauguugaugaccggaacgcuugcaguauucuuuuuguuaauaaugggucaguuaacauggaacgaucuuauaagauuaugcauaauggucggcgccaaugucucugauagaaugggaauggggacuacguaucuugccuuaauggcgaccuuuaagaugagaccuauguucgcuguuggacuauuauuuagaagauugaccagucgagaagucuuacuucugaccauaggacuaucacuuguagccuccguagaacuuccaaauucacuagaagaacugggagacgguuuagcuauggguauaaugaugcuuaaauugcuaaccgacuuccagagucaccaacuauggacaacauuguugagccuaacauuuaucaaaaccacgcuaagucuagauuacgcguggaaaacaauggcuaugguauuaaguauaguaagccucuuuccuuugugccucucuacaacaucacaaaagaccacauggcuuccaguucuauugggaucuuuugguuguaagccacuaacuauguucuugauaaccgagaauaaaauauggggccgcaaaagcuggccgcugaacgaagguauaauggcaguaggcauagucaguauucugcuaucgucgcuacucaaaaaugauguaccccuagcggggccucuaaucgcuggagguauguuaauugccuguuaugugaucagcgggagcucugcugacuuaucgcuugagagagcagccgaaguaucaugggaggaagaagcagaacauuccggugcgucucauaauauucugguugagguucaggaugacggcacuaugaaaauaaaagaugaggaaagggacgauacacuaacgauuuuacuuaaagccacacucuuagcagucucaggcguauauccaaugucaauaccagcaacuuuauucguaugguauuucuggcagaagaagaaacaaagaaguggcguguugugggacacaccuucaccaccagaagucgaaagagccguucucgaugauggcauauaucgcauucuucaacgugggcuucucgggagaagucaaguuggagugggagucuuucaagauggugucuuucauacaauguggcauguaaccagaggggccguuuuaauguaccagggaaaacgauuagaaccuuccugggcaucgguuaaaaaggaucugauuucuuacggggguggauggcguuuccagggaaguuggaauacuggagaagaaguacaagucauugcuguugagccaggcaagaauccuaaaaacguccaaacuacaccaggcacuuuuaagacacccgaaggugagguuggugcaauagcacuugauuuuaaacccggaacaagcggaucaccaaucguuaauagagaaggaaaaaucguagggcuauauggaaaugggguagugacuaccaguggaacguauguaagugcgaucgcacaggcaaaggcaagucaagaggguccucuuccagagauagaagacgaaguguuuaagaaaagaaaccuuaccauaauggacuugcauccagguuccgggaaaacccguagauaucuaccagcaauagugagagaagccauuaagagaaaauuaagaacacuaauacuagcuccaacacgaguaguggcgucagaaauggcugaagcgcuaaaagguaugccuauccgauaucaaacaacagcuguaaaguccgaacauacuggcaaagagauaguggaccuaaugugccaugcuaccuucaccaugcgacuccuguccccuguucgaguacccaauuacaacaugauaauuauggaugaagcacauuucacagauccagcaucgaucgcugcaaggggauauauaucgacaaggguuggaaugggagaagcugccgcaauuuucaugaccgcaacgccacccgguagcgucgaguccuucccgcaaucaaacgcggugauucaagacgaagagagagacauuccugaacgaucauggaacucaggguaugacuggauuacagauuucccgggaaagacuguaugguuugugccuagcauuaagagcggcaaugacauagccaauuguuugcggaaaaaugguaagcggguaauacaacuaucgaggaaaacuuuugauaccgaguaccagaaaacuaaaaauaacgacugggauuaugucgugacaacagauauaagugaaaugggugcaaauuuuagggcagauagaguuaucgauccgcgcagaugucugaaaccugucauauugaaagaugggccggaaagagugauccuugcagggccgaugccaguuacagccgcaucggcagcacaaagaagaggaagaauaggaagaaaccaaaauaaagaaggagaucaguauauauacauggggcaaccgcuaaauaaugaugaagaucacgcucacuggacagaggcaaaaauguuauuggauaacauuaacacaccggagggcaucauaccggcauuauuugaacccgaaagagaaaagagcgcugcgauagacggagaauaucgccuucguggggaagcaagaaagacauuuguagaacuaaugagaaggggagaucucccaguauggcuaucguacaaaguagcaucugaagguuuucaauauucagacagaagaugguguuuugacggugaacgcaacaaucaagucuuggaggaaaacauggacguugagauauggaccaaagagggggaacggaagaaauuacgcccgagguggcuagaugcucguacuuacucagauccauuagcauugcgagaauuuaaagaauuugccgcaggacgcaggucaguuucuggagauuugauucuagaaauugguaaacuaccacaacauuuaacucuaagagcucagaaugcauuagacaacuuagugaugcuacacaacucagaacagggaggaaaggcuuauagacacgccauggaagaacuaccggauacaauugagacgcuuauguuacuagcacuuaucgccguacuuacagggggaguaacgcuauucuuucucagugguaagggacuagguaaaaccucuaucggguuauuauguguuauggcuucaucaguauuauuauggauggcaagcguagagccgcauuggauugccgcaagcauuauacucgaguucuuuuugaugguacuauugauucccgaacccgaucgacagagaacgccucaagauaaccaacuggcauacgucguuauuggacuacuuuuuaugauuuuaacaguagcagccaaugaaaugggacuucuagaaacaacgaagaaagacuuggguaucgggcaugugguagcagaaaaccaucaucacgcaacuauguuagacaucgaccuucauccagcaucugcauggacgcuuuacgcagucgcaaccacaaucauaacaccaaugaugaggcauaccauagaaaacacgacagcuaacauuucacugacagcaauagcaaaccaagcagcaaucuugaugggguuagacaaaggauggccaaucaguaaaauggacauuggaguaccccucuuagcauuagguuguuauagccaggugaauccauugacguuaacugcagccguucugaugcuaguggcucauuacgcuauaauagguccgggucuacaagcuaaagcgaccagagaagcacaaaagcgaacagccgcgggcaucaugaagaacccaacaguagauggaauagucgcaauugauuuagacccaguaguuuaugaugcuaaauucgaaaagcaacugggacagauuaugcuguuaauauuaugcacgucacaaauuuuacucaugagaaccaccugggcacugugugaaucaauaacacuggcuacgggcccguuaacaacucuaugggagggaagccccgguaaauucuggaauacaacuauagccguaaguauggccaauauuuucagaggaucuuacuuagccggugcuggacuggcauucucgcuuaugaagagucuagguggcggaaggcggggaacaggcgcucaaggcgaaacccuaggagagaaauggaaaagacaauuaaaucaacucuccaagagcgaguuuaauacguauaagagaucagguauaauggagguugaucgaucagaagcuaaggagggccuaaagcggggugagacaacgaaacaugccgucaguagaggaacugcaaaauugcgaugguuugucgagagaaauuugguuaaaccggaggguaaaguuaucgaucuugguugugggaggggaggguggucauacuauugugccgguuuaaagaaaguuacggaggucaaaggcuacacaaagggcgguccuggucaugaagaaccgaucccgauggcaacauacggauggaauauaguuaaacuacacucagggagagauguauucuuuaccccaccggaaaaaugugauacauuauuaugcgacauaggagaauccaguccaaacccuacuaucgaagaaggaagaacauuaaggguauuaaagauggucgagccauggcugcgggguaaucaauuuuguaucaaaauacuaaauccuuauaugccuucagugguugaaacuuuagagcaaaugcaaagaaaacaugguggcauguuaguaaggaacccgcucagucguaacucaacucacgagauguauuggguauccuguggaacagguaauauuguauccgcgguuaauaugacgagccgaauguuacuuaauagauuuacaauggcacauagaaaaccuacauaugaaagagauguagacuugggagcaggaacaagacacgucgccguggaacccgaaauagcgaauuuagacauaauaggccaaagaauagaaaauaucaaaaaugaacauaaaucuacuuggcauuaugacgaagauaauccauauaaaaccugggccuaccauggaaguuaugaaguuaaaccaucgggaucagcgagcaguauggucaaugguguagucagacuacuuacaaagccgugggauguuauuccgaugguaacacaaaucgcgaugacagacacaaccccauuuggucagcaacgaguuuuuaaggaaaagguagauacacgaacgcccagaccaaaacgagguaccgcccaaauuauggaagucacagcaaaauggcuguggggcuuuuuaucgcgaaacaagaaaccaaggauauguacucgagaagaauuuacgagaaaagucagaucuaacgcagccauaggggcgguguucguggacgaaaaucaauggaacagcgcuaaggaagcaguagaagacgagcgcuuuugggaucuaguacauagagagcgagaauugcauaaacaaggaaaaugcgccacauguguuuauaauaugauggguaagcgugagaagaaauuaggagaauuuggcaaagcaaaaggaucuagggcaauuugguauauguggcuaggggcaagauuccuggaauuugaggccuuagguuuuaugaaugaagaccacugguucucuagggagaauagucucucuggugucgaaggagaaggacuucauaaauuaggauacaucuuacgggauauuucuaaaaucccuggugguaauauguaugcagacgauaccgcagguugggauacaagaauaacagaagacgaucuccaaaaugaggcgaaaaucacagauauaauggaaccagaacacgcuuuacuugcaaccucaauauuuaaauuaacguaucagaacaaagugguucggguacaaagacccgcaaaauccgggaccgucauggaugugauaucaagaagagaccaaagaggaagugggcaaguugguaccuauggccuuaauacguuuacaaacauggaaguacaacuaauaaggcaaauggaaucugaaggcauauuuucaccgucggaauuagaaaauuccaaccuagcggaaagaguacuggacuggcuagaaaaacacggaguugaaagguugaaacguauggcaauuagcggugaugauugcgucguaaaaccuaccgacgauagauucgcaacggcacuaacggcauugaaugacaugggaaaaguaagaaaagacauaccccaaugggaaccaucaaaaggcuggaacgauuggcaacagguuccguuuuguucccaccacuuucaucagcuaauuaugaaagacgggcgagaaaucguuguaccaugucgaaaccaagaugaacucguuggaagggcaagagucagucaaggagcgggcuggucauugcgugaaacagcuugucuaggaaaauccuaugcacaaauguggcaauuaauguacuuccauagacgagaucucaggcuagcggcgaaugcaauauguagugcuguaccgguaaacuggguccccacaaguagaaccacuuggucaauacacgcacaccaucaauggaugacuacugaagacaugcuaucuguguggaaucgugucuggauagaagagaaucccuggauggaggauaagacccaugucaguucaugggaagacguucccuauuuaggaaaacgagaagaccaauggugcgggucucuaauugggcuaacugcucgcgcuacaugggcaacaaauauccagguugcaauaaaucaagugcgacggcugauagggaacgagaacuaucuagauuacaugaccucuaugaaaagguucaagaaugaaucagauccugaaggugcacuaugguaa

SEQ ID NO: 22090 - RNA, 9879 nt, Artificial Sequence
  derived and/or modified CDS sequence (opt6) from DENV-1__KM403584__SS-prME
ucaguaacuauguuauugaugcuucuaccaacagcacuggcauuucaccugacuacaagggguggcgaaccucacaugauaguaucaaaacaagaaagggguaaaaguuuacuauuuaaaacguccgcuggcgugaacauguguacuuugauugcaauggacuugggcgaacucugugaagacacaaugacuuauaaauguccaaggauaacagaggcggagccagaugauguugacugcugguguaacgccacagacacgugggucacguaugggacaugcucucaaacgggugaacaccgcagagacaaaagaucaguugcguuagcuccacacguaggauuaggccuggaaacucgcacagaaacuuggauguccucagagggugcguggcgccaaauacaaaaaguugagacaugggcgcuccgacacccuggguucacagugauagcuuuguuccuagcucaugcuauaggaacaaguauaacacaaaaaggaauuauauuuauauuacucauguuaguuaccccaagcauggcaaugcguugugucggaaucggaaacagagauuuuguugaaggucuuaguggagcaacguggguugacguuguuuuagagcacgguaguugcguaacgacaauggccaaaaauaaaccaacauuagacaucgaacuguuaaaaacggaaguuacuaauccggcaguauuacgaaaauugugcauugaggccaaaauuuccaauacuacaacagacagccguuguccgacgcaaggugaagcgacccuaguagaggaacaggaugcuaacuuuguuugcaggcgaacuuucguggaucgagguugggguaauggcuguggguuauucgguaaagguagcuuauugaccugugccaaauuuaaaugcguuacuaaauuagaaggcaaaauaguacaguacgaaaauuugaaauauagcgugauuguuacuguucauacuggagaucaacaucaaguagggaaugaaaccacagagcauggaacaauagcaacuaucacaccacaagcacccacuucugagguacaguuaacagacuacggagcuuuaacacuugacugcaguccuagaacaggucuggauuucaaugaaaugguauuacuuacuaugaaagaaaaaucgugguuaguccacaaacaaugguucuuagaccuucccuugcccuggacaaguggugcuagcacaucucaagaaacuuggaauagacaagaucucuuaguuacguuuaaaacagcucacgccaagaaacaggagguaguaguauuaggaagucaagaaggugcuaugcauacagcacucacuggcgcgacggaaauccagacgaguggcacaacaacuauauucgccggucauuuaaaaugccgucucaaaauggacaaauuaaccuuaaaaggcguaagcuauguaauguguaccggaucuuuuaaacuagaaaaagaaguugcagaaacccaacauggaacgguuuugguacaaguaaaauaugaagguaccgaugcuccauguaaaauaccuaucucaacacaagaugaaaaaggaguaacccaaaacggacgauuaauaacugcaaacccaaucguaacugauaaagaaaaaccuguaaauauagaaacggaaccuccauuuggagaaucauacaucguaaucggggcuggggaaaaagcgcucaaauuaaguugguuuaagaaagggucaucgauugguaaaauguuugaggccacugcgagaggagcacggcggauggcaauuuuaggggauacagcaugggacuucggcagcauaggugguguguuuaccuccguaggcaagcuaguacaucaagucuuugguacagcguacggaguucuuuucucagguguaucauggacaaugaaaauagguauuggcauucuauuaacuuggcuugggcuaaauucacgaucaacaucacucaguaugacgugcauagcaguagguaugguuacacuauaccuagggguaaugguacaagccgacaguggaugcguuauuaacuggaagggucgggaauuaaaaugugguucuggcauauuuguuacaaacgaaguacauacuuggaccgaacaguacaaauuucaagcagauaguccuaaacggcuaagcgccgcaauaggaaaggcuugggaagaaggaguuugcggaauaagaucagcaacuagacucgaaaacauuauguggaaacaaauaucaaacgaguugaaccauauauuacuggaaaacgauaugaaauucacgguaguuguaggagaugcauauggaauacuaacgcaggguaagaaaaugauuaggccacaacccauggagcacaaguacaguuggaagucaugggguaaagccaagauaauaggugcugauacccaaaacacaacauuuauaaucgaugguccugauacuccugaaugcccggaugaucaacgagcauggaacauaugggagguugaagauuauggauucgggguuuucacuacgaacauuuggcugaaacuacgggacucauauacacaaaugugugaucauagacugaugucugcggcaauaaaggacaguaaagcuguacacgccgacaugggauauuggauagaaagugagaaaaaugaaacauggaaauuggccagggccucauuuauagaagucaaaacuuguaucuggcccaggucucauacacuaugguccaacgggguauuagaaucagagaugauuauaccaaaaauauacggagggccgauuucacaacacaacuauaggccaggauauuucacccaaacagccgggccuuggcaucuuggaaaacuggagcuugauuucaauuuaugugaaggcacaacggugguaguagacgaacacuguggaaacagagguccgucacuaagaacaacuacuguaaccggcaaaauaauucaugagugguguugcagaucauguacucuaccuccguuacgauuucgaggagaagauggaugcugguauggaauggaaauaagaccagucaaagagaaagaagaaaauuuaguaagaucuaugguaucagcaggcucuggagaaguugacucuuucucucuuggacuucuauguguaucuauaaugauugaagaagucaugagaucacgguggagucgcaagauguugaugacaggaacauuagcugucuucuuucuacuaauaauggggcaacuuacauggaaugacuuaauccgauuguguauaaugguuggugcuaaugucagcgaucgaauggggaugggaaccacauacuuagcacuaauggcuaccuucaaaaugagacccauguuugcuguuggccuucucuuuagaaggcuaacaagucgagaagugcuacuauuaacuauaggucuaucuuuaguagcgagcguggaacuuccuaauucauuagaagaauuaggagacggauuagcgaugggaaucaugaugcuaaaacuuuuaacggauuuucaaagccaccagcuuuggacaacacuccuuucucuuacauuuauuaaaacuacacuaucucuagauuaugccuggaaaacaauggcaauggucuuguccauagugucguuguuuccauuguguuugucgacaacaucacagaaaaccacaugguuaccgguacuauuggguucguuuggaugcaaaccuuugacgauguucuugauaacugaaaauaaaauuuggggucggaaaucguggccuuugaaugaaggcauuauggcaguagggauuguauccauccuuuugaguagcuuauugaaaaaugacguaccacuggcaggaccauuaauagcaggaggaauguuaauugcuugcuauguuauaucggggucaucggcggaucuaagucuagaaagggcugcugaaguuucaugggaagaggaagccgagcauucaggcgcuucccacaauauacuugucgaaguucaagaugacggcacaaugaaaauuaaagacgaagaaagggaugauaccuugacaauauugcuaaaagcaacauugcuagccgucuccggcguuuauccuaugaguauaccggcuaccuuauuuguaugguauuuuuggcagaagaagaaacaaagauccggaguauuaugggauacaccaucaccuccugagguagagagagcuguauuggaugaugguauauauaggauuuuacaaagaggccuauuggguagaucacaaguaggagugggaguuuuucaagacggaguauuucacacuauguggcacgucaccagaggagcgguauugauguaucaagguaaaaggcuugaaccuuccugggcuuccguuaagaaagaucucauuucuuauggaggaggauggagauuccaaggcucauggaacaccggagaagagguucaaguaauagcuguugagcccgguaaaaaccccaaaaacguacagacgacgccuggaaccuuuaaaaccccugaaggcgaggucggugcuauagcgcuagauuucaaaccagggacuuccggaaguccuaucguuaauagggaagguaaaauugugggacucuaugguaaugguguugugacuacuagcggcacguauguaagugccauagcacaagcaaaagccucccaagaagguccuuuaccugaaauagaggacgaggucuuuaagaaaagaaauuuaacuauaauggacuugcauccuggcucggguaagacacggagauaccuaccugcaauaguacgcgaagcgauuaaacguaaacuucguacacuaauucuagcacccaccaggguaguugcaagugagauggcugaagcauuaaaagggaugccaaucagguaucaaacaacggcuguaaagagugagcauacggggaaagaaauuguugacuuaaugugucaugccaccuuuaccaugcgacuauugagccccguaaggguacccaauuauaacaugauuauaauggaugaagcccauuuuacagacccagcaucaauagcugcgagaggcuauauuagcaccagggucgguaugggugaagcagcagcaaucuuuaugacugcuacuccucccggaaguguggaggcuuuuccacaauccaaugccguaauacaagaugaagaacgugauauuccugaaagaucguggaacucaggauaugacuggaucaccgauuuucccggaaaaacuguuugguucgugccauccauaaaaagcgggaaugauauagccaauugucuaaggaaaaacgguaaaagaguaauacaacucucaagaaagacauucgacacggaauaucagaaaaccaaaaauaacgauugggauuacguaguaacaacagacauaagugaaaugggugcaaacuuccgcgccgaucgaguuauugauccccgaagaugucucaaacccguaauacuaaaggacgguccugagagagugauacucgcaggucccaugccuguaacggcggcgucagcggcacaacgacguggaagaauuggacguaaucaaaauaaagaaggggaucaauauaucuacaugggacaaccacugaauaacgacgaagaucaugcgcauuggacagaggcuaaaaugcuacuagacaacaucaauacaccugaaggaauuaucccugcucucuucgaaccggaaagagaaaaaucugcugcaauagacggagaauauagacugcgaggugaagcucgcaaaacuuuuguagagcucaugcggcguggagacuugccaguguggcuaucuuauaaaguagcgagugaaggauuccaauauucugauagaagaugguguuuugacggggagcgaaauaaccaaguacuugaagaaaacauggauguagaaauauggacaaaggaaggcgaacgcaagaaacuaagaccucguugguuagaugcucgaacauauucggauccguuagcauugcgagaauuuaaagaguucgcagcgggaaggagaaguguaaguggugaccuuauacuugaaauuggaaaauugccucaacauuuaacauuaagagcacaaaacgcuuuggauaacuuaguuaugcuacauaauucagagcaaggagggaaagcauauagacacgccauggaagaauuaccagauaccauugaaacuuuaaugcugcuugccuuaauagccguucuuacaggcggagugacuuuauucuuccugucuggaaaaggacucggaaaaacaucaauagggcuacucugcguuauggccucgagcguucugcucuggauggcaucagucgaaccccacuggauagcggcgaguaucauauuagaguucuuuuuaaugguauuacuuaucccagaacccgauagacagaggacaccacaagacaaucaguuagcauaugugguaauagguuuauuguuuaugauacuaacuguggcggccaacgagauggguuuauuagaaacuacuaagaaagaucuagggauaggacaugucguugcagaaaaucaucaucacgccaccauguuggauauagaucuccauccugcuagugcuuggaccuuguacgcggucgccacuacaauaauaacgccuaugaugaggcauacuauagaaaacaccacagcuaauauuucacuaacagcaauagcuaaucaagcagcuauuuuaaugggcuuagauaaaggauggccgauuucgaaaauggauauuggaguaccacuacuagccuuaggcuguuauucgcaagugaacccacuuacccucacugcugcgguccuaauguuaguagcucacuacgcgauaaucgggccaggcuuacaggcaaaggcaaccagggaagcucagaagagaacagcagcaggaauaaugaaaaauccgacaguugauggaauuguagccaucgauuuagauccugucguuuacgacgcuaaauuugaaaaacaacuugggcaaauaaugcuuuuaauacuuugcaccagucaaauauuauuaaugcggacgacuugggcauugugugaaucuaucacuuuagcgaccgguccauuaacuacuuuaugggaaggaucaccggggagauuuuggaacacuacuaucgcaguaucaauggcuaacauauuuagaggaaguuauuuagccggcgcugguuuggcauucucauuaaugaaaucauugggaggaggucgcagagguacaggagcgcaaggagaaacuuuaggagaaaaauggaaaagacaguugaaccaacuaucgaaauccgaauuuaacaccuacaaacguagcgguauaauggaaguagaucgaucggaagcaaaagaggguaugaagagaggggaaacaacgaaacaugcagucucccgugggaccgccaaacuuaggugguucguagagcgaaaccugguaaaaccggaaggaaaggucauagaucuaggcugcggucgagguggaugguccuauuacugugccgggcucaagaaaguaaccgaaguuaaaggauauacuaagggcggacccggccacgaggaacccauaccgauggcaacuuauggauggaauaucguaaaacugcauucagggcgcgauguguucuuuacaccaccagaaaagugcgauacauuauugugugacauaggugaauccucuccaaaucccacaauagaagaaggccgaacuuugcgagugcuaaaaaugguagaaccuuggcuaagagggaaucaauuuugcauaaaaaucuuaaauccauauaugccaucagugguagaaacgcuggagcaaaugcagagaaaacauggugguaugcuaguuagaaacccuuuguccaggaacuccacccaugaaauguacuggguuagcuguggaacagguaauauuguaucagcuguuaacaugacaaguaggaugcuacugaaccgguuuacaauggcucacagaaaaccaacauaugaaagagacguugaucuaggggcaggaacacgucauguugcuguagaacccgagauugcgaaucuugauaucaucggacagagaauagagaacauaaagaaugaacacaaaucaacuuggcauuaugacgaggauaauccauauaagacaugggcauaccauggaagcuacgaagugaagccgagcggaagugcaucuucgauggucaacggaguaguccgucuucuuacuaaaccgugggaugucauaccgaugguuacucaaauagcuaugacagauaccacuccuuuuggucaacaacguguuuuuaaggagaaagucgacacaagaacuccuagaccuaagagaggaacagcgcagauuauggaggugacagccaaauggcucuggggguuuuugagcagaaacaaaaagccucguauauguacaagggaagaguuuacccguaaaguucgaaguaaugccgcgauaggcgcaguauuuguggaugaaaaccaauggaacucggcuaaagaagccguagaagacgaacgauucugggacuuaguucauagagaaagggaacugcacaaacaggguaaaugcgcaacaugcguuuauaacaugauggggaagcgagaaaagaaacuuggagaguucggaaaggccaagggaagccgugccauaugguauauguggcuaggcgcuagauuucuugaauuugaagcauuaggcuuuaugaaugaagaccacugguuuucacgugaaaauucacuuucaggcguagagggagagggccuccauaagcuaggguacauuuuaagggacaucucaaaaauaccggguggaaacauguaugcugaugauaccgcuggaugggauacacgaaucacugaagacgauuugcaaaaugaagcgaaaauaacugauauaauggaacccgagcacgcucuccucgcgacaucgauuuuuaagcucacuuaucaaaacaagguaguuaggguacaaagaccggcaaaauccggaaccguuauggaugugauaucuaggagagaccagagagguucuggccaaguuggaacuuacggacucaacaccuuuacgaacauggaggugcagcuuauccggcaaauggagucugaaggaauauuuagcccauccgaauuggaaaacaguaacuuggcggaaagaguuuuagauugguuggagaagcacggcguagaacggcuuaaaaggauggcaauaucuggugacgacuguguuguaaaacccacugacgauagauuugcuacugcucucacggcacuaaaugacaugggaaagguacguaaagacauaccccaaugggagcccaguaaaggauggaaugauuggcaacaaguaccauucuguucacaccauuuucaucaauugaucaugaaagacgggagagaaaucguagucccuuguaggaaccaagacgaacuugugggacgugcacggguuagucaaggagcaggcuggucuuuaagagaaacagcuugucuagggaagaguuacgcacaaauguggcagcucauguauuuucaucgacgugauuuacgguuagcugcaaacgccauuuguucggcuguaccugugaauugggucccaacaucaagaacaacuuggucuauccacgcacaccaccaauggaugacaacagaagauaugcugagcguuuggaauagaguguggauagaagaaaacccauggauggaagauaaaacacaugucucaucaugggaagauguuccuuaucuaggcaaaagagaagaucaauggugcgggucacuaauuggauuaaccgcacgagcgacaugggccacaaauauccaaguagcaauuaaccagguaagaagacuuaucggaaacgaaaauuauuuagauuacaugaccucaaugaaaagauuuaaaaaugaaucggacccugagggagcguuaugguaa

SEQ ID NO: 22091 - RNA, 9879 nt, Artificial Sequence
  derived and/or modified CDS sequence (opt6) from DENV-1__KM403633__SS-prME
ucagucacuaugcucuuaaugcuuuuaccuacugcauuggcauuucaucugacuacaagaggcggcgaaccacacaugauuguauccaaacaagaaagagguaaauccuuacuuuuuaaaaccucggcaggcguaaauauguguacacuuauagcgauggacuuaggagagcuuugugaagacaccaugacauacaaaugcccaaggauaacagaagcagagccagaugauguugauuguugguguaaugcaacggauacaugggugacuuauggaacuuguucccaaacaggcgagcaucgaagagacaaacgaucuguagcgcuagcaccucacguaggauuagguuuagaaacaaggacagaaacuuggaugagcucagaaggugcguggcgucaaauacaaaaaguugaaacaugggcguuaaggcacccgggauucacagugauagcuuuauuucuugcucaugcuaucgguacaaguauaacgcaaaaaggcauaaucuuuauacuccuuaugcuaguaacgccaucuauggcaaugagaugcguagggauuggaaaccgggauuucgucgaaggcuuaucuggggcaacgugggucgauguaguauuagagcauggcucaugcguaacgacuauggccaaaaauaaaccaacgcucgacauugagcuacuuaaaacugaaguuacgaacccugcaguuuuacggaaauuaugcauagaagcuaaaauaucaaacaccaccacugacagcagaugcccaacucaaggagaagcgacgcuagucgaagaacaagacgcaaacuuuguauguagaagaacguuugucgauagaggcugggguaacggaugcggauuguuuggcaaaggcucucuucucacaugugcaaaauuuaaaugcgugacuaaauuggaagguaaaauuguacaauaugagaaccuaaaauauucaguuauaguuaccguccacacaggcgaucaacaucaaguuggaaacgaaaccaccgaacacggaaccauagcgaccauaacaccccaagcaccuacaucugaaauucaauuaacugauuauggggcguuaacccuagauugcagucccaggaccgggcuagauuuuaacgaaaugguuuuacuuaccaugagggaaaaaucaugguuaguucacaaacagugguuccucgaccuaccgcucccauggacaucaggcgcuagcacgucucaagaaacauggaacagacaagaccuuuuaguuaccuuuaaaacagcacaugccaagaaacaagaaguuguuguacuaggaucacaagaaggagcaaugcacacggcauuaaccggcgcaacugaaauucagacaaguggaaccaccacuauuuuugcgggacaucuaaaaugcagauuaaaaauggauaaacuaacacuaaaaggagugucuuaugucauguguaccgggaguuucaaauuggagaaagaaguugcagaaacgcagcacgggaccguccuaguucaaguuaaauacgaaggaacagacgcaccuugcaaaauuccgauuagcacacaagaugaaaaaggagucacccaaaaugguaggcugauaacugcaaauccaaucgugacagacaaagaaaaaccagugaauauagaaaccgaaccaccuuuuggagaaucuuauauagucauaggugccggugaaaaagcacucaaauuaucaugguucaagaaagguaguucaauugggaaaauguuugaggcaacagcucgaggugcacgacguauggccauacuuggagauacugcuugggauuucggauccauagguggagucuuuaccucgguaggaaaauuaguccaucaaguauuuggcaccgcauauggcguacuguuuagcggaguuaguuggacuaugaaaaucggaauagguaucuugcuuacaugguugggcuuaaauaguagaaguaccucacuaagcaugacauguauagcuguagggaugguuacccuuuaucugggaguaaugguacaagccgauucuggaugcguuauuaacuggaaagggcgugaauuaaaaugugguagcggaauuuuugugacaaaugaaguucauaccuggacagaacaauauaaauuucaggcagauucuccgaaaagauugagugcggcuauaggcaaagcaugggaagaagguguaugcggcauaaggucagcgacucguuuagaaaauauuauguggaaacaaauaucgaacgagcucaaucauauauuacuugaaaaugauaugaaauuuacaguaguaguuggagaugcgaacggaauacuuacacaggguaagaaaaugaucaggccucaacccauggaacauaaauacagcuggaaauccuggggaaaagcuaaaauaauaggggcugauacacaaaacacaacuuuuauaauagauggaccagacacuccugaauguccugacgaucaaagagccuggaauaucugggaagucgaagauuacggguucgguguguucacuacaaauauauggcuaaaacuucgagauaguuauacacagaugugugaucaucgauuaaugagcgcagcuauaaaagauaguaaagcaguacaugcggacaugggauacuggauugaaagugagaaaaacgaaaccuggaaauuggcucgcgcuagcuuuauagaagugaaaacuugcauauggccucguucacauacgcuauggagcaauggcguauuagaaagugaaaugauuaucccaaaaauuuacggugggccgauuucucaacauaacuacagaccugguuauuucacacaaaccgcggggcccuggcaccuagguaaauuagaauuggacuuuaaccuaugugaaggaacaacaguagugguagacgagcacugugguaaccgaggcccuucuuugcggacgacaacugugacggggaaaaucauacacgaaugguguugucggucaugcacauuaccaccacugagauucagaggagaagauggauguugguaugguauggagauaagacccgucaaagagaaggaagagaaucuuguucguuccaugguuagugccgguucgggagaagucgacucauuuagcuuaggcuuguuaugcgucaguauaaugaucgaagaaguuaugagauccagauggucacggaagaugcucaugacugggacguuagcuguauucuuucuacuaaucaugggacaacucacauggaaugacuuaauucggcuauguauuaugguaggugcaaaugucagugacagaaugggcaugggcacaaccuaucuagcacuaauggccacauucaagaugagacccauguuugcaguaggucuacuauucagacgucuaacuucaagagaaguacuauuacuaacuauuggguuaagccuugucgcuaguguagaacucccaaauucccucgaagaauuaggagacggcuuagccaugggaauuaugaugcuaaaauuguuaacagacuuccaaagucaccaacuauggacuacauuacuuucacugacauucauuaagacaacacucagccuagacuaugcuuggaaaacaauggcuaugguuuuaagcauuguuucuuuguuuccccuauguuuaucuacuacuucucagaaaacaacuuggcucccgguguuacuaggcucguuuggguguaaaccauuaacuauguuuuuaaucacugagaacaagauauggggcagaaaaagcuggccuuugaaugagggaaucauggccguggguauagugucgauccuuuugucuucacucuugaaaaacgaugucccauuagcagguccucugauugccggcgguaugcugaucgcauguuauguaaucucggguucuucggcugaucuaucuuuagaacgugcagcugagguaagcugggaagaagaagcggaacauucaggugcgucccauaacauauuaguugaagugcaggaugacgguacaaugaaaauaaaagacgaagaaagagaugauacauugacgauuuuacugaaggcuacauuacucgcaguuucaggaguauacccaaugucaauucccgcaacguuguucguaugguauuucuggcagaagaagaaacaacgaaguggcguccugugggauacaccgucgccuccagaaguugagcgcgcuguucuggacgacgguauauacagaauccuacagagaggucuucucggccguucacagguugguguugguguguuccaagauggaguauuccauacuauguggcacgucacucggggcgccguacucauguaucaagguaaacguuuggaaccgucaugggcaucggugaagaaagaccuuauuagcuauggugguggauggagauuucaagguucguggaacacuggugaagaggugcaaguuaucgcuguugaacccgggaagaaccccaaaaauguacaaacaacacccggcacauucaaaacaccugaaggggaaguaggugcaauagcacuugauuucaaaccaggcacaagcggaaguccuauaguaaacagggaaggaaaaauagucgggcucuacggcaacggugugguuacaacaucugggacauacguuagugcuauugcacaagcaaaagcaucacaggaaggaccccugccagaaauagaggacgaagucuucaagaaacgaaaccuaacuaucauggaccuucacccaggaagugggaaaacuagacgauauuuacccgcaauagucagggaagcgauaaaaaggaaauuaaggacauuaauacuugcaccgacaagaguagucgcaucggaaauggcagaagcacuuaaagguaugccaauccgcuaccaaacaacggcggucaaaucggaacacaccgggaaggagauuguagauuuaaugugucacgcaacuuuuacuaugcgauuacuauccccuguuagagugccaaauuauaacaugauuaucauggacgaagcucauuucaccgauccggcaagcauugcagcacguggguacauuuccaccagaguagggaugggugaagcggcugcuauuuuuaugaccgcaacuccgccugguaguguagaggcuuuuccucaaucaaaugcaguaauacaagacgaagaacgugauauaccugaacguucauggaacuccggauaugacuggaucacugacuucccggguaaaacuguaugguucguccccaguauuaaauccggaaaugauauugccaauuguuuaaggaaaaauggaaagagagucauucaacuuucccgcaagacuuuugauaccgaguaccagaaaacuaagaauaacgauugggauuacguuguaacaacugauauuucagaaaugggagcuaacuuucgcgcagauagaguuauugacccacggagaugucugaaacccgucauuuuaaaagaugguccagaacgagucauacuagccggaccaaugccuguaacagcggcaucggcugcacagagaagaggcaggauuggccgaaaucagaacaaagagggcgaccaauauauuuauaugggccagccauugaauaaugaugaggaucacgcacacuggacugaagcaaagauguuauuggacaacauuaacacuccugaaggaaucaucccggcauuauuugaaccugaaagagagaagagugcugcaauagauggugaguauaggcuuagaggggaggcaagaaaaacuuuuguggaauuaaugaggagaggcgaucuuccaguuugguuaucuuacaaaguagcaagcgagggauuucaauacucagauagaagaugguguuucgauggagagagaaauaaccaaguauuggaagaaaacauggauguugaaaucuggacaaaagagggagaaaggaagaaacuuagaccacgcugguuagaugcaagaacuuacagcgacccguuagcacuaagggaguucaaagaauuugcggcgggacgucgcucggugucaggcgaucugauauuagaaauaggaaaacuaccacagcaccuaacuuuacgugcgcaaaacgcucuagauaaccucgugaugcugcauaauagcgagcaaggcgguaaagcauacagacaugccauggaagaacucccugauacaauugaaacauugaugcuauuagcauugauugcaguauuaacaggggguguaacacuauucuuucugagcggaaagggucuuggaaaaacaaguauaggguugcuuugcguuauggccuccucggucuuauuauggauggccagcguagaaccacauuggauugcugcuagcauuauacuagaguucuuuuuaaugguauugcuaaucccugaaccugauagacaaagaacaccgcaggacaaucaacuagcguauguugugauaggccuucuauuuaugauucucacugucgcggcuaacgaaaugggacuacuggaaacaacuaagaaggaccuagguauaggccaugugguagcugaaaaucaucaccacgcuacuaugcuagauauagauuuacauccagcaucggcuuggaccuuguaugcuguagccacuacaauuauaaccccaaugaugagacauacgauagaaaacacaacggcuaauauaagccuaacugcaauugcaaaucaagcagccauccuuauggggcucgauaaaggauggccgauaaguaaaauggauauaggaguaccauuacuggcacuaggcugcuacucacaaguuaauccauugacauuaacugcggcaguucucauguuaguggcccauuaugcgaucauagggccgggauugcaagccaaagcaacgcgcgaggcucagaaaagaacagcggcagggaucaugaagaauccuacaguagacggcauuguggcaauugauuuggaucccguuguuuacgaugccaaauuugaaaagcagcugggacaaauaaugcuauugauuuuaugcacaagccagauacugcuuaugagaaccacaugggcccuaugugaaucuauuacccuggccacugggccucuaaccacccugugggaggguagcccaggcaaguuuuggaauacgacgauagcggugucuauggccaauauuuucaggggauccuaccuggcaggagcagguuuagccuuuagucugaugaaaucuuuaggagggggaagaagaggaacgggagcccagggggaaacgcuuggcgaaaaauggaaaagacaauugaaucagcugaguaaaagcgaauuuaacacauauaaaagaucaggaauaauggaaguggaccguagugaagcuaaagaaggacuaaaacguggcgagaccacaaaacacgccguuucgcgcggaaccgcgaaacuuaggugguuugucgaaaggaauuuaguuaaaccagagggaaaaguaauagaccucggauguggccgagguggguggaguuacuauugugcaggucuaaagaaaguuacugaaguuaaaggauacacgaaagggggucccggacacgaagaaccuauacccauggccaccuauggauggaacauuguaaaauuacacagcggcagggauguguuuuucacaccuccagaaaaaugugauacauuacuaugcgauauaggagaguccagcccaaauccuacuaucgaagagggcaggacguugcgagugcuuaaaaugguugagccaugguuaagaggaaaccaauucuguauuaaaauccucaauccauauaugccuucaguuguagagacgcuugaacaaaugcaacgaaaacacggagguauguugguaagaaacccccuaucccgaaauucaacacacgaaauguauuggguauccuguggaacugguaacauaguuucugcgguaaacaugacaaguagaaugcuauuaaacagauucaccauggcccauaggaagccgaccuaugaaagagacguugaucuuggugcuggaacucggcacguagcggucgaaccugaaauagcaaauuuggauauuauaggccagcggauugaaaauauaaagaacgaacauaaaagcacauggcacuaugaugaagauaauccuuauaaaacaugggcauaccauggaucuuaugaaguuaaacccaguggcagugcaagcuccaugguaaauggaguaguaagauuacugaccaagccaugggauguuauuccaauggugacacaaauagcaaugacggacacuacuccguuuggacaacagagagucuuuaaagaaaaaguugauacuagaacuccgcgaccgaaacgaggaaccgcacaaauaauggaaguaacagccaaauggcuauggggauucuugucccggaacaagaaaccaagaauauguacccgggaggaauuuacacgcaagguacgcaguaacgcagcuauaggagcagucuucguugacgaaaaccaauggaacucugcuaaagaagcuguggaagaugaaagguucugggaccuaguacaccgagagagagaacuccauaaacaaggaaaaugugcgacuugcguauacaacaugauggggaagcgcgagaagaagcuaggugaguuuggcaaagcuaaagguaguagagcuauuugguauauguggcuaggagcucguuuccuagaauuugaagcauuggguuuuaugaaugaagaucacugguuuaguagagagaauagucuaucugguguagagggcgaaggucuucauaaacuuggcuauauauuacgugauauuagcaaaauaccgggcggcaauauguaugccgacgauacagcaggaugggauacacguauaaccgaagacgaucuacaaaacgaagccaaaauaacggacauaauggaaccagaacacgcacugcuugcaacauccaucuuuaaauuaacuuaccaaaauaaaguaguaaggguacaacggccugcuaaaucagguacuguaauggauguuauaaguagacgagaccaacgaggaaguggucagguuggaacguauggcuuaaacacguucacaaauauggaaguacaauuaauacggcaaauggaaucagaaggcauauucagcccaucggaacuugaaaauucuaauuuagcugagaggguauuagauugguuagaaaaacacggaguagaacggcuaaaaagaauggcaauaaguggagacgacuguguagucaaaccaaccgaugaccguuuugccacagcgcuuaccgcacucaaugauaugggaaaaguuagaaaggauaucccgcagugggaacccucaaaaggcuggaaugacuggcaacagguaccauuuuguucacaccauuuccaucaacuaauaaugaaggaugggagggaaauaguaguaccauguaggaaucaagacgagcuggucggcagagcaaggguaagucaaggcgcgggauggucgcuccgagaaacugcauguuuaggaaagucguaugcacagauguggcaauuaauguauuuccauagacgggauuuacgccuugcggcuaacgcaauauguagugcagugccgguuaauuggguaccuacgucaagaacaacauggucgauacacgcacaccaucaauggaugaccacggaagauaugcucaguguauggaacagaguauggauagaagagaaccccuggauggaagacaaaacccauguaagcagcugggaagacguacccuaucucggcaaacgagaagaccaguggugcggcucacuuaucggauugacggcaagagcgacaugggcgacaaauauacaaguagcaauaaaucagguccgaagacugauuggaaaugaaaauuaucuggauuacaugacaucaaugaaaagauuuaagaaugagucagauccggaaggcgcauugugguga

SEQ ID NO: 22092 - RNA, 9879 nt, Artificial Sequence
  derived and/or modified CDS sequence (opt6) from DENV-1__KM403592__SS-prME
ucuguuacaauguuguugauguuacuccccacugcguuagcuuuucacuuaaccacuagaggaggugaaccucacaugauaguuucuaaacaagaacgggggaaaucauuacucuucaaaacuucagcgggagucaacaugugcacuuuaauugcaauggaucugggugaacuaugcgaagauaccaugacguauaaaugcccgcgaaucacugaagcagaaccugaugacguugauuguuggugcaacgcaacugauacauggguuacauauggaaccuguucgcaaaccggugaacacagacgagacaaaagauccgucgcacucgcgccccauguuggacugggacuagaaacucgaacagaaacauggaugaguucagaaggugcauggcgacaaauacaaaaaguagaaacaugggcccuaagacauccuggauuuacaguuauagcacuauuccuugcacaugccauaggcacaagcauaacacaaaaagguauuaucuuuauacuacuuauguuagucacaccuucaauggcgaugcgaugcguagguauagguaaccgagauuucguugaaggcuuaucaggugcaacguggguggacgucguucuagaacauggauccugcguaacuacaauggcgaaaaacaaaccaacccuagauauugaacuuuuaaaaacagaagugacaaauccagcuguccuuagaaaauuguguauugaagcaaaaaucucaaacaccacaacugacucuagauguccuacucaaggagaagcaaccuuaguggaagaacaagacgcaaacuucgucuguagacguacauucguugaccgaggcugggguaaugguugugggcuauuugguaaaggcagcuuacuuacaugcgcaaaauucaaauguguaacaaaacuagaaggaaaaaucguccaguacgaaaaucucaaauacucugugauagucacuguucauaccggcgaucaacaccaaguaggaaaugaaaccacagaacaugguacuauugcgacaauaacuccucaagccccuacguccgagauacaguuaaccgacuauggggcacugacauuggacugcagcccuagaacuggccuagauuuuaacgaaaugguucuacugacgaugaaagaaaaaucauggcuaguacauaaacaaugguuccuagauuuaccucuaccauggacgagcggggccucaacaagucaagaaacauggaaccggcaagaccuauuaguuacauuuaaaacagcucacgcaaagaaacaagaaguuguaguucuaggaagccaagagggagcaaugcauacugcucugacaggagcuacagagauccaaaccagugguacgacuaccauuuuugcaggucaucuuaaauguagguuaaaaauggauaaacuaacuuuaaaagggguuucauauguuaugugcacaggaaguuuuaaauuagaaaaagaagucgccgaaacgcagcacggaacgguauuagugcaaguaaaguaugaagggaccgacgcaccauguaagauacccauaaguacgcaagacgaaaagggcguagcccaaaauggacgguuaauaacagcgaauccgauaguaacagauaaagaaaaacccgucaauauagaaacugaaccuccuuucggggaauccuauauugugaucggugccggcgagaaagcacuuaaauuaucaugguucaagaaaggaucgaguauuggaaagauguuugaagcaacugcgcggggcgccagacguauggcuauauuaggcgauacggcaugggacuucgggaguauaggaggaguuuucacaagcguagguaaguugguccaccaggucuucgguacugcuuacggaguucuauucagcggggugaguuggacaaugaagauaggaauaggaaucuuacugacuuggcuaggccuaaauucucgcucaacgagucuuuccaugacguguauagccguagguaugguuacacuauacuuaggaguuaugguucaagccgacucaggaugcgugauuaacuggaaaggccgagaacuaaagugugguagcggcauuuucguaacaaacgaaguacauaccuggacugaacaguauaaauuucaagcugacuccccaaaaagauuaucugcagccaucgggaaggcuugggaagagggugucugcggaauuagaucagcaacaagguuggaaaauauaauguggaagcaaauaucuaaugaacugaaucacaucuuauuagaaaaugacaugaaauuuacaguaguaguaggcgaugcaaacgggauauuaacgcaagguaaaaagaugauacgaccccaaccaauggaacacaaguacaguuggaagucuuggggaaaagccaaaauaauuggagcagacacacaaaacacaacguuuauaauugaugggcccgacacuccagaaugcccugaugaccaaagagccuggaacauaugggaaguagaagauuacggauucggaguauuuacaacaaacauuuggcugaagcugagggacagcuacacacagaugugugaucacaggcuaaugagugccgcuauuaaagauagcaaagcgguccacgcugacaugggauauuggauagaaucagagaaaaaugaaacauggaaauuagcccgagccaguuuuauagaagucaaaacauguauauggccacggucacauacacuauggucaaacggcguacuagagagugaaaugauaauaccuaaaauuuacgguggucccauaucgcagcauaauuaccgaccaggauacuuuacccaaaccgcaggcccuuggcauuuaggaaaacucgagcuagauuucaaucucugugaagguacgacagugguaguggacgaacauugugggaauagggggcccagucuaaggacaacaacgguuacuggaaagauaauccacgagugguguuguagaaguugcacucucccuccucuuagguucagaggugaggaugguugcugguacgguauggaaauaaggccaguaaaagaaaaagaagaaaaucugguucgcucgaugguaucagccggaagcggugagguagacagcuucucacucggucugcuaugugucucuauaaugauugaggagguaaugagaucacguuggucacgaaaaauguuaaugacagguacccuagcgguguucuuucuuuuaauaaugggacaacuaaccuggaaugaucuuguacgguuaugcauaaugguaggcgcaaauguaucagaccguauggggauggguacuacauaucuugcauuaauggcuacauucaaaaugagaccuauguucgcaguaggacuccuuuuuagacggcuaacaaguagagaagugcuucuacuuaccauuggacuaaguuuaguugcuucaguagaacuaccaaacucucuagaagaguugggggacggguuagcuaugggcauuaugaugcuuaagcugcuuacugauuuucagucacaucaacucuggacgacacuuuugucacuaacauuuauaaaaacuacgcuaagucuugauuaugcauggaaaacaauggcgaugguucuuucaauugucucccuauuuccucuaugccuaagcacgacuagccagaagacuacguggcuacccguguuauuaggaucuuuuggauguaaacccuugacgauguuccugauuaccgaaaauaagauauggggcagaaaaaguuggccacuuaacgaaggaauaauggcaguugggauuguaagcauacuguuaucaucacuacucaaaaaugauguaccgcuagcuggaccacuaauugcaggaggcaugcuuauugcauguuacguaauaagcgggucaucagccgaccucagccuugaaagagcugcagaaguuucaugggaagaagaagcagagcauucgggagcaucgcauaacauauuaguugagguucaagacgaugguacaaugaaaauuaaggacgaggagcgggaugacacacucacuauacugcuaaaagcgacgcucuuggcggucucgggaguguauccaaugucuauuccugcuacauuauuugucugguauuuuuggcagaagaagaaacaacggagcgguguccuaugggauacaccgucuccuccagaggucgaacgagcaguucuugacgauggcauuuaucguaucuuacagcgaggauuacucggcaggucgcagguaggcguaggaguauuucaagauggaguauuccacaccauguggcacguuacaaggggugcuguucucauguaucagggaaaacgacuagaaccaaguugggcuagcgucaaaaaggaccuaauaucguacggcggaggauggcgauuucaagguucauggaacacuggggaagaaguccaagucaucgcaguugaaccgggcaaaaacccuaagaauguucagacgaugccaggaacuuuuaagacuccagagggagaagucggagcaauugcauuagauuucaaacccggaacaaguggaucaccgauaguuaauagagagggaaaaauaguaggguuguauggaaauggcguagugacaacaucggguaccuauguaagugcaaucgcacaagcaaaagcuagucaggaaggcccauugccugaaaucgaagacgagguauuuaaaaagaggaacuuaacuauaauggauuuacaccccggcaguggaaaaacuaggagauaucugccugccauuguuagagaagccaucaaacguaaauugcgaaccuugauucucgcaccaacaagaguuguugcaucagaaauggcggaagcucuaaaagguaugccgauuagauaccaaacaacugcuguaaaaagugaacauacaggcaaagaaaucguggaucuaaugugccaugcuacauucacuaugcgccucuuaagccccgucagagugccgaauuacaauaugauuauaauggaugaagcccacuucacggacccugcuucgauagcugcgaggggcuauauaucuacgcgcguaggaaugggugaagccgcugcgauauucaugaccgcaacgcccccggguucaguagaagcauuuccacagucgaaugccgucauacaagaugaagaaagagacauuccugaacgaaguuggaacucaggcuacgacuggauaacugauuuuccaggcaaaacggucugguucguuccauccauuaaaagugguaaugacauagcgaauugccuaaggaaaaauggaaaacgggucauucaacuauccaggaaaacuuucgauaccgaauaucagaaaacgaagaauaaugauugggauuacguagugacaacagauauuagugaaaugggcgcgaauuuccgagcagacagaguaauagauccgagacguugucugaaaccuguuauucuuaaagaugggccugagagggugauuuuggcugggccaaugccggucacagcggccucagcagcucaacgacguggaagaauaggccgcaaucaaaauaaggaaggggaucaauacauauacaugggucaaccgcuuaauaaugacgaagaucaugcucacuggacugaagcaaaaaugcuucuagacaacauuaacacaccugaaggaauaauaccugcauuauucgaaccggaaagagagaaaagugcugcgaucgacggugaauaccgacuaagaggcgaagcgcggaaaacguuuguugagcuaaugcggagaggagaccuaccuguauggcuaucauacaaggucgcaagugagggcuuucaauauucugaccgcagaugguguuucgauggugagagaaauaaucaaguucucgaggaaaacauggacguggagauauggacaaaggaaggagaaaggaagaaauugagaccaagaugguuagacgcaagaaccuacucagauccccuagcgcuccgagaauuuaaagaguucgcugcagggaggagaucagugucaggagaccucaucuuagaaauaggaaaauuaccucaacacuuaacucuuagagcccaaaaugcgcucgacaauuuagucauguuacacaacucugagcaaggugguaaggcuuauaggcacgccauggaagaauuaccagacacaauugagaccuuaaugcuacuugcuuuaauagcaguucuaacaggaggcgugacccucuucuuucuaagugguaaagguuuagguaaaacgucgauuggcuuguuauguguuauggcaagcagugugcucuuauggauggcgucggucgaaccacauuggaucgcagcauccauuauacuggaguucuucuuaaugguacuauuaaucccugaaccugaucgucagaggacaccucaagauaaucaauuagcauacguagucauaggcuuacuguuuaugauauuaacaguagcagcaaacgagauggguuuauuggaaaccacgaagaaagaucuaggaauuggccaugugguagcagagaaucaccaccacgccaccaugcuagacauagaucuccacccagcaucggccuggacccuuuacgcuguugcuacaacgauaauaacuccaaugaugagacacacaauagaaaauacaacggccaauaucagccuaacagcgauugcuaaucaagcagcaauucucaugggauuagauaaaggcuggccaauaaguaagauggacauaggaguaccauuacuugcccuggguuguuacucucaaguaaacccgcuaacauuaacagcagcuguacugauguuagucgcgcauuaugcuauaauaggcccagguuuacaggcaaaagccacaagggaagcccaaaagcgcacagcagcaggaauuaugaaaaaccccaccguagacggaauuguugccauagaucuugacccagugguuuaugacgcuaaauuugaaaaacagcucggccaaaucauguugcuaauuuuauguacgucacaaauccuuuuaaugcguacaacgugggcguugugugaguccauaacccuagcaaccggacccuugacaacgcuaugggaaggcuccccagguaaauuuuggaauacaacgauagcaguaucuauggccaacauauuucgagguucauacuuagcaggggcugguuuagcuuucagccuaaugaaaucgcuuggaggagggagaaggggaacaggcgcacaaggugagacauugggugaaaaauggaagcgacaauugaaucaacuaucaaagucugaauuuaauacauauaaacguucaggcauaauggagguagauagaucugaagcgaaggaaggacucaagagaggggaaacgacaaagcaugcuguaucgaggggcacagcuaagcuaagaugguuugucgagagaaaucuuguaaagccagaaggaaaagugaucgauuugggaugcggaagaggaggguggucauacuauugugcagggcucaagaaaguaacagaaguaaaggguuacacgaaaggaggaccaggccacgaggaaccgaucccgauggcaacauaugguuggaauauuguaaaauugcauucgggaagagauguauuuuucacuccacccgagaaaugcgacacccucuugugcgauauuggugaaucauccccgaauccaacuauugaagaaggaaggacacuccgaguucucaaaaugguugagccauggcuacgaggaaaccaauuuuguaucaagauauugaacccguauaugccgucuguaguagagacauuagagcaaaugcagcgaaagcacgguggaauguuggugcgaaacccguugagccggaacagcacgcacgaaauguauugggucaguugcgggacuggaaauauagucagugcuguaaacaugacgucaagaauguugcuaaauagauuuacuauggcgcauagaaaaccuacauacgaacgagauguagaucuaggggcugguacaagacauguagcuguugaaccagagauagcaaaucuugauauuauuggacaaagaaucgaaaacaucaaaaaugaacacaaaucuaccuggcauuacgaugaagacaauccuuauaaaacuugggccuaccauggcucauaugaaguaaagccaucagggagcgccucaucgaugguaaauggggucguacguuuauugacaaagccaugggauguuaucccaaugguuacacaaauugcaaugacagacacaacaccuuuugggcagcaaagaguuuuuaaagaaaagguugacacccgaacaccuagacccaaaagaggaacagcacaaauuauggaaguuacugccaaauggcuauggggauuuuuaucaaggaauaagaaaccuagaauuuguacuagagaggaguuuacccgaaaggucagaucgaacgcagcaauaggagccguauuuguagacgagaaucaauggaacucugcgaaagaagcugucgaagaugaaagauuuugggacuuggugcaucgugaaagagaauugcacaaacaaggcaagugugcaacauguguauacaauaugaugggaaaacgagagaagaaauugggggaguucggaaaagcaaaaggaucuagagcaauaugguacauguggcucggagcacguuucuuagaguucgaagcauuaggcuuuaugaaugaagaucauugguuuucaagagaaaauagccuuuccgguguggagggugaaggucuucauaaauuaggauauaucuuaagagauauaagcaaaauaccagguggaaauauguaugcggacgacacugcuggaugggauacucgcauaacugaagaugaucuacagaaugaagcgaaaaucacggauauaauggaaccagaacacgcacuauuggcuacuuccauauuuaaguuaaccuaucaaaacaagguagugagaguccaaaggccggcaaaguccggaacaguuauggauguaaucucccguagagaucaacggggcagugggcaagucggaacguauggucuaaauaccuucacuaacauggagguacaacuaaucagacaaauggaaucagaaggaauauuuaguccaagcgaacuugaaaauucaaacuuagcagagcggguauuagacuggcuagaaaaacauggugucgaaagauuaaaacguauggcuauaaguggugacgauugcgugguaaaaccaacagaugacagauuugcaacagcuuuaacugcauuaaaugauaugggaaaaguaagaaaagauaucccgcagugggagccaaguaaaggauggaaugacuggcaacaaguccccuucuguucgcaccauuuucaucaacuuauuaugaaagacgggagagaaauuguagucccaugucgaaaucaggaugaacuuguuggcagagcuagaguaucacagggagcaggcuggucuuuaagggagaccgcaugucuuggaaagucuuaugcucaaauguggcaauugauguacuuccacaggcgcgauuuaagauuagcugcaaaugcaauuuguuccgcaguaccgguaaacugggucccuaccaguagaacaacuuggucaauucaugcucaucaccaauggaugacaacugaagauauguuaagugucuggaauagagucuggauagaagaaaacccuuggauggaagauaaaacacaugucucaaguugggaagauguaccguacuugggcaaacgagaagaccaauggugugguucguuaauaggacuaacagcacgagcuacgugggcuaccaauauacaaguagccaucaaccaaguaaggcgacuaaucgguaacgagaacuauuuagauuauaugacgaguaugaaacgcuuuaaaaaugaaucugauccagaaggggcauugugguaa

SEQ ID NO: 22093 - RNA, 9879 nt, Artificial Sequence
  derived and/or modified CDS sequence (opt6) from DENV-1__KM403593__SS-prME
agcguaacaaugcuauugaugcuccuucccacggcgcucgcauuucaucuaacaacuagagguggugaaccccauaugaucguuuccaaacaagaaagagguaaaucacucuuauuuaaaacgagcgcaggaguaaauauguguacuuugauugccauggacuugggagaacuuugugaagauacuaugacauacaaauguccgagaauaacagaagcugaaccagaugauguugauuguuggugcaaugcgacagacacaugggucacguacggcacaugcagccaaacaggagagcauagaagagauaaaagaucaguggcacuugcaccccacguaggacuaggcuuagagacccguacggagacauggaugucgagcgaaggugccuggaggcaaauacaaaaagucgaaacgugggcccucagacauccagguuucacugucaucgcauuauuccuggcucaugcaauuggaacauccauuacgcagaaagggauaauauucauauuauugauguugguaacuccuucaauggcaaugaggugcguggguauagggaaucgagacuuuguagaaggcuuaucaggugcaacuuggguagaugucguauuagaacacggaucaugcguaacuacaauggcgaaaaacaaaccuacuuuagauauugaacuauugaaaacagaagugacaaaucccgcaguauuaagaaaacuauguaucgaagcuaaaauaucaaacacaacuacagacucacgauguccgacacaaggagaagcuaccuuaguagaagaacaagaugcuaauuucguguguaggaggacuuucgucgauaggggauggggaaaugguugugggcucuuugggaaggguucacugcuaaccugugcaaaauucaagugugugacaaaacuagagggaaaaauaguacaguaugagaacuuaaaguacucaguuaucguaacuguucacacuggcgaucaacaccagguaggaaaugaaacaacugaacacggaacaauugcuacaaucacuccacaagcaccaacaucugaaauccagcugacagacuauggggcucuaacguuagacugcuccccucguacaggucuagauuuuaacgagauggucuuauugacgaugaaagagaagucguggcuuguccauaaacagugguuuuuagaucuuccacuucccuggacaucuggcgcuaguacaucgcaagaaacuuggaauagacaagauuugcuagugacauuuaaaacagcacaugcuaagaaacaggaagucguaguuuuaggaagucaagaaggugcaaugcauacagcucuuacuggggcaacugagauacaaacuucagggacaacaacaaucuuugcaggucauuugaaauguagguuaaaaauggauaaauuaacuuuaaaaggaguauccuauguuaugugcaccggaaguuucaaacuugaaaaggagguggcagagacucagcacggaacugugcugguacaaguuaaguaugaaggaacugaugcucccugcaagauuccaauaucaacccaagaugaaaaggguguagcacagaacggaagacugauuacggcuaacccgauaguuacugauaaggagaaacccguaaacauugagaccgaaccaccuuuuggugaaagcuauaucgugauuggugcuggagagaaggcucuaaaacugucuugguuuaaaaaggguucaagcauugguaaaauguuugaagcuacagcaagaggagcgagacguauggcuauacucggggauacggccugggauuuuggaucaauugguggaguauucacaucgguagguaaacuuguucaucaggucuuuggaacugcauauggaguacucuuuagcggaguaaguuggaccaugaaaauuggaauaggaauauuacuaaccugguugggucuuaauucgcgcagcaccaguuuaucaaugacaugcauagcugucgggaugguuacacuauauuugggcgugaugguacaggcggauuccggaugcguuaucaauuggaaaggacgcgaacuaaagugugguuccgguauuuucguuacgaaugaaguacauacauggacggaacaauauaaauuccaagcagauagcccaaaacgacucucugcugcuauaggaaaggcaugggaggaaggcguaugcggcauacgaagugcuacuagauuggagaauauaauguggaagcaaauaagcaacgaauuaaaucacauccuucuggaaaaugacaugaaauuuaccguuguaguuggagaugcaaacgggauauuaacacaaggcaagaaaaugauacguccacaacccauggaacauaaauauagcuggaaaucaugggguaaagcuaaaaucauaggugcagacacacagaauacgaccuuuauuauugacgggcccgauacaccugagugucccgacgaucagagagcguggaauauuugggagguugaagacuaugguuuuggaguauuuacaacuaauauuuggcuuaaacugagggauaguuacacucagaugugugaccauagauugaugucagcagcuauaaaagacucaaaagcggugcacgcagauaugggcuauuggauugaaagcgagaaaaacgaaaccuggaaguuagcccgagcuucauucauagagguaaaaacauguauauggcccagaagucauacauuauggagcaacggaguuuuggaaucggagaugauaauaccuaaaaucuacgguggaccuauuagccaacacaauuauaggccaggauauuuuacgcaaacugcugggccuuggcaucuuggaaaacuugaauuagauuuuaacuugugugaagggacgacaguaguugucgacgaacacugugguaauaggggacccucucugagaacuaccacaguaacaggaaaaauaauacaugaauggugcugccggagcugcacgcugccaccacuuagguuuaggggcgaagacggauguugguacggaauggaaaucagaccggucaaagaaaaagaagaaaaucuaguacgaucuaugguuucugcagguucuggagaaguagacucauucucauugggauuacuaugcguuucuauaaugaucgaagaagucaugagaucuagguggagucgaaaaauguugaugacuggcacgcuagcugucuucuuuuuauugauuaugggacagcuuacuuggaacgauuuaauaagacugugcauuaugguaggugcaaacguauccgaucggaugggcaugggaacaacauaucucgcuuuaauggcgacauucaaaaugaggccaauguucgcagugggccuguuguucaggagauugaccucccgagaaguauuauuacuuacaauuggucuuucuuugguagcaaguguagaauuaccaaauaguuuggaagaguuaggagacggucuugcaauggggauaaugauguuaaaacuuuuaacggacuuccaaucgcaccaauuguggacgacuuugcuaucgcugacuuuuauaaagacgacgcuaaguuuagauuaugccuggaaaaccauggccaugguacuaaguauugucucacuuuuuccacuuugccucucgacgacgagccagaaaacaacuugguuaccuguacuacuagggucuuuuggauguaagccgcucacaauguuuuuaauuacugaaaauaagauauggggcagaaaaucauggccauuaaaugaaggcauaauggcugucgggauagugucuauccuacuuagcuccuuacugaaaaaugacgugccgcuagcaggaccuuugauagcuggugguaugcuaaucgcuugcuacguaaucuccggcucaagugcagauuugagucuugaacgcgcagcagaaguaucaugggaagaagaagcagaacauagcggagccagccacaacauuuuggucgaaguucaggaugauggaacaaugaaaauuaaagacgaagaacgagaugauacucuaacgauuuugcugaaagcuacacugcuagcuguaagcggcguauauccuauguccauacccgcaacacuauuugugugguauuucuggcagaaaaagaaacaaagaagugggguuuuaugggauaccccaaguccacccgaagucgagcgggcagucuuagacgacgguauuuaucgaauacuccaaagaggucuuuuaggacggucacaagugggaguagggguauuucaagauggcguuuuccacacuauguggcacgucacuagaggggcaguccucauguaccagggaaaacgacucgaacccuccugggcaagcguaaagaaagacuuaauaucauacggagguggauggcgauuccaaggaagcuggaauacgggugaagaaguccaagugauagcuguagagccggguaagaauccuaaaaauguccaaacaacaccuggaacauuuaaaaccccugaaggagaagugggcgcaaucgcacuagauuucaagccaggaaccaguggaucaccaauaguuaaucgagaaggaaaaaucgugggcuuguauggcaacggugucgucacgacaagugggaccuauguaagugccauagcucaagcaaaggcaagccaagagggaccguuaccugagauagaggaugaaguauucaagaaacgaaaccuaacaauuauggacuuacauccugguagugguaaaacucgcagauauuuaccggcaauuguacgagaagcuauaaaaaggaaacuaaggaccuuaauucuugccccgacacgaguuguagcuagcgagauggcagaagcgcuaaagggaaugccaauacgauaucagacuacagcaguuaaaagugaacauacuggaaaagagauaguagaucuuaugugccaugcaacuuuuacuaugagauugcuuucuccgguacguguuccgaauuauaauaugauaauaauggacgaagcacauuuuacagauccugcaucuaucgcagccagaggguauauaucaacccgaguggguaugggcgaagcugcggccaucuuuaugacagcaacaccacccggcagcgucgaagccuuuccccaaucuaaugcuguaauacaagacgaagagagggacauccccgagagaucuuggaacucaggcuacgauuggauaacugauuuuccagguaaaacuguaugguuuguuccuucaaucaaaucaggaaaugauauagcaaauuguuuaaggaaaaaugggaaacgaguaauucaauuaucgcguaaaaccuuugauaccgaauaccaaaagacuaaaaacaaugacugggacuauguuguuacuacugacauaucggaaaugggggcaaauuuuagagcggauaggguuauagacccucgccgcugucucaaaccuguaauacuaaaagauggaccugaaagaguaauucuggcaggacccaugccgguaacagcagcgagugcagcacaacgacgaggaagaauagggcgaaaccaaaauaaggagggagaucaauacaucuauaugggacaaccacugaacaacgacgaagaucaugcacauuggaccgaagcgaaaaugcuauuggauaacaucaacaccccagaagguaucauuccagcccuuuuugaaccagaacgggaaaaaucagcagccauagauggcgaauaucgccuccgcggagaagcaagaaaaacauucguggaauugaugagaagaggagaucuaccuguaugguuaucuuauaaaguagcuucugaagguuuccaauacucggaucgacguugguguuuugacggcgagcguaauaaucaagugcuugaggaaaacauggauguggagaucuggaccaaggagggagaacgcaagaaauuacgcccaagaugguuagaugcucguaccuauucugacccauuggcacucagagaauuuaaagaguucgcagcaggacgacgaagcguaagcggcgaucucauacuugaaauaggaaaguuaccacaacaccucacacuaagagcacaaaaugcuuuagauaaucucguaaugcuacauaacuccgagcaagguggcaaagcauacaggcaugcaauggaagaauugccagauacgauagagacguuaauguugcuugcccucauugcaguacuaacagggggaguaacauuauuuuucuuaucugguaagggccuggguaaaacuucgaucggccuauuguguguaauggcaaguagugucuuguuauggauggcaagcguagagccacauuggauugcugcuucaauaauuuuagaguucuucuuaaugguacuauuaauaccagaaccggaccggcagaggaccccacaggauaaucaacuggcauacguggucauaggccuacuuuucaugauauuaacuguagcagcaaacgaaaugggauuacuugagacaaccaagaaagacuuaggaauugggcaugucguggcagaaaaucaccaccacgccacaaugcuugauauugacuuacacccagccagcgcauggacauuauacgcaguugccacaacaauaauaacaccgaugaugagacauaccaucgaaaacacgacugcuaauauuucauuaaccgccauagcaaaucaagcagcgauccuaaugggacuagacaaggguuggccuauauccaaaauggacauuggcgugccauuguuagcucuaggauguuauagucaaguaaauccguuaacacucaccgcugcuguccugauguugguggcccacuacgcgauuauaggaccuggucuacaggccaaagcuacgcgagaggcucaaaagagaacagcugcuggaauuaugaaaaaucccacagucgacggaauaguagccauugauuuggauccagucguauaugaugcaaaauuugaaaagcaguuagggcaaaucauguuguuaaucuugugcacgagucaaauauuguuaaugagaacaacaugggcacuaugugaaucaauuacacuagccacaggaccacuaacaacucuaugggaagguagucccggaaaauucuggaacacuacaauagcagucucgauggcaaauauauuucguggcucuuaucuagcuggcgccggacuggcauucucauuaaugaaaaguuuaggcggaggcagaagagguaccggagcacagggcgaaacauuaggagaaaaguggaagcgucaacugaaucaacuaucuaaaagcgaguucaacacguauaaaagaaguggaauaauggaaguagauagaucugaagcaaaagaaggucucaaacgaggcgaaacuacaaaacaugcuguuucacgagguacagccaaacuuagaugguucguggagagaaaccuaguuaaaccugaaggcaaagugauugaucuggggugcggcagagguggguggucauauuauugugcagguuugaagaaagugacagaaguaaaagguuacacaaaaggaggacccggacacgaagaaccgauuccaauggcaaccuacggauggaacauagucaaacugcacaguggacgagauguauuuuucacgccgccagaaaaaugugacacauuacuuugcgacauuggugaaagcucacccaauccaaccaucgaggaaggaagaacucuaagaguccuuaaaaugguagaaccauggcuacgaggaaaccaauucuguauuaaaauuuugaauccuuauaugccgucaguaguagaaacacuggaacaaaugcagcgaaaacauggcggaauguuaguuagaaauccuuuaaguagaaauagcacccaugaaauguacugggugagcugugguacaggaaauauaguaucggcgguaaacaugacgagucgaaugcuauuaaacagauuuacgauggcacacaggaagccaacuuaugaacgcgaugucgauuuaggagcagguaccaggcauguggcgguagaaccugaaauagcaaaucucgacaucauaggucaaagaauugaaaacaucaagaaugaacauaaaaguacguggcauuaugacgaagauaauccauauaaaaccugggcauaccauggcucauacgagguuaaaccuucuggaucagcuucuagcauggucaacggagucguaagacucuuaacaaaaccaugggauguuauaccgaugguuacucaaauugcaaugacagauacaacaccauucggccagcaaagggucuucaaagaaaaggucgacaccagaacgccuagacccaaaagagguacagcacaaauaauggaaguuacggcgaaauggcuuuggggauuuuugucuagaaauaagaaaccacgcauauguacaagagaagaguuuacuagaaaagugcggucaaaugcggcgaucggggcgguauucguggaugaaaaucaauggaauagugcaaaggaagccguagaggaugaaagauucugggauuugguccacagggaacgugaguuacauaaacagggcaaaugcgcuaccuguguguacaacaugaugggaaaaagggagaagaaauuaggagaguucgguaaagcaaaagggagccgggcgauaugguauaugugguuaggagcacgauuuuuagaauuugaggcauuagguuucaugaacgaagaucauugguuuucgagggaaaauaguuugucugggguugagggcgaaggauuacauaaacugggauauauacuaagagauauaucaaaaaucccaggugguaacauguaugcugaugauacagcgggaugggacacaagaauuaccgaagacgaucuccaaaaugaagccaaaauaacggacauuauggaaccagaacaugcacuacuugcaacauccauauuuaaauugacauaucaaaacaagguaguucgaguucaaaggccagcuaaauccggaacagucauggaugucauaucaagaagagaucaacgaggaucgggacaaguugggacauacggacuuaacacguucaccaauauggaaguacaauuaauuaggcagauggaaagcgagggcauauuuucucccucggagcucgaaaacaguaauuuagcugagaggguauuagauuggcuggaaaaacacgguguggagcggcuaaagcgcauggcgauuagcggugacgauugcguuguaaaacccaccgaugacagguucgcaaccgcgcuaacagcucucaaugauaugggaaaaguaagaaaggacauaccccaaugggaaccaaguaaaggguggaacgauuggcagcaaguuccguucuguucacaucauuuccaucaacuuauuaugaaagacggaagggaaauuguaguucccugccgaaaucaagaugaacucgucggcagggcaagagucucacaaggagcgggauggucucucagggagacagcaugucuugggaagaguuaugcacaaauguggcaacugauguacuuucauagacgcgaucuucgauuagcggcaaacgcaaucugcagcgcaguaccagucaauuggguaccgacgucacgaacuacaugguccauucaugcacaucaucaauggaugaccacggaagacaugcuuaguguuuggaauagaguuuggaucgaagaaaacccauggauggaggauaaaacucaugucucuucaugggaagacguaccauauuuggggaaaagagaagaucaguggugcggcucccuaauaggucuaaccgcaagggcuacuugggcgacaaacauacaaguggcaauaaaucaagugagacgacugauuggaaaugagaauuacuuggauuauaugacgaguaugaagagauuuaaaaaugaaucugauccagaaggggcacuaugguaa

SEQ ID NO: 22094 - RNA, 9879 nt, Artificial Sequence
  derived and/or modified CDS sequence (opt6) from DENV-1__KM403603__SS-prME
ucaguaaccauguuauuaaugcucuuaccgacugcgcucgcauuucacuugacuacucggggaggugaaccgcauaugauuguguccaaacaagaaagggguaaaucguuauuguuuaaaacuuccgccggugugaauauguguacauugauagcaauggaccugggcgaauuaugcgaagacaccaugaccuauaaaugcccucggauaacagaagcugaacccgacgaugucgacugcugguguaaugcuacggauacauggguaacauauggaaccugcucccagacaggcgaacauagacgcgacaaaagauccguagcuuuagcgccccauguaggucuaggccuagaaacaagaacagaaacauggaugucaucggaaggagcauggcgucaaauccagaaagucgaaacaugggcuuuaaggcauccagguuuuacaguaauagcacucuuuuuggcacaugcaauaggcacgucaauaacacaaaaaggaauaauauuuauacuccuaauguuggucacuccuuccauggcgaugcgauguguggguaucggaaaccgugauuuugucgaggguuuauccggcgcuacauggguugauguaguccuagagcacggaucgugugugacuacuauggcgaaaaacaaaccgaccuuagacauugaacuauuaaaaacggaaguaacaaauccagcaguucucagaaaauugugcauugaagccaaaauaagcaauacgacgaccgauucucguugucccacucaaggagaagcuacgcuuguugaagaacaagaugcaaacuuuguuuguaggagaacauuuguagaucguggguggggaaacggcugcggacuauucgggaaaggaucuuugcuaacgugcgcaaaauuuaaauguguaacgaaauuggagggcaaaauaguacaguacgaaaauuuaaaauauagcguaaucguaacaguccacaccggggaucagcaccagguaggaaaugaaaccaccgaacaugguacaauugcaacaauaacaccacaggcaccuacaucagagauacaacuaacugacuauggagcacuaacucuggacuguagcccucgcacgggacuagauuucaaugaaaugguacuauugacaaugaaagagaaaaguugguugguacacaaacagugguuccuggauuuaccacugccauggacaucaggggcauccacaucacaggagacuuggaaucgacaagauuuauuaguaaccuuuaaaacggcucaugcuaagaaacaagaaguugucguacucggaagucaagaaggcgcgaugcauacagcgcuaacgggggccaccgaaauucaaacaagcgguacgacaacgauuuucgccggacauuuaaaaugucguuuaaaaauggauaaacucacauugaaagguguaucauacguaauguguaccggcagcuuuaaacuugaaaaagagguagcagaaacacaacauggaacaguccuagugcaaguaaaauaugaagguacggacgcacccugcaaaauaccgaucagcacacaagacgaaaaagguguaacucagaacgguagguuaauaacugcaaauccuauaguaacggacaaagagaaaccuguaaauaucgaaacagagccaccuuuuggugaaucuuacaucguuaucggagccggagagaaagcucucaaacugaguugguuuaagaaaggauccucaauuggcaaaauguuugaagcaacagcuagaggagcgagaagaauggcaauauugggggacaccgcuugggauuucgguucgauugguggcguauucacaaguguuggaaaauuaguucaccagguauuuggaacugcuuaugggguucuauuuagcggcguaucguggaccaugaaaauagggauaggcauauuacuuaccugguuaggccuuaacuccagaucaacuucgcuaagcaugaccugcauagcgguagggaugguaacucucuaucuaggaguuauggugcaagcagauagcggcuguguuauuaauuggaaaggacgcgagcugaaaugcgguucaggcauuuucguuaccaacgagguucacacauggacugaacaguauaaauuccaagcugauuccccaaaacgucucucagcugcaauagguaaagcaugggaagaaggaguaugcggaauuagaucugcaaccagacuagaaaauaucauguggaaacaaauaucaaacgaacuuaaucacauuuugcuagaaaacgauaugaaauuuaccgucguaguaggagaugcuaacgguaucuuaacacaaggcaagaaaaugauuagaccucagccgauggaacauaaauauucauggaaaucguggggaaaagcaaaaauaauuggagccgacacucaaaauaccacauucauaauugacgggccugacacaccugaaugccccgaugaucaacgcgcuuggaauaucugggaaguagaggacuacggauucgggguguuuacuaccaacauuuggcuuaaauuaagggauaguuauacucaaaugugcgaccauagauugaugagcgcagcaauuaaagauagcaaagcgguccaugcggauaugggauacuggaucgaaagcgagaaaaacgaaacguggaaauuagcaagggcaucuuuuauagagguaaaaacuuguaucuggccaaggagucacacucuuuggaguaauggaguuuuggagagcgaaaugaucauaccaaaaauauauggugguccgaucucucaacacaacuauagaccggguuacuuuacccaaacagcagggccuuggcaccucggaaaguuagaauuagauuucaaccucugugaaggaacaacggucguaguugaugaacacuguggaaaucguggaccaaguuugcgcacuacuaccguuacuggaaaaauaauucacgaguggugcuguagauccugcacacuaccuccacuaagauuccgaggugaagauggauguugguacgggauggaaauaagaccagugaaagaaaaggaagagaaucuaguuaggagcaugguaagugcuggaucgggggaagucgauaguuuuucguuaggucuucuuugugugagcauaaugauugaagaaguaaugaggucacguuggucuaggaaaaugcugaugaccggcacauuagcuguguucuuucuacucaucaugggacaacucacguggaacgauuugaucagacuaugcauaaugguuggugcuaacguaagcgacaggauggggaugggaacaaccuacuuagccuuaauggcgacauuuaaaaugcgaccaauguucgcaguaggacuucucuucagaagacuuacaaguagagaggucuugcuacucacaauagguuuguccuuaguagcaucaguugaauuaccaaacucgcuagaagaguuaggcgauggccuggcaaugggaauaaugaugcugaaacuauuaacggacuuccagagucaccaauuguggaccacauuacuaucauuaaccuuuauuaagaccacgcugucacuagacuacgcauggaaaacgauggcgaugguucucaguauaguuaguuuauuuccccuauguuuaucgaccacgucacagaaaacgaccugguuaccugugcuguuaggaucauuuggguguaaaccacucacaauguuuuuaauuacugagaauaaaauuuggggucggaaauccuggccacugaaugaagggaucauggcugucgggaucguuuccauacuccuaaguaguuuacuuaaaaaugauguuccucuggcagguccacuuauugcagggggaaugcuaauagcauguuaugucauaaguggcucaagugccgaccuuucacucgaacgugcagccgaaguaaguugggaagaggaggcugaacauucgggcgcaucucacaauauucucguagaagugcaggaugacgguacaaugaaaauuaaggacgaagaacgagaugauacacucacuauccucuugaaggcgacuuuguuagcugucucgggugucuacccaaugucaauaccagcaacauuauuuguaugguacuuuuggcaaaagaaaaagcagcggaguggaguacugugggacacuccaagcccuccugaaguagaacgagcaguucuugaugacgguauuuaucguauauuacaaagaggccuauugggaagaucacaaguuggagugggaguuuuccaagacgguguguuccauacaauguggcaugucaccagaggugcggugcuaauguaccaaggaaaaagauuggagccaaguugggcuucaguaaagaaagaccugaucaguuauggcgguggauggagauuucaagguagcuggaauacaggagaggaaguacaaguuauagcuguggaaccggguaaaaacccgaaaaauguccagaccacaccagguacuuucaaaaccccagaaggcgaagucggugcaaucgcacuugauuucaaaccugguaccagcgguucaccuauaguaaaccgugaagggaagauaguaggcuuguacggaaauggagucguaacaacaagugguacuuauguaucggcuauugcucaagccaaagcgucacaagaaggaccccucccggaaauugaagaugaaguauuuaagaaaaggaaucuuacgauuauggaucuacacccagguaguggaaaaacaagacgauaucuaccagccauugugagagaggcaauuaagcgcaaacuacgaacauuaauucuagcaccuacacgaguuguggccucagaaauggcugaagcccugaaaggaaugccgauaagguaucaaacgacagcgguaaaauccgagcacacaggcaaggaaauaguagauuuaaugugucaugccacuuucacuaugagacuauuauccccugugagagucccgaacuauaacaugauaauuauggaugaggcacacuucacagacccagcaucaauagcagcacgaggauauaucucaacucgcguaggcaugggcgaggcugcagcaauauuuaugacugcaacaccaccaggaaguguugaagcauucccgcaaucaaacgccguaauacaagacgaagaaagggacauaccggagcguucauggaacucaggauaugauuggauuacugauuucccaggcaaaaccguaugguuuguaccaucaauuaaauccgguaaugacauagcgaauugcuugaggaaaaaugguaaaagagugauacaacuaucgagaaaaaccuucgauacugaauaucagaaaacaaagaauaaugacugggauuauguggugaccacugauauuucggaaaugggagcuaauuucagagcggaccggguuauagauccaagacguugcuuaaaaccagugauuuuaaaagauggucccgaacguguaauacuggcggguccaaugccuguuacagcugcaucagcugcucaacgacgcggcagaauagguagaaaucagaauaaagaaggcgaccaguacauuuauaugggacaaccguuaaauaacgaugaagaccaugcgcauuggacagaagcaaaaaugcuuuuagauaauaucaauacaccagaagguaucauaccggcuuuauuugaacccgaacgugagaaaagugcagcaauagacggggaauauagauugcguggggaagcccgcaaaacuuucguugaacuaaugagacgaggcgauuugccagugugguuaaguuacaaaguugcgagugaagguuuccaauauagugauaggcgaugguguuuugauggcgaacguaauaaccaaguauuagaggagaauauggauguagaaauuuggacaaaagaaggagaacgcaagaaauuacgcccaagauggcucgaugcuagaaccuauagcgacccauuagcuuuacgggaauuuaaagaauuugcagcggggagacguucaguuaguggugaucuuauuuuagaaauugguaaacuaccacaacacuuaacauuaagagcacagaaugcucucgauaauuuaguaauguuacacaacuccgaacaaggaggaaaagcauaccgucacgcuauggaagaauugccggauacgauagaaacucuaauguugcucgcucuuaucgccguucuaacaggaggaguaacacuauucuuuuuaagcggaaaaggacuaggcaaaacaagcauaggauuacuaugcguaauggcaagcagcguauuauuguggauggcuuccguugaaccccacuggauagcagcaaguaucauucuagaauuuuuccugaugguacuauuaauuccagaacccgauagacaaaggacaccacaggacaaucaacuagccuauguaguaauaggacuacuauuuaugauccucacaguagcagcgaacgaaaugggucuuuuggaaacuacuaaaaaggaucuaggaauuggucauguaguagcugaaaaucaccaucaugcaacuauguuagacauagaucuacacccggcuagugccuggacacucuaugcgguugcuaccaccauaauaacaccgaugaugagacacacaauagaaaauacaacagcgaacauaucccucacugccauagcuaaccaagcggccauuuuaauggguuuggauaaaggguggccaauuaguaagauggauauagguguuccgcucuuggcccuagguuguuauagucaaguaaauccucuaacccuaacagcagcuguucucauguuaguagcacacuaugcuauuaucggaccuggauugcaagcaaaagcaaccagagaagcgcaaaaacgcacagcugcugguauuaugaaaaacccaacuguagauggaauuguagccauugauuuagauccuguuguauaugacgcuaaauucgaaaaacaauuggggcaaaucauguuauuaauauuauguaccagucaaaucuuacuuaugcguacaacaugggcguuaugugaauccauaacauuagcgacgggaccucuaaccacacuaugggaagguucuccaggaaaauuuuggaauacuacuauagcugugucaauggcaaacaucuuucgagguaguuacuuggcuggagccggucuugcguuuucgcuaaugaagacgcuugggggaggaagacguggaaccggggcgcagggagaaacgcuaggggaaaaguggaagcgacaacucaaccaguuaucaaagucggaguucaacacauauaaacggucagggauaauggaaguugauagauccgaagccaaagaggggcuaaaacgaggagaaacaacaaagcacgcagucucuaggggcacagcgaaauuaagaugguuuguagaacgcaauuugguaaagccugagggcaaagugauagauuuaggcugcggcagagggggauggucuuauuacugugcaggucuaaagaaagugacagaaguaaaaggcuauacgaaaggggguccaggccacgaagaaccgauaccuauggcuacauacgguuggaacauaguaaaacuucacagcgggagggacguauucuucacucccccagaaaaaugcgacacacuucuaugugacauuggugaguccucuccgaauccgaccauagaagaaggaagaacacugcggguauugaaaaugguugagccaugguuaagaggaaaucaauucugcauaaaaauucuaaauccauacaugccaagcgucguugaaacacuugaacaaaugcaaaggaaacacggagggauguuagucaggaacccgcuaucgaggaacucaacucacgaaauguauuggguuuccuguggcacaggcaauauaguuagcgcaguuaacaugacgucacguauguuauugaauagauucacuauggcacauagaaagcccacuuaugaaagagauguagacuuaggagcuggcacuagacacguagcgguagagccggaaauagcuaaccuagauauuauuggacaaagaaucgaaaauaucaagaacgagcacaaauccacuuggcauuacgacgaagauaauccuuacaaaacuugggccuaucauggaucguaugaggugaaacccuccggcagcgccaguucaauggucaacggggucguucgucuccuaacaaagccaugggauguuauaccaauggucacucaaaucgcaaugaccgacacaacuccuuuuggucagcaacguguauucaaagagaaagucgauacccgaacgccucgaccaaagcgcgguaccgcacaaauaauggaaguaacagcuaaaugguuguggggauuuuugucccgcaauaagaaaccucgcaucuguacacgcgaagaauuuacaagaaaaguacgaagcaaugcagccaucggagccguauuuguugaugaaaaucaauggaacagcgcaaaagaagcaguagaagaugagcguuuuugggaucuggugcaucgcgaaagagaacuacauaagcaggguaaaugcgcuacaugcguauacaauaugaugggaaaacgagagaagaaauugggggaauuugggaaagccaaaggcagcagagcuauaugguacaugugguuaggagcuagauucuuagaauuugaggcuuuaggcuuuaugaacgaagaccauugguuuucucgagaaaauucauuaaguggcguagagggagagggacugcauaaauuaggauacauauugcgugacauaaguaaaauaccaggaggaaacauguaugcggaugauaccgcaggaugggacacuagaauaacagaagacgacuuacaaaacgaagcuaaaaucaccgacauaauggaaccagaacacgcucuacuagccaccaguauauucaaauuaacauaccaaaacaaaguuguacggguucaaagaccugcuaaaaguggaacagugauggacguaauaagucgaagagaucaacgaggaucuggacagguagggacauauggccuaaauacauuuacaaacauggagguacaacugaucaggcagauggagagugaggguauauuuucacccagugaacuugaaaacucaaaccuagcugaacgagucuuagauuggcucgagaagcacggcguagaacgacuuaaacguauggccauaagcggcgaugacugcguagucaaaccuacagacgaucgcuucgcuacugcacuuacggcucuaaacgauauggguaagguaaggaaagauauuccccaaugggagccaucaaaaggauggaaugauuggcaacaaguuccuuucuguagccaucauuuccaucaauuaauaaugaaagauggaagagagauaguagugccuugcagaaaccaggaugaacuugucggccgcgcgcguguuagucagggagcuggguggucacuaagggaaacagcguguuuagguaaaucauaugcucagauguggcaguuaauguacuuucaucgaagagacuugcguuuggcugcgaacgcaauuugcagcgcagugcccgugaacuggguaccaaccagcagaacuacguggucuauacacgcgcaccaucaauggaugaccacugaagacaugcucagcguuuggaaucgaguguggauagaggaaaacccuuggauggaagauaaaacgcaugugagcuccugggaagacguaccguauuugggaaaaagagaagaucagugguguggaaguuuaaucggccuuacagcuagagcuacaugggcaacuaacauacagguagcuauuaaccaaguucggcgucuaauagggaacgaaaauuauuuagauuacaugacuucgaugaaaagauuuaaaaaugagucugacccggagggugcguuaugguaa

SEQ ID NO: 22095 - RNA, 9879 nt, Artificial Sequence
  derived and/or modified CDS sequence (opt6) from DENV-1__KM403585__SS-prME
agugugaccauguuacuuauguuauuaccuacugcuuuagcauuccacuuaacaacccgugguggugaaccucacaugaucguaaguaaacaagaaagagguaaaucgcuguuauucaaaacgucggccggagucaacaugugcacauuaaucgcaauggauuuaggagaacuaugugaagauacaaugacauacaaauguccgaggaucacagaagcagaaccagaugauguggacugcugguguaacgccacugauacguggguuacuuacgguacuuguucccaaacgggagaacauaggcgagacaaaagaucuguggcauuagccccacauguaggguuagguuuagaaaccagaacugaaacauggaugucaagugaaggagccuggagacaaauacaaaaaguagaaacaugggcgcuacgucacccgggauucacugucauagcauuauuucuagcucaugcaauaggaacgaguauaacucaaaaaggaauaaucuuuauauuacuaaugcuuguuacaccaucuauggcaaugagguguguuggcauuggaaacagggauuuuguugaaggccuaaguggggccacauggguugauguugugcuggaacacggauccugcgugacaacaauggcgaaaaauaaaccuacacuagauauugaacugcuaaagaccgagguaaccaacccagcuguccuaagaaaguuauguauugaggcgaaaauaucaaacacuacuacagacucaagaugcccuacacaaggcgaagcaacacuuguagaagaacaagacgcaaauuucgucugucguagaacuuucguagaucgaggcugggggaacgguuguggauuguuuggcaaagggagccuucuaacaugugcaaaguuuaaaugugugacaaaacuggaaggacgcauaguucaauaugaaaacuuaaaguacaguguaauagugacaguacacaccggugaccaacaccaagucgggaaugaaaccacagagcacggaacuauugccacuauaacaccgcaagcuccaacgucagaagugcaauuaacugauuauggagcacugaccuuggacuguucgccgagaaccggucuggauuucaaugagaugguauuauuaaccaugaaagagaaaagcugguugguccauaaacaaugguuuuuagaccuaccauuaccauggacaucuggugcgucaacgagccaagaaacauggaauagacaagauuugcuaguuacauucaaaaccgcacaugcuaagaaacaagaaguaguagugcuagguucacaagaaggggcuaugcauacggcuuuaacaggcgcaacagagauucaaacaucagggacaacuacaaucuuugcgggacaccugaagugccgauuaaaaauggacaaauuaacucucaaagguguaucguacguaauguguacgggauccuuuaaacuagaaaaggaaguugccgaaacacagcaugggacagucuugguucaaguuaaauaugaaggaacagaugcuccuuguaagauaccaauauccacacaagacgagaaaggugugacgcagaaugguagacugauaacagcuaauccuaucgucacggacaaggaaaagccuguaaauauagagacagaaccgccguuuggagagucuuacauaguaaucggugccggcgaaaaggcgcuuaaauuaucaugguucaagaaagguucgucaauugggaaaauguuugaagcuacugcgagaggcgcuagaagaauggcaauauuaggagauacagcuugggauuucgguagcaucggcggaguauucacgucagucggaaaauuaguacaucaaguauucgguacggcauaugguguacuauucagcggugucagcuggacaaugaagaucggaauaggcauccuacuaaccugguugggauuaaacucgagaagcacuagcuugaguaugacgugcauagcugucgguaugguaacgcuauaucucggcgugaugguacaagcugauucagguugcguuaucaacuggaaagguagagaauugaagugcggguccggaauauucgucacuaacgaagugcauacuuggaccgagcaauauaaauuccaagcagacuccccaaaaagauuaagcgccgcaauaggaaaagcaugggaggagggugugugcgggauccggagugccaccagguuagaaaacauuauguggaagcaaauuucgaacgaacucaaucacauacucuuggagaaugauaugaaauucaccgucguagugggagaugcauauggcauacugacucaaggcaagaaaaugauacggccgcagcccauggagcauaaguacuccuggaagaguuggggaaaagccaaaauaauaggcgcugacacgcagaauacgacuuucauaauugauggaccagauacaccagagugcccugacgaccaaagagcuuggaauauuugggaaguggaggauuauggguucgggguauuuacaacaaacauauggcuaaaacuucgagacuccuauacccaaaugugugaucauagacuuaugucagcugcuaucaaagacucuaaagcugugcacgcggauaugggauacuggauagaaagcgaaaagaacgaaaccuggaaauuggcacgagcaucuuuuauugaaguuaaaacuuguauauggccaaggucacauacucuauggucuaauggaguacucgaaucggaaaugaucauaccuaagauauaugguggcccaauaucucaacauaauuaccggccugguuacuuuacccaaacggcugguccuuggcaccucggcaaacuggaacuagauuuuaauuuaugugaagguacuacgguaguaguagacgaacauugcgguaaccgaggaccgagccuuagaacuacuacaguaacgggcaaaauaauucacgaauggugcugucgaaguuguacauuaccgccucuacgauuucggggagaagauggcuguugguacgggauggagauacgcccgguaaaagaaaaagaagaaaacuuaguucgaaguaugguauccgcugguaguggugaaguggauucauucucauuaggauugcuaugcguaaguauaaugauugaagaaguaaugcggaguagguggaguaggaaaauguuaaugacugguacauuagcuguuuucuuuuuauugauaaugggacaacuuacuuggaacgauuuaaucagacuuugcauaaugguaggugcuaauguaucugaccgaauggguaugggaaccacauaccuugcccucauggcgacguuuaaaaugcgacccauguuugcuguagggcuuuuguuucguagguugacaaguagggagguguuauuauuaaccauaggccuaucauuaguagccucggucgaacuuccaaauucuuuagaagaacuaggagacggauuggcaaugggcauaaugauguuaaagcuacuuacugauuuccaaagccaucaacuuuggacuacccuacucagcuuaacauuuauuaaaacuaccuuaagccuagauuaugcauggaaaacuauggccaugguuuugucaauaguuagccucuuuccauuaugucucucaacgaccucacaaaagacaacauggcuaccuguguuauuaggaucuuucggguguaagccacuaacaauguuuuuaauuacagaaaauaaaauuuggggaagaaaaucuuggcccuuaaaugagggcauaauggcaguagguaucgucuccauccucuuaaguucauuacucaaaaaugacguaccguuagcaggcccacuaauagccggcggaauguuaauagcguguuacgugauuaguggauccucggcggauuugagucuggaacgugcagcagaagucucaugggaagaagaagccgaacacagcggcgcaagccauaacauacucguagaaguucaagaugauggaacaaugaaaauuaaagacgaggaacgggaugacaccuuaacaauauuauuaaaggcaacucuauuagcuguauccgggguauauccuaugucaauuccggcaacucuuuuuguuugguauuuuuggcagaaaaagaaacaacggucgggaguucugugggacacaccaaguccgcccgaagucgaacgugcgguccuggaugacgggaucuauagaauuuuacagcgaggcuuguuaggcagaucacagguaggugucgggguuuuccaagacggaguuuuucauaccauguggcauguuacaagaggugcaguguuaauguaucaagguaaacgacuggagcccuccugggcaucggugaagaaagauuuaaucagcuauggugguggauggagguuucaaggcagcuggaauacgggggaagagguucaaguaaucgcgguagaaccaggcaaaaaucccaaaaacguacaaacuacaccugguacguuuaaaacaccugaaggugaagugggcgccauugcucuagauuucaaaccagguacaucaggaagcccuauagugaaucgugaaggcaaaauuguaggacuauauggaaauggugucguuacaaccaguggaaccuaugucuccgcaauagcccaagcaaaagccucucaggaagguccccuacccgagauagaggaugaaguuuuuaagaaacguaaccuuaccauaauggaucugcacccaggaagugguaaaacuagacgcuaucuuccggcaauagugagagaagcuauaaaaaggaaacuaagaacacuaaucuuagcaccaacacgaguuguagcaucagaaauggcggaagccuuaaaagguaugccaauuagauaccagacaacggcagugaaaucugaacacacuggaaaagaaauaguggaucucaugugccacgcuaccuuuacuaugagacuucuaucaccgguucgcguacccaauuauaauaugauaauaauggacgaagcucauuucacagaccccgcaaguaucgcagcgagaggcuauauaucgacuagaguaggcaugggagaggcugcggcaaucuuuaugacagccacaccuccaggcucuguagaagccuucccacaaagcaaugcuguaauacaagaugaagaacgagacauacccgaacgcuccuggaacagcggguaugacuggaucacagacuuuccagggaaaacuguuugguuugugcccagcauaaaaagugggaaugauaucgccaauuguuuaaggaaaaauggcaagagagugauccaauuauccagaaaaacuuucgauacagaauaccagaaaacaaagaacaaugacugggacuaugucgugacgacagauauaagugaaaugggcgcuaauuuuagagccgacagggugauagauccacgcagaugucuuaaaccgguuauauuaaaagauggcccugagcguguuauauuagccgggccgaugccgguuacagccgcuucagcagcccaaaggagaggaagaauuggaagaaaucaaaacaaagaaggugaccaauauauauauaugggucaaccguuaaauaaugaugaagaccacgcacacuggacugaagccaaaauguuacuugauaacauaaauacacccgaagguaucauaccagcauuguucgaaccagagagagagaaaucugcugcgauugauggagaauaucgacuuagaggggaagcgcgcaaaacuuucguagagcuuaugagaaggggagacuuaccaguaugguugucauauaaaguugcaucugaaggguuccaauauucugaucggagaugguguuuugacggagagagaaauaaucagguguuggaagaaaacauggauguggaaaucuggacuaaagaaggagaacgcaaaaaguugagaccaagauggcucgacgcuaggacguauucugauccacuagcauuaagagaguucaaagaguucgcugccgggcggcgcucgguaaguggagaccugauccuagaaaucgguaaacuaccucaacacuugacucugcgcgcucaaaaugcacuagauaaccuaguaauguuacacaauagugagcagggagguaaagcauaccgucaugcuauggaagaacugccggauacaauagaaacucugauguuacucgcacuaauugcgguacucacaggaggaguaacgcuauucuuuuuauccgggaaaggacuugggaagacaaguaucggacuuuuguguguaauggcgucgagugucuuauuguggauggccagcguugaaccgcacuggauagccgcuucaaucauauuagaguucuuccuuaugguauugcugauaccagaacccgauagacagaggacgccacaagauaaucaauuagcauacguagugauuggauuguuauucaugauucuaacgguagcugccaacgagaugggauuacuagagacaacuaagaaggaucugggcaucggccauguaguugcagaaaaccaccaucaugccacaaugcuagauauugaucuacaccccgcgucggccuggacauuauaugcaguagcaacuacaauuauaacucccaugaugcgacauacaauagagaauacaacggcaaauauaucgcuuacagcaauugcaaaucaagccgcgauucuuauggguuuagauaaagguuggccuaucagcaaaauggauaucggaguuccuuuacuagcuuuaggcugcuacucacaagugaacccguuaacauuaacagccgcaguauugaugcuaguagcccauuaugcaauaauuggacccggauuacaagcgaaggcgacuagagaagcgcaaaagcguacagcagcugguauaaugaaaaauccuacugucgaugggaucguagcgauugaucuugacccgguagucuaugaugcaaaauucgagaaacaacuaggacaaauaauguuacuaauucuaugcacgagucagauacuucuuaugagaacaacaugggcacugugugaaucaauaacacuggcaacgggcccccucacaaccuuaugggaagguagcccagggcgauuuuggaacacaaccauagcggugagcauggcuaacauauuucgaggcucuuacuuagcaggggccggcuuagcauucaguuugaugaaaucucugggaggagguaggcgagguacaggcgcucagggagagacguuaggugagaaauggaagagacaacugaaccaacuaaguaaaucagaauuuaacaccuacaaaaggucugguauuguugaaguugauaggucugaggcuaaagaaggcaugaaaaggggagagacuacaaaacacgccguuagucgggguaccgcgaaauuacgaugguucguagagcgaaacuuagucaagcccgaaggcaaaguaauagaucuuggaugcggaagaggaggguggucauauuauugugccggucuaaagaaaguuacugaggugaagggguauaccaaaggcggcccgggccaugaggaaccuauuccaauggcuacauauggguggaacauuguuaaauuacauagcgguagagacguauucuucacuccaccagagaaaugcgauacuuuacuaugugauauaggagaaucuagcccuaacccaacaauagaagaagguaggacacuucgaguuuuaaaaaugguagaaccguggcuccguggaaaucaauuuuguauaaaaauauugaacccguauaugccaucuguaguugaaacacuagaacagaugcagagaaaacauggugggaugcuagugcggaauccgcuuucacggaacuccacacaugaaauguacuggguaucauguggaacggguaacauaguuagugcaguaaauaugacuucgaggauguuacuaaaccgauuuacaauggcgcauagaaaaccuacuuaugaaagagauguagaccugggcgcagguacuaggcauguagccguugaaccagaaauugcaaaucuagacauaauugggcagcguauagaaaauauuaaaaaugaacacaaaaguacuuggcacuaugacgaagauaacccauacaaaacuugggccuaucauggaucuuaugaaguaaagccauccgguucagcaucuucgauggucaaugguguuguuagacuauuaacgaagccaugggacguaauccccaugguaacgcaaauugcuaugacagacacuacgccauuuggccagcaaagaguauuuaaagaaaaaguagauacccgaacuccccgaccaaagagaggaacagcacaaauaauggaaguuacggcaaaguggcuguggggauuccuaaguaggaauaagaagccacggaucugcacgagagaagaguuuacaaggaaaguacguuccaaugcagccauuggagccgucuuuguagaugagaaucaauggaacagugcaaaggaagcugucgaagaugagcgcuuuugggaucuuguucaccgggaacgagaacuucauaagcaagguaaaugugcaacaugcgucuacaauaugaugggcaaaagagagaaaaagcuaggcgaguucggaaaagcuaaaggcucaagagcaaucugguacaugugguuaggugcucgauuuuuagaauuugaggcuuuaggcuuuaugaaugaagaucauugguuuagccgagagaacucucuaucuggagucgaaggagaaggucuccauaaacuaggguacauucuaagagacaucuccaagaucccaggcggcaacauguacgcagaugacacagcaggaugggauacgcguauuacugaagaugauuugcagaacgaagcuaaaauuacggauauaauggaaccagagcaugcauugcuagcaacguccaucuuuaagcucacauaucaaaacaaaguaguccgcgugcaaagaccagcaaaaucuggcacugugauggacguuauaagccggagagaccaaagagguagugggcaagucggaacuuacggguuaaauaccuuuacaaacauggaaguccagcuuauccgucaaauggaaagcgaaggaauuuucaguccgagugaacuagaaaauucaaaccuagcagaacgggugcucgacugguuggagaaacauggugucgagagacuuaaaagaauggcuaucuccggagaugauuguguaguaaaaccaacugacgauagauucgccacagcucuaacugcccugaacgauaugggaaagguaaggaaagauaucccacagugggagccaaguaaaggcuggaacgauuggcaacaggucccuuuuugcucacaucacuuccaucaauuaauaaugaaagacggacgggaaauaguggugcccugucgaaaccaagaugaguugguaggcagagcucgagucucccaaggagcaggauggucucuucgugaaaccgcgugucuagggaaaaguuaugcgcaaauguggcaauuaauguacuuucacaggagagaucuacgcuuggcggccaacgcuauaugcuccgcgguucccgucaacuggguacccacgaguagaacuacauggagcauacacgcccaccaccaauggaugacuacugaggauaugcuguccguguggaauagggucuggauugaagaaaacccuuggauggaagauaaaacucauguaucaucaugggaagacguucccuaucucgguaaaagagaggaccaauggugcggaucuuuaauaggucugacagcuagggcaacuugggcaacuaauauacaaguugcaaucaaucaaguacgaagacuaauuggcaaugagaauuacuuggacuauaugaccaguaugaaaagguuuaagaaugaaucggacccagagggggcuuuaugguga

SEQ ID NO: 22096 - RNA, 9879 nt, Artificial Sequence
  derived and/or modified CDS sequence (opt6) from DENV-1__KM403595__SS-prME
ucgguaacuaugcucuugauguuauugccaacagcuuuggcauuucauuuaacaacaagaggaggagaaccacauaugauaguaagcaaacaagaacgaggaaaaucgcuacuauuuaaaacaucugcaggaguaaauauguguacccuuauagcaauggauuuaggagaauuaugugaagauacaaugaccuacaaaugcccaagaauaacagaagcagaaccagaugacguagauuguuggugcaaugcaaccgacacuuggguuacguauggcacguguucgcaaacgggagagcacagaagagaccguagaucaguugcucuugcaccccauguuggccuaggguuggaaacgagaacugaaacauggaugaguagugaaggugcuuggcgccaaauucaaagaguagaaacgugggcuuugcgacauccuggauuuacugucauagcguuauuucuugcacaugccauaggcacuucaauaacucaaaaaggcauaauauuuauauuacuaaugcuaguaacgccgagcauggcuaugagauguguagggauagguaaucgugacuuuguggaagguuuaagcggggcgacuuggguugaugugguacuggaacauggcucuuguguaacaacuauggccaaaaauaaaccgacacuugauaucgaacuauuaaaaacugaaguaacgaacccagcaguacuaagaaaacuaugcauagaggcaaaaaucucuaacacaacaacugauagucgaugcccaacacaaggugaagccacguugguagaagaacaagaugccaauuuuguaugcaggagaaccuuuguggauagaggcuggggcaaugguuguggauuguuuggcaaaggcagccuuuuaaccugcgcgaaauucaaaugcguaacaaaauuggagggcaaaaucguacaauacgagaaccuaaaauacagcguuauaguaacuguacacaccggcgaucaacaccaaguagggaaugagacaacagaacaugggaccaucgcuacaaucacgccacaagcuccaacaagugaaauacaauuaacugauuauggcgcacucacucuggacuguucacccagaacuggacuagauuuuaaugaaaugguacuauuaacgaugaaagaaaaaucuuggcugguucauaaacaaugguuucucgaucuaccauugccuuggaccagcggagcgagcacaucacaagaaacguggaaucgacaagacuuacugguuacuuuuaaaacagcgcacgccaagaaacaggagguggucguacugggaucgcaggaaggcgcgaugcacacggcucuaacaggagcaacugaaauucaaacaucagggacuacuacuauuuucgcgggccaucugaaaugucgguuaaaaauggauaaacugacucuuaaaggagugaguuauguaaugugcacaggaucauuuaaauuagaaaaagaagucgcagagacucagcacgggacuguucugguacaggucaaauacgaaggaacagacgcaccauguaaaaucccaauaaguacucaagacgagaaaggagucacucaaaauggccgacuaauuaccgcaaacccaauaguaacugauaaagaaaaaccuguaaauaucgaaaucgaaccaccauuuggagaaucuuauauaguaaucggugcaggcgaaaaagcauugaaacuaaguugguucaagaaagguucaucuauaggcaaaauguucgaagcuacagcuagaggcgccagaaggauggcuauuuugggggauacggcuugggauuuugguagcauuggggguguguuuacaaguguggguaaauugguucaucaaguguuugggacggccuauggaguguuauuuucgggcguuaguuggacaaugaaaauagggauaggcauauuacuuacauggcugggacuaaauucucggaguaccucacuaagcaugacuugcauugcaguagggaugguuacguuauauuuagguguuauggugcaggcugacucuggcuguguaaucaauuggaaagggagagaacucaaaugcggguccggaauauuuguaacaaacgagguccauacguggacggagcaauacaaauuucaagccgacagccccaaaagacuaucggccgcgauaggaaaagcaugggaagaaggaguauguggcauacggucggcuacaagauuagaaaauauuauguggaaacaaaucucuaaugaauuaaaucauauacuuuuagaaaacgacaugaaauuuaccgugguugugggagaugcaaaugggauucuuacccaaggcaagaaaaugauaagaccgcaaccaauggaacauaaauauucuuggaaaagcugggguaaagccaaaaucauaggcgcugauacccagaacaccacauucaucauagauggaccggacacacccgaaugucccgacgaccaaagagcauggaauaucugggagguggaagacuacggauucgggguguuuacaacaaacauauggcuuaaauuacgugacucuuauacacagaugugugaucacagacuaaugucagcugcaaucaaagauagcaaagcuguucaugcagauaugggauacuggauugaaagugagaaaaaugaaaccuggaaauuagccagagcuaguuucauagaagucaaaacaugcauauggccacgaagccacaccuuauggaguaauggaguauuagaaagcgagaugauaauaccaaaaauuuacgggggaccgauaucacaacacaauuacagaccugguuauuucacccagaccgcagggccuuggcaccuagguaaauuagaacuagacuuuaauuuaugcgaaggaacuacggucguaguagacgaacacuguggaaaccgagguccuagucuaagaacaacuacgguaaccgggaaaaucauacaugaauggugcugcagauccugcacacuaccaccauuaagauucagaggcgaagauggguguugguacggaauggaaauaaggccuguaaaagagaaagaggagaauuuaguccguucaauggucagcgcugggaguggcgaaguagacaguuucucauuaggguuacuguguguaaguauaaugauugaggaagugaugcguucaagauggucucguaaaaugcuaaugacgggaacacuagccauauuuuucuugcuaauuauggggcaauuaacuuggaaugaucucauacguuuaugcaucaugguaggugccaacguuucagauaggauggguaugggaaccacauacuuagcuuuaauggcuacauuuaaaaugcgacccauguuugcaguaggucuacuuuuuagacgccucacaagucgagaaguuuuacuauugacaaucggguugagccucguugcaagcgucgaacuucccaauucccuagaagaauugggcgaugguuuagcgaugggaaucaugauguuaaaacuacuaacagacuuucaaucgcaucaacuauggacaacuuuauuaagccuuaccuuuauaaagacaacacuaagucucgauuacgcuuggaagacaauggcaaugguucuuaguauagucagcuuauuuccauuguguuugucaacuaccucacagaaaaccacuugguuaccuguucuacuaggaucauuuggauguaaaccacuaaccauguuccuuauaacugaaaauaagauuuggggaaggaaaagcuggccacuuaacgagggcauaauggcaguagguaucguaucaaucuugcuuucaagccuuuuaaagaacgauguuccacuagcugguccucuaauagcugggggaauguugauagcauguuauguuauuucgggcucuagugcagaccugucguuagaaagagcagcagaaguuagcugggaagaggaggcagaacauucgggagccucucacaacauacucguggagguucaagaugacggaacaaugaaaaucaaagaugaggaaagagacgacaccuuaacaauccuacuaaaagcaacauuguuagccgugaguggaguauaccccaugaguauaccagcuacauuauucguuugguauuuuuggcagaaaaagaaacaaaggucagggguauugugggauacaccaaguccaccagaaguggagcgagccgucuuagaugacgggaucuaccgaauauuacaacgaggccuauuagguagaagucagguaggaguagguguguuccaggacgguguuuuucacacaauguggcacgugacucgcggagcaguacugauguaccaaggcaaaagauuggaaccaagcugggcauccgugaaaaaggacuuaauaucuuaugguggaggauggcgauuucaaggaucauggaacacgggagaagaaguccaaguaauagcggucgagccgggcaaaaauccuaaaaauguacagacaacaccugggacauuuaagaccccagagggagaaguaggggcaauagcccucgauuucaagccgggcacgucgggauccccuauaguaaacagggagggaaaaauagucggauuguauggaaacggugucgugacaacaucagguacguauguuagcgcaaucgcucaagcgaaggcuucucaggaaggcccuuuaccagaaauagaagacgaagucuuuaaaaagaggaauuuaacaaucauggaccuacacccagguuccgguaaaacacggcgauaucucccugcuaucgugagagaagccauaaaacggaaauuacgaacauugauucuagcuccaacccggguaguggcauccgaaauggcagaggcuuugaaagguaugccgauacgauaucagacgacugcggucaaaagugagcauaccggaaaagaaauuguugaucugaugugccaugcuacauuuacgaugcgcuuacugucaccuguacgaguaccaaauuacaacaugauuauuauggacgaagcucauuuuacugacccggcuucuauugcagcucgugguuacaucucuacccgagugggaaugggagaagcggcagcuauauuuaugaccgcuacaccgcccggaagugucgaggcauuuccccaaagcaaugcgguaauacaggacgaagaacgagacauacccgaaagaucuuggaacuccgguuaugacuggauaacagacuuuccaggaaagacuguuugguuugucccuucaauaaaaucugguaaugacaucgcgaacugccucaggaaaaauggcaaacgagugauucaguugagucgaaagacuuucgacacugaauaccaaaagaccaaaaacaacgauugggacuacguuguaacuacggauauaagugaaaugggagcuaauuucagggcagaucgcgucauagauccgagaagaugccuaaaaccaguuauuuuaaaagauggaccugaacguguaauauuagcaggccccaugccagugacugccgcgagcgcggcacagaggagggguagaauuggaagaaaucagaauaaagagggagaccaguauauuuauauggggcaaccuuugaacaacgacgaagaccacgcucacuggacagaagcgaaaauguuauuagauaacauaaauacgccggaaggcaucaucccugcauuauuugagccagaacgugaaaagucagcagcaauagauggcgaguaucgacuacguggggaagcaagaaaaacuuuuguggaauugaugcgucgaggagaucucccugucuggcuuucauacaaagucgcaucagaagguuuucaguacagugacagacgaugguguuuugacggugaaagaaauaaucaaguacuagaagaaaacauggacguagaaauauggacuaaagaaggagagaggaagaaauuaagacccagguggcucgaugcgcgaacauauucagauccccuagcgcuccgugaauuuaaggaauuugcugcagggagaagaucggucaguggcgaucuaauacucgaaauuggaaaauuaccacagcauuuaacuuugagggcucaaaacgcauuggacaaccucgugaugcuacauaauucagaacaaggggguaaggcuuauaggcaugcgauggaagaacugccagacacaaucgaaacacucauguuguuagcacuuauugcaguucuuacaggcggagugacucuauucuucuuaucagggaagggauugggaaaaacauccauagguuugcuuuguguaauggccucgucggugcuucuauggauggcuagcguugagccccauuggauagcugcauccauuauacuugaauuuuuccuaaugguauuguuaauucccgagccagauagacaaagaacgccacaggauaaccaauuggccuacguaguuauagguuugcucuuuaugauacugaccguagcagcgaacgaaaugggacuguuagaaacuacuaagaaagaucugggcauaggacacguuguugcagaaaaccaucaucacgccacgaugcuugacauagaucuacacccugcaagugcguggacauuauaugcagucgcaacuacaaucaucacuccuaugaugcgacauacuauagaaaacaccacugcaaauauuucgcuaacagcaaucgcaaaucaagcugcgauucuaaugggcuuggacaaagguuggccgauaagcaagauggacauugggguaccauugcuagcacuggguuguuauucucaaguaaacccguugacacugacggcugcuguacucauguuaguagcucauuaugcgauaauugguccaggccuacaagcaaaagcuacacgugaagcgcagaaaagaaccgcugccggcauaaugaaaaauccgacaguagauggaauugucgcgauagaucuggauccuguuguauacgaugcaaaauuugagaaacagcuaggucagauaauguuacuaauacugugcacaucacagaucuuauuaaugagaaccaccugggcauuaugugagucuauuacacuggcgacaggaccguuaacaacauuaugggaaggaucccccggaaaguuuuggaauacuacuaucgccguaaguauggccaauauauuuagaggaucguaucuugcgggagccggucuagcauuuucucuuaugaaaagucuaggcgggggaagaagaggaacuggcgcucaaggagaaacguugggugaaaaauggaaaagacaauuaaaucagcuauccaaaagcgaguuuaacacauacaaaagaagcgguauaauggaaguagaccgcucggaagcaaaagaaggacuaaaaagaggagaaacaacgaagcacgccgugucgcgagguacugcaaaacucagaugguucguugaacgaaaucuagugaaacccgaaggaaaagucauugaccuaggcugcggucgaggaggcuggagcuacuauugugcugggcugaagaaggugacugaaguaaaagguuacacaaaaggagggccaggucacgaggaaccaauuccgauggcaacuuacggcuggaauauaguuaaguugcauucgggacgcgauguauucuuuacaccacccgaaaaaugcgauacccuccuuugcgacauaggcgaaucguccccuaaucccacgauugaagaaggaagaaccuuaagaguccuaaaaaugguagagccuuggcuuagggggaaucaauuuugcauaaaaauuuuaaauccguauaugccuucuguaguagagacgcucgaacaaaugcaacgaaaacacgguggaaugcuaguaagaaauccauuaucucgaaauucaacucaugaaauguacuggguaaguugcggaacagguaacauaguuucugcaguaaacaugacaucuaggaugcuacuaaaccgauucacaauggcucauagaaagccuacauaugaaagagauguugaucuaggagccgggaccagacauguggccguugaaccugagacagcaaaucucgacauaauuggucaacgaaucgagaacaucaaaaacgaacauaagaguacuuggcauuacgaugaagacaacccguacaaaaccugggcuuaccauggcaguuacgaagugaaaccgucuggaagcgcuaguucaauggucaaugguguagugcgucuucuaacgaaacccugggacgucaucccuaugguuacucaaauagccaugacagauacaacaccuuucgggcagcaaagaguuuuuaaagagaaaguagacacucgaaccccgaggcccaaacgcgguacugcacaaauuauggaagugacagcuaaaugguuauggggauuuuugagcagaaauaagaaacccagaaucuguacccgcgaagaguucacuaggaaaguacgguccaacgccgcaauaggugcuguguuuguugaugagaaucaguggaauagcgcaaaggaagcuguagaggacgaacgguuuugggaucuaguccacagagaacgagaacugcauaaacaagggaaaugugcuacuugcguauauaauaugauggguaaacgugaaaagaaacuuggggaguucggaaaggcuaaaggauccagagcuaucugguauauguggcugggugcgcguuucuuggaguuugaagcauuaggguuuaugaacgaagaccacugguucagcagagaaaauaguuuguccgggguagagggagaaggacuccauaaacuuggauacauauugagggauauuaguaaaauuccuggaggaaauauguaugcugaugacacugcgggaugggauacucgaauuacugaggacgaucuacagaacgaagcaaaaauuacagauauaauggaaccagaacaugcucuccuagcuacaucaaucuuuaagcuaacuuaucaaaauaaaguagugcgaguacaaagaccagccaagucaggaacuguuauggauguaauauccaggagagaccaacguggcaguggucagguagguacuuauggguuaaacacuuuuacaaauauggaagugcagcuaauacgucagauggaauccgagggcauuuucagcccgagcgagcuggaaaauuccaauuuagcagaacgagucuuagacuggcuagaaaaacauggaguggaaagacugaaacgaauggcaaucucuggugaugacugcguuguaaaaccgacagacgacagauuugcuacugccuugacagcuuuaaaugauaugggaaaagucagaaaagauauaccccagugggagccaaguaaaggguggaaugauuggcaacaaguaccguuuugcucacaucauuuccaccaguugauaaugaaagauggaagagaaauuguagucccaugcagaaaucaagaugagcuagucggucgagcuagaguaucgcaaggugcagguuggucacuccgagaaacggcaugucugggaaaaagcuacgcacaaauguggcaguugauguauuuucaccgacgcgaucuacgacucgcagcgaaugcgauuuguucagcugucccaguaaauuggguaccgacaucaagaacaacauggagcauucacgcacaucaccaauggaugacaacugaggauaugcucucuguauggaacagagucuggauugaagagaacccauggauggaagacaaaacgcacguaaguucaugggaagaugucccguaccuagguaaaagagaagaucaguggugcggaucacuuauaggauuaacggcaagggcgacgugggccacgaauauacagguagcuauaaaucaagugagaagauugauaggcaacgaaaacuaucucgauuauaugacgagcaugaaacgguuuaaaaacgaauccgacccagagggagcucucugguaa

SEQ ID NO: 22097 - RNA, 9879 nt, Artificial Sequence
  derived and/or modified CDS sequence (opt6) from DENV-1__KM403604__SS-prME
ucgguaacgauguuacuaauguuacuuccgacugcguuggcuuuccaccuaacuacgcgaggcggagaaccacacaugauaguuagcaaacaggaaaggggaaaaucuuugcuauuuaaaaccucagcagggguuaacaugugcacguugauagcaauggauuugggagaauuaugcgaagauacuaugacuuacaaaugcccgcguauaaccgaagcugaaccugaugacguugacugcugguguaacgccacagacacgugggucacguauggcaccuguagccaaacaggagaacaucgaagagauaaacgaagcguagccuuagcaccacacguuggucuaggauuggagacacgaacagaaacuuggaugucuucagaaggugcuuggagacaaauacaaaaaguggaaacuugggcguuacgccacccuggcuucacaguuauagcgcuguuccuggcccaugcgauaggaacuucuauaacgcaaaaaggcauaaucuucauccuacucauguuaguaacaccaaguauggccaugaggugcguggguaucggaaauagagauuuuguagaaggacuuucuggagcgacauggguagacguaguauuagaacauggcucaugugugacgacaauggcuaaaaacaaaccaacauuggacauagaauuauugaaaacagagguaaccaauccugcaguuuugagaaaauuaugcaucgaggcaaaaauaucuaauacgaccacugauucucgcuguccaacucagggagaagcgacucuagucgaggaacaagaugcaaauuuuguuuguagacgaaccuuuguggauagagguugggggaauggaugcgguuuguuugguaaaggaaguuuauuaacaugugcaaaauuuaaaugcguaaccaaacuugagggcaaaauugugcaauaugaaaaccuaaaauauaguguaauaguuacaguucacacuggggaucagcaucaaguggggaacgagaccacugaacaagguacaauugcuacuauuacuccacaggcucccacaucugagauacaauuaacagauuauggggcucucacguuggauuguuccccgagaacaggauuagauuuuaaugagaugguacuacuuacaaugaaagaaaaaucaugguugguucauaaacaaugguucuuggaucuaccauuacccuggacaaguggcgcaucuacaagucaagaaacuuggaauagacaagaucuccucguuacauuuaaaacagcucaugccaagaaacaagaaguaguagugcuagggucucaggaaggagcaaugcacacagcuuuaacaggggccacugaaauccaaacguccggaaccacaacaauauuugcagggcacuugaaauguagacugaaaauggauaaacuuacucuaaaaggcguaucguacguaauguguacugguagcuucaaacuagagaaagaaguagcagaaacacagcacggcaccguccuaguacaaguaaaauaugaaggcaccgacgcaccauguaaaaucccuaucaguacacaagacgaaaaagguguuacacaaaacggucgacuaauaaccgcaaauccaaucgucacagacaaagaaaaaccaguaaauaucgaaacggaaccuccuuuuggcgaaucguauauagucauuggagcuggagaaaaggcuuuaaaacucucgugguuuaagaaaggaucaucaauagguaagauguucgaggccaccgcacgcggugcucgacgaauggcaauucucggggacacagcgugggacuuugguuccauuggaggaguauucacgagcgugggaaaauuaguccaccaaguauuuggcacugccuauggcguacuuuucuccggagucucauggacaaugaagauuggcaucggcauacuucuaaccugguuaggacugaauaguagaagcacaucguuaagcaugacuuguauagccgucggcaugguaacguuguauuuagggguaaugguacaagcagauucgggcugcguaauuaauuggaaaggccgagaacuaaaaugugguuccggcauuuuuguaacuaacgaaguccauacuuggacugaacaauauaaauuccaagcagauaguccuaagaggcuuucagcagcaauagguaaagcaugggaagaagguguuugcggaauacgaagugcaacaagacuugaaaauauaauguggaaacaaaucucuaaugaauuaaaucauauccuauuagaaaaugauaugaaauuuacaguaguagugggggaugcuaacggaauacucacucaaggaaagaaaaugauacgaccgcagccuauggaacauaaauauucuuggaaaucgugggguaaagcaaaaauuaucggggcugauacgcaaaauaccacguuuauaauagaugggcccgauacaccagaguguccagaugaucaaagagcauggaacauaugggaagucgaggauuaugguuucggcguuuucaccacuaauaucuggcuuaaauugagagauucauacacacagaugugugaccaccgauuaaugagcgcagcaauaaaagacucaaaagcugugcaugcggacaugggauacuggauugaaucggagaaaaacgaaaccuggaaacuggcuagagcuuccuuuauugagguaaaaacaugcaucuggccuaggagccacacacuuugguccaaugguguacuugaaagcgaaaugauuauaccgaaaauauauggcgguccgauaucacaacauaacuaucgacccgguuauuuuacucaaacugcaggcccguggcacuuaggaaagcuagaacuagacuucaaucucugugaggggacaacuguaguaguggacgaacauuguggaaaccgaggaccgagucuaaggacaaccacaguuacaggcaaaauaauucacgaguggugcugcagaaguuguacguuaccgccccuaagauucagaggggaagauggaugcugguauggaauggaaauucgaccggugaaagaaaaagaggaaaacuugguucgaucaaugguuucagcaggaaguggcgaggucgacucguucucgcuaggguuacuaugcguuuccauaaugauagaagagguaaugcgaucgagauggucccggaaaauguugaugacagguacacucgcuguauucuuuuuauuaauuaugggccaacuuaccuggaaugaccuaauuagauuguguaucaugguaggugcgaaugugagcgaccgaauggguaugggaacaacuuauuuagcccuaauggccacauucaaaaugagaccaauguucgcugugggacuauuguuucggagacucacaagucgugaaguguuauuauuaacaauuggcuuguccuugguagcaucgguggaauuaccuaacagucuagaagaauugggagacggacucgcuauggguauuaugauguuaaagcugcuaacugacuuucaaagucaccaauuauggaccacacuauuaucgcuaacguuuauaaaaaccacucucucauuggauuacgcguggaaaacaauggcaaugguguugaguauaguaucguuauuuccuuuaugucugagcacaacuucacagaaaacaacauggcugccggucuuacuggguagcuucgguugcaaaccuuuaacaauguuucuaauuacagaaaauaaaauaugggguaggaagucuuggccgcuaaaugaagggaucauggcaguugguauuguuaguauacucuuaaguucauuacuuaaaaacgauguaccucuagcugggccacucauagcuggaggaauguuaaucgccugcuauguaauuuccggaucuucggcagaccuuucgcuagaaagagcggcagagguuagcugggaagaggaagcagaacacucaggagcaagucacaauauccuaguggagguucaagacgacggaaccaugaaaauaaaagacgaagaacgagacgauacucuuaccauuuuacuaaaggcuacauuacuagccguaaguggaguuuacccaaugucgaucccagcaacguuguuugucugguacuuuuggcagaagaagaaacaacgaagcggugugcucugggauacaccaagcccaccggagguugagcgagcugucuuagaugauggcauauaucggauacuacaaaggggccuacuaggucgaucccaagugggcgugggaguauuccaggacgggguauuccacacaauguggcaugugacgcgcggcgcaguauuaauguaccaaggcaaacgauuagaaccaucaugggccucaguaaagaaggaucuuauaagcuauggugguggauggagauuucaaggguccuggaacacaggagaagaaguucaaguaaucgcaguagaaccaggcaagaacccaaagaacguccagacaacuccaggcacauuuaaaaccccggaaggugaaguaggagcaaucgcgcuagauuucaagcccggaaccucuggaucaccaauaguaaaucgagaaggaaaaauaguaggauuauauggaaauggugucgucacuacaucaggaacguacgucucagcuauagcgcaggcaaaagccucccaagaagggccacuaccagaaauugaggaugaaguauuuaagaaacgaaauuuaacgaucauggaucugcacccuggcagcggaaaaacacgccguuacuugccugcgaucgugagagaggcgaucaaaagaaagcucagaacacuuauucuugcuccaacaagaguaguagccagugaaauggcugaagcccuaaaaggaaugccuauuagguaccaaaccacagcugugaaaagugagcacacuggaaaggaaauuguagacuuaaugugucaugcaacguuuacaaugagacuacugucgccugucagaguaccaaauuacaauaugauuauuauggaugaggcucacuuuacagacccugcgagcauagcugcgcgugguuacauuaguacaagaguaggaaugggcgaagcagcggcaauuuucaugaccgccacuccaccaggaagcguagaggcuuucccacaaucgaaugccguuauacaagaugaggaacgugauauuccagaacggaguuggaacaguggauaugacuggauuacagauuucccaggaaaaacugucugguuuguuccaucaauaaaguccgguaacgacauugccaauugucuacggaaaaaugguaaaagagugauccaguuaucaagaaagacguuugacacagaguaccaaaagacuaaaaauaaugauugggacuauguaguaacgacugacaucucagaaaugggggcuaauuuccgcgccgacagggugauagauccccgccggugccucaaaccaguaauacuuaaagacgggccggaaagaguuauacuagcuggacccaugccagucacagcagccagugcagcacaaaggagaggucgcaucggacgaaaccaaaacaaagagggggaucaguacauuuauauggggcagccguugaacaacgaugaagaccaugcacauuggacagaagcgaaaaugcuucuggauaauauaaauacgcccgaaggaauuaucccugcauuguuugaaccugagagggaaaaauccgcagcaauagauggagaauauagacuucgaggggaagcaaggaaaacuuucguggaacucaugcggagaggcgaucucccaguauggcuaucauauaaagucgcgagugaaggauuccaguauagugauagaaggugguguuucgacggcgagagaaacaaccagguacucgaagaaaauauggauguagaaauauggacuaaagaaggagagcgcaagaaacugagaccgcgguggcuagacgcuaggaccuauucggacccauuggcauuaagggaauuuaaagaguucgcugcgggacgacgcagcguaucuggugacuuaauacuagaaauagguaagcucccacagcaucugacguuaagagcacaaaaugcauuagacaacuugguaaugcuacacaacagcgagcaaggagguaaggcguauagacaugcaauggaggagcuuccugauacuauagaaaccuuaauguuacuggcacuuauugcaguucuuacuggaggaguaacccuauucuuucuaucagggaaaggccucggaaaaacaaguauagguuuacuuugcguaauggcaucaagcgugcuguuauggauggcuagcgucgaaccacauuggauugcugccucgauaauauuggaguucuucuugaugguauugcucauuccagaaccagacaggcaaagaacuccacaagauaaucaguuggcauacguagugauagggcuccuguucaugauacuaacaguagccgcgaaugaaaugggcuuauuggaaacaacuaagaaagacuugggaauaggucacguggucgcugaaaaucaccaccaugccaccaugcuagacauagaucuucaucccgcaagugcauggacauuguaugcaguugcuaccacgauuauaacacccaugaugaggcacaccauagaaaauacgacugcaaacauuucacuaacagccauugccaaucaagcugccauauuaaugggauuggacaaaggauggccaauuuccaaaauggauaucggaguaccacucuuagcucuugguugcuacagucagguaaauccacuuacuuugaccgccgccguauuaaugcuuguugcucauuacgcuaucauugggccaggguuacaagccaaggcaaccagagaggcucaaaaacgcacagcagcgggaauaaugaaaaauccgaccguagacgguauuguggcaauagauuuagacccaguaguauacgaugcuaaauucgaaaaacagcuaggucaaauuauguuacucauccucuguacgagucaaauacuguuaaugagaaccacuugggcacugugugaaucgauuacucuagcgaccggaccacuuaccacauugugggaagggucaccaggaaaauuuuggaauacgacgauagcaguuucaauggcaaauauauucagggggaguuauuuagcuggagccggacuagcguuuaguuuaaugaagucauugggagggggucgacguggaacuggagcucaaggagagaccuuaggcgaaaaauggaaacggcagcugaaccaacuaucaaaaagcgaauuuaacacuuauaagagaaguggaauuauggaaguagacagaucagaagcuaaagaaggacuuaaacgaggagaaacaacaaaacaugcgguuucacguggcacggccaaauuaagaugguuuguagagcguaaccucguaaagccagaaggcaaaguuauagaucuaggcugcggacgaggaggauggaguuauuauugcgcggguuuaaagaaaguaacagaagucaaaggauacacaaaaggcggcccuggucaugaagaaccaauaccaauggcaacauauggauggaacauaguuaaacuccacucaggaagagacgucuucuucaccccaccagaaaaaugugauacucuauuaugcgacauaggagaaucuagcccaaaccccacgaucgaagagggcagaacacugagagugcuaaaaaugguggaaccauggcuaagagguaaccaauucuguauaaaaauucucaacccuuacaugccaucugucguagaaacuuuggaacaaaugcaaagaaaacacggaggaauguugguuagaaacccgcuuucuagaaacucuacucacgaaauguauugggucaguugugggacugggaacauagucagcgcaguuaacaugacaaguagaaugcuauuaaacagauucacuauggcucauaggaagccaacauaugaaagagacguagacuuaggagccggaacuaggcauguggcaguugaacccgaaauagcaaaucuugacauaaucggacaaagaaucgagaacaucaaaaacgaacacaagaguacauggcauuaugaugaagauaaucccuauaaaaccugggcauaucauggaucauaugaaguaaaaccaagcgggucggcaucgucgaugguaaacgguguaguacgccuuuugacaaaaccaugggauguaauuccuaugguuacgcagauagccaugacugauacuacaccauucggccaacaaaggguauuuaaagaaaagguugacacucgaaccccgagacccaagcgugguacggcgcaaauaauggaaguaacugcuaagugguugugggguuucuuaucacguaacaagaaacccagaauauguacuagggaagaauuuaccaggaaagugcgcuccaaugcagcuauaggggcgguauuuguugacgagaaucaauggaacagugcuaaagaggcuguagaagacgagagauuuugggacuuaguacacagggaacgcgaguuacauaaacaaggaaagugugcgacuuguguauauaauaugauggguaaacgagagaagaaacuaggagaauuuggaaaggcuaagggauccagagccauaugguauauguggcuuggagcaagauuucuggaauuugaagcccuuggcuuuaugaacgaggaucauugguuuucgagggaaaauagccuauccggggucgaaggugaaggucuucauaaacugggcuacauucuacgugauauuaguaagauaccaggcgggaauauguacgcugacgacacagcaggcugggacacacguaucaccgaagacgaccuacaaaaugaagcuaaaauaacugauaucauggagccggaacacgcauuauuagcaacgucaauuuucaaauugacuuaccaaaauaaggucgucagagugcagagaccagcaaagagcggaacugucauggaugucaucucacgcagagaccaaagagggaguggucaagucggaacguacggccuaaacacauuuacaaacauggaagugcaauuaaucagacaaauggaaucagaagggaucuuuucaccgucagaacuugaaaauucaaauuuggccgaacguguucuugacuggcucgaaaaacacggugucgaaaggcuuaaacguauggcaauaagcggagacgauugugugguaaaacccacugacgaucgauucgcuacugcguuaauagcccuaaacgauaugggaaaaguuagaaaagauauaccacaaugggagccgucaaagggauggaaugacuggcaacaaguccccuuuugcagccaucauuuccaucaacucauaaugaaagauggacgcgaaauaguaguaccuugucgcaaucaagacgaauuaguuggucgagcucgagugucacagggugcagguuggagucuacgagagacagcaugccuaggaaaaucauaugcgcaaauguggcaacuuauguauuuccaucggagagauuuacgcuuagcggcaaaugcuauauguagugcgguaccagucaauugggugccaacaucacgaacuacuuggucaauacaugcucaccaucaauggaugacuacggaggauauguuaucuguauggaacaggguuuggauagaagaaaauccauggauggaagacaagacacacguaucuuccugggaagacguuccguaccucgggaaacgcgaagaucaauggugugguucauuaauaggucuuacagccagagcaacaugggcaacaaauauacagguagcgauaaaccaaguaagacgucuaauuggcaacgaaaacuaccuggauuacaugacaucaaugaaaagauuuaagaaugaaucugauccugaaggagcauugugguag

SEQ ID NO: 22098 - RNA, 9879 nt, Artificial Sequence
  derived and/or modified CDS sequence (opt6) from DENV-1__KM403588__SS-prME
ucaguaacaaugcuucugauguuauuaccuaccgcguuggcauuccacuuaacuaccagaggcggggaaccucauaugauaguaaguaaacaagaacgggggaaaaguuuacuguuuaaaacaagcgcgggaguaaacauguguacguuaauugcgauggacuugggugaauuaugugaagauacaaugacauacaaaugcccacguauaacagaagcagaaccagaugauguugacugcugguguaaugcuacggauacaugggucacguacggaacuugcucucaaacaggugaacaucguagggauaaaaggucugucgcucuagcaccccaugucggccuaggcuuggaaacgcgcacugaaacguggaugaguucagaaggcgcauggcgacaaauacagaaaguggaaacgugggcacuaagacauccaggauuuaccguaauagcauuauuucuugcgcaugcgauaggcacaucaauaacacaaaaaggcauuauauuuauccugcuuaugcuagugacaccaucaauggcaaugcgaugcgucgguauugggaaccgugacuucguugaagguuuaucaggggcaaccuggguugacgugguguuagaacacgguaguuguguaacaacuauggcgaaaaauaaaccaacgcuugauauugaacuuuuaaaaacagaagugacaaaccccgcaguacuacgaaaauugugcauugaggcgaaaauaaguaauacaacuacggauagcagaugcccuacgcagggagaagccacauuagucgaagaacaagaugccaauuuuguaugcagacggacauuuguugaucgaggguggggcaacgguuguggucuguucggcaaaggaucccuauuaaccugcgcuaaauuuaaaugcgugacaaaacuagaaggcaaaauagugcaauacgaaaaucuaaaauauaguguaauaguaacaguccacacuggugaccaacaucagguugguaaugaaacgacagaacauggaacgauagccacaauuacaccccaagcgccuaccucagagauucaacuuaccgauuacggagcccuuacauuagauugcagccccagaaccgguuuggauuucaaugaaaugguauuauugacaaugaaagagaaaagcuggcuaguacauaaacaaugguuuuuagauuugccacucccuuggaccucaggagccaguaccucccaggagacguggaacagacaagaccuauuaguaacauuuaaaacagcgcacgccaagaaacaagaaguuguggucuugggcucacaagaaggugcuaugcauacugcauuaacgggagcgacggagauacaaaccagcggaacuacaacaauuuucgcgggucauuugaaaugcagacucaaaaugggaaaacugacuuuaaaagggguaaguuacgugaugugcacagguucguuuaaacuggaaaaagaaguugccgagacccaacacgguacuguucuuguacaaguaaaauacgaagggacggaugcaccuugcaaaauaccuauuagcacacaagaugagaaaggggucacgcaaaacggaagauugaucacugcgaaccccauugucacggauaaagagaaaccuguuaauauagaaacagaaccacccuucggagaaucauauauaguaauuggcgcaggagaaaaagcacuuaaacuuucaugguuuaagaaaggaaguagcauaggaaaaauguucgaagcaacggccagaggugcucgccggauggccauacucggagauaucgcaugggauuuugggucaauuggcgguguguuuacaagcgugggcaaauugguacaucaaguauuuggaacagcguacggaguguuauucucaggggucaguuggaccaugaaaaucggcaucgggauauuacugacgugguuaggacuaaacagccgaucuacgagccucucuaugacuuguauugcaguagggauggugacguuauacuuaggaguaaugguucaagccgacucuggguguguuauaaacuggaaagguagagagcuaaaaugugggucuggcauauucguuaccaaugaagugcauacauggacagaacaauauaaauuucaggcagacucaccaaagagauuaagcgcagcuauugguaaggcgugggaagagggcgucuguggaauccgcucggccacucgcuuagaaaauauuauguggaaacagauaucuaaugaacugaaucauauauuacuagagaacgauaugaaauuuacaguaguugucggagacgcuaauggaauauuaacacaaggaaagaaaaugauacguccacaaccgauggagcauaaauauucguggaaaucuuggggaaaagcaaaaaucauaggugcugacacacaaaauacuacuuuuauuaucgacggaccugauacgccagaaugcccugaugaucaacgagcauggaauauuugggaaguugaagacuacggauuugguguuuuuacaacaaauaucuggcuaaaacuccgcgacaguuacacacagaugugugaucaucgauugaugucugcggcgauacgagacaguaaggcuguucacgcggacauggguuacuggauagaaagcgagaaaaaugaaacuuggaaauuagcacgggccuccuuuauagagguuaagacauguauuuggccccgaucacacacacuauggagcaaugguguauuagaaagcgaaaugaucauaccuaaaauuuacgguggcccuaucucucaacauaacuauagaccagguuacuucacacaaacagcugggccauggcauuugggcaaauuagaguuagauuucaauuugugugagggcacgacaguagucguagacgaacacugcgguaauagagguccuucacuaagaacuacgacuguaacuggaaagauuauacacgaaugguguugcagauccuguacauugccuccuuuaagauuucguggagaagaugguuguugguacggaauggaaauacguccaguaaaagagaaggaagaaaacuuggucagauccaugguuagugcgggaaguggagaagucgauucauuuuccuuggguuuauuguguguaagcaucaugaucgaagaaguuaugagaagucgauggagcaggaaaauguugaugacggguacacuagcaguauucuuccuucuaauaaugggacaauuaacauggaaugacuugaucagacuguguaucaugguaggcgcaaacguaagugacagaauggguaugggcacuacauaucuggcccucauggccacuuuuaaaaugaggccgauguuugcggucggguuauuauucagacgauuaacaagccgugaaguuuuacuauuaacgauuggauuaagucuaguagcuagcguagaauuaccuaacagucuagaggaauuaggcgacggacucgcaaugggcaucaugauguuaaagcuccugacugauuuucaaagccaucaguuauggacgacauuacuaagucuaacauuuauaaagacgacucuaucuuuggauuaugcuuggaagacaauggcaaugguacuaagcauagucagcuuauuuccccuuugucucucaacaacgucacagaaaacaaccugguuacccguuuuacuaggauccuucgguuguaaacccuuaaccauguuucucauaacagaaaauaaaauuugggggcgcaaauccuggccccuaaaugaagggaucauggcgguuggaauaguaagcauccuguuaucaucucugcuaaagaaugacguaccacuagcagguccacuaauagccggaggaauguuaauagcaugcuacguaauaagugguaguucagcagaccugagcuuagaaagagcagcugaggucaguugggaagaagaggccgaacacagcggcgcuucgcacaacauuuuaguugaggugcaggaugacggcacaaugaaaauaaaggacgaagagagagaugauacuuuaaccauccuacuaaaagcgacucuacuagcaguaagcggaguauacccgaugucaauuccagcuacacuuuuuguaugguauuuuuggcagaagaagaaacaaagaagcggagugcugugggacacacccucaccuccagaaguagaaagagcuguauuagacgaugguauauaccgcauucuacaaagaggucuacuugggaggucacaagugggcgugggcgucuuucaagauggcgucuuucauacuauguggcacgugacaagaggggccguacuuauguaucagggaaaaagacuggaaccgagcugggcgaguguuaagaaagaccucauaaguuauggcggaggauggagauuccaggguaguuggaauaccggggaagaaguucaaguuaucgcgguugaacccggcaagaaucccaaaaauguacaaaccacuccuggcaccuuuaaaacacccgaaggagagguuggugcaauagcauuagacuuuaaaccgggaacaaguggcucccccaucgugaaucgagaggggaaaauuguagguuuauaugguaacggagucguuaccacuucgggcacuuacgucucugcaaucgcccaagcaaaggcuucccaagaagguccucuucccgaaauagaagaugaaguauuuaagaaaaggaacuuaacgaucauggaccuccauccaggaucaggcaaaacccggcguuaucuuccugcaauuguuagggaagccauuaaaagaaaguugagaacucuaauauuagcaccuacccgcgucguagcaagcgaaauggcagaggcacuuaagggaaugcccauacguuaucaaacaacagcugugaagagugaacacacaggaaaagaaauaguagacuuaaugugucaugcgacauuuacgaugagguuauugaguccuguacgaguucccaacuacaacaugauaaucauggacgaagcucauuucaccgacccagcauccaucgccgcaagagguuacauuaguaccagaguaggaaugggcgaagcugcggccauauuuaugacagcuacaccgccuggcucgguagaggcuuucccacaaaguaaugccguuauccaagacgaagaaagagauaucccagaaaggucauggaacaguggauaugacuggauuacugacuuucccgggaaaacagucugguuuguucccaguauaaagucaggcaaugauauagcaaauugccugaggaaaaacggaaagagagugauucaacucuccaggaaaacauuugauacagaauaucaaaagacuaaaaauaacgauugggacuauguuguaacuaccgacauuagugaaaugggggcaaauuuucgggccgaucgcguaaucgaccccagaagaugucuaaaaccaguuauucuaaaagacgguccugaaaggguaauccuugccggacccaugcccguagccgcugcuagugcagcccagcguagagguagaaucggacgaaaccaaaauaaagaaggggaccaauacauauacauggggcagccacuuaacaaugaugaagaucaugcgcauuggacagaagcaaagauguugcuagacaacauaaauacgccagaagguaucaucccugcacuguucgagccggaacgcgagaaaagugcggcaaucgacggagaauaucgccuucgcggugaggcucguaaaacuuucguugaauuaaugcggagaggugaucugccaguauggcucaguuacaaaguggcgucagagggcuuccaauacagugauagaaggugguguuuugacggcgagagaaauaaucaagugcucgaagaaaauauggauguugaaauauggacgaaagaaggcgaaaggaagaaauugcggccacguugguuggaugcacgcacauacagcgauccccuggcucuaagggaauuuaaagaguucgccgccggaagaagaucuguuuccggugauuuaauuuuagaaauuggaaaacuaccccaacaucuaacacuccgcgcgcaaaaugcacuagauaauuuaguuaugcuucauaauucugaacagggcggaaaagcauaucggcacgcaauggaggaguuaccagacacaaucgaaacuuugauguuauuagcacuaauugccgucuuaacuggcggcguaacacuauucuucuuaagugguaaagguuuaggaaagacaucgauuggacugcuauguguuauggcaucuaguguucuuuuauggauggcaaguguugaaccucauuggauagcggcaagcauaauucuugaguuuuuccuuaugguuuuauugauaccagaacccgauagacaaagaacgccucaagauaaucaauuggcuuaugucguaauaggccugcuuuucaugauucuaacuguagcagcgaacgaaaugggguuauuggagacuacuaagaaagauuuagguauaggccacguuguagcagagaaucaucaucaugcuaccaugcuagauauagauuuacacccagcaagugcuuggacacucuaugcgguagcuacuaccauaaucacuccaaugaugagacauaccauugaaaauacuacggcaaacaucagccuaacugcuaucgcaaaccaagcugccauacucauggggcuugauaaaggcuggccaauauccaaaauggacauaggaguccccuuguuagcacucggaugcuacagucaagucaauccucuuaccuuaacagcggcaguacuuauguuaguugcccacuacgcuauuauagguccgggacugcaagcaaaagccacacgagaagcacagaaaaggacagcagccggcauaaugaaaaauccgacaguggauggaauaguagcuauagauuuagauccaguaguuuaugaugcaaaguucgaaaagcagcucgggcagauaaugcuauuaauuuuguguacuucacagauacugcuaaugcgcacuaccugggcacugugcgaaucaauaacauuggccacagguccauuaacaacauuaugggaaggcaguccugguaaauucuggaauacuacaauugccguaucuauggcaaacauauuucggggcaguuaccucgccggugcaggauuggcguucagcuuaaugaagucgcucgguggaggacguaggggcacuggagcccaaggagaaacacuaggagaaaaauggaaacgccaacuaaaccaacugagcaaaagugaguuuaacaccuauaagcgcagugggaucauggaaguagauagaucugaggcuaaagaagguuuaaagagaggagaaacuacuaagcacgcagugucaagaggaacagcuaaauuacgaugguuuguugaaagaaaucuagucaaaccggaggguaagguaaucgaccucggauguggacgaggagguuggucguauuacugugccggccucaagaaaguuacugaaguaaaaggcuacacgaaagggggcccaggccacgaagaacccauacccauggccaccuauggauggaacauugugaaauugcacucaggaagagauguuuucuuuaccccaccagaaaagugugauacacuucugugcgauauuggugaaucuucgccgaauccuacaaucgaagagggacgaacccuacgaguuuuaaaaaugguagaaccaugguuacgcggaaaucaauuuuguaucaaaauuuuaaacccuuauaugccauccgucguagagacucuagaacaaaugcaaaggaaacauggagggauguuaguaagaaauccgcuaucuaggaacaguacccaugaaauguauuggguuaguugcgguacagguaauauaguaucagcaguuaauaugacaucaagaauguuauuaaaucguuuuaccauggcgcaucggaaaccaacuuacgagagggacguggaccucggagccgguacucgucaugucgcuguugaaccagaaaucgcaaaccuagauauuauuggucaaaggaucgagaauauuaaaaaugagcauaaaucgacuuggcacuaugacgaagacaauccguauaagacgugggcuuaucauggaagcuaugaagugaaaccuaguggaucggcuucauccaugguuaaugguguggugaggcuucucacuaaacccugggaugucauaccaaugguuacucaaauugcaaugacagacacaaccccauuugggcagcaacguguuuuuaaagaaaagguggauacacguacaccgaggcccaaaagagguacggcccaaaucauggagguaacagcuaaauggcuuuggggguuucuuucacgcaacaagaaaccucgaauaugcacaagagaagaguucacacgaaaaguccgaaguaaugcagcuaucggcgcagucuucguagaugaaaaccaguggaacagugccaaagaagcgguagaagaugaacgauucugggaucugguacauagggaacgugaguuacauaaacaaggaaaaugugcaacauguguauauaauaugaugggcaaacgugagaagaaacuaggagaguucggaaaagcuaaaggaagcagagcaaucugguauauguggcuuggagcgagauucuuagaguucgaggcgcuaggcuuuaugaacgaagaucauugguuuagucgagagaacaguuuaucgggaguagaaggugagggacuucacaaauuaggguauauuuugagggacauuucaaaaaucccaggcgguaacauguacgcagaugacacagcuggaugggauacuagaauaacagaagaugauuuacaaaacgaggcgaaaauaacagauauaauggaaccggagcacgcauuauuagcgacaagcauuuucaaacuuacauaucagaauaaaguagucagaguacaaagaccagcaaaaucagguacaguaauggauguaaucucacguagagaccaacgaggaaguggacaaguuggaacguacgguuuaaacacauuuacaaacauggaaguucaacuuauaagacaaauggaaucugaaggcauauuuagcccuucugaauuagaaaacucgaauuuggcggaaagaguauuagauugguuagagaagcaugguguggaacgucuuaagaggauggcuauaucgggugacgauugugucguuaagccaacagaugauagauuugcuacggcacuaacagcguuaaaugauaugggcaaagugcgaaaagacaucccacagugggagccaaguaagggauggaacgacuggcaacaaguaccauucuguagucaucacuuucaccaacucaucaugaaggauggacgggaaauagugguaccgugucguaaucaggacgagcuaguagguagagcuagaguuucucagggggcgggauggagucuuagagagacggcaugccuagguaagucuuacgcacagauguggcaacuuauguauuuucauaggcgcgaucucaggcuagcagcaaaugcgauauguucugcaguuccggugaauuggguucccacaaguaggacaaccuggucuauacaugcccaucaucaauggaugacaacugaagauauguuaucuguguggaauagaguuuggauugaagagaaucccuggauggaagauaaaacccauguuucaucaugggaggauguaccuuauuuagggaaacgagaagaucaaugguguggaucacuuauaggacuuaccgcacgagcaacaugggcaacuaauauucaaguugcaauaaaccaagucagaagacuuauaggaaacgaaaauuauuuagacuauaugaccucaaugaaaagauuuaaaaacgagucugauccagaaggggccuuaugguag

SEQ ID NO: 22099 - RNA, 9879 nt, Artificial Sequence
  derived and/or modified CDS sequence (opt6) from DENV-1__KM403605__SS-prME
ucaguaacuauguuacuaauguuauuaccaacagcacuagcguuucaccuaacaacaagagguggcgaaccccauaugauuguaucaaaacaagaacguggcaaaucuuuauuauuuaaaacgagugcaggcguaaauauguguacauuaauagcaauggaucuuggagaauugugugaagacacuaugacguauaaauguccuagaauaaccgaagcagaacccgaugauguggauuguugguguaacgcuacggauaccuggguaacuuauggaacaugcucucagacgggcgaacauagacgcgauaaaagaagugucgcgcuagcaccacacguugguuuaggcuuggaaacacgaacugaaacauggaugaguucggaaggcgcuuggcgacaaauacaaaaaguagaaacaugggcucuaagacacccugguuucacuguaauagcauuauuccuggcucacgcaauaggaaccucgauaacccaaaaaggaauaauauucaucuuauuaaugcugguaacgccaagcauggcgaugcgaugcguaggaauugguaaccgagacuucgucgaaggccucaguggugcaacauggguagacgucguacuagaacacgguuccugugugacaacaauggcuaaaaauaaaccgaccuuagauauugaauuacuaaaaacugaaguaacaaauccggcagugcugaggaaacucuguauagaagccaaaauuucgaauacaaccacagacagcagaugcccuacacaaggggaagccacccuugucgaagaacaagacgcaaauuuuguaugccgacgaacauucguugaucgugguugggguaacggauguggauuauuugguaaagguucacuacuuacuugcgcgaaauuuaaguguguuacuaaacuugaagguaagauaguucaauaugaaaaucucaaauauuccguaauagucacuguacauacuggagaccaacaccaagucgguaaugaaaccacagaacauggaacaauagccacgauuacuccacaggcuccaacaagcgaaauucaacuaacagauuauggugcauuaacauuggauuguucgccacgaacaggacuagauuuuaaugaaaugguauugcuaacuaugaaagagaaaagcugguuaguucacaagcagugguucuuagaccucccucuccccuggacaaguggagccaguacgucacaagagacauggaauagacaagauuugcuugucacguuuaagaccgcucaugcaaagaaacaagaggucguggugcuggguucucaggaaggagcgaugcauacagcauuaacaggagcaacagaaauacaaacaucagggacaaccacuauuuuugcggggcaccuuaaaugucgacuaaaaauggauaaacugaccuuaaaaggaguuuccuauguuauguguacuggguccuuuaaacucgaaaaagaagucgcagaaacucaacacggcacaguauuaguucaaguaaaauacgaaggaacggaugcaccaugcaaaauuccuauaucuauucaagacgaaaaaggaguaacucaaaauggacgacuaaucacagccaauccaauuguuaccgauaaagaaaagccaguuaauaucgaaacagaaccaccauuuggggaguccuacauuguaauaggagcaggagaaaaagcacucaaacuuucaugguucaagaaaggaaguaguauuggcaaaauguuugaagcgacugcacguggugcaagacggauggcaauauugggagauacugccugggacuuugggucaauaggcggcguguuuacauccguugguaaguugguacaucaggucuuuggaaccgcuuauggagugcucuuuucuggcguuagcuggaccaugaaaauagguauaggaaucuuauuaacguggcucggacuaaauucucgaucaacuagcuuaucaaugacguguauagcgguaggaauggugacauuauaucuagggguaaugguccaagcugauaguggaugugugauuaacuggaaaggacgcgaauuaaaauguggaucugguauauucguuacuaaugaaguccacacuuggaccgaacaauauaaauuccaagcagauucgccaaaaagguuaucagccgccaucgguaaagccugggaagaagguguaugugggauucguucagcaacccggcuagaaaauauaauguggaaacaaauuagcaaugaacugaaccauauacuacuggagaacgacaugaaauuuaccguagucguuggagacgcuaacgggauucuaacacaagggaagaaaaugauccguccacaaccaauggaacauaaauacucauggaagaguuggggaaaagcgaaaaucauuggagccgacacccaaaacacuacauucauaauugauggcccagacaccccugaaugucccgaugaucagcgcgcuuggaacauaugggaaguugaagauuauggauucggaguauuuaccacuaauaucuggcuaaaauugagggauucauauacgcagaugugugaucauagacuuaugagugcagcuauaaaagacaguaaggcuguacaugcugacaugggcuauuggauagaaucggagaaaaaugaaacuuggaaauuagcacgugcuucguucauugagguuaaaaccuguauauggccuaggagucauacgcucuggucaaauggaguauuggagucggaaaugaucaucccaaaaaucuauggcgggccaaucagucagcauaacuauagaccgggauacuuuacgcaaacagccgggccuuggcaucuugguaaguuagaauuagauuucaaucuuugcgaagguacaaccguagugguugacgaacauuguggaaacagagguccuucacucagaacaacaacaguuaccggaaaaauaauccaugagugguguugccguucgugcacgcugccuccacuaagauucaggggcgaagacggcugcugguacggcauggagauaagaccaguaaaagagaaagaagaaaacuuaguaaggucaauggucucugccggaucaggggaggucgacaguuuuucccuaggucuccuuugcguuaguauaaugauagaagaggugaugagguccagauggagucgaaaaauguuaaugacagggacgcuagccguauuuuuccucuuaauuaugggacaguuaacauggaacgaucugauaagauugugcauuaugguaggcgcuaaugugucagaucguaugggaauggguacuacauaucuagcacuaauggcuaccuuuaaaaugcgaccgauguuugcaguagggcuuuuauuuagaagacuaacaucacgggaaguucuguuacuaacgaucggacucaguuuaguagcaagcgucgaauugccaaacucauuagaggaauugggggacgguuuagcaauggguauaaugauguuaaaauugcuaacugacuuccaaagucaccaauuauggacgacguuacuaucgcuaacuuucauaaaaaccacuuuaucauuagauuacgcguggaaaacgauggcuaugguucucaguauaguaucacuauucccucuuugccuaaguacuacaagucagaaaaccaccugguuaccaguauuacuggguucauuuggcuguaagccuuugacuauguuucuuauuacugaaaauaaaauauggggaagaaaaucuuggccccugaaugaaggcauaauggcgguuggaaucguauccauacuacuaagcucauuacugaagaacgauguaccgcucgcgggaccgcuuauagcaggaggcaugcuaauugcguguuacguaaucucagggucaucugcggaccuuucguuggagagggcggcugaaguaaguugggaagaagaagcagaacauuccggagccucacacaauauucuaguugaaguccaagacgacggaacaaugaaaauaaaggaugaggaaagggacgauacguuaaccaucuuauuaaaagcaacauugcuagcaguaagcgguguauacccgaugucgauucccgcaacauuauuugucugguauuuuuggcagaagaagaaacagagauccgggguuuuaugggauacaccuucaccucccgaaguugagcgggcuguccuagacgaugguauauauagaauccuacaacgcggguuauugggaaggucgcaaguaggcguaggaguuuuccaggacgguguuuuucauacaauguggcauguuacacguggugccguacuaauguaccaaggaaaaagguuagaaccuuccugggcgucugucaagaaagauuuaauaagcuacgguggaggguggagauuccaaggauccuggaacacaggagaagaaguccaaguaauugcagucgaaccuggaaagaauccgaaaaacguccaaacaacaccugguacauuuaagaccccagaaggagaaguuggagcuauugcauuagauuucaagccuggaacaucggguaguccaauagugaaucgugaaggaaaaauaguaggccuuuaugggaacggaguuguuacaacaagugggacuuaugugucggcaauagcacaagcaaaggcuucucaagaaggaccuuuaccagaaauagaagaugaaguguuuaagaaaaggaauuuaacaauuauggaucuucauccugguucugggaaaacucggagguaucuccccgcaauuguucgagaggccaucaaaaggaaauuacgaacuuugauucuggcgccaacaagaguagucgcgucugaaauggcggaagccuuaaaaggaaugccuauaagauaccaaaccacagcuguaaaaucugaacauacaggcaaggagauugucgaccugaugugccaugcaaccuucaccaugagauugcuaucacccguccgggugccaaauuacaauaugauuauaauggacgaggcacacuuuacagauccagcaucaauugcugcccgugguuacauuucuacacguguuggaaugggagaagcggcggcuaucuuuaugacugccacaccacccgguaguguagaggcauuuccccaauccaaugcuguuauucaagaugaagaacgggacaucccagaacguucauggaacucaggcuaugauuggauaacagauuuuccaggaaaaaccgucugguuuguucccuccauaaaaucagggaacgacauugccaauugucuuaggaaaaaugggaagagggugauccaacugagcagaaagacauuugacacagaauaucaaaagaccaaaaacaacgauugggacuauguagugacuacugacaucucugaaaugggagccaacuuuagggcugauaggguaauugacccgcgucgaugucuuaaacccguaauacuaaaggacgguccagagcgaguaauccuugcuggacccaugccaguaacugcugccagugcugcacaaaggagggggcgcauaggacgcaaucaaaacaaagagggagaucaauacauuuauaugggacaaccacuaaauaaugaugaagaccacgcacacuggacagaagcaaagaugcuauuagacaauauuaauacccccgaagguaucauuccagcuuuauuugagccagaaagagagaaaucagcugccauagauggcgaauaucgacuuagaggggaagcgcgaaaaacguuuguagaauuaaugagacgaggugauuugccggucuggcuuagcuacaaaguugcuucagaggguuuccaauacagugaucgacguuggugcuuugauggcgaaaggaacaaccaaguauuagaggagaacauggacguggaaauuuggacgaaagaaggagagcgaaagaaacugagaccucguuggcucgaugcacguacuuauucugacccauuagcgcugagagaguucaaagaguuugcggcaggccggaggaguguaagcggagaucuaauacuugaaaucggcaaacugccucagcaccuuaccuuacgagcacagaaugccuuggauaaucuugugaugcuucauaacucagaacaagguggaaaggcuuacagacacgcuauggaagaacuaccagauacaauagaaacucucauguuauuagcuuuaauagcaguacuuacuggaggugugacacuguuuuuccuaagugguaaagggcuugguaaaacaucaauuggacuacucugcguaauggcaucaucggucuuacuuuggauggcuagcguagaaccgcauuggauugcagccucaauuauucucgaguucuucuuaaugguuuugcuaauuccagaacccgacagacaaaggaccccacaagacaaucaacuugcauacgucguaauuggauuacuuuuuaugauacuuacuguagcugcuaacgaaaugggacuccuggagacaaccaagaaagaucuagggauaggacauguaguugcggagaaccaccaccaugccacgauguuagacauagacuuacacccugcaucggcauggacacuguaugcuguggcgacaacuauaauuacaccuaugaugagacauaccauugaaaauacaacagcuaacauaucacugacagcaauagcgaaucaagcugcuauauuaaugggguuagacaaaggauggccaaucagcaaaauggauauuggcgugccuuuauuggcuuuaggaugcuauagucaaguaaacccacuaacuuuaacugcggcaguauuaauguugguggcccacuaugccauuauaggacccgguuuacaggccaaagcuacccgagaagcacagaagagaaccgcagcuggcauaaugaaaaacccaacagucgauggaaucguagcgauagauuuagauccaguuguauacgaugcaaaauucgaaaaacaguuagggcaaauaauguuauuaauauugugcaccagccaaaucuuauuaaugaggacaacaugggcauuaugugagucuauaaccuuggcaacagguccuuuaacgacucuaugggaaggcagcccuggcaaauuuuggaauacaacuauagcgguaucaauggccaauaucuuucgaggaagcuaccuagcuggugcggguuuagcuuuuuccuugaugaaaacuuuagggggaggacgacggggcacuggagcucaaggugaaacuuuaggagaaaaguggaaaagacaacuaaaucaauuaaguaaaucagaauuuaacacauacaaaagaucgggaaucauggaagucgaccguagcgaagcuaaagagggauugaagcgaggugaaaccacuaagcaugccgucagcagaggaaccgcaaaacucagaugguuuguagaacgcaaccugguaaaaccagaaggcaaagugauugauuuaggauguggccgcggaggauggagcuauuacugcgccggccuuaagaaaguuacagaagucaagggauacacaaaagggggaccaggccacgaagaaccaauaccaauggcuaccuacggauggaacaucgucaaguuacauuccggcagagauguguucuuuacuccuccagaaaaaugugauacccuccuuugcgauauuggcgaaagcucacccaacccaacuauugaagaaggccgcacucuacguguauuaaaaaugguugaaccuuggcugcgcggaaaucaauucuguauaaaaauccuaaauccuuauaugccaucagugguugaaacuuuggaacaaaugcagcgaaaacacggagggauguuagugcggaaccccuuaucacguaauuccacacacgaaauguauuggguguccuguggaaccgggaacauaguaagcgcuguaaauaugaccaguagaauguuacuuaacagguuuacaauggcacaucgaaaaccaaccuaugaacgcgauguagacuuaggagcugggacccggcacguugccguagaaccagaaauugcgaaccucgacauaauugggcaacgcaucgaaaauaucaaaaaugagcacaaaagcaccuggcauuacgacgaggauaauccguacaaaacaugggcguaucauggcucauacgaaguaaaaccaaguggaucagcaucuuccaugguuaauggaguuguaaggcucuuaaccaaaccuugggaugugauacccaugguuacacaaaucgcuaugacugacacaacgccuuuuggacagcaacgaguguuuaaggaaaaaguagauaccaggacaccaagaccuaaaagaggaacugcucagauuauggaaguaacggcaaaaugguuguggggcuuucuuucacgaaauaaaaagccacguaucuguacacgagaagaguucacucgcaagguacguucgaaugcagccauaggcgcaguuuuuguagaugagaaccaauggaacucugcaaaagaagcgguugaagacgaaagauuuugggaucuuguccauagagaacgagaauuacacaaacaaggcaaaugugccacgugcguuuauaauaugaugggaaaaagagagaagaaauuaggugaauuuggaaaagcaaaaggaaguagagcgauaugguauaugugguugggcgcaagauucuuagaauuugaagcauuaggauucaugaacgaagaccacugguuuucgagagagaacucccuuagcggaguagaaggugaaggguuacacaaacuuggcuauauucuacgcgacauauccaaaauaccuggagguaacauguacgccgacgacacugcuggaugggauacuaggaucacggaggaugacuugcagaacgaagccaagauaaccgacauaauggagccggaacacgcacuacuagcgacaagcauauucaaauuaacuuaucagaauaaaguagucagaguacagcgcccagcgaaaucaggaacaguuauggaugugauaucucgaagggaccaacguggaaguggacaaguaggaaccuacggauugaauacuuuuacaaacauggagguucagcuuauaagacaaauggaaucggaagggauauucagcccaucagaauuagaaaacaguaaccuggcagaaagaguacuugacuggcuagaaaaacacgggguggaacguuuaaaaagaauggcaaucaguggagaugacugcgaaguaaaaccaacagaugaucguuucgcuacugcccucacagcacuaaaugacaugggaaaaguacggaaagauauaccacaaugggagccaaguaaaggauggaacgacuggcagcaaguaccauuuuguagccaccauuuccaccaacuaauaaugaaagacggcagagaaauuguaguacccugucggaaucaagacgagcuuguagggcgagcaagagugucacaaggagcaggauggagccuaagagaaacugcuugccuugguaaaucuuacgcucaaauguggcaauuaauguacuuucacaggcgagaccuacguuuagcagcgaaugccauauguuccgcagucccgguaaacuggguuccgaccucuaggacuacuuggagcauccaugcacaucaccaauggaugacuacagaagauauguuaagcgucuggaauaggguauggauugaagaaaaucccuggauggaagauaagacccacguauccaguugggaagacguuccguaccuagggaaacgggaagaucaguggugcgguaguuuaauugguuugacagcuagggccacgugggccaccaauauucaggucgccaucaaccaaguuaggcgauugauaggcaaugaaaauuaccuugauuauaugacuagcaugaaaagauuuaaaaaugaaucagacccagaaggagcacucugguaa

SEQ ID NO: 22100 - RNA, 9879 nt, Artificial Sequence
  derived and/or modified CDS sequence (opt6) from DENV-1__KM403606__SS-prME
agugucacuaugcuacuaaugcuguugcccacagcucuagccuuucaccucaccacucgcggaggagaaccacacaugauuguuagcaaacaagaaaggggaaaaagccucuuauuuaaaacuucagccggugucaacaugugcacacuuauagcaauggauuugggugaacuuugcgaagacacuaugacguacaaaugcccaagaauuacagaagcugaaccagaugacguagacuguuggugcaaugcuacagauacauggguaacuuacggaacuuguagccaaaccggggaacauagacgagacaaaaggucuguagcuuuagcaccacauguuggauugggccuggaaacaagaacugaaaccuggaugaguucagaaggagcauggagacaaauacaaaaaguagagacuugggcucugcgccacccgggcuuuacagucauagcuuuauuuuuagcgcaugcaauaggaacaagcaucacccaaaaagguaucauauuuauacuacuaaugcuagucacuccaucaauggcuaugagaugcguugggauaggcaaucgagauuuugucgaaggucuuagcggugcuacgugggucgauguaguguuagaacacgggucuugugugacgaccauggccaaaaacaaaccaacacuagacauugaacuacuuaaaacggaggucacaaauccagcaguguugagaaaauuauguauagaggcaaaaaucucaaauacuacgacugauucaagguguccuacucaaggagaagcaacuuugguagaagaacaagaugcgaauuuuguaugucggagaacguucgucgaccgagggugggggaaugguugugggcuuuucgguaaagguagccuacucacaugcgccaaauucaaauguguuacaaaauuggaagggaaaauuguucaguaugaaaaucugaaauauagugucauaguaacggugcacacaggugaucaacaucagguaggcaaugagacuacagaacauggaacuaucgcuacaauaacaccucaagcacccacacuugagauacaauuaacggacuauggagcauuaacauuggacugcaguccuagaacaggauuggacuucaacgaaaugguucuccugacaaugaaagagaaaaguugguuaguacauaaacaaugguuucucgauuuaccuuuaccauggacauccggagcuucaacaucacaagagaccuggaauagacaagaccuccuugucacauuuaaaacggcacaugcgaagaaacaagaaguggugguacuuggcucucaagaaggagcaaugcauacugcucugacgggagccacugaaauccaaacgucagguacaacaacgaucuucgcaggucauuuaaaaugcagacuuaaaauggauaaacuuacucuuaaaggaguuagcuauguuauguguacggggucguucaagcucgagaaggaggucgcagaaacgcaacauggaacagucuuaguacaaguaaaauaugaagguaccgaugcucccuguaaaauaccuauuagcacgcaggaugagaaaggaguaacacagaauggaagacuuauaaccgcaaauccaaucguaacagacaaggaaaagccuguaaauaucgaaacagagccaccauuuggcgaauccuauauaguuauaggcgcgggggaaaaggcccuuaaguuaaguugguuuaagaaaggaucuucuauuggaaagauguuugaagcaacagcacgaggcgcacggagaauggcaauauugggagacacugcaugggauuuugggucuauaggugguguuuucacaaguguugggaaauuagugcaucagguauuuggaaccgcauauggaguuuuguucagcggaguuaguuggacgaugaaaauugguauaggaauuuuauugacuuggcucggacugaauaguagaucuacgagccuauccaugacguguauagccguuggaaugguuacauuguauuuaggaguaaugguacaagcugauuccgguuguguuauuaauuggaaaggucgagaacugaaauguggaagcggcaucuuuguaaccaaugaaguacauacguggacugaacaauacaaguuccaagcagacucucccaaacgguuaucagccgcaauuggcaaagccugggaagaaggugugugugggauucgcagugcaacccggcuugaaaauauaauguggaaacagauaucaaaugaacuuaaccacauacuuuuggaaaaugauaugaaauucacgguugugguaggggacgcgaauggcaucuuaacacaagggaagaaaaugauaagaccucaacccauggagcauaaguauagcuggaaaaguuggggaaaagcaaaaauuauuggagcagacacucaaaauacaacauuuauuaucgacgggccugauacaccagaguguccggaugaccaacgcgcguggaauauaugggagguagaagauuacggauucggaguguuuacaacaaacaucugguugaaacuaagagacuccuacacacaaaugugugaucauagauuaaugagcgcagcuauaaaggacucuaaagcaguacacgccgauaugggguauuggauugaaucagagaaaaaugagacuuggaaacuggcccgugcaucauuuauagagguaaaaacauguauauggccuaggucccacacacuuuggucgaacgguguucuugagucagagaugaucauaccgaaaaucuauggcggcccuauaucacaacauaauuauagaccagguuauuuuacacaaacagcaggaccauggcauuuaggcaaacuugaacucgauuuuaauuugugugagggaacaaccguaguaguggacgaacacuguggaaacagggguccaucguugcguacuacaacaguuaccgguaagauaauacaugagugguguugcagaaguugcacucuacccccacuuagauucagaggagaggauggauguugguaugggauggagauaaggccaguaaaggaaaaagaagaaaaucuagucagaagcaugguuagcgcaggaucuggagagguugauaguuuuucauuaggauuacuauguguuagcauuaugauagaggagguaaugagaucccguuggaguagaaaaauguuaaugacgggcacauuagcuguauucuuucucuuaauaaugggccaauugacuuggaacgauuuaauccgucuguguauuauggucggggcaaacguuucugauagaauggggaugggaaccaccuauuuggccuugauggcaacauucaaaaugagaccuauguuugcuguaggccuucucuuuagacguuuaacaucaagagaagucuuacuucugacgauaggucuauccuuaguugcuagugucgaguuaccgaauagucuagaagaacucggugauggauuagcuaugggcauaaugauguuaaaacucuuaacagacuuucaaagucaucaacuuuggacaacucuacuaucucucacauucauaaagacaacacuuagcuuagauuacgcauggaaaacaauggcaauggucuuaucaauuguuagccuguucccauuauguuuguccacaacaucacaaaagaccacaugguuaccgguucuacuagguaguuuuggauguaaaccacuaacgauguuuuugaucacagaaaauaaaauauggggaaggaaaucauggccgcuuaacgaagguaucauggcgguuggcauuguuucgaucuuacucucaagucuauugaaaaaugacguaccguuagcaggaccauuaaucgcgggcggaauguuaauagcaugcuacguaaucagcgguaguuccgcggacuuaucacuagaaagagcagcggaaguaucaugggaggaggaagccgagcacucuggagccagucacaacauacuugucgaagugcaagaugacggaacaaugaaaauaaaagaugaagaacgcgacgacacucuaacaauauugcuaaaagcgacucuccuugcaguaagcgguguguacccaaugagcauuccggcgacgcucuuugugugguauuuuuggcagaagaagaaacagcgaagcgggguacugugggauacgccaucuccacccgagguugagcgcgcuguacuagacgauggaaucuaucguauauuacagcgaggguugcucgggagaagccaaguaggagugggaguauuccaagaugguguuuuccauacaauguggcacguuacucgcggagccguauuaauguaccaaggaaagaggcuggaacccuccugggcaucuguuaagaaagauuuaaucucguauggcggaggguggagguuucaggguucauggaauacaggagaagaaguucaaguuaucgcuguagaacccgguaaaaauccgaaaaauguccaaacgacacccggaacuuuuaaaacccccgaaggugaagugggagcgaucgcguuagauuucaaaccgggcacgagcggaagcccuauagucaauagagaaggaaaaauaguaggccuguacgggaauggagugguuacaacauccggaacauauguuagugcuaucgcacaagcaaaagcgagccaggagggcccuuuaccugaaauagaagacgagguuuuuaagaaacgaaauuuaacaauuauggauuuacauccagguaguggaaaaacccggcgauaccugccugccaucguaagagaagcaauaaaacguaaacuccgcacuuuaauauuagcacccacuaggguaguagcaucagaaauggcagaagcacuuaaaggaaugccuauacguuaucagaccacagcaguaaagagugaacauacugguaaagaaauaguugaucuuaugugucaugccacuuuuaccaugagacuucucucaccaguuagaguaccaaauuauaauaugauuauaauggaugaggcacacuucacugauccugccuccaucgcggcgcgaggauauauuaguacuagagugggaaugggagaagcagcagcaauuuucaugacagcgacaccuccaggcaguguagaggcuuuuccacaaucaaacgcgguaauacaggaugaagaaagagacauuccugaacgcucauggaauagcgguuaugacuggauaacugauuucccggggaagacgguaugguucguaccaaguauaaagaguggaaaugauaucgcaaauugcuugcguaaaaaugguaaaagagucauacaacuuucccgcaagacauuugauaccgaguaucagaaaaccaagaacaacgauugggauuacguagugacaacagauauuagcgaaaugggugcuaacuucagagcggaccgaguuaucgacccuagaagaugucugaaaccaguuauauugaaagacggaccugaacguguaauccuggcugguccuaugccuguuacagccgcaagugcagcccaacgacgcggaagaaucggaagaaaccagaauaaagaaggggaccaauauauauauaugggucagccacuuaacaacgacgaagaccaugcccauuggaccgaggcuaaaauguuacuagauaacauuaauaccccagaagggauuauaccggccuuauuugaaccagagagagagaaaagugcggcgaucgauggugaguaucgcuugcgaggcgaagcgcguaaaacauuuguagaacuuaugagacgcggugauuuaccagugugguuaagcuauaaaguugccagugaaggcuuucaguacagugauaggcguugguguuuugauggugaaagaaacaaccagguucucgaagagaauauggauguagaaauuuggaccaaagaaggugaacguaagaaacugcggcccagaugguuggaugcaagaacauacagcgauccauuagcucuacgugaauuuaaagaauuugcggcaggaagacggucagugucgggagaccuaauacuagaaauagguaaauuaccgcagcaccucacucuacgagcucaaaaugcacuagauaacuuagucaugcuacauaacucggaacaaggcggcaaagcguauaggcaugcgauggaagaacuacccgauacaauagagaccuugauguuacuugcacucauagccguauugacaggaggaguuacguuguucuuucuaucuggaaaagguuugggcaaaacaagcauagggcuucuuugugugauggcaaguaguguguuauuauggauggcauccgucgaaccccauuggauugcagcuucgaucauacuugaauuuuucuuaaugguauuacuuauaccagaaccugacagacaaagaacuccacaagauaaccaacuugcauacguugugaucgggcuauuauuuaugauucucacagucgcagccaacgaaaugggauuacuugaaacuacuaagaaagaucuaggcauuggacauguaguagcagaaaaucaucaucaugcuacuaugcuugauauagaucuucauccagcaagugcuuggacucucuaugccguagcaacaacaaucauaacacccaugaugagacacaccauagaaaauacuacagccaacauaucgcucacggcaauagcaaaucaagcagccauauuaaugggguuggauaaaggauggccaaucaguaaaauggacaucggcguaccgcuacuugcucuuggguguuauagucagguaaauccacuaacccuuacagcggcaguacuuauguuaguggcacacuaugcaauaaucggaccgggacuccaggcaaaagcuacgagggaagcccaaaagagaacagcugccggaauuaugaaaaacccaacuguagaugggauuguugcaauagauuuagauccgguaguauacgacgcuaaguucgaaaaacaacuuggucagauaauguuauuaauacuguguacaucacaaauccuauuaaugagaacaacuugggcuuugugcgagucaauaacguuggcuacaggaccacuuaccacgcuaugggaggggucuccuggcaaauuuuggaacacuacuauagcugucucaauggcuaauauauucaggggaaguuacuuagccggagcaggacucgcuuuuucacuuaugaaaacgcucggaggcggaaggagggguacgggagcucagggugagacgcucggggaaaaauggaaaagacaacuuaaucaacuuucgaaaucagaauuuaacacuuauaaaagaaguggaauaauggaaguggaccgaucagaagcaaaggagggguuaaaacggggugagaccacaaaacaugcggugagcagagguaccgcaaaauuaagaugguuuguugaaagaaaccucgucaagccagaagggaaggucauugaucuuggguguggucgggguggguggucguacuauugcgcuggacugaagaaaguaaccgaaguaaaaggcuacacuaaaggaggaccuggucaugaggaaccuauaccuauggcuacauaugguuggaauauagucaaacuucauucuggaagagauguauucuuuaccccuccagagaaaugcgauacacuauuaugcgacauaggugaaucuucuccaaacccuacaauagaagaaggcagaacacuacguguauugaagaugguagaaccaugguuaagagguaaccaauuuugcauaaagauucugaacccauauaugccgucuguaguugaaacccuugagcagaugcaacgcaaacaugggggaauguuaguaagaaauccguuaagccgaaauaguacgcacgagauguacuggguuuccuguggaacagguaacauuguaucugcagucaauaugaccaguagaauguuacuuaaucgcuuuacaauggcccauagaaaaccaaccuacgagcgugacguagaucuuggugccggcacccgacaugucgcaguagaaccugaaauagcaaaucuggacaucaucgggcaaaggauugaaaacauaaagaaugaacauaagucaacauggcacuaugaugaagacaacccauacaagaccugggcguaucaugggagcuaugaaguaaagccaaguggaucagcaaguucaaugguaaauggaguagugcgcuuacuaacuaagccgugggacguuaucccaaugguaacgcaaaucgcaaugacagacacuacgccuuucggacaacagcggguauuuaaagaaaaaguagauacgcggacacccagaccuaagcgagggacugcucaaauuauggaaguaacagcaaaauggcucuggggguuucuuucaagaaauaagaaaccacgaauaugcacgagggaagaauuuacaagaaaagugcgaucaaacgcagcuauaggagcuguguucguggacgaaaaucaauggaacucagcuaaggaagcgguggaggacgaacgauucugggaucuaguucacagagaacgugaacuacauaaacaaggcaaaugcgcaacuugcgucuauaacaugauggggaaacgugagaagaaauugggagaauuuggaaaggccaaaggcucuagagcuauaugguauauguggcucggugccagguuuuuggaauuugaggcauuggguuuuaugaacgaagaucauugguuuucaagggaaaauaguuugucggguguugaaggagagggacuacauaaauuaggauauauucuucgggacauuaguaagaucccuggagguaauauguaugcggaugacacugcgggcugggauacacgcauuacagaagacgaucuacaaaacgaagccaaaauaacagauauaauggaaccugaacacgcccuuuuagccacuucaauauuuaaauuaacauaucaaaacaaaguaguaagaguucaacguccggcaaaaucugguaccguaauggaugucaucaguagaagggaucagagaggaagcgggcagguagggaccuaugggcuaaauacauucacaaauauggaaguacaacuuauaagacaaauggaauccgaaggaaucuuuuccccaucagaacuggaaaauagcaaccuagcugaacgagucuuagauuggcucgagaaacauggcguagagcgacucaaaagaauggcaauuucaggggaugacugcguuguaaaacccacugaugauagguuugcaacugcacucacagcauuaaaugauaugggcaaaguuaggaaagauauaccacaaugggagccauccaaaggauggaaugauuggcagcagguaccauucugcucucaccauuuccaucaguuaaucaugaaagacgggagagaaaucgucguuccgugccguaaucaagaugagcuaguuggucgagcucgggugucacaaggugcgggauggucauuaagggagaccgcaugccuggggaagucauacgcgcaaauguggcaauugauguauuuccauagaagagaccuccgucuggcugcuaacgcgaucuguucagcgguaccaguuaacuggguucccacaaguagaacuacauggaguauccacgcccaucaccaauggaugacaaccgaagacaugcugagcgucuggaaucguguguggauagaggaaaaccccuggauggaagacaagacgcacguaucaaguugggaagacguaccuuauuuagguaaaagagaagaccaaugguguggaucacugauugguuugacagcuagagcaaccugggcgacaaacauccaaguugcuauaaaucaggucaggaggcugauugguaaugaaaauuacuuggauuauaugacaucuaugaagagauucaaaaaugaaucagaucccgaaggagcacuuugguga

SEQ ID NO: 22101 - RNA, 9879 nt, Artificial Sequence
  derived and/or modified CDS sequence (opt6) from DENV-1__KM403591__SS-prME
aguguuaccauguugcuaauguugcucccgacugcacuggcuuuucaccuuacuacccguggaggcgaaccucacaugauaguuaguaaacaagaaagggguaaaucacuccuguucaaaaccucagccggugucaauaugugcacuuuaauagcgauggaucugggugaacugugugaggauaccaugacauacaaauguccccguauuacggaagcggaacccgacgauguugauuguuggugcaaugcgacggauacguggguaacauaugggaccugcucacaaacaggagaacaccguagagauaaaaggucgguagcacuggcaccucacguagggcuaggauuagaaacaaggacugaaacguggaugaguucggaaggcgccuggaggcagauucaaaaaguagaaacuugggcuuuacgacauccagguuucacuguaauagcguuguuuuuagcgcaugcuauagguacgagcauaacacaaaaaggaauuauauuuauucuucuuauguugguuacgccaucaauggcaaugagaugcguuggcauuggcaauagagauuuuguggaggguuuaucaggcgcgacauggguugauguugucuuggaacaugggagcuguguaacaacaauggccaaaaauaagccgacuuuagauauagaacuacucaagaccgaaguuaccaauccagcuguacuacggaaguuauguaucgaggcaaaaauaucuaacacaaccacagacuccagaugcccuacccaaggagaagcuacuuuaguagaagaacaagacgccaauuuuguaugucguagaacauuuguugauagagguuggggcaaugguuguggucuauuugggaagggaucauuacuuacaugugcaaaauuuaagugugugacuaaguuagaaggcaaaauaguacaauaugaaaaccugaaauacucuguaauagugaccguccacacuggggaccaacaccaagucgggaacgaaacaaccgagcaugguaccauagcaacaauuacuccacaagcgccgacaagugagauacaacuaaccgauuacggggccuuaacauuagacuguuccccaagaacagguuuagacuuuaaugagauggugcugcugacgaugaaggagaaaagcugguuaguacauaaacaaugguuuuuagaucuuccacuucccuggacaaguggugcaucaaccagccaagaaacauggaauagacaggauuuacucguuacguuuaagacagcacaugcuaagaagcaggaagucguuguuuuagggucccaagagggagcaaugcauacagcucuuacaggcgcaacugagauacaaacaaguggaacaacaacuauauuugccggacaccuaaaauguagacuaaaaaugggaaaacucacauuaaagggagucucguauguuauguguaccggcagcuucaaacucgaaaaagaaguugcagagacucaacauggcacaguauuagugcaaguuaaauaugaagggacggaugcaccaugcaaaauaccgauuucuacgcaagacgaaaaagguguaacucaaaauggucggcugauaacggcaaauccuauaguaacagacaaggaaaaaccuguaaauaucgaaacagaaccacccuucggagaaucauauauugucauaggagcaggggagaaggcuuugaaacuaucuugguuuaagaagggaucgucaauuggaaaaauguuugaggccacagcucgaggugcacgacgaauggcaauacuuggugacaccgcaugggacuuuggaucgauaggugguguuuucacgagugucgggaaguuaguacaccaaguuuuugggacagcauauggaguauuauucucaggaguuaguuggaccaugaaaauagguauagguauauuauuaacuuggcucggucuuaauucgaggucaacuucacuaucaaugacaugcaucgcgguugguaugguaacauuauaccuaggaguuaugguacaagcugacucagguugcguuauaaauuggaaaggacgcgaacuaaagugcgguagcggaauauuuguaacaaaugaaguacacacauggacugagcaauacaaauuucaggcugauagcccgaaaagauuaucagcagccaucggaaaagcgugggaagaaggagucuguggaauuagguccgcuacaagacuagagaacauuauguggaaacagauaucgaacgaauuaaaccauaucuuguuagaaaaugauaugaaauuuacuguaguaguaggugacgccaacggaauacuuacgcaggguaagaaaaugauaaggccucaaccuauggagcacaaauacuccuggaaaucuuggggaaaagcaaaaaucauuggugcagauacgcaaaauacuacguucauaauagauggacccgacacaccagaauguccagacgaucaaagagccuggaacauaugggaaguagaagauuauggauuuggaguauuuacaacgaauauauggcuaaaauugagagauagcuauacacaaaugugcgaccaucgucucaugucagcugcaauaaaggacucuaaagcaguacacgcggacaugggauauuggauugagucggaaaagaaugaaacuuggaaacuggcucgagcaucuuucauagaaguuaaaacuugcauuuggcccagaucacauacauuaugguccaacggugugcuagagagcgagaugaucauaccuaagaucuauggaggaccaauuucccaacauaacuauaggccgggauauuuuacccaaacagccggaccuuggcauuuagggaaauuggaacuagacuuuaaccuuugugaaggcacuacuguuguaguagacgaacauugugggaacagaggucccaguuugcgaaccacaacagucacgggcaagauaauacacgagugguguugcagaagcugcacguuacccccacucagguuucgaggagaagauggaugcugguaugggauggagauuagaccugugaaagagaaagaagaaaauuuggucagaucaaugguaucggcaggaaguggggaaguagauucauucucacucggguuauugugugucagcauaaugauagaggagguaaugaggucaagguggagccgcaaaauguuaaugacgggaacauuagccguguucuuuuuguugauaaugggccaacucacguggaacgauuuaauacgacuuugcauuaugguuggcgcaaacguaucagaccggaugggaaugggaacuaccuaucuugcccuaauggccaccuuuaaaaugcgacccauguucgcagugggauuacucuuuagacgauuaacaaguagagaaguauuacuacuaaccauaggucuaucgcuaguggccuccguggaacucccaaacagccucgaagaacucggugauggacuugcaaugggaauuaugaugcuaaaacuauuaacugauuuccaaagucaccaacuauggaccaccuuauuaaguuuaacauuuauaaaaacaacacuaucucuggacuacgccuggaaaacgauggcgauggugcugucgauagugagccuauuuccguuaugccuaaguacuaccucacagaaaacaacauggcuccccguuuuauuagguaguuuuggcuguaaacccuugacaauguuucucauaacggaaaacaaaauauggggacgaaagucauggcccuugaacgaggguauaauggcgguaggcauagucucgauacuucugagcucauuacucaaaaaugauguaccgcuagcagggcccuuaauagcaggaggaauguuaauagcaugcuacguaauaucaggaucuagugcagaucuuucguuagaacgggcagcugaaguaagcugggaggaagaagcagaacauagcggagcaucucauaacauccuugucgaaguacaggaugauggcacaaugaagauaaaggacgaggaacgagaugacacgcugacgauccuuuuaaaagcaacauuauuagcugugucaggagucuauccgaugaguauuccagcaacuuuauucgugugguacuucuggcagaagaagaaacaaagauccggcguccucugggacaccccaucaccaccugaaguggaacgugcaguuuuggacgauggaauauacagaauccuucaaagggguuuguuagguaggagucaaguuggugucgggguuuuccaagacggggucuuucauacaauguggcauguaacgaggggagcaguacuaauguaccaaggaaaacgccuggaaccaucgugggcaagcguuaagaaagaccucauuucauacggaggagguuggcgauuucaaggaucauggaauacaggugaggaaguacaaguuauugcaguagagccugguaaaaauccuaagaacguccaaacuacccccgguacguuuaagacucccgaaggggaaguuggugcaaucgcuuuggacuucaagccaggaacaucgggcucacccauugugaacagagaaggaaaaauuguuggcuuguauggcaaugguguaguuacgaccagcgguacauaugugagugccauagcacaggcgaaagcaucucaagaagguccacuacccgaaauugaagaugaagucuuuaagaagagaaacuuaacuaucauggaucuacauccagguucuggcaaaacuaaacgguaucuuccagcuauaguuagggaagcuauaaaaaggaaauugaggacguugauauuggcaccaacucgcguuguagcuucagaaauggccgaagcgcuuaaagguaugccaauuagauaucaaacgaccgccguuaaaucagagcacacaggcaaggaaauagucgauuugaugugucacgcuacguucacaaugagauugcuauccccuguaaggguaccaaacuacaacaugauuauaauggaugaagcacacuuuaccgauccugcaucaauugcggcgagagguuauaucucuacucgaguuggaaugggcgaagccgcugccauauuuaugacugcaacuccucccggcucgguugaggccuuuccacaaucaaaugcaguuauccaagaugaagaacgugacauuccugaaagaucauggaacuccggauacgacuggauaacagauuuccccgggaaaaccguaugguuuguccccucaauuaagucaggcaaugacauugcaaacugccuaagaaagaauggcaaaagagucauccaauugagcagaaaaacauucgacacggaguaucagaaaacgaaaaacaaugacugggacuauguaguuacaacagauauuagugaaaugggagcuaauuuucgagcugauagggugauagauccucgaagaugccuuaaaccaguuauuuuaaaggaugguccagaacgagugauccuagcuggaccuaugccuguuacagccgcgucggcggcacaaagacgugggcgaauuggacgaaaccagaauaaagagggggaucaauauauauauaugggacaaccccucaacaaugaugaggaucacgcucacuggaccgaagcaaaaauguuacucgauaauauuaacacgccagaaggaaucauaccagcccuuuuugagccagagcgagaaaaguccgcagccaucgauggagaauaucguuuacguggugaagcccgcaaaacuuuugucgaacuaaugcgcaggggcgauuuacccguauggcuaucguauaaaguugcuagugaaggauuucaguacuccgauagacguugguguuuugacggagaacgaaauaaucaagucuuagaagaaaacauggauguugaaauauggacuaaagagggggaacgaaagaaacucagaccccgaugguuggacgcuaggacuuauuccgauccacucgcucuccgagaauuuaaagaguucgcagcuggucguaggagcguaaguggcgaucugauccuugaaaucggaaaauuaccacaacaucuaacguuacgcgcucaaaaugcacuggauaacuuagugaugcuccacaacucagaacaaggaggcaaagccuaucgccaugcgauggaggaacuaccagauacaauugaaacgcuaauguuguuagcauuaauugccgucuugacuggcggagucacauuauucuuccucucugguaagggccuagguaaaacaaguauaggacuacuaugcguaauggcaucgucaguauuguuauggauggcuaguguggaaccacauuggauugcggcgagcauuauacuagaguucuuuuuaaugguauuguugauuccagaaccugauagacaaaggacaccacaagacaaucagcuagcauauguagucauaggacugcuuuucaugauacuaacaguugcagcuaacgaaauggggcuuuuagaaacaacuaagaaagaccuaggcauaggacauguuguagccgagaaucaccaucaugcuacuauguuagauauagacuuacauccagcuagugccuggacguuauaugcuguagcaacgacaauuauaacucccaugaugcgacacacgauugaaaacacaacagcaaauauaaguuuaaccgcuauagccaaucaggcagcaauacugaugggacuagauaaagguuggccuaucuccaaaauggauauaggugugccuuuauuagcauuaggauguuacagccaaguaaauccucuaacucuaacagcggcaguguugauguugguugcucacuaugcuauaauagggccgggacuacaagccaaggcaacaagagaagcccagaaacggacagcugcaggaauaaugaaaaauccaacuguagauggcauaguugccauugaucuagauccaguugucuacgaugcgaaauuugagaaacaauugggucaaauaauguugcuuauacuaugcacgagucaaauuuuauuaaugagaacaacuugggcuuugugugaaucaauuacgcuagcaaccggcccauuaacgacacuaugggaagggaguccagggaaauuuuggaauacaaccauagcaguaaguauggcaaacauauuuagaggauccuaccuagcgggugcuggguuagcauuuucacuaaugaaaucguuaggcggcggucguagagguacuggcgcacaaggagagacacuaggagaaaaauggaaacgacagcuaaaccaacucagcaaaagcgaauuuaauacauacaagagaagcggaauuauggagguagaucguagugaggccaaagaaggguuaaaaagaggggaaacuacuaaacacgccguaagcagggguacagcgaagcuacgcugguuuguugaaagaaauuuagugaaaccagaaggcaaggugauagaucuaggcugcgggagaggagguuggucguauuacugcgcuggacuaaagaaagugacagaaguaaaaggauacacaaaaggaggcccaggacacgaggaaccuauacccauggcaacuuauggauggaauaucguaaaauugcauagcggacgagauguauuuuucacuccacccgaaaaaugugauaccuuauuaugugauauaggagagucuucccccaauccaacaauagaggaaggacgaacccugagagugcuaaagaugguagaaccuuggcugaggggaaaccaauuuuguauaaaaauacucaauccauacaugccaagugugguugaaacccucgaacaaaugcaacgaaaacacggagguaugcuaguacguaauccauugucacgcaacagcacacaugaaauguauugggucagcugugguacaggaaauauaguaucugcugucaauaugacuuccagaaugcuccucaaucgauucaccauggcccauagaaaaccaacguaugaaagggacguagauuuaggugcgggaacacggcauguugccguagagccugagauagcaaacuuagauaucauaggccaaagaauugagaacaucaaaaacgaacacaaaucaaccuggcacuaugacgaagauaacccauacaagacaugggcuuaucaugguucguaugagguuaagccgucaggaucggcgaguucgauggucaauggaguuguccggcuauuaacuaaaccuugggauguuaucccgaugguaacacaaaucgcgaugacagacacaaccccauuuggacaacaaagagucuucaaggagaagguggacacgagaacaccacggccgaaacgagguaccgcucaaauaauggaagugacugcaaaaugguuauggggguuuuugaguagaaauaagaaaccacgcauauguacccgagaagaauuuaccagaaaaguacgaucuaacgcugcuauaggcgcgguauuugucgaugaaaaucaauggaauagugcaaaagaggcgguggaagaugagagauucugggauuuaguacauagggaaagagaauuacauaaacaaggcaaaugcgcaacauguguguacaauaugaugggaaagcgugaaaagaagcuaggagaauuugguaaggcaaaagggucuagagcgauaugguacaugugguugggugcgcgguuuuuagaauuugaagcauuaggguucaugaaugaggaccauugguucuccagagaaaacagccuuucuggcguagagggugaagggcuacauaaacuaggauacauacuuagagacaucucgaagauuccuggaggaaauauguaugcagacgauaccgcgggaugggacacucguauaacagaagacgauuuacaaaacgaagcaaaaauaaccgauauuauggaaccugagcaugcacuucuugcuacaaguaucuuuaaauuaacguaucaaaauaaagucguacgaguccaaagaccugccaagucaggcacagucauggacgucauaucucgacgagaucagagagggaguggacaaguugggacauauggacuuaacacauucaccaauauggaaguucaauuaauacgacaaauggaaagugaaggaauauuuucuccaagugaacucgaaaauaguaacuuagcagaacgaguuuuagauugguuggagaaacacggaguugagcgacuaaagagaauggcuauaucaggugaugauuguguagugaagccaacugacgacagauucgccacagcacuuacggcacuuaaugauaugggaaaagugcgcaaagauauaccccaaugggaaccuaguaagggauggaacgauuggcagcaagugccauucuguagccaucauuuccaucaauuaaucaugaaagauggccgugagauugucguuccgugccgcaaucaagacgaacucguuggaagggcgcgaguaucacaaggcgcaggauggagccuuagagaaacagcaugcuuagggaaaaguuacgcacaaauguggcaauuaauguacuuccauagaagggaucuacgcuuagcagcaaacgcaaucugcuccgcuguaccagugaacuggguucccacaagccgcacgacauggaguauacaugcacaucaucaauggaugacaaccgaggauaugcucucaguauggaauagaguauggauugaagaaaauccauggauggaagauaagacacauguaaguucaugggaagaugugcccuaccuaggaaagcgugaagaccaaugguguggaucuuugauuggguuaacugcgagagcaaccugggcaacuaacauucaaguggccauaaaucaaguaagaagauuaauuggcaacgaaaacuaucuagacuacaugacgagcaugaaaagauucaaaaacgaaagcgacccagaaggcgcacucugguga

SEQ ID NO: 22102 - RNA, 9879 nt, Artificial Sequence
  derived and/or modified CDS sequence (opt6) from DENV-1__KM403607__SS-prME
ucggucacgaugcuuuuaauguuguuacccaccgcuuuagccuuccacuuaacgacuagagguggugaaccccauaugaucguuaguaaacaagagagaggaaaaagccuuuuauucaaaacaucggcaggagucaauauguguacuuuaaucgcuauggauuugggagaguuaugcgaggacacaaugacauauaaaugcccacgcaucaccgaagcugaaccugaugauguugacuguuggugcaaugcaacugauacauggguuacauacgguaccuguagucaaaccggggagcaccgaagagacaaacgaucagucgcucuugcaccacaugugggucuaggacuggagacucgcaccgaaaccuggaugaguucugagggcgcguggagacaaauccaaaaaguagagaccugggcauuacgccacccaggauucacaguuauugcucuauuucuggcgcacgccauuggaacaucaauaacacaaaaaggcaucauuuucauccuguuaauguuagucacaccauccauggcaaugcgaugcgugggaauagguaauagagauuucgucgaaggucucucaggugcaacguggguggaugucguauuagagcacggcucaugcguaacgacaauggcgaaaaacaagccaacacucgauauugaacuucugaaaacugaagucaccaauccagcuguuuugagaaaauuaugcauugaagcuaaaauuucgaacacaaccacagauucaagaugccccacacaaggcgaagcgacacuuguugaagaacaagaugcaaauuucgugugcagacgaaccuucguugauagagguugggggaacggaugcggacucuuugguaaagguagccuuuuaacuugcgcgaaguuuaaaugugucacaaaacuagaaggcaaaauuguacaauaugaaaauuugaaguauaguguaaucgugacuguacauacuggugaccaacaucaaguaggcaacgaaacaacggagcaugggacgaucgcuacgauaacuccucaggcaccuacaagugagauacaacuuacugauuauggugcauuaacacuagacugcucuccaagaacaggacuagauuucaaugaaauggugcuucuaacuaugaaagagaagaguuggcuugugcauaagcaaugguuccuagaccuaccauugccauggacaagcggggcgucaacuucgcaagaaacguggaacagacaagaucuacuugucacauucaaaacagcacacgcgaagaaacaagaaguuguaguauugggaagucaagaaggugcaaugcacacugcacuuacgggcgccacugagauacaaacaucaggaaccacuacuaucuuugcuggacacuuaaaauguagacugaagauggacaaacuaaccuuaaaagggguaucuuacguuauguguacggguucuuucaaacuagaaaaagaaguggccgagacgcaacauggaacaguuuuaguacaggucaaauacgaaggcacggaugcaccauguaaaauacccauuaguauacaagaugagaaaggaguaacacaaaacggaagauuaauuacggcaaauccuauaguaacggauaaggagaagccaguaaacauagagaccgaaccaccauuuggugagaguuacauaguaauaggggcaggagaaaaagcucuaaaauuaucaugguuuaagaaagguucuucgauaggaaaaauguuugaagcuacggcgcgcggagcacgucggauggccaucuuaggugauacugcuugggauuucgggaguaucggugguguuuucaccucagugggaaaauuaguucaucaaguuuuuggaacagccuacggaguccuauuuucugguguaucuuggacaaugaagauaggcauagguauacuccugacauggcuugggcugaacucacggaguacgucacuuucaaugaccugcauagcaguaggaaugguaacguuguaccuagguguaaugguacaagcggauucagguugcgugauaaauuggaaaggcagagaacuaaaguguggcucgggaauauuuguuacgaacgaaguacauaccuggacugaacaguauaaauuccaagcagauuccccuaaaagacugucagccgccauuggaaaggcgugggaagaaggcgucuguggaauuagaucggcgacacgauuagagaacauaauguggaaacaaauaucuaaugaguuaaaucauauauuauuggagaaugauaugaaauuuacaguaguaguuggugaugcaaauggaauacuuacccaagggaagaaaaugauacgaccucagccgauggagcauaaguacuccuggaagaguugggggaaagccaaaaucauaggagcugacacacagaacacaacuuucauuauugauggcccggacacaccugaauguccugacgaucaaagggcauggaacaucugggagguagaagauuacggcuuuggaguauuuacaacaaauauuuggcucaaguuacgcgauucauacacacagaugugugaccaucguuugaugagcgcugcaaucaaagacaguaaagccguucacgcagacauggguuauuggaucgaaucagagaaaaaugaaacguggaagcuagcgcgugcuucauucauagaggucaaaaccuguauauggccccgaucccauaccuuauggaguaauggaguucuagaaucggagaugaucauuccgaaaaucuauggaggaccgauuagccaacacaauuacagacccggauauuuuacucagacggcgggaccauggcaccuagguaaacuugaacuggauuucaauuuaugugaggguacaaccgugguuguggaugaacauuguggaaaucgaggcccuucacuuagaacaacuaccgugaccggcaaaauaauacaugagugguguuguagguccuguacuuuaccuccauuacguuuuagaggugaagacggaugcugguaugguauggaaauaagaccaguuaaagagaaggaagaaaaucucguccguucgaugguuucagcagguaguggagaaguagauucauuuucguugggacugcugugugucagcaucaugauagaagaaguaaugagaucaagguggaguagaaaaauguuaaugacugguacacuagcuguauucuucuuauuaauaaugggccaauuaacauggaacgaccuaauacgguuguguauuauggucggggccaauguaucagaucgaauggguaugggaacaacguauuuggcauuaauggcaaccuuuaagaugcguccuauguuugcggucggccuauuauucagacgauugacgagucgcgaagucuuacuauuaacgauaggccuaucauuaguggccaguguugaauuaccaaacaguuuggaggaauugggggauggauuagccauggggauaaugauguugaaauuacuaaccgacuuucaaagucaucaacuauggacaacuuuauugucacugacauuuauuaaaacaacuuuaucguuagauuaugcuuggaaaacaauggcgaugguauuaucuauaguuucucuuuuuccacucugucugucaacuacgucccagaaaacaacuugguuaccaguauuauuaggaucauuuggaugcaaaccacuaacuauguuuuuaauuacagagaacaaaauauggggccggaaaucauggccuuuaaacgaggggauaauggccguuggaauuguaucgauacuccucaguagucuccuaaagaaugacguaccauuagcgggaccucuuauugccgguggcauguugauagcguguuacguuauauccggaucaagugcggaccuaucgcuugagagagccgcugaaguaaguugggaggaagaggccgaacauucgggagccucacauaauauccugguagaaguacaagaugacgggacuaugaaaauaaaagacgaagagagagacgauacacuaacaauacuccuuaaagcuacgcuacuagcgguuaguggaguguacccgaugaguauaccagcaacauuauuugugugguacuucuggcagaaaaagaaacaaaggucaggaguccuaugggacacuccuucaccaccagagguggaacgugcaguccuagaugauggaauauacagaauccuucaaagagggcucuuagggagaagccaaguaggcguugggguauuucaagaugguguuuuucauacgauguggcauguaacacgaggcgcaguauuaauguaucagggcaaacggcucgagccauccugggccuccguuaaaaaggaucuaauaagcuaugggggagguuggcgcuuccaagguucguggaacacuggagaggaaguucaagucaucgcagucgagccaggcaaaaauccuaaaaauguucaaacaacaccggguacauuuaaaacuccagaaggggaaguaggugcuaucgcucuugauuuuaaacccgguacaaguggaucaccaauagugaacagggaaggaaagauuguuggucuauacggaaacggagucguuaccacaaguggaacuuauguuagugcaauagcccaagcaaaagcaucucaagaagggccuuugccggaaauagaagaugaaguguuuaagaaacguaaucucacaauaauggauuuacacccgggaucgggaaaaacgcguagauauuuaccagcaaucgugagagaagcuauaaaaagaaaauuaagaacacuaauuuuagcaccaacacgaguaguagcuucggaaauggcggaagcauuaaaaggaaugcccauacgauaucaaacaacugcagugaaaagugaacauacagguaaagagauagucgaccuuaugugucaugcaaccuuuaccaugcgccuacuaagcccuguuagaguacccaacuauaacaugaucaucauggacgaagcucauuuuaccgauccugcgaguaucgcugccagagguuacauuucgacucggguuggaaugggugaagccgcugcaauuuuuaugacggccacaccucccgguagugucgaggcuuuuccccaauccaacgcaguuauccaagacgaagaacgagacauuccagaacgcaguuggaauagcgguuaugacuggaucacugauuuuccagguaaaacgguuugguucgugcccucgauuaaaucagguaaugauauagcaaauugccuaaggaaaaauggcaaacgcguaauccaacuuaguagaaagacauucgacacagaauaucagaaaacuaaaaacaaugauugggauuauguaguaaccacugauauaucggagaugggcgcgaacuuccgagccgaucggguaauagaucccagacgcuguuugaaaccaguaauacucaaagacggaccagagcgagugauauuggcagguccuaugccaguaacggcagcgucagccgcacaacggagagggagaauuggaagaaaucagaauaaggaaggcgaucaauacauuuacaugggacagccacuaaacaaugaugaagaucaugcccauuggaccgaagcaaaaaugcuauuagacaacaucaauacuccugaggguaucauaccagcacuuuucgagccggagagggagaaaagcgcugcaauagacggugaauauagguugcgaggagaagcaagaaaaacauucguagaauuaaugcgaagaggcgaccuuccaguauggcuuaguuauaaaguugcaucugagggauuccaauauagugaccgccgaugguguuucgauggagaaagaaacaaucaaguccucgaagaaaauauggauguggaaaucuggacgaaagaaggcgaaaggaagaaauuacgaccaagaugguuggaugcacgaacauacagcgacccacuggcucuacgagaguuuaaagaauuugcagcgggacgaagaaguguaagcggcgacuugauauuagagauugguaaauugccucagcaccuaacacuaagagcccaaaaugcguuagacaaucuuguaaugcugcacaauucggaacaggguggcaaggcuuaucgacaugcaauggaagaacugcccgacacgauagaaacccuaauguuauuagcccuaauugcuguuuuaacaggaggggucacacuauucuuucuaaguggaaaaggucucgguaaaacaucuauaggacuucucugugucauggccucgucgguguuacuguggauggccagcguagaaccgcauuggauagcagcauccauaaucuuagaguucuuucuaaugguuuugcuaauaccagaacccgacaggcagcguacaccgcaagacaaucaacucgcuuacguuguaauuggucuguuauucaugauucugacaguggcagcuaaugaaaugggauuguuggagacgacuaagaaagaccuagggauagggcauguagucgcugaaaaucaucaccaugcgacgaugcuugauauagauuuacaucccgcgucugcauggacguuauaugcuguagcaacgacaauaauaacacccaugaugaggcacacaaucgaaaacaccacagccaacauaucacuaacagcaauugccaaucaagcugccauuuugauggguuuggauaaagguuggccaauuucgaaaauggauauuggagugccuuuauuggcacuggguuguuacagucaaguaaauccauuaacgcugacagcggcugucuuaaugcuuguugcacauuaugccauaauugggccaggccuacaagcaaaagccacaagggaggcacagaaaagaaccgcggcagguauaaugaagaauccaacaguggaugggauaguagcgauugacuuagacccagucguuuaugacgcuaaauucgaaaaacaauuaggacaaauuaugcuguugauacuauguacaucacaaauauuacuuaugagaacaacgugggcauuaugcgaguccaucacucucgcuacaggaccccuuacuacacucugggaaggaucgccaggaaaguucuggaacaccacaaucgcaguaucaauggcuaauauuuuccggggaagcuauuuggcuggagccggauuagcauuuucauuaaugaagacguuaggaggaggaagaagaggcaccggugcacaaggugaaacacugggggagaaauggaaacggcaauugaaccaguuaaguaaaagugaguuuaauacauacaagcgcagcggcaucauggaaguagacagaucugaagcaaaagaaggacuuaagaggggagaaacaacaaaacaugcaguaagccgagguacggcgaagcuccgaugguuugucgaaaggaaucuuguaaaaccggaaggaaaagucauagauuuaggauguggacgugggggauggucauauuauugugcaggucuuaagaaaguaacugaagucaaaggauauacuaaaggggguccagggcaugaagaaccgauacccauggcgacuuaugguuggaacauaguuaaacuccauucaggcagagacguauucuuuacgccgccggagaagugcgacacauuacuaugugauauuggggaaucuucacccaacccaacaauagaggaaggaagaacccuacgcguguuaaaaaugguugaaccauggcuuagaggaaaccaauucuguauaaagauccuaaacccauauaugccauccguuguugagacacuggaacaaaugcaacggaagcaugguggaauguuaguuaggaaccccuuaaguagaaacaguacucaugaaauguauugggucucuugcgggacagguaacauagucagugcagugaacaugacuucgcggaugcuauuaaacagauuuaccauggcccacagaaaaccuacuuaugaaagagacgucgaccucggcgcagguacgagacacgucgcgguagaaccugaaauugcaaacuuagauauaauugggcaaaggauagaaaacauuaaaaaugaacacaaaucuacauggcacuacgaugaagauaacccauauaagacaugggcuuaucauggaucuuaugaaguuaaaccaagugguucagcuucgucuaugguaaauggagucguccgacucuugacuaaaccaugggaugucauaccaauggugacgcagauagcgaugacugauaccacacccuuuggacagcaaagaguauuuaaagaaaagguggauacaagaacgccaaggccaaagcgaggcacagcucaaauaauggagguaacagcuaaguggcucugggguuuccugucucgaaauaagaaaccccgaauuuguacaagagaagaauuuacgcgaaaagugagaucaaacgcagcuauaggugcaguguuuguugaugagaaccaguggaacagugcuaaagaagccguagaagaugagcgguucugggauuuaguucauagagaacgugaauugcauaaacagggaaaaugugcaacgugcguuuauaacaugaugggaaaaagggagaagaaacucggagaauuuggaaaagcuaaaggaaguagagcuauaugguauaugugguuaggagcgagguucuuagaauuugaggcacucgguuuuaugaacgaggaucauugguuuucucgagaaaacucacuuaguggaguagagggagaggguuuacauaaguuaggguauauacugagggauauaaguaagauacccggaggaaacauguacgcagacgacacugcaggaugggacacccgaauuacagaggacgacuuacaaaaugaagccaagauuacagauauaauggagccagaacaugcauuacuggcaacaucgauuuucaagcuaacauaucagaauaaaguugucaggguacagaggccagcuaagucaggaacaguaauggauguaauuagucguagagaccaacgaggcucaggacaagugggaacuuaugguuuaaauacuuuuacaaauauggaaguacaauugauccgucaaauggagagcgaagggauuuuuagcccuucggaauuagaaaacucaaacuuggcugaaagaguucucgacuggcuugagaaacacggggucgaacgccucaaacgcauggcaauaucgggagacgauuguguugugaaaccaaccgaugaccgguuugcaacggcucucacagcacuaaaugauauggggaaagugagaaaagacauaccacaaugggagccuucgaaaggauggaaugacuggcaacaggugccauuuugcucucaucauuuucaccaauugauuaugaaagauggaagagaaaucguaguaccguguagaaaucaagaugagcuuguggguagggcaagaguaucucaaggagccggauggagccuuagggaaacugcaugcuuaggcaaaucauaugcgcaaauguggcaacuaauguauuuucaucgacgagaucugcgccuagcggcaaaugcaauaugcucagcagugccaguaaauuggguaccaaccucucgcaccacaugguccauacaugcacaccaucaguggaugacuacagaagacaugcugucagucuggaaucgaguauggaucgaagaaaauccauggauggaagacaaaacacacguaaguagcugggaagacguaccuuaccuaggaaaacgagaagaucaaugguguggaucauuaaucggacucacagccagagcaacaugggcuacaaauauacaaguagcaauaaaucaaguacgucgguuaauuggaaacgaaaauuaucuggacuauaugaccaguaugaaacguuucaaaaacgaaagcgacccagaaggugcccuaugguga

SEQ ID NO: 22103 - RNA, 9879 nt, Artificial Sequence
  derived and/or modified CDS sequence (opt6) from DENV-1__KM403581__SS-prME
agcguuacaauguuacucauguuacuuccaacagcauuagcauuccaucuaacaacaagggguggugaaccccauaugauagugaguaaacaggaacgaggaaaaucauuacuuuuuaaaacaagugcggguguaaacauguguacacuuauagcaauggauuuaggugaauuaugcgaagauacaaugacuuacaaaugcccacguauuacagaagcagaaccugaugauguagacuguugguguaaugcaacugauacaugggucacauauggaacuuguucccaaacaggagaacaucgacgagauaggcgcaguguugcauuggcuccacauguuggacucggacuagaaacaaggacugaaacuuggaugagcagugaaggcgcauggcgacagauacaaagaguagaaaccugggccuuaagacauccaggguucacagucauagcacuauuccucgcacacgcaauuggcacaaguauaacgcaaaaaggaauaauuuucauacuucuaaugcuaguaaccccuucuauggcuaugcgguguguaggaauaggaaacagagauuucguggaaggacucucaggggcuaccugggucgacguaguacuggaacaugggaguugugucaccacgauggccaaaaauaaaccaacucucgauauagaauuauuaaaaaccgagguuacaaacccagcgguacugagaaaauugugcauagaagcgaaaauaucgaacaccacaacugacagucguuguccgacgcagggagaagcgaccuuaguagaagaacaagacgcaaauuuuguaugccgacguacguucguugauaggggaugggguaacggauguggauuauuuggcaaagggagucuccugacaugugcuaaauuuaaauguguuacuaaacucgaaggaaaaauaguccaauacgagaacuuaaaauauucgguaauagugacuguucacacaggcgaccaacaccaaguggggaacgagacaacagaacaugguacgauugcgacgauuacaccgcaggcaccaacgagugaaauacaacuuaccgacuauggagcuuuaacguuagauuguuccccuagaacaggucuggacuuuaaugaaauggugcuacuuacaaugaaggaaaagucuugguugguccacaaacaaugguuuuuagaccuaccacucccauggacgagcggagcaucaacaucucaagagacauggaauagacaggaucuucuaguaacguucaaaacggcccacgcuaagaaacaagaagugguaguacuaggaagucaagaaggugcaaugcacacagccuuaacaggagcuacugagauucagacaagcggaacgacuacaauauucgccggacauuuaaaguguagacuaaaaauggacaagcuaacacucaaagguguuucauacgugauguguacaggaucguucaaauuagaaaaagaaguugcugagacacaacacgggacuguguugguucagguaaaauacgagggaacugaugccccuuguaaaauuccuaucagcacucaagaugagaaaggugugacucaaaacggaagacuaauaacagccaauccuaucgugaccgacaaagaaaagcccguuaauaucgaaacagaaccuccguuuggagaaaguuauauuguuaucggggcuggggaaaaagcauuaaaguuaucaugguuuaagaaagggaguucaaucgguaaaauguucgaagccacugcucgcggagcaagacgcauggcaauauuaggagacaccgcaugggacuucggaucuauuggugguguuuuuacuucaguagggaaacuuguucaucagguauuuggaacagcauacggcguccuauuuuccggagucucauggacgaugaaaauagguauaggaauacuucuaacauggcuaggacuuaacagccguucaacaucauugagcaugacauguauagcaguaggcaugguuacacuguaucuggguguaauggugcaggcugacucugguuguguuauaaauuggaaggggcgagaauuaaaauguggcucaggaauuuuugugacuaacgaaguacauacauggaccgaacaguauaaauuucaggcagauucaccaaaaagacuaagugcugcaauugguaaagcaugggaagagggugugugugguauuagaucagcuacgcggcuggaaaauauuauguggaaacaaauaucaaaugaacucaaccauauauuauuagagaacgauaugaaauuuacaguuguaguuggugacgcuaacggaauacuuacgcaagguaaaaagaugauacgcccucaaccuauggaacauaaauauaguuggaaaucaugggguaaggccaaaauaauaggagcagacacucaaaauacaacuuucauuaucgaugguccagauacucccgaauguccagacgaucaaagagcauggaacauaugggaaguagaggacuaugguuuuggaguauuuaccacaaauaucuggcucaaacugagagauucuuacacacaacuuugugaucauagacugaugucagcagcaauuaaagacucaaaagcuguacaugcagauaugggguauuggauugaaagcgagaaaaaugaaaccuggaaauuagcaagagccagcuucaucgaaguuaaaacuuguauauggccccgaucucauacucuguggagcaauggaguucuggaaagcgagaugauaaucccgaaaauuuacggaggaccaauaagucaacacaauuauagaccaggguacuuuacacaaaccgcaggucccuggcaccuuggaaaauuagaguuagauuucaaccuaugugagggaacaacgguaguggucgaugagcacugcgguaacagagggccaucacuuaggaccacuacuguaacaggaaagauuauacaugaguggugcuguagaagcugcacguugccuccauugagauucagaggugaggacggcuguugguaugggauggaaauucgaccaguuaaggaaaaagaggaaaauuugguucgauccauggucagcgcuggaucaggagaagucgacaguuucucacuaggucuucucugcguaucuauuaugauagaggagguaaugcguucgagauggucaaggaagauguuaaugacaggaacuuuagcuauauucuuucuguugauaaugggacaacugacuuggaacgaccuaauacgcuuauguauuauggugggugcaaacguaagcgauagaaugggaaugggcacaacauacuuagcauuaauggcuacauucaagaugagaccuauguuugcugucggacuauuguuucgucgcuugacaucaagagaaguacuacuacuaacaauuggcuuaagccuaguugcaucaguagaacuaccuaauucucuugaggaacugggugaugguuuagccauggggaucaugaugcuaaagcugcuaacggacuuccagucccaucaacuuuggacgacguuauuauccuugaccuuuauaaaaacaacacugagccuugacuacgccuggaaaacuauggcaaugguguuaagcauagucucguuguuuccacuuugccuuucaacuacgucucaaaagacgacaugguuacccguacuauugggcaguuucggauguaaaccauuaacuauguuucuuaucacagagaauaaaauaugggguagaaagaguuggccucucaaugaaggaauuauggcaguugggauugucucaauccuucuaagcucacuacucaagaaugacguaccccuagcaggaccgcuuaucgcuggagguaugcuuauagcuuguuaugucauaucgggaucuagugcagaucuaaguuuagaaagggcagcagaaguaaguugggaagaagaggcugaacauucuggagccucucacaacauauuagucgaaguacaggacgacgggacaaugaaaauaaaagaugaagaaagggaugauacauuaacuauuuuguuaaaggcgacauuacucgcaguauccggcguauauccuaugagcauaccagcuacacuauuuguuugguauuuuuggcagaagaagaaacaaagaucaggagugcuuugggacacgccaucaccaccggagguugaaagagcuguauuagaugaugguauauaccgaauacuccaacguggcuuauuaggucgaucccagguagguguuggcguuuuucaagauggaguuuuccacacgauguggcacgugacuaggggugcgguccuuauguaucaaggcaagcgacuagaaccuucgugggcuucuguuaaaaaggacuuaauaucuuauggaggagguuggagguuucaaggaagcuggaauacaggugaagaaguacaaguuauagcuguagaaccgggcaaaaauccuaaaaauguucaaacaacaccaggaacuuucaaaacuccagagggagagguaggugcaauagcacuagauuucaagcccgggaccucuggaagccccaucgugaauagagaaggaaaaauagucggacuuuaugguaauggaguaguaaccacaagugggacuuauguuagcgcaauagcucaggcaaaagcaagccaagaagggccgcugccagaaaucgaagaugagguauuuaagaaacgcaauuuaacaauaauggaccuacauccaggaaguggaaaaacgagaagauauuugcccgcaauaguucgagaagcaauaaaacguaaguuaagaacacucauccuggcaccaacaagggugguugccagcgaaauggcagaggcuuuaaaaggaaugccaauuagauaucaaaccacugcgguaaaaagcgaacacacuggaaaggagauaguggaucugaugugccaugcaacuuucacuaugaggcuauuaagcccaguaagggugccuaauuauaauaugauaauaauggacgaagcacauuuuaccgacccugcuaguauugcugcacgaggcuacaucucaacgagagucggaaugggcgaagcggcggccaucuuuaugacugcaacucccccgggcaguguagaggcauuuccacaaucaaaugcaguaauucaagaugaagagagagauauuccagaacgcaguuggaacucugguuaugacuggaucacggacuuucccggcaaaaccgucugguuuguuccaaguaucaaaaguggaaacgauauagccaacuguuuaaggaaaaaugggaagagaguaauacaacuaucgagaaaaacauucgauacagaauaucaaaagacaaagaauaaugauugggacuacguuguuacaacugacauuagcgagaugggagccaauuuccgugccgaucgggugauugauccuaggaggugccuaaaaccaguaauacucaaagauggaccagagcgaguaaucuuagcuggaccuaugccuguaacagcggcaucugcagcgcaaaggagagggagaauaggaagaaaucaaaacaaagaaggugaucaguacaucuauaugggacaaccacuaaauaacgaugaagaucaugcucacuggacugaagcaaagauguuacucgacaauauaaauaccccugaggguauaauuccagcauuguuugaaccggagagggagaaaagcgcggcaauugacggagaauauagacuccgaggagaagccaggaaaacauuugucgagcuuaugcggcgaggagacuuaccgguuugguuaucuuauaaaguugcuucggaaggguuccaauauagcgacaggcgcuggugcuuugacggggaacgaaauaaucaaguauuagaagagaauauggauguagagauauggacuaaagagggagaacgaaagaaacuaaggccucgauggcuagaugcuagaacauauucugacccuuuagcguuacgcgaauuuaaagaauuugcugcuggccguagaagugucaguggagauuuaauauuagaaaucggaaaacugccgcaacaccuaacauugcgugcccaaaaugcguuagauaauuuggugauguugcauaacucggagcagggagggaaagcauauagacaugcaauggaggagcucccagauacuauagaaacucuaauguuguuagcucuuauagcaguacucacuggaggaguaacuuuauucuuccuuucaggcaaagguuuaggaaaaacaagcauaggucuauuaugugucauggccaguagcgucuugcuauggauggccagcguugaaccacacuggauugcagcaucaauaauucuugaguucuuuuugauggucuuguuaauuccugaaccugaucgacaaagaacaccacaagauaaccaauuagcuuacguagucaucggacuacuguuuaugauauugacaguagcagccaaugaaaugggauugcuagaaacuacuaagaaagaucuaggaaucggacaugugguagcagagaaucaccaccacgcaacuaugcucgauauagauuuacaucccgcuucagccuggacgcuuuaugcaguagcuacgaccaucauaacuccgaugaugagacauacaauagaaaauacgacugcuaauaucagcuuaacagcaauugccaaccaagcugcgauauuaauggggcuugauaaaggguggccuauaaguaagauggauaucggagugcccuuauuagcgcucggaugcuauagucaaguuaauccucuuacguugacagcugcagugcuaauguuaguagcgcauuaugcaauuaucgguccaggccugcaagccaaggcgacucgagaagcucaaaagcguaccgcggcagguauaaugaagaauccuacgguggacggaauuguggcuauagacuuagauccaguaguuuaugacgcaaaauuugaaaaacagcuaggucaaauuauguuacuuauauuauguacaagucaaauauuauuaaugagaacgacuugggcacucugugaaucaauaacgcucgcaacaggacccuugacaacccugugggagggaagcccuggaaaauucuggaauacaacuauagcaguuucaauggcuaauaucuuuagaggauccuacuuggcuggcgcaggucuagcuuuuagccuuaugaagucccuaggcggagggaggagaggcacaggagcccaaggugaaacauuaggagaaaaguggaagagacagcuaaaccagcuauccaagucugaauuuaauacauacaagcgaagcgggaucauggaagucgauaggucggaagcaaaagaaggccuaaaaaggggcgaaacaacgaaacaugcaguaaguagggggacagcuaaacucagaugguuuguagaaagaaauuugguuaaaccagaagguaaaguuaucgaucuggggugcggucgaggaggguggaguuauuauugugcgggacuaaagaaaguaacagaagucaaaggcuacacaaaagggggacccggucacgaagaaccaauaccaauggcuacuuauggcuggaacauuguaaaacuacacagcggacgugauguauuuuucaccccucccgagaaaugugauacauuguugugcgacaucggcgagaguucacccaaccccacaauugaagagggacguacuuuaagaguauugaaaaugguggaaccgugguuacgugguaaccaauuuuguauuaaaauacuaaauccauacaugcccuccguaguggaaacccuggagcaaaugcaacguaaacacggaggaauguuaguuagaaacccccuauccagaaauuccacacacgagauguauugggucucauguggaaccggaaauaucguuagcgccguaaauaugacaaguagaaugcucuuaaaccguuuuacaauggcacauaggaaacccacauaugaacgggacguagaucucggugcgggaacccgacaugucgcaguugaaccggagauagcaaacuuagacauaauuggacaaagaaucgaaaacaucaaaaaugagcauaaguccacguggcauuacgaugaagauaaucccuauaaaacaugggcuuaccacgguaguuaugaaguuaaacccucaggcagcgccuccucuauggugaacggaguaguaagguuacuaacaaaacccugggaugucaucccaauggucacgcaaauugcaaugacugacacgacacccuucggacaacaaagaguguuuaaagaaaaaguggacacacggacaccaagaccaaagaggggaacagcgcagauuauggaaguuacggcaaagugguuauggggauuucuaagucgaaauaagaaacccaggauaugcacaagggaagaguucacuagaaaagugagaucuaacgcugcuauuggcgcuguuuucguagacgaaaaccaauggaacuccgccaaggaagcagucgaggaugaaagauuuugggauuugguacaccgcgaaagagaauugcacaagcaaggaaaaugugcaacuugcguguauaacaugauggguaaaagagagaagaaauugggugaauuugguaaagcgaagggcucacgugccauuugguauauguggcucggagcaagguuuuuagaauuugaagccuuggguuucaugaacgaagaccauugguucaguagggaaaacagcuuauccggggucgaaggugaaggauugcacaaauuagguuacauacuaagagauaucucuaaaauuccuggugggaauauguaugcagacgacaccgccgggugggauacaagaauaacagaggacgacuuacaaaacgaggccaaaaucacagauaucauggaaccugaacacgcauugcuugcgacgaguauuuuuaaauuaacuuaccagaauaaagucguacgcgugcaacgaccagcaaaaucugguacuguuauggauguaauaucgcguagggaucagcgggguaguggucagguagguaccuacggguugaauaccuuuacgaauauggagguccaacuuauuaggcaaauggagucugaagguauauuuagcccuagcgaacuggaaaacagcaaccuggcggagcggguacuggauuggcuugagaaacauggagucgagagauuaaaaagaauggcaauaaguggagaugauuguguaguuaagcccaccgacgauagguucgccacggcacugacugcacucaacgacaugggcaaagugagaaaggauaucccucagugggaaccauccaaaggauggaaugacuggcaacaaguaccguucugcucgcaccauuuccaccaacuaauaaugaaagauggaagagagauaguugucccaugcaggaaucaagaugaacucguuggucgcgcacgaguaagccaaggagcaggauggucauuacgugaaacugcuugcuugggcaagucuuaugcacaaauguggcaauuaauguauuuccaccgaagagauuuaagauuggccgcuaaugcuauuugcucagccgugcccguaaacuggguuccgacaagccgaacaacuugguccauucacgcgcaccaccaauggaugacaaccgaagacaugcuuucuguguggaauaggguuuggauagaagaaaauccuuggauggaggauaagacucaugucaguucaugggaagacguaccguaccuggggaaaagagaagaccaauggugugguucuuuaaucggauugacugcccgugcaacuugggcaacaaacauacaaguugccauuaaucaaguaagacguuuaauugggaaugaaaauuaucuugauuauaugacaucgaugaagagauuuaaaaaugaaucagacccagagggggcguuaugguga

SEQ ID NO: 22104 - RNA, 9879 nt, Artificial Sequence
  derived and/or modified CDS sequence (opt6) from DENV-1__KM403597__SS-prME
agcguuacuaugcucuugaugcucuuaccuacagcacuggcauuccauuuaacaacuagagggggugaaccacacaugauaguaaguaaacaagaaagaggaaagagcuuauuauuuaaaacuucagcggguguuaauauguguacccuuauugcaauggauuuaggcgaauuaugcgaagacacuaugaccuauaaaugucccagaauaacagaagcggaaccugaugauguugauuguugguguaaugccacugauacuugggucaccuacggaacauguucacaaacaggcgaacauagaagagaccgaagaagcguugcguuggcgccacacguagggcugggccuagagacaagaacugagacuuggaugucgucugaaggagccuggagacagauacaaaggguagaaacuugggccuuaagacauccuggauuuacgguuaucgcccucuucuuggcucaugcaauuggaacuucaauaacacaaaaagguaucauuuucauuuuauuaaugcuuguaacgcccucgauggcaaugagauguguagguauuggcaauagagauuucguugaaggacuuucaggcgcaaccuggguugacguaguacuagagcaugggucgugugucacaacaauggcgaaaaauaaaccaacucuagacauagagcuacugaaaaccgaggucacuaauccugccguccuaagaaaacuaugcauagaagcuaaaauuaguaauacaaccacugacuccaggugccccacccagggagaggcuacuuugguagaggaacaagaugccaauuuuguguguagacgaacguucguugaucgcggaugggguaacggcugugggcuuuuuggaaaaggaaguuuauuaacgugcgcaaaauuuaaauguguaaccaaacucgaaggaaaaauuguacaauacgaaaauuuaaaauauagcgugaucguaacgguacauacgggugaucaacaccaaguuggcaaugagacuacagaacauggaacuauagcaacgauuacaccucaagcuccaacauccgaaauacaauuaacugauuacggagcauuaacgcuugauuguucaccuaggaccggcuuagauuuuaacgaaaugguguuacuaacaaugaaagaaaaaucauggcuagugcauaaacaaugguuucuagaccuaccacuuccauggacuagcggagccucaacaucccaagaaaccuggaauagacaagauuuguuagugacuuucaaaacugcucacgccaagaaacaagaagugguuguccugggaucgcaagagggagcaaugcauacagcuuuaacgggggcaacggaaauacaaacaagcggcacgacaacuauuuucgccggucaucugaaaugccgauuaaaaauggauaaauuaacacuuaaaggaguaaguuauguaauguguacgggaaguuucaaacucgaaaaagagguugcggaaacacaacacggaacaguauuaguccaggugaaauaugaaggaaccgaugcaccguguaaaauaccuauuucaacucaagaugaaaaagguguaacucagaaugggaggcugauaacagccaauccuauuguuacggacaaagaaaaaccugucaauauugaaaccgaaccaccguucggagagaguuauaucguaauaggcgccggcgaaaaagcacuaaaacugucuugguucaagaaaggcaguucaauagggaagauguucgaagccaccgcuaggggugcuagaagaauggcaauuuuaggugacacagccugggauuucgguucaauagggggcguuuucacuucuguaggcaaauuaguucaucaaguguuugggaccgccuauggugugcuauuuucaggaguauccuggacgaugaagaucgguauaggaauauuguugacuuggcuagggcucaauaguagaucgacgaguuuaagcaugaccugcauagccguugggaugguaacuuuguaucuugguguaaugguacaggcagauucgggcuguguaaucaacuggaaaggaagagaacucaaaugcggaagcgguaucuucguuacgaaugagguucacaccuggacagaacaauacaaauuccaggcugauaguccaaagaggcuaagugcagcaauuggcaaagcaugggaagaaggcgucugugggaucaggucagccacgcgacucgaaaauauaauguggaaacaaauuaguaaugaacuuaaccacauauuacuagagaaugacaugaaauucacaguaguaguuggugaugccaacgggauccuaacacaaggcaagaaaaugauccgaccgcaaccuauggagcauaaauauucguggaaaucuuggggaaaggcuaaaauaauaggugcugauacacagaauacaacguuuaucaucgauggcccggauacaccugaaugucccgacgaucagagggcuuggaauauuugggagguugaagauuauggcuucggggucuucaccacaaauaucuggcuuaaacuuagggauucuuauacucagaugugcgaccaccgauugaugucggcggcuauaaaggacucaaaggcuguucaugcugacaugggguauuggauagaaagugagaaaaaugaaaccuggaaacuugcaagagcgagcuucauugaaguaaaaacuuguauauggccgcgcucgcauacccuauggagcaacggcgucuuagaaagcgagaugauaauuccaaagauauauggaggcccgauaagccaacacaauuacagaccagguuauuuuacgcaaacagcuggacccuggcauuuagggaaauuagaacuagauuucaaucuaugugaaggcacaacuguggugguagaugaacacuguggaaacagggguccgucguuaaggacaacuacagugacaggcaaaauaauacaugaauggugcugccggucauguaccuuaccaccucuccgauucagaggggaagauggauguugguaugguauggagauacgacccgucaaagagaaagaagaaaauuugguaagauccaugguaucagcgggaaguggggaaguggauucauuuagccuuggauuacugugcgucaguauuaugauugaggaagucaugagaucaagauggagccgaaagauguuaaugaccggaacacuugcuauauuuuuccugcuaauuaugggucaacuuacauggaaugaccuaauacgauuaugcauuaugguuggagcaaauguuucagauagaauggguauggggacgacauauuuagcucugauggccacauucaaaaugaggccaauguucgcuguuggauuguuauuucgucgauuaacguccagagagguguuauuacuaacgauaggucucagucuuguagcgucaguugagcucccgaacucguuagaagaauuaggugauggacuggccauggguauuaugaugcugaaacugcugacugacuuucaaagccaccagcuguggacuacucuacuaucauuaaccuucauuaagacaacauuaagucuugauuacgcuuggaagacaauggcaauggucuugucaauuguaagccucuucccgcucugcuuaucuaccacgucccagaaaacaacaugguuaccgguacuacuaggaaguuucggaugcaagccccuaaccauguuuuuaauaacugagaacaaaauuugggggagaaaaagcuggccacuaaacgagggaauuauggcgguagguauaguaucaauacuuuugagcaguuuacuuaaaaacgauguaccccuagcaggcccccuaauugcugguggcaugcuuauagcguguuacguuauaaguggaucaucagcagaucuuagucucgaaagagcagcagaaguaaguugggaagaagaagcagagcauaguggggcaagucauaacauuuuaguagaaguacaagaugacggaacaaugaaaauaaaagaugaagaacgcgacgacacccucacuauauuauugaaggccacuuuacuagcgguaagugguguguaccccaugucaaucccugcaaccuuauuuguaugguacuuuuggcaaaagaagaaacaaaggucuggaguucuuugggacacaccuagcccuccagaagucgagagagcggucuuggaugacggcauauacaggauucuucaacguggguuauugggucgcucgcagguaggaguagguguauuccaagacgguguguuucacacgauguggcacguuacucgaggggcgguacucauguaccaaggaaaaaggcuugaaccaagcugggcaucugugaagaaagaucuaauuaguuauggcggaggauggcgauuucaaggcucauggaauacaggagaggaaguucaagucauagcaguugaaccuggcaaaaaucccaaaaaugugcaaacuaccccaggaaccuucaaaacaccagaaggugagguuggugcuauagcacuagacuuuaaaccaggcaccucggguaguccuauaguaaaucgcgaaggaaaaauuguuggguuauaugguaauggcgucgucacuacaagugggacauacgucagugcaauagcacaggcaaaagcaucucaagagggaccacuucccgaaauagaagaugaaguguucaaaaagcggaaucuaacaaucauggauuugcaccccgggucgggaaaaacgagaagauaucuucccgcuaucguucgagaagcuauuaaaagaaaguuacgcacacuaauucuagcaccuacuagaguaguagcuuccgaaauggcggaagcccuuaaaggaaugccaauaagauaucagacaacugcgguuaaaagugaacauacugggaaagaaaucguagaccuaauuugccaugcaacuuuuaccaugagacuuuuaagcccuguucgaguaccgaauuacaauaugaucauuauggacgaagcccauuuuacagauccagccagcauugcugcaagaggguacauaucgacgcgggucgggaugggagaagcagcagccauauucaugacugcaaccccaccagggucaguugaggccuuuccacagucaaacgccguaauacaggaugaagaacgugauauaccugagagaucuuggaacucuggguacgauuggauaacagauuuucccggaaaaaccguaugguuuguaccaucuauuaaauccggaaaugauaucgcuaauugccuaaggaagaaugggaaaaggguuauacaguuaagccguaagacguucgacacggaauaccagaaaaccaagaauaaugauugggauuacguaguuacaacagauauaucagaaaugggugcaaauuucagggcagacagagugaucgauccaagaagaugucugaaaccagugauuuuaaaagaugguccugaaagagugauauuagcggguccgaugcccgucacagcagcuucagcagcacaacgacgaggccggauuggacgaaaucaaaacaaagaaggugaucaauacauuuauaugggucaaccucuaaauaaugaugaagaucacgcucauuggaccgaggcaaaaaugcuccucgauaauauaaauacuccugaaggaaucauaccugcacuauuugagccagaacgcgaaaaauccgcugcgaucgauggagaauaucgacuacgaggugaagcuagaaagacauuuguagaauuaaugaggaggggugauuugccagucuggcucucauauaaaguagcaagcgaggguuuccaauacagugacagacgauggugcuuugacggugagagaaacaaucaagucuuagaggaaaacauggauguggaaauauggacgaaggagggggagcgcaaaaaguuaaggccacgaugguuagaugcccggaccuauagcgauccacuggcgcuaagagaauuuaaagaauuugcagcggguagaagaucagugaguggugauuuaauacuugagauaggaaaguuaccucaacacuuaaccuuaagggcgcagaaugcccuugacaacuuaguuaugcuacauaauucggagcaaggcggcaaagccuaucgccaugcuauggaagaacugccugauacaauagagacauuaauguuacuagcgcugauagcagucuugacugguggagugacacucuucuuucuaaguggcaagggacucggcaagacaagcauugguuuacuauguguuauggcuucgaguguacuacuauggauggcuucaguggaaccucauuggauagcggcgucaauuauuuuagaguucuuccugaugguucuucuaauaccagaaccagauagacaacgaaccccacaggauaaucaguuagcauauguaguaauaggacugcuuuuuaugauccuuacuguagccgcuaacgaaaugggcuuguuagaaacaaccaagaaagauuuaggcauaggacaugucguagcagaaaaccaucaccacgccacaaugcucgauauagaucuucaccccgcauccgcauggacauuguacgcaguugcaacaacaauaauaacucccaugaugagacauacgaucgagaauacaacagcaaauauaucauugacggcuauagccaaucaagcagcgauccugauggguuuagauaaaggauggccaauaaguaaaauggacauaggcgucccucugcuagcgcuagggugcuauucacaagugaacccauuaacauugacagcugccguccuaaugcucguggcccauuaugccauuaucggcccaggguugcaggcaaaagcuacacgagaagcacaaaaacgaacugccgccggaaucaugaaaaauccaacaguagauggaauuguugcuauugaucuugauccagugguuuaugacgcuaaguucgaaaaacaacuaggacagauaaugcucuuaauacuuugcaccucucaaauucuacuaaugagaaccacaugggcauugugcgagucaaucacacuagcaacaggaccccuaacaacucuaugggaaggcagccccgguaaauucuggaacacaacgauagcuguaucaauggcgaacauauuucggggaaguuauuuagcuggggcuggauuagcauuuagcuuaaugaaauccuuaggugguggaaggcguggcacgggagcacaaggugaaacucuaggugagaaauggaagcgucaacuuaaucaacuaagcaaauccgaauuuaauacauauaaacggucggguauuauggaggucgaucgcagugaggcuaaagaagggcuaaaacggggagagacuacgaagcacgcuguaaguagaggaacagcaaaauugagaugguucguagaaagaaauuugguuaagccugaggguaagguuaucgaucuagguugcgguaggggagguuggaguuacuauugugcaggacuaaagaaaguaacagaaguaaaaggauauacaaaaggaggaccaggucaugaagaaccaauaccaauggcuacauacggauggaacauaguuaagcuacacagcggacgugacgucuucuuuacgccaccagagaaaugugacacguuacuuugcgacauaggugaaagcaguccaaacccgacgauagaggaaggaagaacauugagagucuuaaaaaugguagagccuuggcuuagaggaaaccaguuuugcauuaagauacuaaaucccuacaugccaagugugguugaaacgcucgaacaaaugcaaaggaaacaugguggaaugcuuguaagaaacccacuaucucguaacucaacacaugaaauguacugggucucauguggaaccggcaauauuguaucggcagucaacaugacaagccgcauguugcuaaaucgauuuacgauggcgcacagaaagccaacuuaugaacgugauguugaccuaggugcugguacacgccacguagcuguugaaccggaaauagcaaacuuagacauaaucgggcaacgaauugaaaauauuaaaaacgaacauaagucuacuuggcauuacgaugaagacaauccauauaaaacuugggcauaucaugggucuuacgaagucaaaccgucagggucugccucuagcauggucaauggagugguuagauuauuaacaaagccgugggauguaauacccauggucacacagauagcaaugacagacacgaccccuuuuggucagcaaagaguauuuaaagaaaaaguagauacacgaacaccgcguccaaaacguggaacagcacaaauaauggagguuacagccaaauggcuuuggggauuuuuaagucgaaauaagaaaccucguauuugcacgagggaagaguucaccagaaaaguaaggaguaaugcugcaaucggggcgguuuuuguggaugaaaaucaauggaacucagcaaaagaggcuguugaagaugaacguuuuugggauuuaguacaucgggaaagagaauugcauaaacaaggaaagugcgcaacauguguauauaauaugaugggcaaacgugagaagaaacucggagaguucggcaaagcuaaagguucaagagcuauuugguauauguggcugggcgcaagguuucuugaguuugaagcccuagguuuuaugaacgaagaucacugguuuucaagagagaacagcuuaaguggaguagagggcgaagggcuucauaaauuaggauauauucuuagagacauaaguaaaauaccuggagguaacauguaugccgacgacacggcaggaugggauacuagaauuacggaagacgacuuacaaaacgaggccaagauuacagauaucauggagccggaacaugcuuuacucgccacaaguaucuuuaaacuaacguaucaaaauaaggucguaaggguacagagacccgcaaaaucuggcacggugauggauguaauaucgagacgagaccagagaggaucaggucaagucggcaccuaugguuuaaacacauuuacgaauauggaaguacaauugaucaggcaaauggagucagagggaauauucucuccaucggagcucgaaaauucaaauuuggcggagcguguucucgauuggcuagagaagcacggaguagaaagguuaaaaaggauggcaaucaguggagaugacuguguuguaaagccaacugaugaccgcuucgcaacugcauuaacugcgcuuaacgauauggggaaagucagaaaagauaucccucagugggaaccguccaaaggauggaacgacuggcaacaggucccguucugcucccaucacuuucaucaauugaucaugaaagauggaagagaaauaguaguaccauguaggaaucaagacgagcucguaggucgggcgagggugucucaaggcgccggguggagccuaagagaaacugcuugcuuaggaaagaguuaugcacagauguggcaacucauguauuuccaccgacgagaccugagauuagcggccaaugcaauuugcucugcaguucccguaaauugggucccuaccucucgaacaaccuggucaauacaugcucaccaccaauggaugaccacugaagauaugcuaagcguguggaauagaguguggauagaggaaaaccccuggauggaagauaaaacacauguuucgagcugggaagauguuccguacuuggguaaaagggaagaccaauggugugguucacugauuggccucacggcacgagccacaugggcuacgaacauucaaguagcuauaaaccaaguaagacgucuaauagguaacgagaauuaccuggacuacaugacgucgaugaaacgauucaaaaacgagucggacccagagggugcauugugguga

SEQ ID NO: 22105 - RNA, 9879 nt, Artificial Sequence
  derived and/or modified CDS sequence (opt6) from DENV-1__KM403610__SS-prME
agcguaacaauguuauugaugcuccucccuaccgcacuggccuuucaccuuacaacgagaggaggagaaccgcacaugauaguuucgaaacaggaaagaggcaaaucacuucuauuuaaaacaucggcaggggugaacaugugcacccuaaucgcgauggauuuaggugaauuaugcgaagacacaaugaccuauaagugcccuaggauuacugaggcagaacccgaugauguggauugcuggugcaaugcgaccgauacguggguuacguacggcaccuguucacaaacaggcgaacauagacgggauaagcggucaguggcauuagcaccgcacgugggucuuggucucgagacccggacagaaacauggaugagcucagaaggcgcguggagacaaauacagaaaguagaaacuugggcauuaagacacccaggguucacuguaauagcguuauuuuuggcacacgcaauaggcacaagcauaacucaaaaaggaauuaucuuuauucuacucaugcuaguaacuccgaguauggccaugagaugugucggaauaggaaauagggauuucgucgaaggauuaagcggagccaccuggguggauguugucuuagagcaugguagcuguguaacgacaauggcgaaaaacaagcccacauuggacauagaacuccuaaaaaccgaggucacuaauccugcagugcuaagaaaauuaugcauugaggcuaaaauaucaaacacaacgacagauaguagauguccgacacaaggcgaagccacauuaguggaggaacaagaugcaaauuucguauguagaagaacauuuguagacaggggauggggcaauggcuguggguuauuugguaaagggaguuugcuuaccugugcaaaauucaaaugugucacaaaauuagagggaaaaaucguucaauaugaaaacuugaaauacucaguaauagugacuauucauacaggggaccagcaccagguagguaaugaaacaacagaacacggaacuauugcuacuauaacaccucaagcuccuaccagugagauccaacuaacggauuauggagcauugaccuuagauuguaguccaagaacaggauuagacuuuaaugaaauggugcuucuuaccaugaaagaaaaauccuggcucgugcauaaacagugguucuuagaucuuccucuaccauggaccuccggagcuagcacaagccaagaaacauggaacagacaggaucuuuuaguuaccuuuaaaacagcucacgcaaagaaacaagagguaguaguauuaggcagccaagaaggagcaaugcacacagccuuaacuggagcaacugaaauacaaaccaguggcacuacgacgaucuuugcuggucauuugaaaugucgauuaaaaauggacaaauuaacucuaaagggggugucauacguaaugugcacaggaaguuuuaaguuagaaaaagaaguugcggagacacaacaugguacuguccuaguccagguaaaauacgaagggacagaugcucccuguaagauaccgauaucaacacaggaugaaaaaggaguuacacaaaacggucguuuaaucacagcaaauccgauugugacagauaaagaaaaaccugugaacauugagacagaaccuccauucggcgaaucuuauauagugauaggagcaggggaaaaagcuuuaaagcugucaugguucaaaaaaggaucaaguauugguaagauguucgaagcaacugcacgaggcgcacgaaggauggcuauuuuaggcgauacugcgugggauuucggaucaaucgguggggucuucacguccguaggcaaauuagugcaccaaguauuugguacugcauacggugugcuauuuaguggagucaguuggacuaugaaaauaggaaucggaauauuacugacuugguuaggacuaaacucaaggagcacaagcuuaucgaugaccuguauugccguaggaaugguaacucuuuauuuaggcguaaugguucaggcggacucaggguguguuauaaauuggaagggaagagaauuaaaaugugguucuggaauuuucguaacuaacgagguacacacguggaccgaacaguauaaauuccaggcagauagccccaaacgcuuauccgccgcgauagguaaagcgugggaagaaggaguauguggcauuagaucggcaaccagauuagagaauauaauguggaagcagauuucuagcgagcuuaaccauauacuauuagaaaaugauaugaaguucaccgucguaguaggcgaugcaaacgggauucucacacaaggaaaaaaaaugaucagaccgcaaccuauggagcacaaauacucauggaaaucauggggaaaagccaaaaucauuggugcggauacucaaaacaccacuuuuauaauagauggucccgauacaccugaauguccggacgaccaacgagcauggaauauuugggaaguugaggacuaugguuucggcguuuucacgacuaauauauggcuaaagcuaagagauaguuauacucaaaugugcgaucaccguuugaugagugcugccaucaaagacagcaaggcaguucacgcagauaugggguauuggaucgaaagugaaaaaaacgagacuuggaagcuagcaagagcgagcuuuauagagguaaaaaccugcauuuggccucguagucauacccuaugguccaaugguguauuggaaucugaaaugauuauacccaagauuuacggugggccaauaucacaacacaacuaccgaccggguuauuuuacccagacagcaggcccauggcaucuagguaaacuugagcucgacuucaaccuaugugaaggaacaacaguaguuguugaugaacauugcggaaaucguggcccuagcuuacgaacaaccacggugacugggaaaauaauacaugaaugguguugcagaucauguaccuuaccuccguugcguuuuaggggagaagacggauguugguauggcauggaaauccgaccaguaaaagaaaaagaagaaaaccuagugcggucuaugguuagugcugguagcggagaaguagacuccuuuucucuaggauugcuauguguuucuauaaugauugaagaagugaugcguuccagauggucaaaaaaaauguuaaugaccggaacucuugcggucuuuuuucuguuaaucaugggacaauuaaccuggaaugaucuaauucgacuguguauuaugguaggugccaacguuucugaucgcaugggaaugggaacuacuuaccucgcucucauggccacguuuaagaugcgaccaauguucgccguaggucuccuauuuagaagauuaaccagcagggagguuuuacuauuaacgauuggacucuccuugguugcaaguguugaauuacccaauaguuuagaagaacuuggugacgguuuagcgaugggaaucaugauguugaaacugcuaaccgauuuccagucgcaucaacuauggacaacauuauuaucguugacauuuauaaaaaccacgcucagcuuagauuacgcauggaaaaccauggcgaugguuuuaucaauaguaagccuguucccacuauguuuaaguaccacuucucaaaagacuacaugguuaccgguuuuacuaggauccuucgggugcaaaccauuaacaauguucuuaaucacagaaaauaagauuugggggagaaagucauggccacuaaaugagggaauaauggcuguugguauaguuuccauucuucuuucaagucuguuaaaaaacgauguaccguuggcaggaccauugauugcgggcggaauguugauagcuugcuacguaauaagcggaagcucggcagaucuaagcuuagaaagagcugcagaagugaguugggaagaagaggcugaacauagcggagccucacauaauaucuugguagaaguacaagaugauggcacaaugaaaauuaaagaugaagaacgagaugacaccuuaacaauacugcucaaggcgacacuuuuagcaguuagcggaguauauccaaugaguauaccagcaacuuuauuuguuugguacuucuggcaaaaaaagaaacaaagaucggguguauuaugggacacaccaucaccgcccgaaguugaaagagcaguccuugaugacgguaucuaucggauacuccagagaggacuauuggguagaucucaagucggaguaggagucuuucaagacggaguguuccacacgauguggcaugucacacgaggcgcugugcugauguaucaagggaaacgcuuggagccaaguugggcaucuguaaaaaaagaccuaauaucauauggaggaggauggcguuuucaaggcucauggaacacuggugaagaggugcaaguaauagcuguugaaccaggaaaaaauccgaagaauguucagacuacgccgggaacuuuuaaaacuccagaaggagaggugggugcuauugcguuagacuucaagccgggaacauccggaucaccaaucgucaaucgcgaaggcaaaaucguuggauuauaugguaacgguguuguaaccacaucuggaaccuauguuagcgcgauagcccaagcuaaagcgagccaagaaggaccauuaccggaaauugaggaugaaguauuuaaaaaacguaacuugacgauaauggaucugcauccgggcucagggaaaaccaggcgcuaucuaccagcgaucgucagagaagcaauuaagcgcaaguuacgaacuuuaauauuagcaccaacaaggguagucgcuucugagauggcugaagccuugaaagguaugccgaucagguaccaaaccacugcaguuaagagcgaacauacgggaaaagaaauaguggaucuaaugugucacgcaacuuucacgaugcgauuauuaucuccagugagaguaccgaauuauaauaugaucauaauggacgaagcucauuucacagaucccgcuagcauagcugcacgcgguuauaucaguacacgaguaggcaugggcgaagcagccgcaauauucaugacagcgacgccuccaggcaguguugaagcauuuccacagagcaacgccgugauucaagacgaagagcgagacauaccugaacguuccuggaacagcggauaugauuggauaacagauuucccaggcaaaacggugugguucguaccaucaauuaaaucggguaaugauauagccaauugccuacgaaaaaauggcaaacgagugauccaacuuagcaggaaaacguuugauacugaguaccagaaaacaaagaauaaugauugggauuauguagugacaacagauauuucagaaaugggugcgaacuuucgcgcagacaggguaaucgauccgaggcgaugcuuaaaaccuguaauauuaaaagaugggccagaaaggguuaucuuagcggguccaaugcccguaacagcggccucggcggcgcaaaggagagguaggauaggacguaaccagaauaaggagggagaccaauauauauauaugggacaacccuuaaauaacgacgaggaucacgcucauuggacggaggcuaaaauguuacuagacaauaucaacacuccagaagguauuauuccagcacuuuuugaaccugagcgagagaaaucagcagccauugacggugaauaucguuugcgaggagaagccaggaagaccuucgucgaacuaaugaggagaggggaccuuccaguauggcuaagcuauaaaguagcgucugagggauuucaguacucggaucgucgguggugcuuugacggggaaagaaauaaucaagugcuggaagaaaacauggauguugaaauauggacaaaagaaggagaaagaaaaaaauuacgaccaagauggcucgacgcuaggacauacucugauccgcucgcauugagggaguuuaaagaauuugccgcaggaagacguagugucucuggcgaccuaauuuuagaaaucgggaaguuaccgcaacaccucacguugcgugcucagaaugcgcuugauaaucuuguaauguugcauaacucugaacaaggagggaaagccuacagacacgcaauggaggaacuaccugauaccauagaaaccuuaauguuacucgcauugauugcaguauuaaccggcggaguaacuuuauuuuuucuaagugguaagggucuagggaaaacgagcauagggcuccuaugcguaauggccagcagugucuuauuauggauggccucuguugaaccacacuggauugccgcuagcauaauauuagaauucuuuuugaugguucuacuuauacccgaacccgaccggcaacgaacgccacaggacaaucaauuagcguacguaguaauuggacuuuuauuuaugauacuuacagucgcggccaaugaaaugggacucuuagaaacuacgaaaaaagaccucgggauaggacaugucguagcagaaaaucaccaucacgcuacaauguuagauauagaccuucacccagcuucagcauggacuuuauacgcagucgcaacaacaauuauuaccccgaugaugcgacauacuauugaaaauacaacugcuaauauaaguuugacugcaaucgcgaaccaggcagccauauuaauggguuuggacaaggguuggccuauaucaaagauggacauaggaguaccuuuacucgcauugggauguuauagccaagucaauccuuugacauuaaccgcugcugucuuaauguuaguagcgcauuacgcaaucaucggaccgggauuacaagcaaaagcaacaagggaagcacaaaagaggacagcagccggaauaaugaagaauccaacaguagacgggaucguugcuauugaccuagaucccguagucuaugaugccaaauuugaaaagcaacuaggacaaauaauguuacuaauacucuguacaucucaaauauuguuaaugagaacaacgugggcguuaugugaaaguauaacacuggcuacaggaccucuuacgacgcugugggaaggaucaccuggcaaauuuuggaacacaacuaucgcaguguccauggcuaauauauuucgcggaucauaccuagcaggugcggggcuagccuuuaguuuaaugaaaagucuaggagggggacggagaggcacaggcgcacagggggagacccuuggcgaaaaauggaagaggcaguuaaaccaauuaaguaagagugaguuuaauaccuauaaacguagugggauuauggaagucgauagaucagaagccaaagaaggguuaaaacgcggggaaacuacaaaacacgcgguaucgagaggaacggcuaagcuuaggugguucguugagagaaaccucguaaaaccugaggggaaaguaauugaucugggauguggcagagguggguggucuuauuauugugcgggucugaaaaaaguaaccgaagugaaagguuauaccaaaggaggaccugggcaugaagaaccuauuccaauggccacauacggcuggaauauugucaagcuacacucagggcgggacguauucuuuacgcccccagaaaaaugcgauacacucuuaugcgacauaggugagucaagcccgaaccccacuauagaggaagggaggacguuaagaguuuuaaagaugguagagccaugguuaaggggaaaccaauuuuguaucaaaauuuugaacccguacaugcccagugugguugaaacgcuagaacaaaugcaacguaaacaugggggaaugcuaguaagaaauccauugucaaggaauucuacacacgaaauguauuggguaucgugugguacaggaaacauuguaucggcuguaaacaugacuagccgaauguuacuaaaucguuucacaauggcacaccgaaagccaacguacgagcgugacguagaccucggagcaggaacuagacauguugcgguagaaccagaaauagcuaaccuagacauuauaggacaaagaauagaaaacauaaaaaaugagcauaagagcacauggcacuacgacgaagauaauccuuauaaaacaugggccuaucauggaucauaugaaguuaaaccgucgggaucagcaaguucuauggucaauggaguugucagacuauugacaaagccuugggauguaauaccgaugguaacucaaauagcaaugaccgauacaacacccuucggucaacagaggguauuuaaagaaaaaguagauacgagaaccccgagaccaaaaagaggaacagcucaaauaauggaagugacagcuaaaugguuauggggcuuucucucacggaauaagaaacccagaaucuguacccgugaagaauucacaagaaaaguacgaaguaaugcugcaauuggugccguauuugucgaugagaaucaauggaauuccgcuaaggaagcuguagaagacgaaagauucugggacuuagugcauagagaaagagaauuacauaaacaggguaaaugugcuacaugcguguacaauaugaugggaaaaagggaaaaaaaacuaggagaguuugguaaggcaaaaggaucccgugccauaugguacaugugguuaggagccagauuccuugaguuugaggcacuugguuucaugaaugaggaucauugguucucaagagaaaauagccuuuccggcgucgaaggagaaggccuacacaaacucggauacauauugagagauauaucuaaaauaccaggaggaaauauguaugcagaugauacugccggaugggauacuaggauaacagaagaugaucugcagaacgaagcgaaaaucacugauaucauggaaccagaacaugcucuacuugcaacaaguaucuuuaaauugacauaucaaaauaaggucguuagaguacaaaggccugcgaaaucugggacgguuauggauguuaucucucgcagagaucaaagagguucaggucaggucggaacauacggauuaaauacguucacaaacauggaaguacagcuaauucgccaaauggaauccgagggaauauuuuugccaagcgaacuagagaacaguaaucucgccgaaagaguauuagauuggcucgaaaaacacgggguagaaagacuuaagagaauggcuauuucaggagacgauugcguaguuaaaccgacagacgacagguucgcaacagcuuuaacugcacuaaaugacaugggaaagguccgaaaggacauuccacagugggaaccuuccaaaggcuggaacgauuggcaacagguuccauuuuguagccaucacuuucaucaacuuauaaugaaagacggacgcgaaauuguagugccgugcaggaaccaagaugaacuaguaggcagagcacgagucucacaaggugccggauggucauuacgcgagacugcauguuuagguaaaucauacgcucaaauguggcagcuaauguauuuucacagaagagauuuaaggcuugcugcaaacgcuauuuguagugcuguaccgguaaauuggguccccacaucgcgaacuacuuggaguauacacgcccaucaccaauggaugacuacagaagauauguuauccguauggaacagagucuggaucgaagaaaacccauggauggaggacaagacacauguaucaucgugggaagauguuccauaucuuggaaagagagaagaccaaugguguggaucacucauaggccuaaccgcuagggcuacuugggcaacaaacauucaaguagcaauaaaccaaguacgcagauuaauuggaaaugagaauuauuuagacuauaugacaucaaugaaacgauucaaaaacgaaucggauccugagggggcacuaugguaa

SEQ ID NO: 22106 - RNA, 9879 nt, Artificial Sequence
  derived and/or modified CDS sequence (opt6) from DENV-1__KM403596__SS-prME
ucagucacuauguuacuuaugcuuuugccaacugcauuagcauuccauuuaacaacaagaggaggggaaccucauaugauaguuucgaaacaagaaagaggaaaaagccuccuguuuaaaacgucggcuggugugaauaugugcacacuuauagcuauggaucuuggugaacuuugugaagacacaaugacauacaaauguccucgcauaacugaagcagaaccagaugauguagauuguuggugcaaugcuacagacacgugggucacguauggaacauguagucaaacaggggaacacagacgcgauagaaggagugucgcacucgcaccacaugugggauuaggguuggagaccagaacggaaacuuggaugucaagugaaggugcauggcgccagauucaaagaguugaaacgugggcacuuagacacccuggauuuacggugauagcguuguuuuuggcgcacgccauagguacuucaauuacucaaaaagggauaauauucauuuuacuuaugcuaguuacccccucgauggcgaugcgauguguagguauugguaauagagauuuuguugaaggacuaucgggagcaacauggguugaugucguacuagaacacggaagcugcguaacuacaauggccaaaaauaaaccaacacuagacauagagcuuuuaaaaaccgaaguaaccaaccccgcaguauuaagaaaauugugcaucgaggcuaaaauauccaacaccacaacugauaguagauguccgacucaaggagaggcaacguuaguagaagaacaagacgcuaacuucguauguaggcgaacguuuguugauagaggcugggggaacgggugugguuuguucgggaaaggaucacuguuaacuugcgcaaaauucaagugcguuacaaaacuagaagguaagaucguacaauaugaaaaccuaaaguauucugugauagucacugugcacacgggggaucaacaucaagucggaaaugaaacuacggaacacggaaccauagcgaccauaacgccucaagcuccuacaagcgagauucaacugacggacuauggcgcuuuaucgcuggauuguagcccccgaaccggauuagacuuuaacgaaaugguauuauuaacuaugaaagagaaaagcuggcucguccauaaacaaugguuccuagauuuacccuuaccuuggacuucaggagcuuccacgagccaggaaacuuggaauagacaggacuuauuaguaacauuuaaaacagcgcacgcgaagaaacaagaagucguaguguuggguucacaggaaggcgcaaugcauacagcgcuuaccggagccacugaaauacaaacaucagggacuacaacuauuuucgcagggcacuuaaaauguagacuaaagauggacaaauuaacccuaaaaggcguaaguuauguuaugugcacagguagcuucaaauuggaaaaagagguagcggaaacccagcaugggacgguucuaguacaagucaaauacgaggguacagacgcccccuguaagauaccuauaaguacccaagacgagaaggguguaacgcaaaacggucgauugauuacggcuaauccuaucguaacggacaaagaaaaaccaguuaacauugaaauagagccaccuuucggagaguccuacauaguaauuggagcuggcgaaaaagcucuaaaauuaucaugguuuaagaaaggcucgucaaucggcaagauguuugaagcgacagccagaggagcuaggaggauggccauucuaggugauacagcaugggauuucggauccauagggggaguauuuaccucagucggaaaacuuguacaucaaguuuuugguacggcguacgguguacuauuuucuggcguuuccuggaccaugaaaauugguauuggcauccuacuuacauggcuaggucuaaauucgcgcucaacaucauugucuaugacguguaucgcuguggggaugguaacucuuuaucuugggguaaugguucaagcggauucagguuguguaauaaauuggaaaggcagagaauuaaaaugcgggucagggauuuucguuacuaaugagguacauaccuggacagagcaauacaaauuucaagcagauucucccaaaagauugucugcugcaauuggaaaagcgugggaagagggcguuuguggaauacgaagcgcuaccagacuugaaaauauaauguggaaacagaucucaaaugaauugaaucacauuuuauuagaaaaugauaugaaauucacaguuguugugggugaugcaaaugguauccuuacucaaggcaagaaaaugauucgcccucaaccaauggaacacaaauacucauggaaaucguggggcaaggcuaaaauuaucggagcagauacacaaaauacaacauuuaucauagacggaccugauacuccggaaugucccgacgaccaacgagcauggaauaucugggaaguagaggauuauggauucggcguguuuacaaccaacauauggcuaaaacuaagagauucauauacacagaugugcgaucauagacucaugucugccgcaauuaaggacucuaaagcaguucacgcagauauggguuacuggaucgaaucggagaaaaacgaaacauggaaacuagcuagagcgucuuuuaucgaaguaaaaaccuguaucuggccgcggucgcauacacuauggucaaacggagugcucgaaucggaaaugauuaucccgaagauauauggggguccgaucucacagcacaauuaccguccagguuacuucacacaaacugcgggcccauggcaucuaggcaaauuagaauuagacuuuaacuuaugcgaaggcacaacaguaguaguugacgagcauugcggaaauagaggaccaucuuuaaggaccacuacggucacgggcaaaauaauacaugaaugguguuguagaucgugcacacugccucccuugagauuuaggggcgaagacggguguugguaugguauggaaauuagaccaguaaaagaaaaagaagaaaaucucguaaggucaaugguaucagcaggaucgggugaaguagacucauucucuuuaggauuauuaugcguuucaauaaugauugaagaaguuaugagaucgagauggagucgcaaaauguuaaugacagggacuuuggcuaucuucuuccuuuuaaucaugggucaacuaacauggaaugaucuaauucgcuuaugcauaaugguaggagcuaaugucucugacagaaugggaaugggaacaacauauuuggcucuuauggcuacuuucaaaaugagaccaauguucgcuguagggcuauuauuuaggaggcuaacuucucgagaagugcuauuacuaacuauaggccuaucguuaguagccagcgucgaacuuccgaacucccuagaggaauugggagacggccuggcuauggguauaaugaugcuaaaauuacuaaccgacuuccagucacaucaguuguggacaacgcuacugagccuuacauucauuaaaaccacacugucgcuagauuaugcauggaaaaccauggcuaugguguugaguauugugagcuuauuccccuuauguuuaaguacaacuucgcagaaaacuacaugguuaccgguacuacuugggucuuuuggaugcaaaccuuuaacaauguuucucauaacagaaaacaaaauauggggaagaaaaucguggccacuaaaugaagguauaauggcggucggaauuguaucaaucuugcuauccagucuacugaaaaaugauguuccacuagccggcccuuuaauagcggguggaauguuaauugcaugcuaugucauuucaggaucuucggcugauuuaucucuagaacgugcggcggagguuucaugggaagaagaggcagagcauucaggagcuucucacaacauccuaguagaaguacaagaugaugguacuaugaagaucaaagaugaggaacgugacgauacacucacaauuuuauugaaagcaacacuacucgccgucagcgggguuuauccgaugucaauucccgcuacacuuuucguaugguauuuuuggcagaagaagaaacaaaggucaggagugcuaugggauacucccaguccgcccgaaguugagagggccguacuggaugauggaaucuauagaauacuucaacgcggucuucuaggacgaagucaaguaggaguaggcgucuuccaagaugguguauuucauacaauguggcacgucacaagaggggcaguacuuauguaccaagguaaaagauuagaaccaucuugggccagcguuaagaaagaccuuauaaguuaugguggaggcuggagauuucaaggcagcuggaauacaggcgaggagguccaaguuaucgcaguagaaccgggcaaaaaucccaaaaacgugcagacaacaccaggaacauuuaagacuccggaaggagaagugggcgccauugcgcuugauuuuaagccagguacaaguggcagcccaaucgucaauagggaaggaaagauuguugggcuuuaugguaacgggguuguaacaacguccggaacuuacguuagugccauugcacaagccaaggcuucacaagaaggcccucugccagagauugaagacgagguauucaagaaaagaaauuuaacaauuauggaccuacacccuggcucaggcaaaacucggcgcuaucuaccugccaucguuagagaagcgauaaaaagaaaacugaggaccuuaauacuugcucccacuagaguugucgcuucagaaauggccgaagcacuaaaggguaugccgauaagauaccaaacaacugcagucaaaagugaacauacugguaaagaaauuguggacuuaaugugccaugcaacauuuaccaugcggcuauuaagucccgugagaguaccgaauuauaauaugauaauuauggaugaagcucauuucacagacccugcuaguauugcggcgagaggauauauaagcacacgaguaggaaugggagaagccgcugcgauauuuaugacagcgacacccccgggcucaguagaagcauucccacaaucaaacgcaguaauacaagacgaagagagggacauacccgaaagauccuggaauaguggauacgacuggauaaccgauuucccagguaaaacuguaugguuuguuccaaguauuaaaucugggaaugacauagcgaauugucuacggaaaaacgguaagcgagugauacaacucucgagaaaaacauuugauacagaauaucagaaaaccaaaaauaaugauugggauuacguaguaacgacugacauuagugaaaugggggcuaauuuuagagcagauagagugauagacccccguagguguuuaaaaccugucauacugaaagauggaccagaaagaguaauauuagccggacccaugccaguaacagcggcuagcgcagcucaaaggcgcggaagaaucggccgaaaucaaaauaaagaaggagaucaauauauuuacaugggacaaccauuaaauaaugaugaggaccaugcccauuggacugaggcuaaaaugcuucuagauaacauaaauaccccagaaggcauaauaccggcacucuuugaacccgagcgcgaaaaaucggcugcaauugauggggaauaccgccuacguggagaggcgaggaaaaccuuuguagaacuaaugagaagaggagaucucccggucuggcuaucauacaagguugcaagugaaggauuccaauacuccgaucgacgauggugcuucgacggagagaggaacaaucaagugcucgaggaaaacauggacguugaaauauggacuaaggaaggagagaggaagaaacuacguccccguuggcuagaugcgcguacauauagugauccacuugcauugcgcgaauuuaaagaguucgccgcuggacgaagauccgugucgggagauuugauuuuagaaauuggaaaauuaccccaacauuuaacacuucgugcgcagaacgcgcuagacaaucuugugauguugcauaauagugagcaaggagguaaagcauauagacaugcuauggaagaacuuccggauacaauugaaacacuaauguuacucgcccuuauugcggucuuaacagguggcguuacacuauucuuucuuagugggaaaggacucgggaaaacgucaauugggcuucugugcguaauggcgagcaguguacuccuauggauggcuaguguagaaccacacuggaucgcggcaaguauaauucuggaguuuuucuugaugguccuacugauuccagagccugacagacaaagaacaccccaagauaaccaacuagcauauguagugauaggacuacuuuucaugauacuaacuguagccgcaaacgagaugggucuacuugagacuacaaagaaagauuugggaauaggccauguuguagcagagaaucaucaucaugcuaccauguuggacauugaucuacacccggcuagcgcuuggaccuuauacgcugucgcgacaaccauaauuaccccuaugaugcgacacaccauagaaaauacgacagcgaacaucaguuuaacagcaauagcuaaucaggcggcaauccuaaugggucuagauaaaggauggccgauauccaagauggauaucggggugccacuuuuagcacucggauguuauagucaaguuaacccccuuaccuuaacugccgcaguucuuaugcugguggcacauuaugcaauuauuggcccgggauuacaagccaaggcaacgcgugaggcacaaaaacgcacugcugcagguauaaugaaaaaccccaccguugauggcauagucgcaaucgauuuagacccaguuguauacgaugccaaauucgagaaacaguugggucagaucaugcugcuaauucugugcacaagccaaauacuacucaugcggacuacuugggcauuaugcgagucuaucacuuuggccacaggaccauugaccacgcuuugggaaggaucgccugguaaauucuggaacacgacgauagcuguauccauggcuaauauuuuuagaggaucauauuuagcgggcgcgggacuagcauucagccuuaugaaaagccuagggggcggacgucgggguacuggcgcacagggagaaaccuuaggagagaaauggaaacgucaauuaaaucaacugucuaaguccgaauuuaauacauacaaacgaucgggaauaauggagguagaccgaagcgaggcaaaagaaggucuaaaaaggggcgaaacgacaaaacacgcuguuuccaggggcacagcuaaauuacgcugguuuguagaaagaaauuuagucaaaccagaaggaaaagucauagaucuggguugcggaagaggcggcuggucauacuauugugcgggacuaaagaagguuacggaaguaaagggcuauacgaaaggcgggccaggucaugaagaaccaauuccuauggcuaccuaugguuggaauauuguaaaacuacauagcggucgugacguauucuuuacuccaccagaaaagugcgauacacuauugugugacaucggggaaucaucacccaaucccacuaucgaggaagggaggacguugcgcguauuaaaaaugguagaaccaugguuaagaggaaaccaauucuguauuaaaauucuuaacccauauaugccuucaguaguagaaaccuuagagcaaaugcaaagaaaacauggaggaauguuaguacgcaauccacuaucuagaaacuccacccaugaaauguauugggucaguugcggaacugguaacauugugagcgcaguaaacaugacuucccgaaugcuguuaaaccgauuuacuauggcacaucguaaacccacauaugagcgggacguagauuuaggggccggcacaagacauguugcggucgaaccagaaaccgcaaaccuggauaucauaggccaaaggauugaaaauaucaaaaacgagcacaagucuacauggcacuaugaugaagauaacccauauaaaacaugggcauaucacggaucuuaugaaguaaaaccaagugguucggcgagcucaauggugaauggcguagugaggcuuuuaacaaaaccaugggacgugauuccaaugguaacucaaauugcaaugacugauaccacgccauucggacaacaaagagucuuuaaggaaaaaguagacacaaggacuccacggcccaaaaggggaaccgcacaaauaauggaaguaacagcaaaaugguuauggggcuuucuuucacgaaauaaaaagccucgaauaugcacucgagaagaauuuacuagaaaaguccgaagcaaugcggcaauaggcgcaguauucguagacgaaaaucaguggaacuccgcuaaagaagcaguggaggacgaaagguucugggaccuaguucaucgcgagcgcgagcuccacaagcaaggaaagugcgcuacaugcgucuauaacaugauggguaaaagggagaagaaauugggugaauuugggaaggcuaaaggaucacgggcaaucugguauauguggcucggagcuagauuccucgaguucgaagcucuggguuucaugaaugaagaccauugguuuucacgagaaaauucuuuaucagguguggaaggagaaggccuacacaaacuuggauauauauuaagagauaucuccaagauacccggaggaaauauguacgcagaugacacagcaggaugggacacccguauaacagaggacgaucuccagaacgaggcuaaaauaacagacauuauggaaccagaacaugcguuacuggcgacaucuauauuuaaacuuacauaucaaaauaaagugguuagggugcaacguccagcaaaaaguggaaccgucauggaugucauaagcaggcgagaucagagggguucaggucaaguagguacauauggauuaaacaccuuuacaaacauggaaguucaauuaauaagacaaauggaaucugaaggcaucuuuagcccaagugaguuagagaacaguaaccuugcugaacgagucuuagauuggcucgagaagcacggcguagagagacuaaaacggauggcaaucagcggagacgacugugucguaaaacccacggaugauagauucgcaaccgccuuaacugcuuuaaacgacaugggaaagguuagaaaagacauaccccaaugggaaccgaguaaaggguggaaugauuggcaacagguaccauucugcagccaccacuuucaucaacugauaaugaaagauggaagagaaauaguuguuccauguagaaaucaagaugaauugguaggucgagcacgaguaagucaaggagcugguuggagucuaagagagacagccuguuuagggaaaaguuacgcccaaauguggcaguuaauguacuuucauagaagagaucuuagacucgcggcaaaugcuauauguucggcaguuccaguaaauugggucccuacuucucgaacgacguggucuauacaugcgcaucaucaguggaugacaacugaagauauguugagcguguggaaucgugucuggauugaagagaacccuuggauggaggauaagacucacguaucgucgugggaagauguaccguacuuaggcaaaagggaggaucagugguguggaucgcuaaucggacuuacagccagagcuacaugggccacaaacauucagguagcuaucaaucagguacgccgucucauagguaaugagaauuaucuagacuauaugacaagcaugaagagauucaaaaacgagucagauccugagggcgcucucugguga

SEQ ID NO: 22107 - RNA, 9879 nt, Artificial Sequence
  derived and/or modified CDS sequence (opt6) from DENV-1__KM403616__SS-prME
ucggugacuaugcuauugauguuacugccaacugcguuggcguuccaccuuacgacucgagggggagaaccucacaugauaguuaguaaacaggaacguggaaaaucuuuguuauucaaaacaagugcuggcguaaauauguguacuuuaauagcaauggaucuuggggaauugugugaagauacgaugacauauaaauguccuaggaucacagaagcugaaccggaugauguugacuguuggugcaacgcgacagacacuuggguaacauauggaacauguucacagacaggugaacaccgcagagauaaacguaguguagcgcucgcaccucacgugggcuuggggcucgaaacaaggacagaaacauggaugaguucagaaggagcauggcgucaaauacagaaagucgaaacaugggccuuaagacacccuggcuucacuguaauagcacuauuuuuagcucaugcaauagggaccagcaucacacaaaaagguauuaucuuuaucuugcuuaugcuugucaccccuucuauggcaaugcguuguguugguauugggaauagagacuucgucgaaggauuaaguggugcaacauggguugauguuguauuagaacauggaucuuguguuacaacuauggcgaaaaacaagccaacccuggauauugaacuuuuaaagacugaagugacuaacccagcaguauuacguaaacuuugcauagaagcaaaaauaucuaacacaacuaccgacuccagauguccaacacaaggagaagcgacgcuaguugaagaacaagaugcaaacuucguaugcagacggacuuuuguugauagaggauggggaaaugguuguggguuauuuggaaagggcucgcugcuaacuugugcaaaauucaaguguguaaccaaacuugaaggaaaaauuguccaauacgaaaauuuaaaguacucgguagucgugaccguacauaccggugaucaacaucaaguuggaaacgaaacuacagaacacggaacuauagccacaauaacuccacaggcuccuacaagugaaauacaacuaacggacuauggagcuuuaacgcuugauuguagcccacguacagguuuagacuucaaugaaaugguuuuacuaaccaugaaagagaaaagcugguuaguacacaagcagugguuuuuagauuuaccacucccauggacgucaggcgcuucaaccagucaagagaccuggaauagacaagaccuuuugguaacauuuaaaacagcacaugccaagaaacaggaagugguagugcuaggaagccaagaaggugccaugcauacagcauugacaggagcgaccgaaauacaaacuucaggaacaacaacaaucuuugccgggcaucuaaaauguagguuaaaaauggauaaauuaacgcuaaaaggaguaucuuauguuauguguacuggaucguuuaaacuugaaaaggaaguugcagaaacacaacacggaacuguacugguacaaguaaaauacgaagguaccgacgcaccaugcaagauaccaauaagcacccaagacgaaaaaggaguaacccagaauggaagacuaauaacagcuaacccgauagucacagacaaggaaaagccagucaauauugaaacagaaccaccauucggggaaagcuacauaguaauaggagcuggugaaaaagcauugaagcugucgugguuuaaaaagggaagcucaauugggaaaauguuugaggcgacagcuaggggcgcaagaagaauggccaucuuaggugacacagcuugggauuucgggaguauuggaggaguauuuacaucuguagguaaacuugugcaucaggucuuuggaacggcguaugggguccuguuuaguggaguuucauggacaaugaaaauagggauaggcauucuccuaacuugguuaggauuaaauuccagaaguacaucauuaucuaugacauguauagcaguggggauggugacacuauaucucgguguuaugguacaagcugacucaggauguguuaucaauuggaagggacgggagcucaaauguggaucuggaauauucguaaccaaugaagugcacacauggacggagcaauacaaauuucaagcagauaguccaaagagacuuagcgcggccaucgggaaggcgugggaggaagguguuugcgguauacgaucugcuacaagauuggaaaauauuauguggaaacaaauuucuaaugaauugaaucauauccuguuggaaaaugauaugaaauuuacgguggugguuggagacgcaaaugguauauuaacucaaggaaagaaaaugaucagaccacaacccauggaacacaaguauaguuggaaaucauggggaaaagccaaaaucauaggagcagacacacaaaauacuacauuuauaauagaugggcccgauacaccagaaugucccgacgaucaacgagcauggaacauaugggaaguggaagauuacggauuuggcgucuucaccacaaauauaugguuaaaguuacgagauuccuacacacaaaugugugaccaccgauugaugucagcggcuaucaaagacucuaaagcagugcaugcagacaugggauacuggauugaaucugagaaaaaugaaaccuggaaguuagcucgugcgagcuuuauugagguaaaaacuuguauauggccgagaucacacacacuauggagcaauggaguauuggaauccgagaugaucauaccuaagauuuacggcggaccgauuagucaacauaauuaucgcccuggcuacuuuacgcaaaccgcagggccauggcaccucggaaaacuugaacuagauuuuaaccuuugugagggaacgacgguaguaguagaugaacacugcgggaaucgcgguccuaguuuacgaacaacgacaguaacagggaaaaucauccaugagugguguuguagaucuuguaccuuaccaccuuuacguuuucguggcgaggauggguguugguacgguauggagauucgucccguaaaagagaaagaagaaaaucucguuaggucuauggucuccgcgggaaguggcgagguggauaguuuuagcuuaggacuacuaugcguauccauuaugauagaagaagucaugaggagccgcuggucuagaaagaugcugaugacugguacguuagccgccuucuuucucuugauaaugggacaauuaacauggaaugauuuaauaagacuaugcauaaugguaggggcaaacguaagcgauagaauggguauggguaccacguacuuagcgcuaauggcuacguucaaaaugcgaccgauguuugcaguaggcuuauuauuuagaagguuaacgucgagagaagugcuacuacuaaccauaggucuuuccuuaguugcuucgguugaacuaccgaauagcuuagaggagcuaggagauggacuagcaauggguauuaugauguugaaguuacuaacagauuuccaaagucaccaauuauggacuacccuauuaagucuaacauuuauuaaaacaacuuuaucccuagauuaugccuggaagacuauggcgaugguauuauccauaguauccuuguuucccuugugucuaagcacgacgucacagaaaacuacauggcucccaguucuauuagggagcuuuggguguaagccucuaacaauguuucuuauuaccgagaauaaaauaugggguaggaaaucauggcccuugaaugaaggcauaauggcuguagguauaguguccauacugcucaguucauuacuuaaaaaugauguucccuuagccggaccccuuauagcgggcgggaugcuaaucgccugcuacguaauuaguggcagcucggcagaccuaucccuagagagagcggccgaaguuaguugggaggaagaagcugaacauaguggcgccagucacaauauauuagucgaaguacaagacgacgguaccaugaagauaaaagaugaggaacgagaugacacccuaacgauccucuuaaaagcaacucuguuggccguguccggaguuuaccccaugucgauuccagcaacacuauucguaugguauuucuggcaaaagaagaaacaacgcucuggaguccucugggauacaccuagucccccugaaguagaaagagcuguucuugaugauggcauuuacaggauucugcaaaggggacuauugggacggagucaaguaggaguaggaguauuucaagacggaguguuccauacuauguggcauguuaccagaggagccguauugauguaucaaggcaaacggcuagaaccuucaugggcaagugucaagaaagacuugauaucguacggugggggcuggagauuucaagguucauggaacaccggugaagaaguacaagucauagcuguugagccggguaaaaaccccaaaaacguucaaaccacaccagggacuuucaagacgcccgagggcgaaguuggggcgauagcacuagacuucaaaccaggaacaaguggaucaccgauaguaaacagagaggguaagaucguaggauuauauggaaauggaguuguaacaacuuccggaacauacgucucagcaaucgcgcaagcaaaagccucacaggaagguccauuacccgaaauagaagacgaaguuuuuaagaagcggaaccuaaccauuauggaucuucauccaggaagcggaaaaacaagacguuauuuaccagcgauagucagggaagcuauaaaaagaaagcuacgaacccuaauucucgccccuacacggguuguugcauccgaaauggcggaagccuuaaaagguaugccaauaagguaucaaacgacugcuguuaaguccgaacauacuggaaaagaaauaguagaucugaugugccaugcaaccuuuacuaugcgacuguuaagcccgguuagaguuccaaacuacaauaugauaauaauggaugaggcacauuuuacggacccggcaucgauugcugcucgugguuauauauccacgagaguagguaugggagaagccgcugcaauuuuuaugaccgcuacgccuccagguagcguggaggcuuucccucagucgaaugcgguuauucaagaugaggaaagagauauaccagaacguucauggaacucuggguaugauuggauaaccgauuuuccuggaaaaacugugugguucguacccagcauuaaaucaggcaaugauauugcgaauugccuucgaaagaauggaaaacggguaauacaacuaucgcggaaaacguucgauacugaauaucagaaaacuaaaaacaaugauugggacuauguaguaacaacagauauaucggaaaugggggcgaauuuucgcgcagaucgcgugauugacccaagaaggugucuuaaaccggucauccuaaaggacgggccagaaagaguaauccucgcaggacccaugccuguaacggcugcuucagcggcucaaagacgaggucggaucggacgaaaucaaaauaaggaaggagaucaauauauauacauggggcaaccacucaauaaugaugaagaccaugcucauuggacagaagcuaagaugcuacuugauaauauaaauacaccugaggggauuauccccgcacuuuuugaaccagagagagagaaaagcgcagcgauugacggagaauacagguugaggggagaagcgcgaaagacauuuguggagcuaaugagaagaggagacuugcccgucuggcuuagcuacaagguagccuccgaaggauuucaguacucugaccgaaggugguguuucgacggagaaagaaacaaccaaguguuagaagaaaacauggauguugaaauauggacuaaagagggagagcgaaagaaacuaagaccuagauggcucgacgcaagaacguauagcgauccacuugcccuacgcgaguucaaagaauuugcugcgggucgaagauccguaaguggagaccuaauucuugagauuggaaaacuaccucaacauuuaacuuuacgagcccagaaugcuuuagacaacuuagucauguuacacaauucagaacaaggggguaaagcguaccgccacgccauggaggagcugcccgauacaaucgaaacuuuaauguuauuagcacucauagcagugcuaacgggcgguguaacguuguuuuucuuaagcgguaaaggguuaggaaaaacauccauaggcuuacuaugugucauggcuucuaguguccuauuauggauggcaucggucgagccgcauuggauagcggcgucuauuauccuagaguucuuucuaaugguuuuacucauaccagaaccagauagacaaagaacaccgcaagauaaccaguuggcguacguggugaucggauuacuuuucaugauacuaacaguagcugcaaaugaaaugggucuacuugagaccacaaagaaagaucucggaauaggacacguaguggccgaaaaucaccaccaugcaacuaugcuagauauugauuugcacccagcaucggccuggacucuauaugcuguagccacaaccauaaucacgccgaugaugcggcauacuauugaaaacaccacugcgaauauuaguuuaacggcuauugccaaccaagcugcaaucuuaaugggucucgacaaggguuggccaauaucaaaaauggauauaggagucccccuacuagcgcucgguugcuauucccaagucaacccacucacauuaacggcugcaguauugaugcuuguggcucauuaugccauaauagggcccggucuccaggcaaaggcaacgcgugaagcucaaaaacgcacugcggcaggaauaaugaaaaauccaacuguugaugguauuguggcgauagaucuugaucccguuguguaugacgcaaaauuugaaaagcaacuaggacaaauaauguuguugauacugugcacaucacaaauauuauugaugcgaacaacaugggcauuaugugagagcauuacauuagccacggguccguuaacuacacuaugggaggguuccccaggaaaauuuuggaauacaacaauagccguaucaauggcuaacauuuuucgcggaaguuacuuagcaggggccggcuuagcauucucguuaaugaaauccuuaggcggaggaagaagagguacgggugcgcaaggagaaacuuugggggagaaauggaaacgacaacuuaaccaacuaagcaaaagcgaauuuaacacuuacaaaaggucuggcauaauggaaguugauaggagcgaggcaaaggaaggacugaaaagaggugaaacaacuaagcacgccgucucaagggggacugccaaacuccgaugguuuguugaacguaaucuaguaaaacccgaaggaaaaguuauagaucuuggauguggccgcgguggauggaguuacuacugugcaggcuugaagaaaguuacggaaguaaaagguuacacuaaaggaggaccaggccacgaagaaccuaucccgauggcgacauauggauggaauauagucaaacugcauucuggucgcgauguauucuuuacuccaccugaaaagugcgauacguuacugugcgacaucggagaaagcaguccaaaucccaccaucgaggaggguaggacacuucgaguucuaaaaaugguggaaccuuggcuacgaggaaaccaauucugcauuaaaauacuuaaucccuauaugccgucuguaguagagacgcuugaacaaaugcaacguaaacacggugguauguuagucaggaauccuuuaagucgaaacucaacucaugagauguauuggguauccugugguacgggaaacauaguaucagcaguuaauaugacuuccagaaugcucuuaaauagguucacuauggcacaucgaaagcccacuuacgagcgagauguggaccuuggagcuggaacacggcacguagccguagagccagagaucgcaaaucuagacauuauaggucaaagaauagagaacauuaagaaugaacacaaaagcacauggcauuacgaugaggauaacccguauaagacuugggcauaccauggcucauacgaaguaaaaccuucgggcagugcuucaaguaugguaaauggugucguacgacuacuuacuaaaccaugggauguaauucccauggucacacaaauagcuaugacagacacaacccccuucgggcagcagcguguuuuuaaagagaagguagacacgagaacaccacggccaaaaaggggaacugcucaaauaauggaaguaacagcaaaguggcucuggggauucuugucgcgaaacaaaaagccucgaaucuguacaagagaagaauuuacacgaaagguuagaucaaaugcugcuauaggugcaguuuucguagaugaaaaucaauggaacuccgcuaaagaggcaguugaagacgaaagauuuugggacuuaguacauagggaaagagaacuucauaagcagggaaagugcgcaacauguguauacaauaugauggguaaacgagagaagaaacuaggcgaguuugguaaagcuaaagggucaagagcgaucugguacauguggcucggagcaagauuucucgaguuugaagcguuaggauucaugaaugaagaucauugguuuaguagggaaaacagucuuagcggcguagaaggagaggggcuucauaaauuggguuacauccuccgugauauuuccaaaauaccuggugguaacauguaugccgaugacacugcugggugggauacccgaauaacugaagacgacuuacaaaaugaagcaaaaauuacagacaucauggaaccagaacaugcgcuacucgcgaccuccaucuucaaguuaacuuaucagaauaagguaguaagaguacagagaccagcaaaaagcggaaccguaauggacgugauaucuagacgugaucagagagggaguggacaaguagguaccuauggguuaaauacauuuacaaauauggaaguccaauuaauacgacaaauggagucagaaggaaucuuuucaccgucagaacuugaaaacuccaauuuagcugaaaggguacuagauuggcuagaaaaacaugguguugagagacuuaaacggauggcgauaucuggagaugauugugucguaaaaccuacggaugauagauucgcaacggcauuaacugcuuuaaaugauaugggcaaaguucgaaaggauauuccacaaugggaaccaagcaaaggcuggaacgauuggcagcaaguaccauuuugcucgcaucacuuccaucaauugauaaugaaagauggacgugaaauagucguuccauguagaaaucaagacgaguuaguggguagggcccggguaucccaaggagcaggguggucucucagagaaacagcuugucuagguaagaguuaugcucaaauguggcaacuuauguauuuccaccgaagagacuugagguuggcugcaaaugcaaucuguagcgcggugccgguuaacuggguaccaacaucuagaaccaccugguccauucaugcccaucaccaguggaugacaacugaggacaugcuaucuguauggaacagagucuggauugaagaaaauccuuggauggaagacaagacacaugugucaucuugggaagauguaccauacuuaggaaaacgagaagaccaauggugugguaguuuaauuggacuaacagcacgcgcaacaugggcuacuaauauucaaguagcgaucaaucaagugaggagauuaauagggaacgaaaauuacuuagacuacaugacaaguaugaaacguuuuaaaaaugaaagugauccagagggggcucucugguag

SEQ ID NO: 22108 - RNA, 9879 nt, Artificial Sequence
  derived and/or modified CDS sequence (opt6) from DENV-1__KM403617__SS-prME
uccguuacaaugcuuuuaauguuguuaccaacugcacuagcauuucacuuaacaacaaggggaggagaaccacacaugaucgucaguaaacaagaacgaggaaaaucacuuuuauuuaaaacaagugccggugugaauauguguacacuaauugcuauggacuuaggugaacugugugaagauacaaugacuuauaaauguccucggauaacagaagcagaaccagaugauguagauugcugguguaaugcaacagauaccuggguaacauacgggacuuguagucaaacgggagaacauaggcgagacaaaaggucaguagcacucgcuccacacguaggauugggacuugaaacuagaacagaaacuuggaugagcagugagggugcuuggcgucaaauacaaaaaguagaaacgugggccuuaaggcauccuggcuucacuguaauagcgcuauuucuagcucaugcaauaggcacgagcaucacucaaaaagguaucauuuucaucuuguuaaugcugguaacaccaaguauggcaaugaggugcguuggaaucggcaacagagauuucguagaagguuuaucaggagcuacguggguagacguaguacuugaacacggcucauguguuacaacaauggccaaaaacaaacccacacuagauauagaacuuuuaaaaaccgaaguuacuaaccccgcaguacuaaggaaacucuguauugaagccaaaauuagcaauacaacaaccgacagccgaugcccuacucaaggggaagccacacuuguggaggaacaagaugcgaauuucguaugcaggaggacauuuguggaucgcgguugggguaaugggugugguuuauuuggcaaagggucucuccuuacuugcgccaaauucaaauguguaacuaaauuggagggcaaaaucguacaauacgaaaaccuuaaauauucugugguagugaccgugcauaccggugaccagcaucaaguaggaaaugaaacaacagagcaugggacaauagcaacgaucacaccccaggcuccuacaagcgaaauucaacuaacagacuacggagcuuuaacacuagauugcucuccuagaacaggauuagauuuuaacgaaaugguucuguugacgaugaaagagaaaaguuggcucguccacaaacaaugguuccuggauuuaccacuaccauggacgaguggagcaucaaccucucaagaaacauggaaucgacaagaccuucuugugacguucaaaaccgcacaugcuaagaaacaagagguugugguguuagggagucaagaaggcgcuaugcauacugcucucacgggagcaaccgagauucagacaaguggaacuacgacaauauucgccgggcauuugaaauguagacugaaaauggauaagcuaacguuaaaagggguaucuuacgucauguguaccgguucauucaaacuggaaaaagaaguagcagaaacacaacacggaaccguacucguacaaguaaaauacgaagggacagacgcaccauguaagaucccaauuucaacucaggaugaaaagggcgucacccaaaacggccgccucauaacggcaaauccaauugugaccgacaaagaaaaaccgguaaauauagaaacggaaccuccauucggugagucuuacauagugauuggagcaggagagaaagcacuuaaguuaaguugguuuaaaaagggaucaagcauugguaaaauguuugaagcuacagcacgaggagcucgaaggauggccauucuaggagacaccgcgugggauuucggguccauaggcgguguuuucacgucuguggguaagcuaguccaucaaguauucggaaccgccuauggagugcuauuuuccggaguguccuggaccaugaaaauagggaucgguauauugcucaccuggcuaggacuaaauucuagaaguacgucgcuaucuaugacauguauagcgguaggcaugguuacacucuauuugggagucaugguacaagcugauucagguuguguaaucaacuggaagggucgagaacuaaaaugcggaucuggaauauucgucacuaacgaaguccauacauggacagaacaauacaaauuucaagcggauucuccaaaaagauuaagcgcagcaauaggaaaggcgugggaagaaggaguauguggcauucggucggccacaagguuagaaaauaucauguggaaacaaauaucaaaugaauuaaaucacauacuauuagaaaaugacaugaaauucacgguagucguaggcgaugcaaauggaauacuuacgcaaggcaagaaaaugauaagaccucaaccgauggaacauaaauacuccuggaagaguuggggcaaagccaaaauaauaggagcugauacacaaaacacgacuuuuauaauagauggccccgauacaccagagugcccggacgaccaacgcgcauggaauauaugggagguggaggacuauggauucgguguauuuaccacaaacauaugguuaaaauuaagagacucauauacacaaaugugugaucauagacuaaugagcgcugcgauuaaagauuccaaagcaguucaugcugacauggguuauuggauagaaucugagaaaaaugaaacuuggaaauuggcaagagcgagcuuuaucgaaguaaaaaccuguauuuggccgagaagucacacacuauggucgaacggaguacuagaaucagaaaugaucauaccaaagauauacggagguccaaucucucagcacaauuaucguccaggauacuucacucaaaccgcagggccuuggcaccuggggaaacuugaacuagauuucaaucuuugcgagggaacuaccguggucgucgaugagcauuguggaaaucgaggucccucccucagaacuacaacugucaccgggaaaauaauacaugaaugguguugcagaaguugcacacuacccccgcuacgcuuuagaggagaagaugguuguugguauggcauggaaauuaggccuguuaaagaaaaggaagaaaacuugguaagauccauggugucggcagggucaggggaaguagacaguuuuucacuugguuugcuuugcguaaguauuaugaucgaggaggugaugaggagccgcuggagucgcaaaaugcucaugacggguacauuggcaguauucuuucuacuaauuaugggucaguugacuuggaaugaucugauuagauuauguauaaugguaggcgccaacguuagugauagaauggggaugggaacaacauaccuugccuuaauggcaacauuuaaaaugcgacccauguuugcaguagguuuguuauuuagacgacuaacaaguagggagguucucuuacuuacaauugguuuguccuuaguagcaucagucgaacuaccuaauagucucgaagaauugggggacggacucgcuauggguaucaugauguuaaaauuacuaacugauuuucagagucaccaacuauggaccacacuguugucuuuaacauuuauaaaaacaacucugucacucgauuaugcauggaaaacaauggcuauggugcuaucaauaguaucacuauuuccgcuuugucuuucuacuacgucacagaagacuaccugguuaccaguauuacuaggcucauuuggguguaaaccucuaaccauguucuuaauaacugaaaauaagauauggggcagaaaaagcuggccuuugaacgaggguauaauggcaguagguaucguuaguauccuauugucaucucuguugaaaaaugaugucccguuggcaggaccacuuauagcggguggaaugcuaauagcauguuauguuauuagugguucaagcgcagacuugagcuuagagcgggcagcagaaguaagcugggaagaagaggcggaacacaguggugcgagucauaauauauuaguagaaguucaagacgaugguaccaugaaaauuaaggacgaagagagagaugauacccuaacuauuuuauugaaagcuacccuucucgcagugucaggaguuuaccccaugucgauaccugcaacgcuuuuugugugguauuucuggcagaagaagaaacaacgcagcggagugcugugggauaccccaucuccaccagagguagaaagagcuguauuagacgauggcauauacaggauucuacaacgcggauuacucggaagaucacaaguuggaguuggcguauuccaggauggaguguuccauacaauguggcauguuaccagaggagcgguucuaauguaucagggaaaacgccuagaaccaucuugggcaucaguaaagaaggaccugauaucauauggaggugguuggcgauuccaaggcucuuggaauacaggagaagagguacaaguaauagccguugaaccgggaaagaaucccaaaaauguucaaacuacaccagggacauucaaaacuccugagggagagguuggagcaauugcacucgacuucaagcccgguacaagcggcuccccgauagucaacagagaaggcaaaaucgugggauuauaugggaacggcguuguaacaaccucaggaacuuauguaagugcuauagcucaagccaaagccagucaggaaggaccguuaccagaaauugaagacgaagucuuuaagaaaaggaaucuaacuauaauggaccuccaucccgguagcggcaaaacacgcagauaucuuccugcaauaguucgugaggcgauuaaacgaaaacuaagaaccuugauacuagccccgacgaggguggucgcaucggaaauggcugaagcccucaagggaaugccaaucagguaccaaacaacagcagugaaaucagaacauacggguaaagaaauagucgacuugaugugccacgcaaccuucacuaugagauuauuaucaccgguaagaguccccaauuacaacaugauaauaauggaugaagcacauuuuacagauccagcuagcauugcggcacgaggauacauuucaacucgagucgguaugggcgaagccgcagcuauauuuaugacagcgacuccacccggaucuguugaggcauucccccaauccaacgcagucauacaagacgaagaaagagauaucccugaaagaucguggaacucagguuacgauuggauaacggauuuuccagguaaaacagucugguucgugccaucaauuaaaaguggcaacgacauugcaaauugccucagaaagaaugggaaaagagugauucagcugucaaggaagaccuucgacacggaauaccagaaaacgaagaauaaugacugggacuacguaguaacuaccgauauuucugaaaugggcgcuaauuuucgagccgaccggguuaucgauccacgaagaugucuaaaaccuguuaucuuaaaagauggcccggagcgaguaauauuggcggggcccaugccaguuacugcagcuagcgccgcacaacgaagaggcagaauaggaaggaaccaaaacaaagaaggugaucaauauauauauaugggacaaccucugaacaaugacgaagaucacgcgcacuggacggaagcuaaaauguuauuggacaacauaaauacgccugaaggcaucauaccagcacuuuucgaaccugagcgggagaaaagcgcugccauagauggugaauacagguugagaggagaagcccgaaaaacuuuuguugaacuaaugcgacgcggcgaccuaccaguguggcuaagcuauaaaguagccagcgaaggcuuucaguacagcgauagaagguggugcuucgauggagaaagaaacaaucagguauuagaagagaacauggauguugaaauauggacgaaggaaggcgagcgaaagaaauuaagaccaagauggcuugaugcacgcacguacuccgacccacuagcucuaagagaguuuaaagaguuugcggcagguaggagaagcguaucaggugauuugauacuagaaaucggaaaauuaccucaacaccuuacgcuccgugcacaaaaugcgcuugauaaucuaguaauguuacauaacucugaacaaggaggcaaggcuuaucgacacgcgauggaagaauuaccugacacaauugaaacuuuaauguuacuugccuuaaucgcuguauuaacgggaggaguaacauuauucuuucucucaggaaaaggucuuggaaaaacaaguauuggauuacucuguguaauggcauccaguguccugcuauggauggcuucaguagaaccccacuggaucgcagccucuauaauacuagaauuuuuccuaauggugcuucuuauuccugaaccugaccgacaaagaacgccacaagauaaccaacuugcauacguuguaauuggacuucuguuuaugauacuaacuguagcagcuaacgaaauggguuuacuagaaaccaccaagaaagacuuagguauaggacauguaguggcagaaaaucaucaccacgccacaauguuagacaucgauuuacacccagcuagugcguggacucucuaugcaguggcgacuacaauaauaacaccuaugaugcgacauaccauagaaaauacaacugcaaauaucucguuaacagcuauagcaaaucaagcugcaauacugaugggguuagacaaaggauggccgauuuccaaaauggacaucggaguaccguuguuagcacuggguuguuauucccaagucaacccacuaacucugacugcagcuguacuuaugcuaguugcucauuaugcuauuauuggaccuggccuacaggcaaaagcuacacgagaagcucagaagcggacagcagcagggauaaugaaaaauccaacuguagacggaauugucgccaucgaucuagaucccguaguuuaugacgcaaaauuugaaaaacaacuugggcaaauuaugcuguuaaucuuguguaccagccaaauacucuugaugagaacaaccugggcccucugcgaaucgaucacauuagcaacugguccguugacaacguugugggaaggcaguccaggaaaauucuggaacacuacaauugcgguuagcauggcgaacauauuucgaggcagcuaucucgcaggagcugguuuagcauuuucuuuaaugaaauccuuagggggaggacgacgcgggacgggagcgcagggcgagacccuuggggaaaaauggaaaagacagcuaaaccaacucuccaaaucagaguucaacacauauaaaaggagcgggauaauggaaguagacagaucagaggcaaaagaaggacuaaagcgaggagaaacuacgaaacaugcuguaagccgaggaaccgcaaaguuaagaugguuuguggagagaaauuuagugaaaccagagggaaaagucaucgauuuaggaugcggcagaggaggauggucguauuacugugcgggacugaagaaaguaacugaaguaaagggauauacaaaaggggguccgggucacgaagaaccaauacccauggcuacguauggcuggaauaucguuaaacuucauaguggaagagaugucuucuuuacaccaccagaaaaaugugauacucucuuaugcgauauaggggagaguucaccaaacccaacuauagaggaaggccgcacacuaagaguccucaaaauggucgaaccaugguugcgaggcaaccaauucugcauaaaaauucuaaaccccuacaugccgucggugguagaaacauuggaacaaaugcagagaaagcacggagggaugcuggugcgcaacccauuaucaagaaauuccacgcaugaaauguauuggguaaguuguggaacugguaauauuguaucggccguaaacaugacgucuagaauguuguugaaucgauucacaauggcccacagaaagccaacauaugagcgggauguugaccucggggcagggacuagacauguagcaguagagccagaaaucgcaaauuuagauauaauuggacaacgaauagaaaacaucaaaaaugaacauaaaaguacguggcacuaugaugaggauaauccauacaaaaccugggcauaucaugguaguuaugaagucaaaccgucagguucggcaagcucaauggugaacggcguagugagauugcuaacuaagccaugggauguaaucccuauggugacacaaaucgcaaugacagauacgacaccuuuuggccagcaacgaguauuuaaagaaaaaguugauacccgaacaccaagaccaaagcgaggaacagcacaaauuauggaagucacugcaaaaugguuauggggauucuuaucgcguaauaagaaaccgcgaauaugcacgagagaggaguucacccguaagguucggucuaaugcagcgauaggugcgguguuuguagacgagaaucaauggaacagcgcgaaagaagccguugaagaugaacgauuuugggauuugguacacagggagcgagaauuacauaaacaaggcaaaugcgcaaccugcguauacaauaugauggguaaaagagagaagaaacucggcgaguucggaaaagccaaagguucgagagcaauaugguauaugugguuaggagccagauuuuuagaguuugaagcacuagguuucaugaaugaagaucacugguuuucucgagagaacucuuugucaggaguagaaggugaaggauugcauaaacuuggauacauacuuagagauauaucaaagauaccagguggaaauauguacgcagaugacacagcggguugggacacaagaauaacugaagacgaccuccagaaugaggcaaagauuaccgauaucauggagccagaacaugcauuacuugcuacgucaauauuuaaacuaacuuaccaaaacaagguagugcguguacaaagacccgcuaaauccggaacugucauggacguaauaaguagaagggaccaaagaggauccgggcaagugggaacauauggacuuaauaccuuuacaaauauggaaguucaauugauucgucaaauggaaucggaagguauauuuucuccuagcgaacuugaaaacucaaaucuugccgaaagaguucuagauuggcuugaaaaacacggaguugaaagacuaaaaagaauggcaauuaguggggacgauuguguagugaaaccuacagacgauagguuugcaacggcgcuaacugcauuaaaugauaugggaaaagucaggaaagauauuccucagugggaaccguccaaaggauggaacgacuggcagcaaguucccuuuugcagucaccauuuucaucaauuaaucaugaaagauggacgggaaauaguaguaccaugcagaaaucaagaugagcuaguaggcagagcucgaguuucucaaggggcaggauggucgcucagagaaacugcauguuuagguaagucguaugcucaaauguggcaauugauguauuuucaccgacgagauuuaagauuagcagcgaaugcaauuuguagugcugugccuguaaauuggguacccacuucgcgaacaaccuggucuauccaugcccaccaccaauggaugacaacggaggacauguuaucaguuuggaacagaguuuggauagaagagaacccauggauggaagauaaaacacacguuaguaguugggaggauguaccauacuuaggaaaaagagaggaccaguggugcggaagucuuaucggauugacagcgcgagcaacaugggccaccaacauucaaguagcaauuaaucaaguacguagauuaaucgggaaugaaaacuacuuagacuauaugacaucaaugaaaagguuuaaaaaugaaagcgauccugaaggcgcauugugguaa

SEQ ID NO: 22109 - RNA, 9879 nt, Artificial Sequence
  derived and/or modified CDS sequence (opt6) from DENV-1__KM403635__SS-prME
agcgucacuaugcuguugaugcuacugcccacugcccucgcuuuucaccuuacgacucgaggaggggaaccacauaugauagugaguaaacaggaacgugguaaaucacuguuauuuaaaacguccgccgggguuaauauguguacccuuauagcaauggaucucggagagcuaugugaagacacuaugacauauaaauguccacgaauuacggaagcagaaccugacgauguagauugcuggugcaacgcgacagauacuuggguuacguacggcacgugcucccaaacgggagaacaucggcgagauaaaagauccguugcacuggcaccacacguaggacuugguuuagaaaccagaacggaaacauggauguccagugaaggagcauggagacaaauucaaaaagucgaaacaugggcuuuaagacacccaggauuuacaguaauagcgcucuuuuuggcacaugcaauagggacuagcauaacucaaaaagguauaauauucauccuuuuaauguuagucacucccucgauggcaaugagauguguagguaucgguaacagggacuuuguugaaggcuuaucaggagcaacuugggucgacgugguuuuagaacauggaucgugcgucacaacaauggcuaaaaacaaaccuacacucgacauagagcuuuuaaaaacggaaguuacuaacccggccguuuuaagaaaacuuugcaucgaagcaaaaauuagcaauacgacuacugauaguagauguccuacgcaaggugaggcaacauuggucgaggaacaagaugcaaauuuuguaugcagacguaccuucguggauagaggauggggaaacgguuguggauuauuuggcaaaggaagccugcuuaccugugcuaaauuuaaauguguuacuaaacuagaagguaaaaucguccaauacgagaacuuaaaauauucuguaauaguuaccguacacacgggagaucaacaucaagugggcaacgaaacuacagagcauggcacaauagccacuauuacaccccaagcaccuaccagcgagauucaguuaacggacuauggugcgcuaacucuggauuguagcccgagaaccggccuagauuucaaugagaugguucuucugacaaugaaagagaaaucuugguugguacauaaacaaugguuccuugacuuaccguugccuuggacauccggggcaucagccagucaagaaaccuggaacagacaagacuuguuagucacuuuuaaaacagcacaugccaagaaacaagaaguggugguccucggaagccaagaaggggcaaugcacacagccuuaacaggcgcaaccgagauacaaacguccggaacuacgaccauauucgcuggucauuuaaaauguagacuaaaaauggacaaguugacacuaaaagguguauccuauguuaugugcacugguucauuuaagcucgagaaagagguugcggaaacacaacauggcaccguacucguucaaguuaaguaugaaggcacagacgcgccauguaaaauaccaaucucuacacaggacgagaagggcguaacacaaaacggucgauugauuaccgccaauccaauaguuacggauaaagagaagccagucaacauugagacugaacccccuuucggagaaagcuauauuguaauaggugccggcgagaaagcacuuaagcuaucaugguucaagaagggcucgucuaucggaaagauguucgaagcuacagcuagaggugcaagacgaauggcaaucuuaggagauaccgcuugggauuucgggaguauaggaggugucuuuaccaguguagggaaguuaguacaucaagucuucggcaccgccuaugguguucuauuuuccggaguauccuggacgaugaaaauugguauagggauucugcuaaccuggcugggacuuaauagcagguccacaaguuuaucuaugacauguauagcugucgguaugguuacccucuaucuuggaguuaugguacaggcugauucaggaugcguuauaaauuggaagggcagggaacucaaauguggcagcggcauauuuguuaccaaugaaguacacacauggacagaacaauauaaauuccaagcagauuccccuaaaagacucuccgcagcaaucggaaaagcaugggaagaaggaguaugcggcauacgaagugcuacgagacuagagaauauuauguggaagcaaauaucaaacgaauugaaucauauacugcucgaaaacgauaugaaauucaccguaguagugggcgaugccaauggaauauuaacacaagguaagaaaaugauacgcccacagcccauggaacacaaguauaguuggaaaucuuggggaaaagcaaagaucaucggugcagacacgcaaaauaccacguuuauuaucgacgggccugacacuccagaaugccccgacgaccaaagagcguggaauauuugggaaguagaagauuauggguuuggggucuucacaaccaacauauggcucaaauugagagauuccuauacucaaaugugcgaccauagauuaaugucagcagcaauaaaagacucaaaggcaguucacgcggacaugggauauuggauagaguccgagaaaaaugaaaccuggaaguuggcuagggcaucuuucauagaggucaaaacuuguauuuggccucguucacacacccuauggagcaacgguguccuagaaucagagaugauaauuccuaaaaucuauggagguccgauaucucaacauaauuaccguccaggguauuucacacaaacagcagggccuuggcacuuaggcaaacuugaacuagauuucaaucucugcgaagguacaacagugguaguagaugagcacugcggaaauagagggccaagucuaagaaccaccaccguaaccggaaaaaucauacaugaaugguguugucgaucuugcaccuugccaccauugagauuuagaggggaagauggcugcugguaugguauggagaucagaccgguaaaagaaaaagaagagaaccuaguccgaaguauggucucugcggggucuggugaaguagauucuuucucccuaggccuuuuauguguguccaucaugaucgaagagguaaugcgaucacgguggucuagaaaaauguuaaugacagguacgcuagcuguauuuuucuuauuaauaauggggcaacuuaccuggaaugaucuaauccgccuauguauaaugguuggugcuaauguaagugauaggauggggauggguacuacguauuuagcacucauggcuaccuuuaaaaugcgucccauguuugcaguuggacuucuauucaggagacuuaccucuagagaaguucuucuacuaacuauagggcugaguuuagucgcauccgucgaacugccuaauucuuuagaagaauugggagacggucuugcaaugggaauaaugauguuaaaacuucucacugacuuucagagucaccaacuguggacuacccuauuaaguuuaacauuuauuaaaacuacguuaucucuggauuacgcuuggaagaccauggcaaugguacucaguaucgucucacuguucccacucugccuuaguacuacaucccagaaaacgacguggcuccccguacuguugggaucuuuuggauguaaaccacuuaccauguuucuaaucaccgagaacaaaaucuggggucggaagaguuggccucuaaacgaaggaauuauggcuguggguaucgugucuauuuugcugagcagccuucuaaagaaugacguuccgcuagcagguccccuaauagcaggagguauguugaucgcuuguuaugugauuagcggcaguagugcagacuugagcuuagaaagagccgcagaaguuucuugggaagaagaagcagaacauuccggagcuucccauaauauauuaguugaaguucaagacgacggaacuaugaaaauaaaagaugaggaaagggaugacacauuaacgauauuauugaaagcuacuuuauuagcuguaucaggaguguacccaaugucaauaccugcgacuuuauuuguuugguacuuuuggcagaagaagaaacaacguagugguguuuuaugggauaccccaaguccgccugaaguggaacgagcuguuuuggaugauggaaucuacagaaucuuacagcgcgguuuacuuggccggucacaaguaggagucggaguuuuccaggaugggguauuccauaccauguggcaugugacaagaggggccguccugauguaccaaggaaaaagacuugaacccucaugggcgucagugaagaaagaucuaauuucuuaugguggaggauggagguuucaagguagcuggaacacgggugaagaaguccagguuaucgcuguagagcccggcaaaaauccgaaaaacguacaaacaaccccgggcaccuucaaaacaccugagggugagguuggugccaucgcguuagacuucaaaccaggaacgaguggaaguccaauagugaaucgcgaagguaaaauaguaggguuauauggaaauggaguugugacuacguccgguacguacguuagugcuauagcacaagccaaagccagucaagagggaccacuuccagaaauagaagacgaaguguucaagaaacgaaaucuaaccaucauggaucuacaucccggaagcggaaaaacacgccgauaccugccugcuauagugcgcgaagccauaaaacguaaguuaagaacguugauacuugcacccacacgaguaguugcaucagaaauggccgaggcuuuaaaaggaaugcccauuagauaccaaacaacagccguaaagucggaacacacaggaaaagagauaguagacuuaaugugucaugcaacuuuuacaaugaggcuauugagucccguacgcguacccaauuacaacaugauaauaauggacgaagcacauuuuacagacccggccuccauugcagcaagagguuacauaagcacucgagucggaaugggagaagcugcagcuauauucaugacagccacuccuccaggauccguugaagcauuuccucaauccaacgcaguuauucaagacgaggagcgcgacauaccagaaagaucauggaacucuggcuacgauuggauaaccgacuuuccaggcaaaacagucugguucguaccaaguauuaaaucuggcaaugacauugcaaacuguuuacggaaaaaugggaaaagaguuauacaauuaucgcguaaaacguuugacacagaguaucagaaaacuaaaaacaacgacugggacuauguuguaacaacagauauaucggaaaugggagcgaacuuccgggcagacagagucauugaccccagaaggugucucaaaccuguuauacuaaaagacggaccugaacgaguaauccuagcuggaccgaugccaguaaccgcagcuucggcugcccaaagaaggggaagaauuggaagaaaccagaacaaagaaggcgaccaauacauauacaugggccagccauuaaauaaugaugaagaucacgcucauuggacggaagcaaagaugcuuuuggauaauauaaacacaccugaaggaauuaucccugcuuuauucgaaccagaaagggaaaaauccgcugcuauugacggugaauauagauuacgcggagaagcacgcaaaacauuugucgaacuaaugcgaagaggagauuugccaguguggcuaucuuacaaaguagcaucggagggauuccaauauagugauaggagguggugcuuugauggagaacgaaauaaucaaguccuggaagagaauauggacgucgaaauuuggacuaaagaaggagagaggaagaaauuaaggccacguuggcuugaugcaagaacauauagcgacccuuuggcgcuacgagaauuuaaagaauuugcagcgggacgucgaucaguaagcggagaccugauacuugagaucggaaaacugccacaacacuuaacuuugagagcccaaaaugcacuagacaaucuaguaaugcuacauaauucagaacagggugguaaagccuaucgacacgcgauggaagaacuuccggauacaauagaaacucucaugcucuuagccuuaaucgcaguacucaccggcgguguaacacuauucuuuuuaucggguaaaggauuaggaaagaccucuauaggucuacucuguguuauggccucaucugucuuacuguggauggcaaguguagaaccacacuggaucgcagcguccauaauucuggaauuuuucuuaaugguacuccuaauaccugagccagacagacaacggacaccccaagauaaucagcuagccuauguuguuauaggucucuuauuuaugaucuugacaguagcagcaaaugaaauggguuuacuugaaacaacuaagaaagaccucgguaucggucauguggucgccgaaaaucaucaccaugcuacgauguuggauauugaucuacauccagcgagcgcauggacuuuauaugccguggcgacaacaauuauuacgccuaugaugaggcacacuauugaaaacaccacagcaaauauaucauuaacugccauugccaaucaggcagcaaucuugaugggacuugacaaaggauggccgauaagcaaaauggauauaggcguaccacuauuagcuuuaggguguuacagucaaguuaacccacuaacacuaaccgccgccguguuaaugcucguagcacauuaugcuauaauaggcccuggucuacaagcaaaagcgacaagggaagcucagaaacguacggcagccggcauaaugaagaauccuacagucgacgggauugucgcaaucgauuuagauccuguagucuacgaugcgaaauuugaaaaacaauuaggacaaauaauguuacucauacuauguacaucacagauccuacuaaugagaacaaccugggcccugugugaaucuauaacuuuagcaacaggaccccuaaccacacucugggaaggaucuccagggaaauucuggaauacuacgauagccguuucaauggccaacauauuccgcggcucauacuuagcaggggcuggcuuagcauucaguuugaugaaaucauuagggggcggccgaagagguacaggagcacaaggugaaaccuugggcgagaaauggaaacgacaacuuaaucaacuaucuaaguccgaauuuaacacuuauaaacgaagugggauaauggaaguagauagguccgaagcaaaagaaggguuaaagagaggcgaaacaacuaagcacgcgguaucccguggaacggcuaagcucaggugguuuguagaacggaaucuuguuaaaccagaagguaaaguaauugaucuagguugcgggcgaggcgguuggaguuauuacugugcuggccuaaagaaaguaacugaagugaagggauauacgaaagguggaccaggucacgaagaacccauuccaauggcuacauacggcuggaauauaguuaaauuacacagcggacgggauguauucuuuacacccccugaaaaaugcgauacauuauuaugugauauuggcgagucgucaccaaauccaacuauagaagaaggucguacacuccgaguauuaaagaugguagagccguggcucagaggaaaccaguuuuguaucaaaauucuaaacccguacaugccuucaguaguugaaacauuagaacaaaugcaaagaaaacacggcggcaugcuaguccgaaacccucuuucaaggaauagcacccacgaaauguauuggguuaguugugggacaggcaauauaguauccgcuguuaauaugacuucucgcauguuacuuaaccgauuuacaauggcccaccguaaaccuaccuaugaacgagauguggaccuaggugcggguacaagacacguagccguggaaccagaaauagcaaacuuggacauuauaggacaaaggauugaaaauaucaaaaaugaacauaaguccaccuggcauuaugacgaggacaauccauauaaaacaugggcauaucauggaaguuaugaaguaaagccuaguggaagugccagcagcauggugaauggcguuguucgauuacuaacaaaacccugggacgugauaccuaugguaacccaaauugcuaugacagauacaacaccauuuggacaacaaagaguguucaaggagaaaguggauacucguacaccucgacccaaacguggcaccgcacaaaucauggaggugacugcuaaauggcucuggggcuuuuugagucguaacaagaaaccaaggauauguacuagagaagaguucacaagaaaaguaagaucaaaugcugcaaucggcgcgguuuuuguagacgaaaaucaauggaacuccgcaaaagaagcaguagaggaugaacguuuuugggaucuaguacauagagaaagagaguugcauaaacaggggaagugugcaacaugcguauauaauaugauggguaaacgggagaagaaauugggcgaauuuggaaaagcaaaaggcucaagagcgauuugguauauguggcuaggugcgcgauuucuugaguuugaagcguuaggauuuaugaacgaagaucacugguucucucgggagaauagcuuaaguggaguggaaggugaaggcuuacacaaauuaggauacaucuugcgcgauaucuccaaaauaccgggagguaauauguacgcagacgacacugcaggaugggacacaagaauuacagaagacgaccuacagaacgaagcaaaaauaacagauauaauggaaccagaacacgcucuauuggcaaccaguauauucaaacuaacauaucagaauaaaguaguacgggugcaacgaccugcaaagucaggaacagugauggacgugauuuccagaagagaccaaagaggaagcgggcagguuggcacuuaugggcuuaacacauucacaaauauggaaguacaacuaauacgucagauggaaucagaagguaucuucucgccuucagaauuagaaaauuccaaucuugcggaacguguauuagauugguuagaaaaacauggcguagagagauuaaagaggauggcuauaaguggagacgauugcguagugaagccaacagaugaucgcuucgcuacugcuuuaacugcauuaaaugacaugggaaaaguaagaaaagauauaccacagugggaaccgucaaaaggauggaaugacuggcaacaagugccauuuuguagucaucacuuucaucaguuaauuaugaaagacgguagagaaauagucguacccugccgcaaucaagaugaguuagugggcagagcaagggucucgcaaggcgccggauggucauuaagagagaccgcgugccuaggaaagaguuacgcgcaaauguggcaauuaauguauuuccacagacgagacuuacguuuagcggcaaaugcgaucugcucugcugugccugucaauuggguaccaacaucuagaacuacuuggucaauacacgcacaucaucaauggaugacuacagaggauauguuauccguguggaacagaguauggauagaagaaaaccccuggauggaagauaagacacauguuucaaguugggaggauguaccuuauuugggaaagagagaggaucaauggugugguaguuuaauaggacuaacagcuagggcgacaugggcaacuaauauacaaguagccaucaaccagguuagaagauugguuggaaaugaaaauuaucucgauuauaugaccucgaugaagagguuuaaaaaugaaucagacccagaaggugcauugugguga

SEQ ID NO: 22110 - RNA, 9879 nt, Artificial Sequence
  derived and/or modified CDS sequence (opt6) from DENV-1__KM403621__SS-prME
ucaguuacuauguuacugaugcuacuuccuacugcuuuagcauuccauuuaaccacgagagggggagaaccgcacaugauaguaaguaaacaagaacgagguaaaucacugcuguuuaaaacaucagcaggaguaaacauguguacauuaauugcaauggacuugggugaauuaugcgaagauacuaugacauacaaauguccccggauaacggaagcagaacccgacgauguggacuguugguguaaugccacagauacauggguaacuuauggaacauguagccaaacgggagaacaccguagagauaaacgcucaguugcacuagccccucauguaggauugggauuagaaacgcgcacggaaacauggaugucgucggaaggcgcuuggagacaaauucaaaagguggaaaccugggccuuaaggcacccaggauuuacaguaauagcuuuguuucuagcucaugccauagggaccaguaucacacaaaaaggaauaaucuucauccuauuaaugcuagugacaccuaguauggccaugaggugcguuggaauaggaaacagggacuuuguugaaggauuaagcggugcuacauggguagacguuguguuggaacacggcucguguguaacaacuauggcgaaaaauaaaccuacgcuggacauagaguuacuuaagacagaaguuacaaacccugcaguacuacgaaaacuuuguauagaagcaaagauuuccaauacuaccacagacucucgaugcccaacacaaggggaagcgacauuaguagaagaacaggaugcuaacuuuguuuguagaagaacauuuguugauagggguuggggaaacgguuguggauuauucgggaaagguucauuguuaacuugugcuaaauuuaaaugcguaacaaaguuagaaggaaaaauuguccaauaugagaaucuuaaauauucuguuauuguaacaguccacacgggugaccagcaucaaguaggcaaugaaaccacagaacacgguacaauugcgacgaucaccccacaggcaccuacaagcgagauacagcuuacugacuauggcgcccugacccuagauuguaguccaaggacaggccuugacuuuaaugaaaugguucuuuuaacaaugaaagaaaaaucauggcuaguccacaaacaaugguuccuagaucucccacuaccauggacuucaggagccaguaccucccaagaaacauggaaucggcaagacuuauugguaaccuucaagacagcacaugccaaaaagcaagagguugucgugcuaggcagucaagagggugcaaugcacacugcacucacaggugcaacagaaauacaaacuucggggaccaccacaauuuuugcuggucacuugaaaugucgauuaaagauggauaaguuaacgcucaaaggcguaucauacguaauguguacugggaguuuuaaacuugagaaagagguggcagaaacucagcauggcacaguauuaguacaaguaaaauaugaagggacagacgcacccuguaaaauaccaaucucaacucaagaugagaaaggagucacucagaacggacgucuaauuaccgcaaauccaauuguuaccgauaaagaaaaaccagucaacauagaaaccgaaccuccauuuggggaaaguuacauagugauuggggccggugaaaaagcguuaaaauuaucuugguucaagaaggguucuuccaucgguaaaauguuugaagcgacugccaggggugcaaggagaauggccauuuuaggggacaccgccugggauuucgggucuauuggcgggguauuuaccucagugggaaaauuaguccaucaagucuuuggcacggccuaugguguuuuauucuccgguguuucuuggacuaugaagaucggaaucggaauccuauuaacauggcucggguuaaacagccgcucgaccagccugucaaugacaugcauagcagugggaaugguaacacuuuaucuaggugugaugguucaagcagauaguggcugcgucauaaacuggaaaggcagagaacuuaaguguggcagcgguauauuugucacuaaugagguccacacauggacugaacaauauaaauuucaggcugauucacccaaaagauugucugccgcuaucggaaaggcuugggaagaaggaguaugugguauuaggucagcaacaagacuagagaauauuauguggaaacaaauaucuaacgaauuaaaucauauacugcuagaaaaugauaugaaguuuacugugguuguaggcgacgcgaacggaauauuaacacagggcaagaaaaugauaagaccccagccaauggagcacaaauauaguuggaaauccuggggaaaagcaaaaaucauaggcgcagauacucaaaacacaacuuuuauaauugauggacccgauacaccagaguguccagaugaccaaagagcauggaacaucugggaagucgaagauuacggauucggaguauuuacgacaaacauuugguuaaaauuaagagacaguuacacacaaaugugcgaucauagacuaaugagugcugcuauaaaagauucuaaagccguacaugcagacaugggguauuggauugagucagagaaaaaugagacauggaaauuggccagagccucauuuauagaggucaaaaccuguauuuggccuaggagucauacccucuggucaaacgggguccuugaaucugaaaugauuauuccuaaaauauauggaggaccaauaucgcaacauaacuaucgcccaggguacuuuacucagacugcagguccguggcauuuaggaaaacuagaauuagauuuuaaucucugcgaagguacgacaguaguaguagaugagcauugugggaaucguggaccaucucuucguacaacuaccguuaccggcaaaauuauacacgaaugguguuguagaucaugcacuuuaccuccucuacguuuuagaggggaagaugguugcugguacgggauggaaaucagaccagucaaggaaaaagaagaaaacuuaguaagaaguaugguaucugcaggauccggagaaguagacucauuuuccuuaggguuacuuugcguuaguauaaugauagaagagguaaugaggaguagauggucccguaagaugcugaugacgggaacuuuagcaguauucuucuugcuaauuaugggccaacuaacauggaaugaccucauuagacuaugcauuaugguaggugccaacguaucugauagaauggggauggggacaacauacuuagcguuaauggccacguuuaaaaugaggccuauguuugcuguaggucuauuauuuaggagacucacgucaagagagguauugcuuuuaacgauagguuuaagccuaguggcgucaguagaacuaccgaacucacuugaggaguuaggagacggauuggcgaugggaauaaugauguugaaacuauuaaccgacuuccaaagccaccaacuguggacuacacuauugucuuuaacguuuaucaaaacgacauuaucguuagacuaugcuuggaaaaccauggccaugguguuaagcauuguuucacuauuuccguuaugccuaaguacaacaucacagaaaacaacauggcuuccaguccuauuggguucuuuuggguguaagccccugacaauguuucuaauaacagaaaauaaaauaugggguagaaaauccuggccacuaaacgaagguaucauggcugucgguauuguuaguauucuacuaaguaguuuacucaaaaaugauguaccguuagcaggacccuuaauagcggguggaauguuaaucgcuugcuacguaauaucgggcaguucggcugauuuaucccuggaaagagcugccgagguaaguugggaagaggaagcggaacauucuggcgcuagccauaacauccuuguagaagugcaagacgauggaacgaugaaaaucaaagacgaagaacgcgaugauacuuuaaccauuuuguuaaaggcuacauuauuagcaguuaguggcguauauccgaugucaauuccagcuacauuauuuguuugguacuuuuggcagaagaagaaacagcgcagcggaguauuaugggacacccccucuccacccgagguagaacgagcaguauuagaugacgguauuuauaggauuuuacaacgaggauuacuuggaagaucccaggucgggguaggaguuuuucaggauggugucuuucauacaauguggcacguaacucgaggcgcgguacuuauguaucaaggaaaaagacuugaaccaucaugggcaucuguaaagaaagaucugauaagcuacgguggaggguggagguuccagggaucguggaauacuggagaagagguacaagugaucgcagucgaaccaggcaagaauccuaaaaauguccagacgacucccgggacguucaaaacacccgagggugaggucggugcuauugcauuggauuuuaaaccugggacgaguggcagccccauuguuaauagagaagguaagaucgugggacucuacggaaaugguguggucacgacuagcgggacuuaugucagugccauagcacaagcaaaagcaagucaagaagguccacugccugaaauugaagaugaaguguuuaagaaaagaaaucuuacaauaauggauuuacauccgggaaguggaaagacccggagauauuuaccagccaucgugcgugaagcuaucaaaagaaaacuccggacccuaauucuagcaccaacuagaguugucgcaucugagauggcugaggcuuuaaaaggaaugccaauucgauaucaaaccacagcagugaaaucagaacauaccgggaaagagauugucgaucucaugugucacgcaacauucaccaugagacuauuguccccuguacggguucccaauuauaauaugauaauuauggaugaagcgcauuucacugacccagccaguauugccgcuagagguuauauaaguacacgggucgguaugggugaagcagcagcaauauuuaugacagcaacaccaccuggaaguguagaaaguuuuccucagaguaaugcgguuauacaagaugaagaaagggauauaccggaacggucguggaacucuggauacgauuggauaacagacuuccccggcaaaaccgucugguuugugccauccauaaaaaguggcaaugacaucgccaauuguuugaggaaaaaugguaaaagaguuauacaacuaucccggaaaacuuuugauaccgaauaucagaagacgaaaaacaaugacugggacuauguagucacaacugauauaucggaaaugggugcuaacuucagagcagauaggguuauugauccuagaaggugcuuaaaaccuguaauccuuaaagaugggccagaacgcgugauacuggcugggccaaugccaguaacugcagcaucagccgcgcagcgcagagggaggaucggucgcaaccaaaacaaagaaggggaucaguacaucuacaugggucaaccucucaauaaugaugaagaccaugcucauuggacagaagcuaaaauguuauuagauaacaucaauacuccagagggaauuauuccggcuuuauuugaacccgaacgagagaaaagugcagcaauugauggugaauaucgacuacguggugaagcacgcaaaaccuucguagaguuaaugagaaggggagacuuaccaguauggcuaucauauaagguugcauccgaaggauuucaauauucggacagaagaugguguuuugauggugaaagaaacaaccaaguuuuagaagaaaauauggacguugaaauuuggacgaaagaaggagaaaggaagaaacuacguccaagauggcuugacgcacguacauauagcgacccucucgcauuaagagaauuuaaagaauuugcggcaggaagacgguccguaucaggggacuuaauacuagagauuggcaaguuaccucagcaucucacacugagagcacaaaaugcacuagauaauuuaguaauguugcacaauuccgagcaaggcgggaaagccuauagacacgcuauggaggaacuaccggauaccauugagacgcuaauguuguuggcacuuauugcagugcucaccggcggcgugacauuauucuuuuuaucuggcaaaggucucggcaaaacgagcauagggcuacuuugcguuauggcuucguccguccuucuuuggauggcuagcguggaaccacacuggaucgcagcaaguauaaucuuagaguucuuccucaugguucuacuaauaccagagccagacagacaaaggacgccacaagacaaccaacuagccuacguugucaucggucuccuauucaugauacugacaguagcagccaacgaaaugggacuauuagaaaccacuaagaaagaccucggaauagggcaugucguugcggaaaaucaucaucaugcgacgaugcuagacaucgaccuucauccggcauccgcuuggacauuguacgcuguagcaacaaccauaauaacuccaaugaugagacacaccauagaaaauacaacggcaaacauaaguuuaacagcgaucgcaaaucaggcagcgauacuaaugggauuggauaaaggcuggccuauuucaaagauggauauagguguuccauuacuggcacuaggaugcuauagucaaguaaauccacucacgcuaacagcggcaguauuaaugcuuguagcccacuaugcgauuaucggaccagggcuccaggcaaaggcgacaagggaggcacaaaaacguacggcagcaggcauuaugaagaacccgaccguugauggcauaguugcgauagauuuggacccagugguuuacgacgcuaaauuugaaaagcaauuaggacaaauaauguugcuaauacuuuguacuucacaaauccuauugaugagaacgaccugggcacuaugcgaaucaauaacucucgcaacgggcccuuuaacuacccugugggaaggcucaccuggaaaauuuuggaacacaaccauugcagugucuauggccaauauuuucagagguagcuaccuugcuggagcagggcuagcauuuucguuaaugaaaagccuugguggcggaagaaggggaacaggugcucaaggugagacauuaggggaaaaauggaaaaggcaacuaaaccaguuaagcaaaagcgaauuuaacacauacaaaagaucaggaauaauggaaguagauaggagcgaggccaaggaaggacuaaaaaggggcgaaacuaccaaacaugcagucucccgcgggaccgcgaaguuacgcugguucguggaaaggaaccucguaaaaccggaaggaaaagucauugaccucggcuguggacgaggaggguggucguauuauugugcuggucuaaagaaagucacagaagugaaggguuauaccaaaggcggcccagggcacgaggaacccauccccauggcuacauacggcuggaauaucguaaaauuacauaguggaagagacguauucuuuacaccgccagagaaaugcgacacguuacuaugugacauaggugaaagcucacccaacccgacuaucgaagaagguagaacacuaagaguccucaaaaugguagaaccaugguuaagggggaaucaguucugcaucaagauacuaaauccuuauaugccgagcguugucgagacacuagaacaaaugcagagaaaacauggagggaugcuuguucgaaauccccuaucacgcaauagcacucacgaaauguacuggguguccugcgguacaggaaauauaguuuccgccguaaauaugacuucaagaauguuacucaauagguuuacaauggcccacaggaagcccacguacgaacgugacgucgauuuaggggccggcaccaggcauguugcgguugaaccagaaauagcuaauuuagauauaauaggacagaggauagagaacaucaaaaacgaacacaagucgacauggcacuaugaugaagauaacccuuacaaaacaugggcauaccaugggucauaugaaguaaagccuagugguagugcuagcucaauggugaaugggguugugcgacuauuaacaaaacccugggacgucauuccuaugguaacccaaauagcaaugaccgauacaacccccuuuggacaacaaaggguauuuaaagaaaagguugacacuagaacgccacggccuaaacguggcacugcccagauuauggagguaaccgcuaaauggcuguggggauuccuuucaagaaauaagaaaccccguauauguacuagagaagaguuuacuagaaaaguccggucaaacgcggcgaucggagcaguuuuuguggacgaaaaucaauggaacagcgccaaagaagcuguugaagaugaaagauuuugggauuuaguacacagggaaagggaguuacacaaacagggaaaaugcgcaaccugcgucuacaauaugaugggcaagcgagagaagaaauuaggggaauuuggaaaagcgaaaggauccagggccauaugguacauguggcugggugcgcgauucuuagaguucgaggcccugggauuuaugaacgaagaucacugguucucgagggaaaauagccucucugguguggagggugaaggauuacacaaacucggauauauauuacgagauauuucaaaaauaccaggaggaaacauguaugcugacgacacugcaggaugggauacuagaaucaccgaagaugaucuacagaaugaagcaaagaucacagacauuauggaaccugaacacgcccucuuagccacaaguauauuuaaauuaacauaucagaacaagguaguacgaguacaacguccagcuaagagugggacgguuauggaugucauaucgaggcgagaucaacguggauccggucaaguugggacuuacggacucaauaccuucacgaauauggaagugcaauuaauuagacaaauggaaagugagggaaucuuuagccccagugaguuagaaaacucgaauuuagcggagagaguucuagauugguuagaaaaacauggcguggagaggcugaagcgaauggcuaucucuggugacgacuguguagugaagccuacagacgauagauuugcgacagcauuaacagcuuuaaacgacauggggaaaguccgcaaagauauaccacaaugggaaccuucgaaaggauggaaugauuggcagcaagucccauucuguagccaucauuuucaccagcugauaaugaaagacgguagagaaauugucguuccaugucguaaucaggaugaguuaguugggcgagcgcgagugagucagggagcaggguggucguuaagagagacggcgugcuugggaaaaagcuacgcgcaaauguggcaacuaauguacuuucauagacgagaucuccgacuggcugcaaacgcaauauguagcgccgucccuguaaauugggucccaacaagccgaaccacauggucaauucaugcacaucaccaauggaugaccaccgaggacauguuaagcguguggaaccgagucuggauugaagaaaaucccuggauggaagacaagacucauguuucuagcugggaggacguuccguaccugggaaaaagagaagaucaguggugcgguagucuaauaggauuaacagcucgugcuacaugggcgacuaauauacaaguggcaauaaaccaaguacgccgucuuauagggaaugaaaauuaccuagacuacaugacuucaaugaaaagauuuaagaaugaaagugacccugaaggagcacuaugguaa

SEQ ID NO: 22111 - RNA, 9879 nt, Artificial Sequence
  derived and/or modified CDS sequence (opt6) from DENV-1__KM403623__SS-prME
agcguuacuaugcuucucaugcuauugccaacugcauuagcguuccauuuaacuacucggggcggugaaccccauaugauuguaucgaaacaagagagggguaaaucucucuuauucaaaacgagcgcaggggugaacauguguaccuugauagcaauggaccuuggagaacucugcgaagauacaaugaccuauaaauguccucguauuacagaagcggaaccggaugacguugauugcugguguaaugcaacagauacauggguaacauaugguacgugcucccaaacaggugaacacagacgagacaaacgaagcguagcucuagcuccgcacguagguuuaggacucgaaacacggacagaaacauggaugucauccgaaggagcguggcgucaaauacaaaaaguagagacuugggcguugcgacauccgggauuuacuguaaucgcauucuuucuugcacaugcgauaggaacgaguauaacucaaaaaggcaucauauuuauacuucuaauguuagugaccccuucaauggcaaugagaugcguggguauaggaaauagggauuuuguagaaggcuugaguggugcuacguggguggacgucguacucgaacauggaucauguguuacaaccauggccaaaaauaaaccgacucuagacaucgaacuguugaaaacagagguaacaaauccggcaguauuacgaaaacuuuguauugaggcuaaaauuuccaauacaacgacugauucaagaugccccacucaaggagaagcaacuuugguugaagaacaagacgcaaauuuuguguguaggcgaacuuucguagaccggggguggggaaacggauguggccuauucgguaaaggaucacuccuaacuugcgcgaaauuuaaauguguaacaaaacuugaaggaaaaauuguacaauacgagaaucuaaaauacucaguaauaguaacggugcauaccggagaccagcaccaaguaggaaacgaaacaacugaacaugguacaauugcuaccauaacaccucaagcaccgacgagugaaauacaauuaacggacuauggagcguuaacacuugacugcucgccuaggacuggauuagauuuuaaugaaaugguguuauugacuaugaaagaaaaaucauggcucguucauaaacaaugguuccuggauuugccauugccguggacaaguggagcaaguaccucgcaagaaacguggaaucgacaagaccuguuaguaacauucaaaacugcacaugccaagaaacaagaaguaguaguacuugguagucaagaaggggcaaugcacacagcucugaccggugcaacggagauacagacgucggguacuacaacuauauuugcagggcacuuaaaaugucgguuaaaaauggauaaauuaacauuaaaaggaguaucauauguaauguguacaggaucguuuaaauuagaaaaagaagucgcugagacucaacacggcacuguucuaguacagguuaaauaugaagguacugacgcuccaugcaaaauaccuauaucuacucaagaugaaaaaggggugacgcaaaacggcagauuaaucacagcgaauccuaucgugacagacaaagaaaagcccguuaacauugagacagaaccuccauuuggcgaauccuauauuguaauuggcgcaggagaaaaggcuuuaaaacucucaugguucaaaaaggguagcucaauuggaaagauguucgaagcgacagcacggggugcgcgccguauggcaauauuaggagacacugcuugggauuucgggaguaucggagggguguuuacgucuguaggcaaguugguacaucaaguguucgguacagcguauggcguacucuucaguggcguaagcuggacaaugaagaucgguaucgguauucuacuaacauggcuaggacugaauaguagaucaacuucccuaaguaugacaugcauagccguagguaugguuacucuguaucuaggagugaugguucaagcagacucgggaugugugauuaacuggaaaggucgugaauuaaaguguggcagcgguauauucguaacgaacgaaguacacacauggacagaacaauauaaauuucaggcagacaguccaaaaagacuaucagcggcuauaggaaaagcaugggaagaaggggucuguggcaucaggucggcuacuaggcucgaaaauaucauguggaaacagauaagcaaugaacuuaaucauauauuacucgaaaaugacaugaaauuuacaguugugguaggggaugccaacgguauucuaacccaagguaagaaaaugauaaggccacaaccuauggaacacaaauacucguggaaaagcugggggaaagcaaaaauaauaggcgcagauacccaaaauacaacauuuauaaucgacggacccgauacgccagaaugcccggaugaucaaagagcuuggaacaucugggaaguagaagauuauggauuuggaguuuuuacgacaaauauaugguugaaacuuagggauaguuauacacaaaugugugaucauagacugaugagugcugcuauuaaagacucgaaagcaguccaugcggacaugggcuauuggaucgaaagugagaaaaacgaaaccuggaaauuagccagagcaucguuuaucgagguaaagacauguaucuggccccgaucucauacauuguggaguaacggaguccuagaaucugagaugauaauucccaagauauaugggggcccgauaagccaacauaacuacaggcccgguuauuucacccagaccgcaggucccuggcaccugggaaaacucgaacuagacuucaauuuaugugaagguacaacuguugucguugacgagcauugcgguaaccgcggaccaucuuugcgaacuacuacuguaacagguaaaaucauucaugaaugguguugucguagcuguacauugccaccacuccguuucagaggggaagauggauguugguauggaauggaaauacggccaguaaaggagaaagaagaaaacuuggucagguccauggugucagcgggaaguggagaagucgauucauucucguuagguuuacuaugcguuagcaucaugaucgaggaagucaugaggaguagguggucucggaaaaugcuuaugaccgguacguuggcaguauucuuucuucuaauaaugggucaacugacguggaaugacuuaauuagauuaugcaucaugguaggagccaauguuucagacagaauggguauggggaccacauaucuagcauuaauggcgacuuuuaaaaugaggccaauguuugcaguaggacucuuauuuagaaggcuaacuucaagagaaguauuguuauuaacuauaggucuuagcuuagucgccucgguagaauuaccuaauagucucgaagaguuaggugacgggcuagcaauggggauuaugaugcuaaaacuacugacggauuuucaaagucaucaauuauggacaacauuauugagccuuacguucauaaagacaacucucucuuuggauuaugcuuggaagacaauggcuaugguauuaucaauaguuagccuauuuccacuaugucuaucuacaacgagucagaaaacuacauggcuaccaguucuauuagguucuuucggauguaagccacuaacaauguuccucauuacagaaaauaagauaugggguaggaaaagcuggccucugaaugaaggcaucauggcagugggaauaguuaguauauuacucaguucacuauugaagaaugauguaccucuugccggaccguuaaucgcuggcggaauguugauagcaugcuacguuaucucagggucgagugcagauuugucgcuagagagagcugccgagguaucuugggaggaagaagcagaacauagcggagcaucccacaacauauuaguugaaguccaagaugauggaacaaugaaaauaaaagacgaagaacgagaugacacucuuacgauucuucuaaaggccaccuuacuugcgguaucuggaguuuacccgaugagcaucccagcuacauuauucgugugguauuucuggcaaaagaagaaacaaagaucugguguucucugggauacuccuucgccaccugagguugaacgagcuguucuagacgaugguaucuacaggauacuccagaggggguuauuaggacgcucccaaguaggaguagguguauuccaagauggaguauuccauacaauguggcacgugacaagaggggccguucuuauguaucaggguaaacgacuugaacccagcugggcuucagucaagaaagauuugaucagcuauggcggaggcuggagauuucaagggucauggaacacaggugaggaaguacaaguuauagcugucgaaccagggaagaauccgaagaauguccagaccacaccagguacauucaaaacaccggaaggggaagucggggcuaucgcauuagauuucaaaccuggaacuuccgguucuccaauagugaaucgcgaaggaaaaauaguaggauuauaugguaauggaguuguaacuacaucugggacuuauguaucggccauagcucaagcaaaagcuagucaggaaggacccuuaccagagauugaagacgaaguguucaagaagcguaauuugacaauuauggaucuucauccaggaucagggaaaacacgaagguaccugccagcuaucguucgagaagcuauuaaacggaaauuacgaacucuaauucuugcccccacccgaguagucgcgucugaaauggccgaagcccuaaaaggaaugccaauaagauaccaaacuacagcagugaaguccgaacauacaggcaaagaaaucguggaucuuaugugucaugcuaccuucacgaugaggcucuugucaccgguucgaguuccgaauuacaacaugauaauaauggacgaagcgcacuuuacugacccagcaucaauagcagcacgaggguacauuagcacccguguugggaugggugaagcugccgcaaucuuuaugacugccacuccaccagggucgguggaaaguuucccucagucaaacgcuguaauucaagacgaagagagagauaucccagaacgaucuuggaacucaggauacgacuggauaacagacuuccccggaaaaacaguaugguuuguuccaaguaucaaaaguggaaaugauaucgcaaacuguuuaaggaaaaacggaaagcgagugauccaacuaucaaggaaaacuuuugauaccgaauaccagaaaacgaaaaauaaugacugggacuaugugguuacuacagacauaucggaaaugggugccaauuuccgugcagacagaguaaucgauccacgaaggugcuuaaagcccguaauauuaaaagauggcccagaaagaguaaucuuagcaggaccgaugccggucaccgcugcgucagcagcacagagaagagggcgaauaggacgaaaccaaaauaaagaaggcgaucaauacaucuauaugggccaaccccugaacaaugacgaagaucaugcucauuggacugaagcaaaaaugcuuuuagacaacauaaauacaccagagggcaucauuccugcacuauucgaaccagaaagggaaaaaucagccgcaaucgauggggaauaucgacuaagaggggaggcaagaaaaacauuuguagaacuuaugcggcgcggugaucuacccguuugguugaguuauaaaguugccucugaaggcuuucaauauucagauagaagauggugcuucgacggugagcguaacaaucaaguucuugaagaaaacauggauguugagauuuggacuaaagagggggagcgcaagaaacuaagaccaagauggcuggacgcuagaacuuauagugauccauuagcauugagggaguuuaaagaauuugcagcgggcagacguucuguaucuggagaucugauauuagaaaucggaaaauugccucagcaccuuacacuuagagcacagaaugcccuagacaacuuaguuauguuacauaacucggagcaagguggaaaagcauaucgacaugccauggaagaacugcccgacacaauagaaacucuaaugcucuuagcccuaauugcaguauuaaccggaggcgugacccuauucuuuuuguccgguaagggacucggcaaaaccaguauaggguuacucugcguuauggccagcucaguuuuacuauggauggcaucuguugaaccacacuggauagccgcaucuaucauauuagaguucuuucuuaugguacuccuuauaccugaaccugauaggcaaaggacuccgcaagauaaccaauuagcuuacgucgucauaggccuccuguuuaugauucucacggucgcugcgaaugaaaugggccucuuagagacaacuaagaaagaccuuggcauaggacauguuguggcagaaaaccaucaccaugcaacuaugcuugauauagacuuacauccagcuucggcauggacccucuacgccgucgcaacgacaaucaucacaccgaugaugagacacaccauagaaaauacuacagcaaacauuucuuuaacagcaaucgcaaaucaggcggcaauacuaauggggcuggauaaaggauggcccauauccaagauggauaucggcguaccacugcuagccuuagggugcuauucacagguaaauccacuuacuuugacagcggcgguacuuaugcuuguugcucacuaugcuauuauugggccagguuuacaagcuaaagcaacgcgagaggcacagaaaagaacugcagcaggaauaaugaaaaauccuaccguugauggcaucguugcaaucgaccucgaccccguaguguaugaugcaaaauuugaaaaacaacuaggacaaauuaugcugcuaauauuaugcaccagucaaauacuuuuaaugcgaacgacgugggcacuaugcgaauccauaacccuugccacgggaccccucacaacauuaugggaaggaaguccggggaaauuuuggaauacaacaauagcugugaguauggcgaauauauucagaggaaguuaucuugcaggcgccggccuugccuuuagucuuaugaaaucccuuggaggaggacgacgcgguacaggagcccaaggugaaacgcugggggaaaaauggaaaaggcagcucaaucaacuaaguaaaucugaauuuaauacauacaagcggaguggaauaauggaaguagaccgcuccgaggcaaaagagggguuaaaacggggagagacaacaaaacacgcaguuagucgagggaccgcaaaauuaagaugguuuguugaacgcaaccugguaaagccggaaggcaaagucaucgaccuugguugugggagaggggguuggucauauuauugugccggacugaaaaagguuacagaaguuaaaggguacacaaaaggagguccuggacaugaggagccaauuccuauggcuacauaugguuggaauauaguuaaauugcacuccgguagagaugucuucuuuacgcccccugagaaaugugacacguuacuaugcgacauaggagagagcucuccuaacccgaccauugaagaagggagaacauuacgaguccuaaagaugguagaaccaugguuaagggggaaccaguuuuguauuaaaauauugaauccuuauaugccuucuguaguagaaacgcuagaacaaaugcaaagaaaacacggaggaaugcuuguaagaaauccccuuaguagaaauaguacucaugagauguacuggguuagcugcgggaccggaaauauugucagugccguuaacaugacuucaagaauguuguuaaaccgauuuacaauggcacaccggaaacccacauaugaaagagauguugacuugggagccggaacacgacacguagcuguggaaccagaaauagcaaacuuagauauaauuggucagcgaauugaaaacauuaaaaacgaacauaagaguacauggcauuaugaugaagauaacccguauaaaacuugggcuuaccaugggaguuacgagguaaaaccuagugguagugccaguucuaugguuaaugguguggugcgccuucucacaaaaccaugggacguuauaccaaugguaacacaaauagcuaugaccgacacgacaccuuuuggacagcaaagaguauucaaagaaaaaguugauacaagaacaccucguccaaagcgugggaccgcacaaauaauggaggucaccgcaaaaugguuauggggauuccuauccagaaacaagaaaccaagaauuugcacccgcgaggaguucaccagaaagguaagaucaaacgcagcaauaggagccguauuuguggaugaaaaucaauggaauagugcuaaagaagcaguugaagacgaacgauuuugggauuuaguacaccgugaaagagaacugcauaaacaaggaaaaugcgcaacuuguguauauaauaugaugggcaagagggagaagaaacuaggggaguucggaaaagccaaagggagcagagcaauaugguauauguggcuuggagccagauuccuugaauuugaggcccucggauuuaugaaugaagaucacugguuuagccgagaaaauucauugucuggaguugaaggcgaaggucugcacaaauuaggguauauucuccgcgauauuucuaaaauaccagguggaaauauguaugccgacgauacagcuggcugggacacuaggauuacggaagaugaucuucagaaugaagcaaaaauuaccgacauaauggagccugaacacgcauuacuugcgacaucuauauuuaagcucacauaucaaaauaaggucguaagaguccagagacccgcuaaaagcgguacugucauggacguaauuagcagaagagaccaacgagguucgggacaagugggcacauauggacuaaauacguuuacuaacauggaaguucaauugauacgacagauggaaucugaagguauauuuuccccaagugaauuggagaacucaaaucuugcugaacgcgucuuagacuggcuggaaaagcacggaguugaacgauuaaaaagaauggccauauccggggaugauuguguaguuaaaccgacagacgauagauuugcaacagcgcugacggcgcuuaaugauaugggaaaaguccguaaagauauuccacaaugggaaccaaguaaagguuggaacgauuggcaacaaguaccuuucuguucccaccauuuccaucaauuaauaaugaaagauggucgugaaauaguagugccauguaggaaccaagaugaacucguggggagagcaagagucucgcaaggagcugguuggaguuuaagagagacagcgugccuuggaaaaucauaugcucaaauguggcaacugauguauuuccacaggagagauuuacgcuuagccgcuaaugcgauaugcucugcaguaccaguaaauuggguaccgacgucaaggacuacuuggaguauucaugcgcaucaucaguggaugacuacagaagacaugcuaucaguguggaaucgcguauggauagaagaaaaucccuggauggaagacaagacucacguauccagcugggaagacguaccguaucuaggaaaaagagaagaucaaugguguggaucauuaaucggccucacagcuagagcuacaugggcaacaaauauacaagucgcaauaaaucagguaagaaggcuaauuggcaaugaaaauuacuuagacuauaugacaaguaugaaaagauuuaaaaacgagucagauccggagggggcgcucugguga

SEQ ID NO: 22112 - RNA, 9879 nt, Artificial Sequence
  derived and/or modified CDS sequence (opt6) from DENV-1__KM403575__SS-prME
agcguuacgaugcuucuaauguuacucccuacugcguuggcauuccaccuaacuacaagagguggagaaccucauaugauaguaaguaaacaagaacgcgguaaaucuuuguuauuuaaaaccagugcuggaguuaauaugugcacacuaauugcaauggauuugggagaauuaugcgaagacacgaugacguacaaauguccgcgaauaacggaagcggaacccgacgacguggacugcuggugcaacgcaacagauacauggguaaccuaugguacauguucacaaacuggugaacauagaagagacaaaagaagcguugcuuuagcaccgcauguaggauugggauuagaaaccagaacugaaaccuggaugucauccgaaggagcauggagacaaauccaaaaaguagaaacaugggcacuuagacauccgggguuuacuguuauugcacucuuccuugcacacgcuauagguacgucaauuacacagaagggaauaauuuuuauacugcuuaugcuaguaacuccaaguauggcaaugagauguguugguauagggaaccgcgauuuugucgagggacucagcggagcaaccuggguagacguuguccuagaacacgggagcugugugacuacuauggcgaagaacaaaccaacacucgauaucgaauugcuaaagacagagguaacaaauccugcaguguuacgaaaacuuuguauagaagcuaagaucucgaauacgacaacugacagccgauguccaacccaaggugaagcuacauuaguagaagaacaggacgcuaacuucguuugcaggcgaacuuuuguagacaggggguggggaaauggauguggacucuuuggcaaaggcagccuacuaacuugugcuaaguuuaaaugcguuaccaaacuagaagguaaaauaguucaauacgaaaaucuaaaauacuccguaaucguaacaguacauacaggugaucaacaucaaguagguaacgagacaacugaacauggcacaauagcaacaauaacuccccaggccccuacuucggaaauccaguuaacggacuacggggcauuaacccucgacuguucgcccagaacagguuuagauuucaacgaaaugguacuacuaacgaugaaagaaaaaucauggcuaguccacaaacaaugguucuuggaucugccuuugccauggacaucuggagcuucaacuucgcaggaaaccuggaacagacaagaucuacuugugacauuuaaaaccgcacacgccaagaaacaagaaguugucguucuuggcucgcaagagggcgccaugcacacugcuuuaacaggagcaacagaaauccaaacgucagguacgaccacaauauucgcaggacaccuuaaaugucgucuaaaaauggauaaacuuacucuaaaaggugucucuuacgucaugugcacugguaguuuuaaacucgaaaaagaaguagcugagacacaacauggaaccguauuaguucaaguaaaguaugagggcacagacgcgccaugcaaaauaccgauaaguacacaggaugaaaaagggguaacccaaaauggaaggcuaaucacugcgaacccaaucguaacagauaaggaaaaaccuguaaacauagaaacugaaccuccauuuggagaaucuuauauaguaauaggcgcaggagaaaaagcacuuaaguuaaguugguuuaagaaagguaguaguauagguaaaauguucgaagcuacugcgagaggugcaaggagaauggccauuuuaggggauacagcuugggauuuugguagcauaggaggagucuuuacaaguguagguaaacuuguacaucaaguuuuuggcacagcguaugguguacuguucucaggaguaaguuggaccaugaagauuggcauugguauacuuuuaacuugguugggcuuaaacucaagaucaacuucacuuucaaugaccugcaucgcuguuggaaugguaacacuuuacuuaggagucaugguacaagcugauucuggaugugucauuaacuggaagggucgcgagcuuaaguguggcucaggaauauucguuacaaaugaaguucauacauggaccgaacaauacaaauuucaagcugacucuccaaaacguuuaucugccgcuaucggaaaagcaugggaagaaggggucugcggaaucagaucagcaacucgguuagagaacauaauguggaaacagauaucaaaugaauuaaaccauauuuuacuugaaaaugauaugaaguucacuguagucguaggagaugcuaauggaaucuugacucaaggcaagaaaaugauacgcccccaaccaauggaacauaaauauucauggaaaagcugggguaaagcaaaaauuauuggggcagauacacaaaauacaacuuucauaaucgauggucccgauacuccagaguguccugacgaccaacgagcauggaacauaugggagguggaggacuaugguuucggugucuucacuacgaacauauggcucaaacuccgugauuccuacacucaaaugugcgaucauagguuaaugucagcugccaucaaggauuccaaagcaguacacgcugacaugggcuauuggauagaaagugagaaaaacgagaccuggaaguuagcaagggcaucauuuaucgaaguaaaaaccuguauauggccacguucacauacccuguggucaaauggaguacuugaguccgagaugaucauaccaaaaaucuacggagggccaauaagccaacacaauuaucggccagguuauuuuacacaaacagcuggucccuggcaucuagggaaacuugagcuagacuuuaauuugugugaaggcacuacaguuguaguagacgaacauuguggaaauagagggccaagucucagaacgaccacaguuacaggcaaaaucauucaugaauggugcugccgaucguguacauuaccaccccuacgguuucgaggugaggacggauguugguacggcauggaaauccguccaguaaaagagaaagaagaaaacuuagucagaucaauggugucggcggguuccggugaaguagacagcuucucuuuaggauuacuaugcguuucaauuaugauagaagaagucaugagaagcagauggaguagaaaaaugcuaaugacagguacacucgccguguucuuuuuacucauaauggggcaguuaacauggaacgauuuaauccguuuaugcauuaugguaggugcuaaugugagcgaucgaaugggaauggguacaacauauuuagcguuaauggcgaccuucaagaugagaccaauguuugcugugggauuguuauuucgucgucugacuucccgcgaaguuuuauuauugacgauaggacuaucguuagucgcgaguguagaacugcccaauagcuuagaagaauuaggagacggacuggcaaugggaaucaugauguugaaauugcuaacagacuuccagucccaccaacuguggacuacgcucuugucccuaacuuuuaucaaaacaacacucagccuagacuaugcauggaaaacaauggcaaugguuuuaucuauugucucauuauuuccccuaugucuaucaacaacgagccagaagacgacguggcucccuguauuacuaggaucguuuggauguaaaccacuuacaauguuccuaauuacagagaacaagaucuggggaagaaagagcuggccccuaaaugaagguauaauggccgucgguaucgucucaauauuauugaguucucuacuuaagaaugauguaccauuagcaggaccauugauagccggaggaauguuaauugccugcuacguaauaaguggaaguagcgcagauuuaucacuggaacgugcugcggaaguuucuugggaagaagaagcagaacacuccggagccagccauaauauacucguagaaguacaggaugaugggacuaugaaaauuaaagacgaagaacgugaugacacacucacuauacuauuaaaggcaacacuguuagcaguuuccggaguauaucccaugaguauucccgccacuuuauuugucugguauuucuggcaaaagaagaaacaacgaucaggggugcuuugggauacuccgucaccaccugaaguagaacgagccgugcucgacgauggcauuuaccggauucuacaacgcggauuauuggguagaucgcaagucggggucggagucuuucaggacggaguauuccauacaauguggcauguaacucgcggagccgucuuaauguaucaaggaaaaagacuagaaccuucaugggccucagucaaaaaggauuugauuucuuauggcggaggauggcgauuucagggaucuuggaacaccggagaagagguucagguaauagcaguugagccaggaaagaauccuaaaaauguacaaacuacucccgguacauuuaaaaccccagaaggugaagucggugcgaucgccuuagauuucaaaccagguaccagcgggagcccgauaguuaauagagagggcaaaauagucgguuuauauggcaacggcguuguaaccaccagcggaacauauguaucggcuauugcacaggcgaaagccagucaagaaggaccuuuaccugaaauagaagaugaaguuuuuaagaaaagaaacuugacuaucauggauuuacaucccggcucagggaaaaccagaagguaucugccagccauuguuagggaagcaaucaaacgcaaguugagaacuuuaauauuggcgcccacacgaguaguugcauccgaaauggcagaagcccugaaagguaugcccauaagauaccagacaaccgccgucaaaucugaacauaccgggaaagaaauuguagaucuaaugugucaugccacauuuacgaugagauugcuaagccccguuagaguuccaaacuacaacaugauaauaauggaugaagcucacuuuacagauccggcuagcauagcggcgagaggcuauauuucaacucguguuggaaugggagaagcagcugcgauuuucaugacugcaacgccucccgguagcguugaagccuuuccucaaucaaaugccgugauccaggaugaggaaagggacauacccgagcggucuuggaacucugguuacgacuggaucacugacuucccgggaaaaacaguuugguucgugccgucaaucaaaucagggaaugauauugcaaacugcuuacguaaaaacgguaaaagaguaauacaacuuucacggaaaaccuuugauacagaauaucagaagaccaaaaauaacgauugggauuaugucguaacuacagacaucucagagaugggcgcaaauuuuagagccgacagggucaucgauccuaggagaugccuaaagccagucauucuuaaagacggaccagaacguguaauccuugcagguccaaugccugucacagccgcaagugcagcccaaaggcgcggacgaaucgggcguaaucagaauaaggaaggggaccaauauauuuauaugggccagccucuaaauaaugacgaagaccaugcucacuggacagaagcuaaaaugcugcuggauaacauuaauacaccugaggggauuauacccgcucuuuucgagccagagcgagaaaagucggcugcaauagauggagaguacagauuacgaggagaagcccggaaaacauuuguugaauuaaugagacggggagaucuacccguuuggcuuucauacaaaguagcaucagaaggguuucaauauuccgauagaagaugguguuucgacggugaaagaaacaaucaaguauuagaagaaaauauggacguagaaauuuggaccaaagaaggugaaagaaagaaauuaaggccccgaugguuagaugcuaggacguacucugacccgcuugcgcucagagaguuuaaagaguucgccgcggggagacgaaguguauccggagaccuaauucuugaaauagggaaauugccucaacauuugacacuucgggcucagaaugcauuagacaaccucguaaugcuucauaauagcgaacaaggcggaaaagcauacagacacgcaauggaagaacucccagauacgaucgagaccuuaaugcuacuagcccucauugccguacugaccggcggaguuacacuauucuuccuaaguggaaaaggguuaggaaaaacaaguauaggauuacuaugcguuauggcuucaaguguuuuauuauggauggcuagcguugaaccacauuggauagcagcgaguauaauucuagaguucuuccugauggucuugcucauuccagagccggacagacaacgaacuccgcaggacaaccaguuagcauauguaguaauuggccuucuauuuaugauuuuaacaguagccgcaaaugaaaugggauuacuggaaacaacgaagaaagauuuggguauaggacauguaguugcagaaaaucaucaucacgcgacaauguuagauaucgaucuucaucccgccagcgcuuggacacuauacgcagucgccacaacuaucauaaccccuaugaugagacacacaauugaaaauaccacagccaauauuagcuugacggcuaucgcuaaucaagcugcuauccuaaugggcuuagacaaaggauggccgaucaguaaaauggauauaggcguaccccuuuuagcauugggcuguuacagccaaguuaacccccuaacacuaacagcagccguuuuaaugcugguagcucacuaugcgauaaucggucccggacuacaggcuaaggcaacucgugaggcacagaagcgcacagcggccggaaucaugaaaaauccuacgguugacggaauagucgccauagaucucgaucccguaguguacgacgcaaaauuugagaaacaauugggucagauaauguuauuaauucuuuguaccagccaaaucuuacuuaugcguacgacgugggcacuuugcgaaaguaucacucuagcuaccgguccucuaacaaccuuaugggaagggaguccuggaaaauucuggaacaccacaauagccguuagcauggcgaauauuuuuagaggaucguaucuagcuggcgcaggguuagcauuuagccucaugaaaucauuagguggugggaggcgugguacuggcgcucaaggggaaacguuaggcgaaaaauggaaaaggcaauuaaaucaguuaucaaaaucggaauuuaauaccuacaaaagaucagguauuauggaaguagauaggucagaagcaaaagaaggacucaagcgaggagaaacuacaaaacacgcuguaucaaggggaacggcaaaacucagaugguuuguagaaagaaaucuuguuaaaccagaaggcaaaguuauagaccuagguugcgguaggggagguuggucguauuauugugcaggauugaagaaagugacagaaguaaaaggcuauacaaagggaggcccaggacacgaagaacccauacccauggcuacauauggauggaacauaguuaaacuucauucuggacgagaugucuucuucaccccgccagagaagugcgauacacuacuaugcgauauaggagaaaguucuccuaacccaacgauagaagaagggcggacacuacggguacucaaaaugguagagccuugguugagagggaaucaguuuugcauuaaaaucuuaaauccauauaugccaucuguaguugaaaccuuagagcaaaugcaaaggaaacaugguggaauguuaguucguaacccuuuaucgagaaacagcacacacgagauguacugggucagcugcggaacaggaaauauagugucugcagucaauaugacaaguagaaugcuuuuaaaucguuucacuauggcccauaggaaaccuacauaugaaagagauguagacuugggugcagggacgaggcacguggcagucgaaccagagaucgccaaccuggacauaauaggucaaaggauagaaaauaucaaaaaugaacacaaaucaacuuggcacuaugaugaagacaauccguauaaaacaugggcuuaucacggcucauacgaaguaaagccaucaggaagugcaucaucuaugguaaauggcguaguacgacuauugacaaagccuugggauguaauaccaaugguaacgcaaauagccaugacggacacaacaccauucggacaacagaggguguucaaagagaagguagacacaagaaccccgcgaccgaaaaggggcacugcgcagauuauggaagucacagcuaaaugguuauggggguuuuuaaguagaaauaaaaagccacggauuugcacacgugaagaauuuacaaggaaaguaagaucuaacgcggcuaucggcgcugucuucguggaugaaaaucaauggaauagugcaaaagaagcagucgaagacgaacgauucugggaccugguacaucgugaacgagaacuccauaaacaaggaaaaugcgcuacuugcguauauaauaugaugggcaaacgugagaaaaaguuaggugaauuuggaaaagccaaaggaucacgugcaaucugguauauguggcucggcgcgagauuuuuagaauuugaggcuuuaggauucaugaaugaagaucauugguucagccgagaaaacagcuugucagguguagaaggagagggucuucacaaauuagguuacauauuaagagacauuucaaaaauaccaggugguaacauguacgcagacgacaccgcaggaugggauacaagaauuacugaagaugacuuacaaaaugaggcuaagauaacagacauuauggaaccagaacacgcacuacuugcaacaagcaucuucaaauuaacauaucaaaacaaaguuguacguguacaacggccugcaaagaguggaacaguaauggacguaauaucacggagagaucagcgugggucaggucaggucgggacuuacggacugaacacauucacaaacauggaaguacaacugaucagacaaauggagagugaaggcauauuuaguccgucggaauuggaaaacucuaauuuagcagaaagaguacuagauugguuagagaagcacgguguggagaggcuaaaaaggauggcaauaaguggcgacgauuguguaguuaaaccaacugacgauagguucgcaacugcacucacggcucugaacgacaugggaaaagugcgaaaggacauaccgcaaugggaaccuucgaaaggauggaaugacuggcaacaaguaccauuuuguagucaccacuuucaucaauugauaaugaaggaugggcgagaaaucgucgucccguguagaaaucaagaugaauuaguggggagagcucgcguuucucagggggcagguugguccuuaagagagacagcuuguuuagggaaaaguuaugcacaaauguggcaacuuauguauuuucauagacgugaucuaagacuugcagcuaaugcaauuuguagugcggugccaguuaauuggguaccuaccuccagaacaaccuggaguauccacgcccaccaucaauggaugaccacagaagauauguuaucgguauggaaucgaguauggauagaagaaaaucccuggauggaggauaaaacucauguuagcagcugggaggacguacccuauuuagguaaaagagaggaucaauggugugggagcuuaaucggacuuacggcacgagcaacaugggcgacaaauauacagguagcuaucaaucaggugagacgguugauaggaaaugaaaauuauuuggacuacaugacuucaaugaaacgguucaaaaacgaaucugauccggaaggugcccuuugguga

SEQ ID NO: 22113 - RNA, 9879 nt, Artificial Sequence
  derived and/or modified CDS sequence (opt6) from DENV-1__KM403586__SS-prME
ucgguuacgauguuauuaauguugcuaccaacugcccucgcguuucacuuaacaacaagagguggcgaaccgcacaugaucguaucuaaacaagaaagaggaaaaucacuauuauuuaaaacuuccgcuggaguaaacauguguacucugauagcgauggaucuuggagaauuaugcgaagauacaaugaccuauaaaugcccuagaauuaccgaagcagaaccagacgauguagacuguuggugcaaugccacggacacuuggguuacguacggcacaugcucucaaaccggagaacaucgcagagauaaaaggucgguugcccucgcuccacauguaggauugggucucgagacucgcacggagacauggaugagcagugagggcgcauggagacaaauucaaaaaguugaaacaugggcacuacgacauccugguuucacuguaauugccuuuuucuuagcucaugcgaucggaacaucuauaacgcaaaaaggaauaauuuucauacuacugauguuaguaacuccuucuauggccaugagaugcguaggaauaggaaacagagacuucguugaagguuuaucuggagcuaccugggucgacguaguacuagaacacggaagcugcguaacuacuauggcuaaaaacaaacccacccuugauaucgaacucuugaaaacagaaguuacaaauccugcagugcuuagaaaacugugcauugaagcaaaaauuaguaacacuaccacugacucacguuguccuacucaaggagaagcaacuuuagucgaagaacaagaugcaaacuucguguguagacguacguuuguagaccggggcuggggcaacgguugcggauuauucgguaaagguucuuuacuuacuugcgcuaaauucaaaugcguaacuaaacuugaaggcaaaaucguacaauacgaaaacuugaaauauagcguaauuguaacagugcauacaggcgaucaacaucaaguagguaacgaaacaacugagcauggaacaaucgcaacgaucacuccgcaagccccuaccagugaaguucagcuaaccgauuacggggcuuuaacauuagacuguucuccuaggaccggacuagauuucaacgagauggucuuacuuacuaugaaagagaaaagcuggcuuguucauaaacagugguuuuuagacuuaccgcuaccauggacgaguggggcgaguaccucccaagaaacauggaacaggcaggauuuauuagucacguucaaaacagcccaugcuaagaaacaagaagugguuguauuagguagccaagaaggugcuaugcauacggcucuaacuggugccacugaaauucaaacauccggaacaacuacgauauuugcaggacaccucaaaugucgcuugaaaauggauaaacuaaccuuaaaaggagucucuuacguaaugugcacggguucuuuuaaauuagaaaaagagguugcagagacacaacauggaacuguucugguucaaguuaaguaugaaggaacugacgcucccuguaaaauuccgauaaguacgcaagaugaaaagggggugacgcagaacggcagguuaaucacagcgaauccaauagugacugacaaagaaaaacccgucaauauugaaacugaaccuccauuuggggaaaguuauauuguuauaggagccggggagaaggcucugaaacuaucaugguuuaagaaaggaaguucuauuggcaaaauguuugaagcuacagcuagaggagcuagacgaauggcgauuuuaggugauacagcgugggauuucggcucuaucgggggagucuucacaagugucgguaagcuaguacaucaaguauucgggacugcuuacggaguacuguuuagcggcgucaguuggacaaugaaaauaggaaucgguauauuacuaaccugguuaggauuaaacagcaggucuaccucauuauccaugacguguauugcuguuggcauggugacccuauauuuaggaguaaugguccaagccgacucggggugcguuauaaacuggaaaggacgagagcuuaagugugguagcggaauauucguuaccaacgaaguacauacauggacugaacaauauaaguuucaagcggauagcccuaaacgccuuucggccgcaauagguaaagccugggaagaagggguauguggaaucagaagugcaacaagacuugaaaauauaauguggaaacaaauuaguaacgaacuaaaccauauauuauuagaaaaugauaugaaauucacgguuguaguaggagacgcauaugguauacuuacacaggggaagaaaaugauaagaccccaaccaauggagcauaaauauaguuggaaaagcuggggaaaagcuaaaauuauaggggccgauacacaaaauacaacuuuuauaaucgauggaccugauacacccgagugcccggaugaucaacgcgccuggaacauuugggagguagaagauuacgguuuugguguuuuuacgacaaauauuuggcugaaacuacgcgacucauacacgcaaaugugugaccacagacuaaugagcgcggcuauuaaagauucaaaagccguacacgcggauauggguuauuggaucgaaucagagaaaaacgaaacauggaaauuggcucgagcuaguuuuauagaaguaaaaacguguauauggccacgcagucauacccuuuggaguaaugguguacuugaaagugaaaugauuauaccaaaaauauaugguggcccaauuucacaacauaacuauagaccugguuauuucacacaaacagcaggucccuggcaucuuggaaaauuagaacuagauuuuaacuugugugaaggaacaacggucgucguggaugaacauugugguaacagagguccaagccuuaggacaacuacugucacugggaaaaucauacacgaaugguguugcagaucuuguacccucccgccucuaagauuuagaggcgaagaugggugcugguaugguauggaaauuagaccaguaaaagaaaaggaagaaaaucugguuaggagcaugguaagugccggaagcggagaaguagauucuuucucuuugggucuauuaugcgugucaauuaugauagaagaagugaugcguucgcgcuggucucgcaagaugcuaaugacgggcacauuagccgucuucuuucuauugauaauggggcaauuaacauggaaugauuuaaucagauuguguauuaugguuggagccaauguaucagacaggauggguauggggacaaccuaucuagcgcuuauggccacuuuuaaaaugagaccaauguucgcaguuggcuuacucuuuagacgccucacuagccgagagguuuuacuguuaaccaucgguuugucgcucgucgcgucgguagaacuacccaacucguuagaggagcuuggcgauggacuugcuaugggaaucaugauguugaaguuacucacggacuuccaaucucaccaauuguggacaacuuuauugucucuaacauucauaaaaacuacauuaucauuagacuacgccuggaagacuauggcaaugguuuugagcauaguaucucuguuucccuugugucuuuccaccacaucucagaaaacgacuugguuaccgguacuacuagguucauuuggauguaaaccauugacuauguuucuaauuacugagaauaaaauuuggggaagaaaaucuuggccacuaaacgaggguauaauggccgucggaauugugaguauccuccuuaguagcuuacucaaaaaugauguaccccuggcgggaccguuaaucgcggguggaaugcucauagcaugcuauguaauaucaggaaguagcgcugaucuuucgcuugagcgugcagcggaaguuagcugggaagaagaggcggaacauaguggugccucacauaauauacugguagaaguccaagacgaugguacuaugaagaucaaagacgaggagagagaugacacucuaacgauacuacuuaaagcaacuuuauuagcggucuccggaguuuauccaaugucaauuccagcgacauuauuuguuugguacuucuggcagaagaagaaacaaagaucagguguauuaugggauacaccguccccgccagaaguugaacgagcgguacuggacgaugguaucuacaggauacuccaacgcggacuguugggucgaucgcagguaggaguagguguauuucaggacggaguuuuucacacgauguggcacguaacgagaggagcaguauugauguaucaagguaagagacuugagccaucuugggcaucugucaagaaagaccuaauuucguaugggggagguuggagauuucaaggguccuggaacacaggcgaagaagugcagguuauugcaguagaaccaggaaagaaucccaagaauguacagaccacacccggaacuuucaaaacaccggaaggggagguaggcgcgauagcauuagauuuuaaaccaggcacaagugguagcccuauuguuaaucgugaagguaaaauuguaggccuuuauggaaaugguguagugacgacaucaggaaccuauguauccgcaauagcacaagcaaaagcuagccaagaagggccgcuaccagaaauugaggacgaaguauucaagaaacgaaaccugacuauaauggaucuucauccuggaagcggcaaaacaagaagauaccucccggcuauaguaagagaggcuauaaaacguaaguuaagaacuuuaauuuuggcaccaacuagaguagucgcaucagaaauggcggaagcauugaaaggaaugccaauacguuaucaaacgacugccguaaaauccgaacacaccggaaaagaaauaguugacuuaaugugccacgccaccuuuacgaugagauuacuauccccaguacggguuccaaauuauaauaugauaauaauggacgaggcacacuuuacagaccccgcaucaauugcugcaagaggauauauaaguacucggguaggcaugggugaagcagcggcaauauuuaugacugccacaccaccggguucaguggaagcguuuccacaauccaacgcagucauacaggaugaggagagagacauccccgaaaggucguggaacaguggcuaugauuggauaaccgacuuccccgggaaaacgguaugguuuguaccaaguauaaagagugguaaugacauugccaacugccuaaggaaaaacggaaaacgaguuauccaacuuagcagaaaaacuuuugacacagaguaucagaaaaccaaaaauaacgauugggacuaugucgugaccacggauauaagugaaaugggcgccaacuuucgggccgauagaguuauagauccuagaagguguuuaaagccuguaauacuaaaggauggcccugaacgggugauuuuagcgggcccaaugcccguuacagcggcuagcgcagcccaaagaaggggacggaucggaagaaaccaaaauaaggagggagaucaauauaucuacaugggacagccucuaaacaaugacgaagaucaugcacacuggaccgaagccaagaugcuauuagauaauaucaauacuccggaggguauuauaccagcucuauuugagcccgaacgagaaaaaucggccgcaaucgacggcgaguacagacugcgcggagaagccagaaaaacguuuguugagcuaaugaggcgcggcgauuuaccggucuggcugucauacaagguagcuucggagggauuccaauauucugauagaagaugguguuucgacggagaaagaaauaaucaaguccuagaggagaacauggacguagaaauauggaccaaggagggagagaggaagaaacuucggccuagauggcuagaugccaggacuuacucggauccauuagcgcuacgcgaauuuaaggaguuugcagcaggacguaggaguguuucuggggaccucauauuggaaauaggaaaauugccacagcacuugacgcuaagagcacaaaacgcucucgauaauuugguaauguuacacaacucagaacaaggggguaaagcauacagacacgcaauggaagaacucccagacacuauagaaacauuaaugcuacucgcauuaauugcgguccuuacgggcggagucacauuauuuuucuuaucaggaaaaggauuaggcaagacaagcauuggacuacuaugugucauggcaucaagcgugcuuuuguggauggcuuccguugaaccacacuggaucgcagcuaguauaauauuggaguucuuucucaugguucucuugauacccgaacccgaucgacaaagaaccccucaggauaaccagcuagcguauguugucauaggacucuuauuuaugauauuaacaguugcugcuaaugaaaugggcuuacuagaaaccaccaaaaaggaccuaggaauuggacacgucguagcggaaaaccaucaucacgcuacgauguuagauauugauuuacacccugcaagugccuggacauuauacgcaguggcaacuacgauuauaaccccaaugaugagacauacuaucgaaaauacaaccgccaauauuagcuuaacugcuauugcaaaucaagcugcgauauugaugggacuagacaaagguuggccaaucucuaaaauggauauagguguaccacucuuagccuuggguuguuauucacaaguuaacccacuaacuuuaacagcugcaguuuuaaugcucguugcacacuaugcaauaauagguccaggauugcaagccaaagcuacaagagaagcacaaaaacgcacugcagcugguauuaugaaaaacccgacagucgauggaauuguagcaauagacuuagaucccgucguauacgaugcaaaauuugaaaagcaguuaggucaaauaauguuauuaaucuuaugcacaucacaaaucuuauugaugaggacaacaugggcacucugugaaagcauuacauuagcaacugggccacuuacuacuuuaugggaagguucacccgggcguuuuuggaauacuaccaucgcggucagcauggccaauaucuucagaggaagcuaucuagcaggagccggauuagccuuuucauugaugaagagucuaggaggugguaggaggggaacaggcgcacagggagaaacucuuggagaaaaauggaaacgucaauuaaaccaacuuucaaagagugaauuuaacacguauaaaagaucaggcauaauggagguugaucgaucagaagcaaaagaagguaugaaacgaggugagaccacgaaacaugcagugagucgaggaacggcaaaguugcgcugguuugucgaacguaaccuaguuaaaccagaagguaaagucauugaucuaggcugcgggcgcggcgguuggucuuacuauugcgcgggucuuaagaaagucacagagguaaaaggauacacaaaagggggaccaggucaugaagaaccaauaccuauggcaacauacggguggaacauaguuaaacuucacucuggccgagauguauucuuuacuccacccgaaaagugcgauacacuauuaugugauaucggagagucaaguccaaacccgaccauagaagaagggaggacucuuagagugcuuaaaaugguagaaccauggcuaagagguaaucaauucuguauuaaaaucuuaaaccccuauaugccuucaguaguagaaacgcucgaacaaaugcaaagaaagcauggagguauguuggucaggaacccccuaaguagaaauaguacacaugagauguauuggguaaguugugguacagguaacauaguuuccgcagucaauaugacaucgagaaugcuacuaaauagguuuacaauggcucauagaaaaccuacguacgaaagagacgucgaccuuggggccggcacucgacacguagccguugaaccagaaauugcgaacuuagacauaauuggucaaagaauugaaaacaucaaaaaugaacauaaaaguacauggcauuaugaugaagacaaucccuauaaaacaugggcguaucacggcucauaugaggugaagccaagcgguagugcuucuucuauggucaauggggucgucaggcugcuaacuaaacccugggaugucaucccgaugguaacacaaauagcaaugacagacacaacuccauuugggcaacaacguguuuuuaaagagaaagucgauacgaggacaccaaggccuaaacgaggaacggcgcaaaucauggaaguaacagcaaaauggcucuggggguuucugagucgcaauaagaaaccacggauuuguacacgcgaggaauuuacaagaaaagugagguccaacgcggcuaucggagcaguguucguagacgagaaccaauggaacagcgccaaggaagcaguggaagacgaacguuucugggacuuaguccacagggaaagggaauugcauaagcaaggcaagugugcaacauguguuuauaacaugaugggcaaaagagagaagaaacugggcgaguucggaaaggcaaaaggaucccgggcaauaugguauauguggcuuggcgcacgguuucuggaguucgaagcacugggauuuaugaacgaagaucacugguucucucgagaaaauucguugucagggguggaaggagaaggccuucauaaauugggcuauauucuacgagacauaucaaaaaucccaggcggaaacauguaugcagaugauacugccggaugggacacuagaaucaccgaagacgauuuacaaaacgaagcuaaaauuaccgacauuauggaaccagagcacgcauuauuagcaacauccaucuuuaaauugacuuaccaaaacaaagucgucagaguccaacguccugcaaaaagugggacuguuauggaugugauuagucgucgcgaccaaagggguucaggacaaguagggacauauggauuaaacacuuuuacuaacauggaaguucaacuuauaaggcaaauggaguccgagggaauauuuucaccguccgagcucgaaaauuccaaccuugcugaaagagugcuagauuggcuagaaaaacacggaguagaaagguuaaagaggauggcgaucucaggggaugauuguguugucaagccuacugacgauagauuugcgacagccuuaacagcacuuaaugauaugggcaaaguaaggaaagauauuccgcaaugggaaccaagcaaaggauggaaugacuggcagcaaguaccguuuugcagccaucacuuccaucaacucauaaugaaagauggaagagaaauuguuguaccaugcagaaaccaagaugaguugguagguagagcgagaguaucgcagggcgccggaugguccuuacgagaaaccgcuugccucgguaaauccuacgcucaaauguggcaguugauguauuuucauagacgugacuuaagacucgcagcaaacgcaauaugcagugccgugccuguuaacuggguucccacaucgcggaccacauggucuauacaugcacaccaccaauggaugacgacagaggauauguuauccguguggaaccgaguauggauagaagaaaacccauggauggaagauaaaacacauguuaguuccugggaagauguaccauaccugggaaagagggaggaucaaugguguggaucacuaauaggucucacggcuagagcgacgugggcaacaaauauacagguagcuauuaaccaagucaggagacuuauagguaaugaaaauuaucuugauuauaugacuucuaugaaaagauuuaaaaacgaaagcgacccagaaggagcacuuugguaa

SEQ ID NO: 22114 - RNA, 9879 nt, Artificial Sequence
  derived and/or modified CDS sequence (opt6) from DENV-1__KM403602__SS-prME
aguguaacgauguuacuuauguugcuuccaacugcuuuagcguuucaccuuacgaccagagggggagaaccccauaugauagugaguaaacaagaaagaggcaaaaguuuacuauuuaaaacuucugcuggaguuaauauguguaccuuaauagcaauggaucugggugaauuaugcgaagauacaaugacguauaaaugcccgagaauaaccgaagcagaaccagaugauguggacugcuggugcaaugcuacugauacauggguuacguacggcaccuguucacaaacuggcgaacacagaagggauaaaagaaguguagcucuagcgccgcacgucgguuuagggcuagaaacaaggacagaaacguggaugucgagcgaaggagcuuggagacaaauucagaaaguggaaaccugggcacuucgacauccgggcuuuacaguuauagcacuuuucuuggcacaugcaaucggaaccucuauaacccaaaaaggaaucauauuuauauugcuuauguuagucaccccguccauggcuaugcgauguguagguauuggaaaucgagacuuuguugaaggcuuaaguggagcuacaugggucgauguaguguuagaacauggaucaugugucacaaccauggcgaaaaauaaaccaacacuagacaucgaauuguuaaaaacggaaguuacuaauccagcaguguuacguaaacuuuguaucgaagcgaaaauaucaaauacgacgacugacagccgauguccaacacaaggcgaagccacacucguagaagaacaggacgcgaacuuuguguguagaagaacuuucguagauagaggcugggguaacggaugcggcuuauucgguaaagguagucuuuuaacaugcgcaaaauucaaauguguaacuaaacuggaaggcaaaauaguacaauacgaaaauuuaaaauauagugugaucguaacgguacacacaggugaucagcaucaaguagguaacgagacaaccgaacacggcacgauagcuacgauaacuccacaagcgccuacgagcgagauacaauuaacagauuauggugccauuacauuagacuguucaccucgaacuggguuagauuuuaaugagaugguacuauugaccaugaaagaaaaaucauggcuaguacauaaacagugguuucuagacuuaccacuuccauggaccaguggagcuaguacuucacaagaaacauggaauagacaagaucuauuaguuacuuuuaaaacggcucaugcuaagaaacaagaaguagugguccuaggaagucaagaaggagcaaugcacaccgcacucacaggugcaacagaaauucagacgucagggacuaccacaaucuucgcgggccaccuuaaauguagauuaaaaauggauaaacugacauuaaaaggcguaucauacguaaugugcaccggaaguuuuaaacuugagaaagagguagccgaaacgcaacacgguacuguauugguacaagugaaauacgaaggaacagaugcgcccugcaaaauaccaaucucaacccaagaugaaaagggggugacacagaauggaagacugaucaccgcaaaucccauaguuacggauaaagagaaaccagucaauauugaaacggagccgccguuuggugagucguauauuguuaucggagcaggcgaaaaggcuuugaaguugagcugguuuaagaaagggaguucgauaggaaaaauguuugaggcaacggcacggggagccagaagaauggcaauacucggcgacacugccugggauuuugggaguauuggcgguguuuuuaccucagucgggaaacuuguacaucaaguguucggcacugcuuacggcguccuauuuuccggcgucuccuggaccaugaaaauugguauuggaauccugcucacguggcucggccucaacucuagaucaacaucuuuaucuaugaccuguaucgcaguuggcaugguuacacuuuacuuaggaguuaugguucaagcagauaguggaugcguaauuaauuggaagggucgcgaacugaaauguggauccggcauauuugugacaaaugagguacauacuuggacagaacaauauaaauuucaagcugacaguccaaagagacuuucagcagcaaucgguaaggcaugggaagagggagucuguggcauccgcagcgcuacucgacuagaaaacauaauguggaaacagauaagcucggaguugaaucacauucuucuggaaaaugauaugaaauucacgguaguagugggagaugcuaauggaauacugacacagggcaagaaaaugauaaggccgcaaccaauggaacacaaauauucguggaaaagcugggguaaagcuaagauaauaggggcugauacccaaaauacaacauuuauuaucgaugguccagauaccccagaaugcccagaugaucaaagggcuuggaacauuugggagguugaagauuauggauuuggcguauuuacgacuaauauauggcuuaaacuuagagauucuuauacgcagaugugcgaucaucgacuaaugagugcagcuauaaaagacaguaaggcagugcaugcagauaugggcuacuggauagaaagcgagaaaaacgaaaccuggaaacuagcuagagcuagcuuuauagaagucaaaacauguauauggccgagaucucauacauuauggaguaacggaguacuagaaucagaaaugauaauaccaaagauauacggaggaccaauaagucagcacaacuauaggcccggcuacuucacacaaacagcagggcccuggcaucucggaaaacuagaguuggacuuuaaucucugcgaagguacaacuguuguaguagaugaacauuguggcaacaggggcccuucacugagaacaaccacaguaacaggaaaaauaauacacgagugguguugcaggucgugcacucugccuccccuuagguuuagaggggaagacgggugcugguacggcauggaaaucagaccaguaaaagagaaagaggaaaaccuuguuagaucuaugguaucagcggggagcggagaaguagauucauuuucucugggacuauuaugcguuagcauuaugauugaagaagugaugcgauccagauggaguaagaaaaugcuuaugacugggacucuggcaguauucuucuuacugauaauggggcaacucacguggaaugaccuaauccgucuuuguaucauggucggagcgaaugucagugaccgaaugggaauggguacgacauaccuagcgcuuauggcuacguucaaaaugagaccuauguuugcaguagggcuacucuuccgacgauuaacaagucgagaaguacuuuuauugacuauugguuuaucacucguagcaaguguagaacugccuaauucucuagaagaacuuggugauggucuagcuauggggauuaugaugcuaaaauuacuaacggacuuccaaucacaucagcuauggacuacguuauuaucuuugacuuuuauuaaaacuacauuaucuuuagacuacgcuuggaaaaccauggcaaugguacuaagcauaguaucauuauuuccuuuaugccuaucaaccaccucgcagaaaacuacauggcuaccaguacuuuuaggcagcuuuggaugcaaaccacuaacaauguuucugauuacagaaaauaagauauggggaaggaaaucuuggccucuaaacgagggcaucauggcgguuggaaucgugucaauccuucuguccagcuuacugaaaaaugacguaccacuggccggaccuuuaaucgccgguggcauguugauagcuuguuauguuauaucugggucgagcgcagauuugucauuggaacgcgcggcagagguaagcugggaagaagaagcagaacauagcggugccucgcacaacauuuuaguagagguacaagaugacgguacuaugaaaauaaaggaugaagaacgagacgauacauuaacuaucuuacuaaaagcaacgcuccuugccgucucagguguauacccaaugucuauuccagcgacuuuguucgucugguauuucuggcagaagaagaaacaacgaaguggagucuuaugggacacaccuaguccuccagaagucgagcgagcagugcuagaugacggcauauaucgcauucugcagcgaggauuauugggccgcagucaggucggcgucggaguuuuucaagauggaguauuucacaccauguggcacguuacccgaggcgcgguacucauguaccaagggaaacgauuagaacccaguugggccucagugaaaaaggaucucauaaguuaugggggagguuggcgcuuucaagguucauggaacacuggagaagaaguacaagugauagcaguagagcccggcaaaaauccuaaaaacgugcaaacaacacccggcacauucaagacaccugaaggcgagguaggagcgauugccuuggacuuuaagccugguacaaguggcagcccuauugugaaccgggagggaaagauaguuggguuguauggcaacggaguaguaacuaccucuggcacauauguaucggccauugcgcaagcaaaagcaucacaggaagguccuuuaccagaaauugaagaugaaguuuuuaagaaacgcaauuuaacaauaauggauuuacauccgggaucggguaagacacgacgcuauuuaccagcaauugugagagaagcaauaaaacgcaaacugagaacccuaauauuagcgccaacuaggguaguagcaagcgagauggcagaagcucuaaaaggcaugcccauacgcuaucaaacaaccgcaguaaaaucugagcacacaggaaaagaaauaguugaucucaugugccacgcaacauuuacuaugcgccuguuaucaccuguacgaguaccaaauuacaacaugauaauaauggaugaggcgcauuucacugauccagcgagcauagcggcaagaggauacaucucuacacgaguagguaugggagaagcagcggcuauauucaugacagcuacaccaccaggaucaguagaagcauuuccucaaaguaacgcuguaauccaagaugaggaaagagauauaccagaacgaagcuggaacaguggcuacgauuggauaacagauuuuccugguaagacagucugguucgugccaaguauuaaaucuggaaaugacauagcaaacuguuugaggaaaaaugguaagcggguuauacaauugucaagaaaaacguuugacaccgaauaccaaaagacaaagaauaaugacugggauuacgucguaacaacagauauaagugagaugggcgccaauuuccgcgcugauagagugauugauccaagacguuguuuaaagccgguaauauuaaaagauggacccgaaagaguaaucuuagcgggaccaaugccaguuacggcugcaagugcagcacaacggcguggaaggauuggcaggaaucagaacaaagaaggcgaucaguauauuuauaugggucagccacucaacaaugacgaggaccacgcccacuggacagaggcgaaaauguuauuagauaacauuaauacuccugaagguauaauacccgcucucuuugaaccugagcgugaaaagucagcggcgaucgacggcgaauauaggcuuaggggugaagcaaggaaaaccuucguugaacucaugaggcgaggugaccuaccuguaugguuaucauauaaaguggccagugaaggcuuucaauacucagauagacgguggugcuucgauggagaaaggaauaaucaaguacuagaggaaaacauggauguggaaauauggacgaaagagggugaaagaaagaaauuacgacccagguggcuagaugcucgaaccuacucugacccuuuggcauuacgagaauuuaaagaguuugcugccggacgcaggucagucuccggagaccucauacuagaaauaggaaaacuuccccaacaucuaacacuucgagcacaaaacgcucuugauaauuuaguuaugcugcauaauucagaacagggaggaaaagcguacaggcacgccauggaagaguugccugauacuauagaaacauuaauguuauuggcacucauagccguacugacgggaggagugacccuauucuuuuuguccggaaaaggucuaggaaaaacgaguauugggcuauuauguguaauggcauccucaguacuguuauggauggcgucuguagaaccucauuggauugccgcgucuaucauccuugaguucuuucucaugguuuuacuaauuccugaaccugauagacaaagaaccccacaagacaaucaacucgcguauguagugauuggcuuacuuuucaugauacuaaccguugcagcaaacgagaugggguuauuggaaaccacuaagaaagaccuugggauugggcacguugucgcugaaaaccaucaucaugccaccaugcuagacauagaucuucaccccgcaagcgcuuggacccuauaugcggucgcuacaacaauuauuaccccuaugaugaggcacacaauagaaaacaccacagcuaacauuucacuaacggcuaucgcaaaucaagcagcgauccuuaugggucuagauaaaggauggcccauaaguaaaauggacaucggagugccacuucuagcuuuaggcugcuauagucaaguaaaccccuuaacucuuaccgcagcaguacucaugcuaguagcccauuaugcuauuauaggaccuggauuacaagcaaaagcaacacgagaagcacaaaagagaacagcagcagggauuaugaaaaauccuacaguagacgggauaguagcuaucgaccuugacccagucguauacgaugcgaaauucgaaaaacaauuaggacaaaucaugcuauuaauucugugcacuagccaaauacugcuuaugagaacgacuugggcacuaugugaaaguauaacucuagcaacuggccccuuaacaacucuaugggaaggcagucccggaaaauuuuggaauacgacuauugcaguuucgauggcuaauauauuuagaggaaguuacuuagccggagcaggacuagcauuuagucuuaugaagucccuugggggcgguaggcgugggacuggugcacaaggugagacuuuaggcgagaaauggaaaaggcaacugaaucaguuaagcaaguccgaguuuaacacguauaaaagaucugguauuauggagguagaucgcucagaagcaaaagagggguuaaaacgaggggagaccacgaagcaugcagugucuagaggaacagcaaagcuccgaugguuuguagagcgcaauuugguuaagccagaaggcaaagugaucgacuugggcugcggucgagggggauggucuuauuauugugcuggacucaagaaaguaacggaagugaaaggcuacacgaaaggcgguccuggccaugaagaaccgauuccgauggcuacauacggguggaacauuguuaagcuacauuccgggagagauguuuucuuuacacccccugaaaaaugugauacccuauuaugcgacauuggcgaaucaucuccuaacccaacuaucgaagaaggacguacuuugaggguacuaaaaauggucgaaccauggcuucguggcaaucaauucuguauaaagauacucaauccauauaugccgagcguaguugaaacguuggaacaaaugcaaagaaaacauggcggcauguuaguuagaaauccucuaucaagaaauucgacccaugaaauguacuggguaaguuguggcacagggaacauuguuagcgcagucaacaugaccucgagaaugcuauuaaauagguuuacgauggcgcauaggaaaccuacguaugaacgagauguagaccuaggggccggaacucgacauguagcuguugagccggaaauagcaaacuuagauauaaucggacagagaauugaaaacaucaaaaaugaacacaaguccacauggcacuaugaugaagacaauccguauaaaacuugggcauaucacgguucuuaugaaguuaaaccuucaggaagugcuuccucaaugguuaacggaguaguccgucuauuaacgaaaccgugggaugugaucccaauggugacucaaauugcuaugaccgauaccacaccguucggccagcaaagaguuuuuaaagaaaaaguggauacuagaacaccccggcccaaaaggggaacagcccagauaauggagguuacagcaaaauggcuuuggggauucuuguccaggaauaagaaaccacguauaugcacaagagaggaauuuaccaggaagguacgaucaaacgcagcaauaggugcugucuuuguagacgaaaaucaauggaacucagccaaagaagccguagaggacgaaagauucugggaccucguacacagggaacgagaauuacauaagcaggguaaaugugcaacuugcguauauaauaugauggguaaaagagagaagaaauuaggugaauuuggaaaagcuaaagggagccgagccauaugguacaugugguuaggagcaagauuucucgaauuugaggcuuuagguuuuaugaacgaagaucacugguucucacgagaaaacagucuaaguggaguugaaggagaagggcuacauaaauuaggguacauccuacgcgauauaucuaaaauaccaggugggaauauguaugcugaugacaccgcaggcugggauacaaggauaacagaagaugacuugcagaaugaggcaaaaauaaccgacauuauggaaccggaacaugcucuauuagcuacaucuauauuuaaacucaccuaccaaaauaaagugguacgagugcaacgaccugcgaaaucagguacgguuauggacguaauuagucgucgggaucaaagggguagcgggcaaguagguacguacgguuuaaauaccuucacgaauauggaaguacaguuaauaagacaaauggaaucugaaggcaucuuuucuccaucagagcuagagaacaguaauuuagccgaaaggguacuggauugguuagaaaaacacggaguggaaagacugaagagaauggccaucucaggagaugacuguguuguaaagccaacggacgaccguuuugcuacggcacuuacugcuuuaaacgauauggguaaggugcgcaaggauaucccucaaugggagccgucuaagggcuggaaugauuggcagcaaguuccguuuugcucacaccacuuccaucaauuaauaaugaaggauggccgagaaauuguaguucccuguaggaaucaagacgaauuagugggacgagcaaggguaagccaaggagcgggauggucucuacgugaaacagccugccuaggaaagucguaugcucaaauguggcaauuaauguauuuucauagaagggaccuuagacuugcagcaaaugcuauauguagcgcugugccgguaaauuggguaccuacgucgagaacgacguggucgauacaugcacaucaccaguggaugacaacagaggauaugcucucugucuggaacagaguauggauugaggagaauccuuggauggaggauaaaacacacguaucuucgugggaagauguaccauaccuggggaagcgagaggaucaaugguguggaucauuaauuggcuuaacagcucgcgccacgugggcuacgaacauucagguugcaaucaaucaaguccgccgacuuauaggaaaugaaaauuaucuggauuauaugacgucaaugaaaagauuuaaaaaugaaagugauccagaaggagcauuaugguaa

SEQ ID NO: 22115 - RNA, 9879 nt, Artificial Sequence
  derived and/or modified CDS sequence (opt6) from DENV-1__KM403582__SS-prME
agcguaacaaugcuacucaugcuacuaccaacagcacuugcguuucaucuuacuaccagaggaggugaaccccauaugauaguuucuaaacaagaacgaggaaaaucgcuauuauuuaaaacgucagcgggugucaauauguguacucuuauagccauggaucucggagaauuaugugaagacacaaugacguacaaauguccccgaauaacagaagcagaaccugacgauguagacuguugguguaaugcaacggacacguggguaacauacggaaccuguagucaaacaggcgaacauagaagagacaggcgaagcguggcacuugcaccacacgucggauuagggcucgaaacgagaacagaaaccuggaugaguucagaaggcgcguggaggcaaauacaaagaguagaaacaugggcacuacgacacccuggauucacagugauagcacucuuuuuagcacacgcaauugggacgucuauuacacaaaaagggauaauauuuauucugcuaaugcuugucacaccuucaauggcgaugcguuguguuggaauugggaacagggauuuuguagaaggcuuaucuggggcuacuuggguugacguuguacucgaacaugguagcugugugacuacuauggcuaaaaauaaaccaacgcuagacauagaacuauuaaaaacugaagugacuaaccccgcuguuuugagaaaacucuguaucgaagcuaaaaucagcaauacaacuacggacagccgaugucccacgcaaggggaagcaacgcuaguugaagaacaagaugcaaauuucguauguagacguacguuuguggaccgggggugggguaaugguugcggucuuuuuggcaaagguucgcuacugaccugugccaaauuuaaaugcguaacgaaguuagagggaaaaaucgugcaauaugaaaaccugaaauacucggugauuguuacaguucacacaggugaucaacaucaaguaggcaaugaaacuacggagcaugggacaaucgccacaauuacuccacaagcaccaacaagcgaaauucaauuaacagacuauggugcacuaacucuugauugcagcccuagaaccggauuagacuuuaaugaaaugguacuguuaacuaugaaagaaaaaucaugguuaguacauaaacagugguuuuuagaucuucccuuaccguggacuagcggcgcaucaacaucacaagagacauggaacagacaggaccucuuaguaacuuucaaaaccgcacaugcuaagaaacaagaggugguuguguugggaucacaagagggagcuaugcacacugcuuuaacaggagcuaccgagauccaaacaucugggacaacuacaaucuucgcaggucacuuaaaauguagacuuaaaauggacaaacuaacuuuaaagggcguguccuauguaauguguacagguucguucaaacucgaaaaggagguggcugaaacucaacaugggacuguuuugguucagguuaaguaugaaggaacagaugcacccugcaaaauaccgauaucuacucaagacgaaaaaggagucacacaaaaugguaggcuaauuacggcuaauccaauaguaacagacaaggaaaaaccuguuaacauugaaacugaaccgccauuuggagaaucguauauagugaucggcgcaggagagaaagcucuaaaauugucuugguuuaagaaaggaucuucaauagguaagauguuugaagcuacugcucggggagcaagacguauggcaauacuaggagauacugcuugggacuucggauccauuggcggaguuuuuacaagcgugggaaaacucguucaucaaguauuugguaccgcauaugguguuuuauucucuggaguaaguuggacaaugaagaucgguauagggauauuguuaacauggcuuggccuuaauucucgaagcacaucucuuucgaugaccuguauugcggucgguaugguaaccuuauacuugggaguaaugguucaagcggauagcgguugcguuaucaacuggaagggacgggaauuaaaguguggaaguggcauauucguuacaaacgaaguacacacauggacagaacaauacaaauuucaagcagauucaccaaaacgacucucggccgcaauuggaaaagcaugggaggaaggggucugcgggauaagaucgacaacaagguuagaaaauaucauguggaaacagauaucaaaugaauugaaucacauauuacuggagaaugauaugaaauucacaguaguuguaggagaugccaauggaauacuuacucaggguaagaaaaugauucguccccaaccuauggaacauaaauauucuuggaagaguuggggaaaagcgaaaauaauuggugcggauacacagaauacuacauuuauuauugaugguccugauacuccggaaugcccagaugaccaacgagcauggaacauuugggaaguagaagacuaugguuucggcguauucaccacaaauauauggcuaaaacuucgcgacucguauacacagaugugcgaccauagauugaugagugccgcaauaaaggacucuaaagccguccacgcugauaugggguauuggaucgaaucugagaaaaaugagacauggaagcucgcgcgagcaucauucauugaaguaaaaaccugcaucuggccucgcucucacacguuauggaguaacggggucuuagagucagaaauggugauuccgaaaauauauggcggacccauaagccagcacaacuaccgcccuggguacuuuacccagaccgccgggccguggcaccuggggaaauuggaacuugauuuuaaucuaugcgaaggcacgacuguuguaguagaugaacacugugggaauagagguccuucucugagaacgaccaccgugacaggaaaaauaauucaugaguggugcuguaggucauguacacuaccaccauuacgauuuagaggugaggacggaugcugguauggaauggaaaucagaccaguaaaggaaaaagaagaaaauuuaguucgaucaaugguaagugccggcaguggagaaguggacucguucucucucggauuauuaugcgucucuauaaugauagaagaaguaaugagaagucgguggaguaggaagaugcuaaugacaggcacccuagcaauauucuuucuccucauuauggggcaacuaacauggaacgaccucauuagacuuuguaucaugguaggagcaaacguuucugaccgaauggggauggguacaaccuaucucgcucucauggcgacuuuuaaaaugagacccauguucgcagugggacuguuauuucgaagacuaacuucucgagagguucuauuauuaacuauaggacucucccuagucgcaucuguagagcuaccaaacagcuuagaagaacugggagauggauuagccauggggauaaugauguuaaaacuuuugaccgacuuucaaucgcaccaacuuuggacuaccuuauuaucauuaacuuuuaucaaaacaacuuuaucuuuggauuaugcauggaaaacuauggccaugguacucucuaucguaagucuuuucccccuaugucuaucgaccacuucgcaaaagacgaccugguuacccguuuuacuaggcaguuucgguuguaaaccauugacaauguuucuuauaaccgagaacaaaaucuggggaaggaaaucauggccgcucaaugaagguauaauggcaguuggaauaguaagcauccuauuaaguuccuuacuaaagaaugaugugccauuagcugguccuuugauagcggguggaauguuaaucgcauguuauguaauaagcggaucuagugcggaucuaucacuagagcgugcugcagaagugucuugggaggaagaagcagaacauucgggagccucccauaauauauuggucgaaguccaagaugauggcacgaugaaaaucaaagaugaggagcgugaugauacauuaaccauauuauuaaaagcaacacuccuagcaguuaguggcguguauccuaugagcaucccagcaacccuauucguaugguauuucuggcagaaaaagaaacagaggucaggaguauugugggauacuccgaguccaccggaaguagaaagagcaguacuugacgaugggauuuauagaauacugcagaggggauuacuaggccgaucacaaguaggcguggguguguuccaagaugguguauuccauacuauguggcacguaacucgaggugcuguauugauguaccagggcaaaaggcuugaaccaaguugggccaguguuaagaaagaucucauaucauacggcgguggauggagguuucagggauccuggaauacaggagaagaaguucaaguaauagcaguagaacccggcaaaaaccccaaaaacguccaaacuacgccggggacauuuaagacuccugaaggggaaguaggagcaaucgcuuuagacuucaaaccagggacuucaggaucaccaaucgucaaucgggagggaaagaucguaggacuauauggaaauggcguagugacgacguccgggacuuauguuuccgccaucgcgcaagcuaaagcaucacaagaaggaccacuaccggaaauagaagacgaagucuucaaaaagagaaacuuaacaauaauggaucuucacccuggaucagguaagaccagaagguauuugccggcaauuguucgugaagcaaucaaacguaaauugagaaccuuaauauuagcaccaacuagaguaguagcgucggaaauggcggaagcauuaaaggggaugccuauccgauaccaaacaacggcgguaaaauccgaacacacuggaaaggaaauaguggaccuaaugugucacgcaacuuuuaccaugcgacuccuaucgccaguaaggguaccaaauuacaacaugauaauaauggaugaagcgcauuuuacugaucccgcuagcaucgcagcaaggggauacauaucuacacguguagguaugggagaagcugcagcaauuuuuaugacagcaacaccaccaggaucagucgaagccuucccacaaucuaaugcaguuauccaagaugaagaaagggacauuccagaaaggaguuggaacucuggauacgacuggauaacagauuuuccaggcaaaacugucugguucguuccgaguauaaaaucagguaaugauauugcaaacugccuacggaaaaacggaaaaagaguuauucagcuauccagaaagacuuucgacacagaauaccagaaaaccaaaaacaaugacugggauuauguaguaacuaccgauauaucugaaaugggcgccaacuuucgcgcagauagaguuauagauccacgcagaugucugaagccaguuauucuuaaagacggaccggagaggguuauacuagccgggccuaugcccgucaccgcagccucagcagcccaacgucguggaaggauaggaaggaaucagaauaaagaaggugaucaauacauuuauaugggacaaccacuuaacaaugacgaagaccaugcucauuggacugaagccaagaugcugcuagauaacauuaauacuccugaaggaauuaucccggcacuauucgagccagagcgggaaaaaucugcagcaaucgauggggaauaccguuuaaggggagaggcacgaaaaacguuuguggaacugaugagacgcggcgauuuaccgguauggcuaaguuauaaaguggcaucagaagguuuccaguacagugauaggagaugguguuuugauggagaaaggaacaaucaaguauuagaagaaaacauggauguugaaaucuggacaaaagaaggggagaggaagaaacuucggccacgguggcuagaugcacguacauacagcgacccuuuggcucugcgugaguucaaagaguucgcagcgggcagaagaagcguaucaggggaccugauucuagaaauagguaaacuuccucaacaccuaacauugcgggcccaaaacgcgcucgauaauuugguuaugcuacauaauucagaacagggcggaaaagcauacaggcacgcaauggaagaacuacccgacacaauugaaacacuaaugcuacucgcauuaauagcaguucuuacaggcggaguaacauuauucuucuuaagcgguaaaggucucggaaagacuuccauaggacuacuaugugugauggccaguuccguauuauuauggauggcgucgguagaaccccauuggauagccgcgucaaucauacuagaauuuuucuuaaugguacuacuuauucccgaaccggaccgucaaaggacgccgcaagauaaucaauuagccuacgucgucauuggacuacucuuuaugaucuugacuguagcagcaaacgaaaugggcuuacuagaaacuacuaagaaagaucuagguauagggcaugugguagcagagaaucaucaucaugcuacaaugcuugacauugauuugcaucccgcaagugccuggacgcuuuacgcuguagcuacuacaauaaucacgccaaugaugagacauacaauagagaauacgacugcaaacaucucguuaaccgcaauagcaaaucaagcggcaauucucauggggcuagauaaaggauggccaauaaguaaaauggacauaggaguaccacuguuagccuuaggauguuacucacaagucaauccauugacucuaacggcagccguccuaaugcuuguagcccacuaugcaauuauugguccuggguuacaagcaaaagcuacucgcgaggcucagaaaagaacagcagcaggcauaaugaagaauccaacagucgaugggauuguggcgauugaucucgauccugucguauacgaugcgaaauuugagaaacaguuaggucaaauaauguuauuaauauuaugcacuucgcaaaucuuauugaugcguacgaccugggcuuugugugaaagcauaacgcuggcaacaggaccacuuaccacauuaugggaagggaguccuggaaaauuuuggaauacuaccauagcaguaagcauggcaaauaucuucaggggaagcuacuuagcgggagcugggcuagcguuuucauuaaugaaaagccuaggcgggggcagacgugggacuggugcgcaaggagagacacugggugaaaaauggaaacggcaauuaaaccagcugucaaagagcgaguucaauacguacaagagaucuggaaucauggaagucgaccgauccgaagcaaaagaaggucucaaacguggcgaaacuaccaagcacgcagugagucguggaacagcaaaauuacgcugguuugucgaaaggaauuuaguuaaacccgaaggaaagguaauagauuuaggcuguggacguggagguuggucauauuauugugccggacugaagaaggugacggaaguuaagggcuauacgaaagguggaccgggacaugaagaaccgauucccauggcgacguacgguuggaauauaguaaaauuacacucaggucgagacguauucuuuacaccaccagaaaaaugugacacgcuucuuugugauauuggagaaucaucaccaaacccaaccauugaagaggggagaacauuacgugucuuaaaaauggucgaacccuggcugcgagguaaucaguuuuguauaaaaauccugaauccuuauaugccaucaguagucgaaacacuugagcagaugcagcggaaacacgguggaauguuaguuaggaacccucucagcagaaauuccacucaugaaauguauuggguauccugugguacaggaaacauagucucagccgucaacaugacaucccggauguuacuaaacagguuuacaauggcacacaggaagccaacauaugagcgagauguagauuuaggagcaggaaccagacauguagcaguagaaccugaaacugcuaacuuagacaucauaggacagcgcaucgaaaauaucaaaaacgaacauaaaucuacuuggcauuacgaugaagauaauccguacaaaacaugggcauaucaugguuccuacgaaguaaagccgucaggaucugcgucaucuaugguaaaugggguaguccgauuauuaacaaaaccgugggauguaauaccuauggugacccaaaucgcaaugacagauacaacaccguuuggacaacaaaggguuuuuaaagaaaagguagauacacgaacuccaaggccuaaaagaggaacagcucaaaucauggaaguuaccgcaaaauggcucugggguuuucuuucaagaaacaagaaacccagaauauguacaagagaagaauuuacaagaaaagugaggucaaacgcugcuaucggugcuguauuugucgaugaaaaucaguggaacucugcaaaagaagcaguggaagaugagagauuuugggaccuugugcauagagaacgagaacuacauaaacaagguaagugugcaacguguguauacaacaugaugggaaagagggagaagaaauuaggugaauuuggaaaagcaaaaggaagcagagcaauaugguacauguggcucggagcuagauuuuuagaauuugaagcccugggauuuaugaaugaggaucauugguuuucccgagaaaacagccuuucaggcguagagggggaaggucuacacaaauuaggauacauuuuaagggauauuaguaagauaccaggagguaauauguacgccgaugauacugcagggugggacacucggauuacggaagaugaccugcaaaacgaagcuaaaauaacagacauaauggaaccagagcacgcacugcuagcuacaagcauauucaaacuuacauaccaaaacaaaguugugcgcgugcaacggccagccaaaagcggcacaguaauggacgucaucaguagaagagaccaaagaggaucaggacaggucggcacauauggacuaaacacuuucacuaacauggaaguucaguuaaucagacagauggaauccgaaggcauauuuucuccuagugaauuggaaaauagcaaucuggccgaaagaguuuuagauuggcuagagaaacacggaguagagcgacuaaagaggauggcaauuaguggagaugauugugucguaaagccaacugaugaucgauucgcgaccgcuuuaaccgcccucaaugacauggggaagguaagaaaagacauuccucaaugggaaccaucgaaaggcuggaaugacuggcaacaagucccuuucugcagccaccauuuucaucaguuaaucaugaaagacggcagagaaauuguuguaccauguagaaaucaagaugagcuagugggacgcgcaagggucucucaaggggcagguuggucccuacgugaaacagcuugccucgguaaaucuuacgcccaaauguggcaacuaauguauuuucaccgacgagaccugcggcuagccgccaacgcuauauguucugcggugccgguaaauuggguccccacaucacguacaacuuggucaauacaugcucaucaccaauggaugacaacugaggacauguuaucaguauggaaucgaguauggaucgaagaaaacccuuggauggaggauaagacccaugugucaagcugggaagacguaccauaucuugggaaaagagaagaccaauggugcgguagucuaauaggauuaacugcucgagcaaccugggcaacuaauauacaaguagccauuaaucaaguucgaagauuaauuggaaacgaaaauuauuuagacuauaugaccucuaugaaaagauuuaagaaugagagugauccagagggagcuuuaugguag

SEQ ID NO: 22116 - RNA, 9879 nt, Artificial Sequence
  derived and/or modified CDS sequence (opt6) from DENV-1__KM403577__SS-prME
ucuguaacaaugcuuuuaauguuauugccgacugcacuagcguuucaccugacaacuagagguggagaaccacacaugauaguuucaaaacaagaacgagguaagagcuuacuuuuuaaaacuucagccgguguuaauaugugcacucuuauagcaauggauuugggugaauuaugugaagauacgaugacuuauaaauguccuaggauaacugaagcagaaccugaugacgucgauugcugguguaaugcaacagacaccuggguaacuuauggaaccuguucucaaacaggugaacauaggagagauaaaagauccgucgcauuagcgccucacguaggacuuggacuugaaacaagaacggaaacauggaugucuagugaaggagcauggagacaaauacagaaaguagaaacgugggcauugagacauccagguuuuacgguaaucgcauucuuuuuagcacaugcaauaggaacuucaauuacacaaaaagguauaauauucauacuguuaaugcugguaacgcccaguauggcaaugcggugugucggcaucgguaacagggauuucguggaaggccuguccggggccacguggguugacguuguguuagaacaugggaguugcgucaccacaauggccaaaaauaaaccuaccuuagauauagaacuucuaaaaacagaaguuacaaacccugcaguuuugcgcaaauuauguaucgaagccaaaauaagcaacacuacaacagauagccgaugucccacacaaggagaggcaacccuaguagaagaacaagaugcaaauuuuguauguagacggacuuuuguagauagaggaugggggaauggauguggcuuguuugguaaaggcaguuuauuaacaugugcuaaauuuaaauguguaacaaaacuagaagggaaaauaguacaauaugagaaccuaaaauauagcgugauaguaacuguccauacgggagaucaacaucagguaggaaacgaaaccaccgaacacggaaccauagcuaccaucacuccccaagccccaacaucagaaauccaacugacugauuacggcgcauugacccuugacuguucaccuagaacuggauuagacuuuaaugaaaugguucuucuaacaaugaaagaaaaaucuuggcucguacacaaacaaugguuucuagauuuaccacuuccuuggacaaguggugcauccacuucucaggagacguggaaucgacaagauuuauuaguaacauuuaaaacggcccacgccaagaaacaagaaguuguuguucuagggucccaagaaggagcaaugcauacugcacuuacaggggccacugagauccaaacuagcggcacaaccacaauauuugcaggacaccucaaauguagauuaaaaauggauaaacuaaccuuaaagggcguauccuauguaauguguacagggucauucaaacuagagaaggaaguggcggaaacacagcaugguacuguauuagugcaaguuaaauaugaaggaacagacgcgcccuguaaaauacccauaucaacucaggaugaaaaaggaguaacccaaaaugguagacuuauaacagcuaauccaaucgugacagauaaagaaaagcccguaaacaucgaaacggaaccgccuuuuggggaaaguuacauaguaauaggugcgggugagaaagcucucaaauuaucaugguuuaagaaggggaguucaauuggcaaaauguucgaagcuacagcuagaggagccaggcggauggcgauccucggggacacugcaugggauuuuggaaguauaggagguguuuucacaucagucgguaaauuaguccaccagguauuuggcacugcuuacggcguuuuguuuucugguguaagcuggaccaugaaaauaggaaucggaauacuguuaacuugguuaggauuaaacucaagaucuacgagccuuaguaugacaugcauagcuguugguaugguuacguuguacuuagggguaaugguucaagcagauucagguugcguaaucaacuggaaaggcagagagcuuaaguguggaaguggaaucuuuguaacaaacgagguccacaccuggaccgaacaauauaaauuucaggcggauaguccaaagcgacuuagugcagcaauugguaaagcaugggaggaggguguaugcgguauucggagugcaacaagauuagagaauauuauguggaaacagaucaguaacgaacuaaaccauauacugcuagagaaugacaugaaauuuacugucguuguaggggaugcaaauggcauauuaacucaggggaagaaaaugauccgaccacaaccgauggaacauaaauacaguuggaaaucguggggaaaagccaagaucauaggcgcagauacacaaaacacaacuuuuaucaucgacggcccagauacucccgagugcccugaugaccaaagagcuuggaauauaugggaaguagaagauuauggauuuggaguuuuuacgacuaacauuugguuaaaacuacgugacaguuauacacaaaugugugaccacagguuaaugagugcagcgauaaaagacuccaaagccgugcaugcagauaugggguauuggauagagagugagaaaaaugaaacuuggaaauuagcacgagcaucauuuauugagguuaagacauguaucuggcccagaagccauacacuuuggucaaacggaguauuagaaucagaaaugauaauaccgaagauauauggcggaccgaucagucaacauaauuauagaccuggauauuucacucagacggccggccccuggcaucucgguaaauuagaauuagauuuuaaucuaugcgaagguacaacaguaguuguggaugagcauugcgggaauagagggccuucacuacgaacuacaaccguaaccgggaaaauuauacacgaaugguguuguagaaguuguacacuacccccgcuuagauuuagaggcgaggauggaugcugguauggaauggaaauacggcccgugaaagaaaaagaagagaacuuaguuagauccauggucuccgcagguucaggugaaguugacucuuuuaguuuggguuuauuaugcguaaguauaaugauagaggaagugaugaggucacguuggucuaggaaaauguugaugacugggacucuugcgguauucuuuuuauuaauaaugggucaacuuacauggaacgaccuaauuagguuaugcauuaugguaggagcaaaugugucagaccguauggguauggguacaaccuauuuggcuuuaauggcgacauuuaaaaugcguccaauguuugcggugggauuacuauuccggagacucaccucaagagaaguauuauuauugaccauaggucuuagucuuguggcaaguguagaauuaccgaauagccuagaggaacuuggagauggguuagcuaugggcauaaugaugcucaaauuacugacagacuuccaaucacaccaauuauggacuacucuauuaagccugacauuuauaaaaacgacguuaucuuuagacuaugccuggaaaacgauggcaaugguucugucaauuguaucuuuguuuccguuaugucucucaacgacaagccagaaaaccacgugguugccagugcuccuaggaucauuuggauguaaaccuuuaaccauguuucucauaacugaaaauaagauauggggcagaaaaucuuggccacuaaacgagggcauaauggcaguuggcaucgucucuauauuacucaguucgcuacuuaagaaugaugucccguuagcuggaccauuaaucgcuggagguaugcuuaucgcguguuacguuauauccggcucaagcgcugauuuaagucuagagagggcggcugaaguaagcugggaggaagaggcggaacacaguggcgcgucccauaauaucuuagucgaaguucaagaugaugggacuaugaaaaucaaagaugaagaaagagacgauacauuaacaaucuuauuaaaagccacauuauuagccguaucuggaguauaucccaugucaauuccugcuacccuauuugucugguacuucuggcaaaagaagaaacaacgcucuggcgucuuaugggauacaccaagucccccggaaguagagagggcagugcuugaugacgguauuuaccgcauacuacaacguggauuacuaggucgaucacagguuggaguagguguguuccaagacggaguauuccacaccauguggcauguuacccgaggagcaguuuuaauguaccaaggaaaacgccuagagcccucaugggcaagugucaaaaaggaucuuauaaguuacgguggaggguggcguuuucaaggaucguggaauacuggagaagaaguucaaguaauagcaguagaaccagguaagaauccuaaaaacguucaaaccaccccuggaaccuucaaaacuccggaaggugaagugggugcaauugcauuagacuuuaaaccagguacgucaggauccccaaucgugaauagagaagggaagaucguaggccuauacgggaacggaguuguaacuacaucaggcacauaugucuccgcuauagcacaagcaaaggcuucucaggaaggaccacuaccugaaauagaggacgaaguuuucaaaaagagaaaucucaccauuauggaucuucaucccggaucuggaaaaacuagaagauauuugccggccauaguuagagaagcaauaaaaagaaaacuaagaacacuaauacuugccccgacucgugucguggccagcgaaauggcggaagcccucaaaggcaugccaauacgauaucagacaacagcgguuaaauccgaacauacuggaaaagaaauugucgauuuaaugugucaugcaaccuuuacuaugcgauugcuuagcccuguaagggucccaaacuauaauaugauaaucauggaugaagcacacuucacagauccugcuucuauugcugcuagaggcuacauuucaaccagagucgguaugggagaagcagcagcuauuuuuaugacugcuacaccuccaggaagcguagaggcuuuuccgcaaagcaaugcuguaauacaggacgaagaacgagacaucccugaaagguccuggaauagcggguacgauuggaucaccgauuuuccagguaaaacaguaugguuugucccuucaauuaaaucggggaacgauauugcgaacugucuccgcaaaaacgggaaaagaguaauacaauuguccaggaagacguuugacacagaauaucagaaaaccaaaaacaaugacugggauuauguagugacaacagacauaucagagaugggugcaaacuuuagggcugauagagugauagauccacggcgauguuuaaaaccaguuaucuuaaaggacggaccugagagagugauauuagcgggcccaaugcccguuacagcagcgucagcugcacagagaaggggacggauaggacgaaaucaaaauaaagaaggggaucaguauauauacauggggcaaccuuuaaacaaugacgaggaucacgcacauuggaccgaggccaaaaugcuacuagacaauauaaacacaccugaagguauaaucccagcccuauucgaacccgaaagagagaaaucggcugcgaucgacggagaguacagacuuagaggagaagcacguaaaacuuuuguagagcucaugcguagaggcgaccuuccaguguggcuaaguuauaaaguagcgucagaaggguuccaguacuccgacaggagauggugcuuugauggagaacguaacaaucaagucuuagaagaaaauauggauguagaaauauggacgaaggagggagaacguaagaaauuaagaccuagaugguuagaugcacgcacuuauuccgacccguuagcguuacgagaauuuaaggaauuugccgcaggacgaagaucaguaaguggcgauuugauccucgaaauaggaaagcuaccacaacauuuaacauuacgggcacagaacgcacuagacaacuuagugaugcugcauaauucugagcaaggagguaaagccuauaggcaugcgauggaggaguugccagacacgauagaaacucuuauguuacuagcacucauagccguuuuaacgggaggggucacuuuauucuuuuuaagcgggaagggacugggcaagacauccauaggcuuacuauguguaauggcgagcucaguuuugcucuggauggcuucaguugaaccucauuggaucgcagcaagcaucauacuggaauuuuuccuuauggucuugcugauaccugaaccagauaggcagcguaccccucaagacaaccagcuugccuauguuguaauagggcuacuguuuaugaucuuaacuguagcggccaacgaaauggguuuacuugaaacgacuaagaaagaucucgguauuggucacguagucgccgaaaaucaccaucaugcaacuaugcuugauauagaucuucauccagcuucugcauggacgcucuacgcugucgcaaccacuaucauuaccccuaugaugaggcauacaauugaaaauaccacggcaaauauuaguuuaacggcaauugcgaaucaagcagcgauucuaaugggcuuagauaaagguuggccuauaucaaaaauggauauuggggugccacuacuagcccugggcuguuacagucagguaaauccauuaacauuaacagcagcggugcugauguuaguggcucauuaugcuauaauaggucccggauuacaagcuaaagccacacgugaagcgcagaaacggacugcugccgguaucaugaaaaauccgacugucgaugguauuguagcuauagacuuagauccgguaguauaugaugcuaaauucgaaaaacaauuaggucaaauuaugcuucuaaucuuaugcaccucacaaauuuugcuaaugaggacuacuugggcauugugugaaucaauuacauuggcuacagguccacuaacaacccuuugggaagguucaccagggaaauucuggaauacaaccauagcaguaagcauggcaaacauauucagaggcucuuauuuagccggcgcaggacucgcauuuagucuaaugaagaguuuaggcggcggcagaagaggaacaggggcccaaggggagacguugggagaaaaauggaagaggcaacucaaccaacuaagcaaguccgaauuuaacacuuauaaaaggucuggcaucauggaagucgaccgcucggaagcaaaggaaggccuaaaaagaggggaaaccacgaaacaugccguaucgcggggaacggcaaaguuaagaugguucguagagcguaaccucguaaaaccugaagggaaaguaaucgauuuaggauguggcaggggaggcuggucguauuacugcgcuggccuaaagaaaguaacggagguuaagggguauacuaagggaggcccgggccaugaagaaccuauaccuauggcaacuuauggauggaauauaguuaaauuacacagcgggagagauguauucuuuacaccgccugaaaagugugauacccuguuaugcgacaucggagaaucgagcccaaaccccacaauagaggaaggucgaacacugcgaguguuaaaaaugguugaaccauggcuacgaggaaaccaauucugcaucaaaauauugaaucccuacaugccguccguugucgaaacuuuagaacaaaugcaacguaaacacggagguauguuaguuagaaauccuuuaaguaggaacagcacacacgaaauguacugggugucauguggcaccggcaauaucguaucagcagugaacaugaccagucgaauguuacuaaaucgguuuacaauggcgcauagaaaaccuacguacgagcgagacgucgacuuaggagcggggacgcgacacguugcugucgaacccgaaauugcuaauuuagauauuauuggccaaagaauagaaaacaucaaaaaugaacauaaaucuacuuggcauuaugaugaagauaauccuuauaaaacaugggcauaucauggaucauacgaaguaaaaccaaguggauccgcguccaguaugguaaacggcguugugcgauuacugaccaaacccugggauguuauucccaugguaacucaaauugccaugaccgauacuacaccuuucggacaacaaaggguuuucaaggaaaaaguggacacucgaacuccucgaccaaaaagaggaacagcucaaauuauggaaguaacugccaagugguuauggggauuuuugagucgaaauaagaaacccagaauuugcacuagagaagaauuuacucggaaagucaggaguaaugcugcuauaggagcuguauucguggaugaaaaucaauggaacucagcuaaagaagcggucgaagaugagcgauucugggaccucguacaccgcgagcgcgaauuacauaaacaaggaaaaugcgcaacauguguuuacaauaugaugggcaaacgagagaagaaacuuggcgaguuuggaaaggcgaaaggaagcagagcuauuugguacauguggcuuggugcaagauuuuuagaauuugaagcccuagguuucaugaacgaagaccauugguucucacgagagaacucucucucaggagucgagggagagggucuacacaaacuaggauauauucuaagggacaucagcaaaauaccaggagguaacauguacgcggaugauacagcggggugggauacucggauuacagaagacgacuuacagaaugaggcaaaaaucaccgacauaauggaaccugaacacgcacuguuagcgacgagcauauucaaauuaacauaucaaaauaaaguaguaagaguacagcgaccggcgaagucaggaacagugauggauguuauuucgcguagagaccagagaggcuccggacaaguugguacauauggguuaaacacauucacuaauauggaaguacaacuaauaagacaaauggaaagugaaggcauauucaguccuucagaacuagagaauagcaaccuagcagaaaggguauuagacugguuagagaaacauggaguagaaagacuuaagagaauggccaucaguggggacgauuguguuguaaaaccgacagacgaccgcuucgccacagcacuaacagcuuuaaacgauaugggaaaagucaggaaagauauuccacaaugggagccgagcaaagguuggaacgauuggcagcaaguaccuuuuugcucacaccauuuucaccaacuuaucaugaaggauggacgggagauaguuguucccugcagaaaucaggaugaauuaguagggcgagcuagaguuucgcaaggcgcuggauggagccuaagggaaacagccuguuuaggcaagucauaugcccaaauguggcaacuaauguauuuucacaggagagaucuucgucuggcagcaaaugcaaucugcucggcuguuccaguaaauugggucccuaccucacgaacgacaugguccauacacgcgcaccaccaauggaugaccacagaagauaugcuaucgguauggaauagagucuggaucgaggaaaauccguggauggaagauaagacccauguuuccaguugggaagacguuccauaccucggcaaacgagaggaucaguggugcggcucacuaauagguuuaaccgcaagagcaacaugggcaacuaauauacaaguagcaauuaaccaaguccgucguuuaauugggaacgaaaauuacuuagauuauaugacauccaugaaaagauucaaaaaugaauccgacccugaaggagccuugugguaa

SEQ ID NO: 22117 - RNA, 9879 nt, Artificial Sequence
  derived and/or modified CDS sequence (opt6) from DENV-1__KM403631__SS-prME
ucaguaacuauguuacuaaugcuacuaccgacggcucuagcguuucaucuuaccacgaggggaggagaaccacauaugauagugucaaaacaagaacgagguaaaucccuauuauucaaaaccucggcuggaguuaauaugugcacuuuaauugccauggaucucggagaacucugugaagauacgaugacauacaaaugcccucgcaucacugaagccgaaccugaugauguagauuguugguguaaugcuacagauacuuggguaacauacggcaccuguagucaaacuggagaacauaggcgagauaaaagaaguguugcauuggcuccacaugucggccuaggacuggaaacacgaaccgaaacauggaugucaucagaaggugcauggagacaaauacaaaaaguugaaacaugggcacuuaggcacccaggguuuacaguuauagcuuuguuuuuggcacaugcaaucgguacaagcaucacacaaaaagggauuauauuuauuuuauuaauguuagugacuccuucgauggcuaugagaugcguuggaauaggcaacagagauuuuguagaaggucucaguggcgcaacuuggguagacguaguguuagaacauggaucauguguaacaacaauggcuaaaaauaaaccuacauuggauauagaacuauugaaaaccgaaguaaccaaucccgcaguucucaggaaacucugcauugaagcaaaaauuucgaauacuacuacagauucacguugucccacacaaggcgaagcuacacucguagaggagcaagaugcuaauuucguauguagacgaacuuuuguagacagagguuggggaaauggaugcgguuuauuuggaaaaggaucacuccugacuugugccaaauucaaaugcgugacuaaacuagaaggaaaaauuguacaauacgaaaaccucaaauauucuguuauagucacaguacacacaggugaucagcaccagguaggaaaugaaacaacagaacacggcacuauagccacgauaacaccacaagcucccaccagugaaauacaacugacagacuauggcgcacucacacucgauuguagucccagaacuggauuagauuuuaaugaaaugguucugcuuacaaugaaagagaaaagcugguugguacacaaacaaugguucuuagauuuaccacuuccuuggacaaguggugccucuacgagucaagaaacuuggaauagacaggaucugcuuguaacguucaaaacggcccacgccaagaaacaggaagugguaguguuagguucacaggagggagcgaugcacacugcacugacaggcgcaacugaaauccaaacaagugggacaacgacgauauucgcugggcaucuaaaaugcagacugaagauggauaaauuaacgcugaagggaguuagcuaugucauguguaccggaucauuuaaauuggaaaaagaaguugcugaaacucaacaugguacuguacuugugcagguuaaauacgaaggaacagacgcgccuuguaaaauaccaauaucgacacaagaugagaaaggaguuacccagaauggucgccuuauaacagcaaauccuauuguaaccgauaaagagaaaccuauuaauauagaaaccgaaccaccauuuggggagucauacauaguuauaggagcaggagaaaaggcuuuaaaacugucaugguucaaaaaggguucgucuauuggcaagauguuugaggcaacagcccgaggugcccgacguauggcgauacuaggagacacggccugggacuuuggcucaauaggaggcgucuucaccucgguagggaaguuaguccaucaaguguuugggacugcauauggugugcucuuuagugguguaaguuggacuaugaagauaggcauaggaauacuacuaacuuggcuggguuuaaauaguagguccacgucguugucaaugaccuguauagcaguagguaugguaacacuauaucucgggguuaugguacaggcugacucaggaugcguuaucaauuggaaaggaagggaacuaaaaugcgguagcggcauuuuuguaacaaaugaaguucacacguggaccgagcaguacaaauuccaagcugauucuccaaaaagauuaagugcagcgauagggaaggcuugggaagaaggagucugcgguaucaggucagccacgagauuagagaauauuauguggaaacaaauuucaaacgaacuuaaccauauauuguuggaaaacgauaugaaguucacggugguaguaggagacgccaaugguaucuuaacacaaggcaagaaaaugauuagaccccaaccuauggaacauaaauacaguuggaaaucaugggggaaagcuaaaauuauuggagcugauacacagaacaccacguuuauuauagauggacccgauacuccagaaugcccugacgaccaaagagccuggaacauaugggaggucgaggauuauggauucggcguauuuacaacgaauauauggcuaaaauuaagagacaguuauacacaaaugugcgaucauagauuaaugagcgcagccauaaaagauucuaaagcggugcacgcagauaugggauacuggauagagucugagaaaaaugaaacuuggaaacuugccagagccagcuuuauagaagugaaaaccugcauauggccaaggucucacacccuauggucaaauggggugcuagaauccgaaaugauaauaccgaaaauauauggaggaccgauaucacaacauaacuaucguccagguuauuuuacgcaaacugcagguccguggcaccuaggaaaacuugaguuagauuucaaccuuugugaaggaacuacaguuguuguagacgaacauugugguaaccguggacccaguuuacgaacgacuaccguuacaggaaaaauaauacaugagugguguugucgaucauguacgcucccaccuuuacgauucaggggugaagacggauguugguacggaauggaaauaagaccugucaaagaaaaagaagaaaauuuagugcgcagcaugguaucagcagguuccggagagguagauaguuuuucacucggacuucuaugugucagcaucaugauugaggaaguaaugagaucuagauggucaagaaagauguuaaugacagguacguuagcaguauucuuuuuauugauaaugggacagcuaacauggaacgacuugauccgucuguguauuaugguuggagcaaacgugucagacaggauggguaugggcaccacguacuuagcccugauggccacuuucaaaaugcgaccaauguucgcgguuggacuacuauucagaagguuaacaucuagagagguauuacuacucacgauuggacucucacugguggcgucaguugaacucccaaauucuuuggaagaguugggagauggucuagccauggguauaaugauguugaaacuauuaacggauuuucagucgcaucaacuauggacuacauuacucagcuuaaccuuuauaaaaacgacauuaagucuggauuaugcauggaaaacaauggcuaugguauugaguauaguaucucuguucccucuaugucuauccacuacgucacaaaagaccacauggcucccgguccugcuugguagcuucggguguaaaccucuuacaauguuucugauaacggaaaacaaaauaugggggaggaaaucuuggccacuuaacgaaggaaucauggcuguaggaaucguaaguaucuugcugagcucauuauugaaaaacgaugugccgcuagccggaccucuaauagcagggggaaugcuuauagcgugcuacgucaucucaggaaguuccgcagauuuaucauuggagcgggcugcggaaguaucuugggaagaagaggcggaacauagcggggcaagccauaacaucuuaguagaagugcaagacgauggaacuaugaaaauuaaagacgaagaaagggaugacacgcucacaauacuauuaaaagcaacauuauuagcuguaucggggguauauccgaugucuauuccggcaacauuauuugugugguauuuuuggcagaagaagaaacaaaggucaggcguccuuugggacacaccaaguccaccagaaguggaaagagcuguacuugaugaugguauauaucggauauuacaacgaggguuauuaggacgaucacaagugggcgucggaguuuuucaggaugguguuuuucauaccauguggcauguaacuaggggugcgguacuuauguaucaaggaaagcgacuagaacccagcugggcgucagucaagaaagauuuaauauccuauggaggugguuggcgcuuucaaggcaguuggaauacuggggaagagguacaagucauagcuguggaaccuggcaagaacccuaagaauguccaaacaacuccaggaacauuuaaaacacccgagggcgaaguuggggcgauagcauuagauuuuaaaccggguaccuccgguagcccuauuguaaaccgggaagggaaaaucguuggauuguaugguaauggaguugucaccacuagcggaacauaugugucugccauugcacaggcgaaagcgucccaagaagguccacuaccagaaauugaagaugagguuuucaaaaagagaaaucuuacuauaauggaccuucaccccggaucugguaaaacucgcagauaucugccggcaauuguuagagaggcaauaaaaaggaaacuaagaacacuaauacuagcuccuacacggguuguugcaagugaaauggcugaagcguugaagggcaugccaauaagguaccagacuacagcaguaaaaagugaacauacaggcaaggaaauuguugaccugaugugucaugccacguucacaaugcgauuauuaaguccggugcgagugccaaacuauaauaugauaauaauggaugaagcgcacuucacggauccagcaucaaucgcugcuagaggcuacauaucuacgagaguaggcaugggggaagccgcggcaauauuuaugaccgcuacaccaccagguuccguggaagcauuuccacagaguaaugcuguaauccaagaugaggaacgugauauaccugaaagaaguuggaacagcggcuaugauuggauuacagauuuuccagguaaaacggugugguuugucccaaguaucaaauccggaaaugacauugcgaauugucuccggaagaaugggaaacguguaauccaacuaagccgaaagacuuuugauacggaauaucagaaaacuaaaaauaacgauugggacuacgucguaacuacagauauaagugaaaugggagccaacuuccgagcggacaggguaauagauccacgaagguguuugaaaccagugauucuuaaagaugggccagaaagaguaauucucgcaggaccaaugccugugaccgcggcaagugcagcacaacgacguggucguauaggcagaaaccaaaacaaggaaggcgaucaauauauauauaugggucaacccuuaaauaacgaugaagaucaugcacauuggaccgaggcaaaaauguuguuagauaacauuaacacgccugaaggcaucauuccggcucuuuucgaacccgaacgggaaaaaucagcagcaauagacggggaauacagguuacgcggagaggccagaaagacguuuguggagcuaaugcgacggggagaccucccaguguggcuuaguuacaaggucgcaucggaaggguuucaauauucagaucgacgaugguguuucgacggagaaagaaauaaucaaguucucgaagaaaacauggaugucgagauauggacaaaggagggggaaaggaaaaagcuaagaccuaggugguuagacgcuagaacguauagugauccgcuagcucuacgagaauuuaaagaauuugccgcugguagaaggagugugucuggagaccuaauuuuagaaauaggcaaauuaccgcagcauuuaacucuccgagcucagaacgcucuugauaaccuagugaugcuucacaauucagaacagggugguaaggcuuacaggcacgcuauggaagaguuaccugauacaauugaaacucuuauguuacuagcauuaaucgcaguacucacuggaggagucacucuauucuuccuuucuggcaaaggacuagguaaaacuucaauagguuuacugugcguaauggcaucauccguccucuuguggauggcauccguagaaccgcauuggauugcagcaucaauaauuuuagaguucuuucuuaugguauuacuaauccccgaaccagaucggcagaggacuccccaagauaaccaacuagcauauguugugauaggauuauuauuuaugauacuaacaguugcggcuaacgaaaugggauuauuagaaacaacgaagaaagaccuaggcauagggcauguuguugcggaaaaucaucaccaugcgacaauguuggauauagauuuacaucccgccucggcguggacguuauaugcaguagccaccacaauuauaaccccaaugaugagacauacaauagaaaauacuacggccaacauaagccucacugcaauagccaaucaggccgcaauacuaaugggccuggauaagggcuggccaaucucaaaaauggauauaggggugccauuguuggcacucgggugcuauagucagguaaaucccuugacgcucacggcugcaguucugauguuaguagcacauuacgcuaucaucggacccggcuugcaagcuaaagcuacaagagaggcacagaaaaggacagcugcggggaucaugaaaaacccaacuguugauggaauaguggcaauugauuuagauccgguggucuacgacgccaaguuugaaaagcagcuagggcaaauaauguuguugauacuauguacuucccaaauacuauuaaugagaaccacgugggcacuaugcgaaucgauuacgcuggcgacugggcccuuaacaacuuugugggaaggaucacccggcaaauuuuggaacacaacgaucgcuguaucuauggccaacauuuuuaggggaucauacuuagcaggcgcgggguuagcuuuuucccucaugaaaucgcuaggggguggacgacgugguacaggcgcucagggagagaccuugggagaaaaguggaaaagacagcuaaaccaauugaguaaaagcgaauuuaacacuuacaaaagaucaggaauuauggagguggacagaucagaagcuaaagaaggucuuaaaagaggggaaaccaccaagcaugcggucucacggggaacagcgaaguugcgaugguuugucgaaagaaacuuaguaaaaccugaagggaagguuauagaucugggaugcggcaggggaggguggucguacuauugugcaggucuaaagaaagucacagagguaaaaggauauacaaaaggagggcccggucaugaagaaccaauacccauggcgacguauggguggaacauaguuaaauuacauagcggaagggacguguucuuuaccccgccagaaaaaugugacacacuacucugcgauauaggcgaaucaagcccaaacccuacuauagaggaaggccgaacacuccggguacuaaaaaugguagaaccuugguuacgaggaaaccaauucuguauuaaaauucuuaauccauauaugcccagcguaguagaaacacuugaacaaaugcaaagaaagcaugguggaauguuagucagaaacccccuaaguagaaauucuacacaugagauguauugggucaguugcggaacaggcaauauaguaagugcagucaacaugacgucacgaaugcuuuuaaacagauucacgauggcccaucgaaagccaacauacgaacgggacguggauuuaggagcuggaacgcggcauguggcgguggaaccagaaauugcaaacuuagacauuauaggucagcgaauugagaacaucaaaaacgaacauaaaaguacuuggcauuacgaugaagauaaccccuauaaaaccugggcguaccaugguucuuaugaagucaaacccucaggaucggcuucuaguaugguaaaugggguuguacgacuccuaacaaagccaugggaugucauccccaugguaacucagauagcaaugacagacacuacuccguuuggacaacagagagucuucaaagaaaaaguagacacgcgcacaccacggccgaaacguggaacugcccaaauaauggaaguuaccgcuaaguggcucuggggauuuuugagcagaaacaagaaaccacggauauguacccgcgaagaguucacaagaaaaguaagaagcaaugccgcuauaggugccguguuuguugaugaaaaucaauggaacucagccaaggaagcaguagaagacgagcguuucugggacuuaguucacagagagagagaauuacauaaacagggaaaaugugcaacaugcguuuacaacaugaugggaaagagagagaagaaacuaggugaguucgguaaagcaaaagguucaagagcaauaugguauauguggcuaggagcaagguuucuagaauuugaggcacugggcuuuaugaacgaagaucauugguucucuagggaaaauucuuuaagcgggguugaaggcgagggguuacacaaacuaggauacauacuucgugauauaucuaaaauaccaggagguaauauguaugcagacgauaccgccggaugggauacaagaaucaccgaggaugaccuccaaaacgaggcaaaaauaaccgacauaauggaaccagagcacgcacuuuuggcaacguccauauuuaaauugacuuaccaaaacaaaguuguucgagugcaaagaccagcuaaguccggaaccgucauggauguaauaucucgaagagaccaacgaggauccggccaggugggaaccuacggucugaacacuuuuacuaacauggagguacaacuaauccgucaaauggaaucagaagggauauuuucgccaagcgaauuagaaaauagcaaucucgccgaaagaguccuugauugguuagaaaaacaugggguagaacgacugaaaagaauggcaauaucuggcgaugacuguguagucaaaccaacggacgauagauucgcgacugcccuaacagcacuuaaugacaugggcaaggugagaaaagauauuccgcaaugggagccuucaaaaggguggaaugauuggcaacaaguaccguuuuguucgcaucauuuucaucaacuaauaaugaaagacggaagggagauuguuguucccuguagaaaccaagacgaacugguagggcgugccagagugucccaaggagcagguuggucccuaagagaaacagcaugcuuggguaaaucauaugcucaaauguggcaauugauguauuuucaucgccgagacuuaagacuagcagcaaaugcuaucuguagugcaguaccugugaauugggucccgacaucucgaacaaccuggagcauccacgcacaucaucaauggaugaccacagaagauauguuaaguguuuggaaucggguguggauagaagaaaauccuuggauggaggacaaaacacacguaaguucaugggaggauguuccauacuuaggaaagcgugaagaucaauggugcgggucgcucauagggcugacugccagagccacaugggcuacaaauauacaaguagcaaucaaucagguccgcagguugaucgggaaugaaaauuaccuagacuacaugacauccaugaaacgcuucaaaaacgaaucugaccccgaaggugcauugugguaa

SEQ ID NO: 22118 - RNA, 9879 nt, Artificial Sequence
  derived and/or modified CDS sequence (opt6) from DENV-1__KM403632__SS-prME
ucuguuaccauguuauuaauguuauugccaacggcgcuugcuuuucauuuaaccacccgaggaggugaaccacauaugauaguuucuaaacaagaacgcgguaaaucacucuuguuuaaaacgucggcaggaguuaacauguguacauugauagcaauggaucugggagaacucugugaagauacaaugacauacaaaugcccacgaaucacagaagcggaaccagaugauguugauugcugguguaacgcuacagacaccuggguaacauauggcacaugcucacaaacaggugaacauaggagagacaaacgaaguguugcccuagcgccccauguuggccuuggacuggaaacacgaaccgagacauggauguccucagagggagcauggcgccaaauucaaaaaguugagacgugggcacuucgacacccaggauucacuguaauagccuuauuuuuagcccaugccaucggaacaucaauuacacaaaaagguauuauauucauucucuugauguugguuacaccgucaauggccaugaggugcguuggaauaggaaacagagauuuuguagagggguuaaguggagcaacauggguagaugugguauuagaacaugguagcugcguuacaacuauggccaaaaacaaaccuacuuuagauaucgaauuguugaaaacagaaguaacaaauccggccguuuugcgaaaacuauguauugaggccaaaauaagcaauacgacaaccgauagcagaugccccacgcaaggagaagcaacccuaguagaggagcaagaugcaaauuucguuugucguagaacguuugucgaccguggauggggaaauggauguggccuauucgguaaagggucauuacuaacuugugcuaaauuucgauguguuaccaaacuugaaggaaaaaucguccaauacgaaaaccuaaaauacagugucauugucacugugcauacaggagaccaacaucaaguaggaaaugagacuacagaacacggaacuaucgcaacuauuacaccacaagcccccacaagcgaaauacaacucacagacuauggugcucuaacuuuggacuguaguccgaggacugguuuagauuuuaacgaaauggucuugcuaacuaugaaagagaaaagcuggcugguacauaaacaaugguuccuugaucucccgcuaccguggaccagcggugcuucuaccagucaagaaacguggaauagacaagaucugcucgucacguucaaaacagcccaugcuaagaaacaggaaguugucguucuaggaagucaagagggagcuaugcacacggcucuaacaggcgcuacagagauacagacaagcgguacgacuacgauauucgcuggacaucucaaauguagguuaaaaauggacaaacuuacacugaaaggaguuucauauguaaugugcacuggcucauucaaacuggagaaagaaguagcugagacacaacacggaacuguauuaguucaaguaaaauacgaaggaaccgacgccccauguaaaaucccuauuuccacgcaagacgagaaaggggucacacaaaauggaagauugaucaccgcuaaucccauagucacagauaaagagaagccaguuaacauagagaccgaaccgccguuuggcgaauccuauauuguuaucggagcgggggagaaggcacuuaaacuuuccugguuuaagaaagguaguagcauuggaaaaauguuugaagcaaccgcgagaggggcaagaagaauggccauauuaggugacacagcaugggauuuugguaguaucggcgggguuuuuacuucaguugggaaacuuguacaucaaguuuuuggaaccgcguauggugucuuauuuagugguguuucuuggacaaugaaaauaggaauaggaauccuauugacgugguuaggacuaaauucaaggucuacaucacuuagcaugacauguauagcgguuggaaugguuacucucuacuuaggaguaaugguacaggcugauucugguugugugauuaauuggaagggaagagaacuaaaauguggaucuggcauuuuuguaacaaacgaaguucacacauggacagagcaauauaaguuucaagcagauaguccgaagcgguuaagugcagcgauaggaaaagcgugggaggagggcguuugugggauucggagcgcuacacgacuagaaaauauuauguggaaacagauuucaaaugaacuuaaccauauacuauuagaaaaugacaugaaauucacagugguaguaggggaugcaaacgggauccucacccagggaaagaagaugauaagaccacaaccaauggagcacaaauacucauggaaaagcuggggcaaagcaaaaauaauuggggcagacacucagaacacaacauucauuauagaugguccagacacuccggaauguccagaugaucaaagagccuggaauaucugggaaguagaagauuacgguuuugguguuuuuaccacuaacaucugguugaagcuccgcgauucauauacccagaugugcgaccauaggcugaugagugcugcaaucaaagauucuaaggccguacaugccgauauggguuauuggauagaaucugagaaaaaugaaacauggaaacuagcuagggcaucguuuauagagguaaaaacaugcaucuggccgagaagccauacacuuuggucgaaugguguguuagaaucagaaaugauuaucccgaagauauauggcgggccaauaucacagcauaauuauagaccaggcuauuuuacccagaccgcaggaccguggcacuuaggaaaacuagaguuggauuuuaauuuaugugagggaacaacaguaguuguggaugaacacuguggaaauaggggaccauccuugagaacuacaacaguaacagguaaaauuauucaugaauggugcuguagaagcugcacauuaccaccucuccgauuuaggggagaagauggauguugguauggcauggagauaaggccaguaaaagagaaagaggaaaaucuaguuagaucaauggucagugcagguagcggagaaguagauaguuuuagucucgguuuauuaugcguaagcauaaugauagaggaggucaugcgaagccgguggucaaggaaaaugcugaugaccggcacacuugcuguauucuucuuacugauuaugggucagcuuacauggaaugauuuaauaagauuauguauuaugguaggagcaaacguuucugauagaaugggaaugggaacgacuuaucuugcguuaauggcaacauuuaaaaugcgaccaauguuugcaguuggccuccuuuuccgcagauuaacuagcagagaaguacucuuacuuacuaucggcuuaucccuaguggcgucugucgaacuuccuaacuccuuagaagaauuaggagacgggcuagcuaugggaaucaugauguuaaaacuucugacagauuuucaaucacaccaacuuuggacuacauuauuaagucuuaccuuuauaaaaacuacauugucacuugauuaugccuggaagacaauggccauggucuuaucgaucguuucuuuauucccuuuaugucuaucuaccacgucacagaaaacuacaugguuacccgugcuacuuggaucauuuggaugcaagccuuugacgauguucuuaaucacugagaauaagauauggggacgcaaaucauggcccuuaaacgaagguaucauggcgguuggaauagugucgauccuacugaguagccuauuaaagaacgauguuccgcucgccggaccauuaauagcaggcggcaugcugaucgccugcuauguaauaucuggcagcucggcugauuugagccuggaaagagcggcggaaguuaguugggaagaagaagcagaacacuccggagccucgcacaauauauuaguagaaguacaagaugacggcacaaugaaaauuaaagaugaagaaagagaugauacauugacuauacucuuaaaagcaacuuuauuggcugucucaggcguauacccgaugucuauaccagccacauuauuugucugguacuucuggcagaagaagaaacaaaggagugguguucuaugggacacacccucuccuccagagguugagagagccgucuuagaugaugggauuuaccgcauacuacaaagaggauuacuaggucgcagccaaguuggcguugguguauuucaagacgguguauuucauacgauguggcauguaacaagaggagcggugcuuauguaucaaggaaagagauuggagccuagcugggccucagucaagaaagacuuaaucagcuaugggggaggauggcgauuccaagguagcuggaauacuggugaggaaguccaaguaauagcaguagagccuggcaaaaacccaaagaauguucaaacuaccccgggaacuuuuaaaaccccagagggugaagucggcgcgauagcucuagauuucaaaccagggacuucaggaucgccaauaguuaauagggaagguaaaauagugggcuuguacgguaacggaguggugacaaccuccggcacauauguaucggcgauagcucaagcuaaagcgucucaagaagggccccuaccugagauagaagaugaaguauucaagaaacgaaacuugaccaucauggacuugcauccuggcucgggcaagacaagaagauaccucccagcaauagugagagaagcuauaaagcgaaagcuacgaacucuuauccuggccccuacacgaguaguagcaagugaaauggcagaggcucuaaaagggaugccgauuagauaccagacuacagcaguaaaaagcgaacauaccggaaaagagauaguugaccucaugugccaugcaacuuuuacuaugagacuacuauccccaguaaggguuccaaacuauaacaugauaauuauggacgaggcgcauuucacugauccugcaucgauugcagcacgagguuauauaagcacucguguaggaaugggagaagccgccgcaaucuuuaugacagcaacgcccccagguaguguagaagcguuuccgcaaucuaacgcagucauacaggacgaagaaagggauaucccagaacgaucauggaacucuggcuacgacuggauaacugauuucccaggaaaaacgguuugguuuguuccuucgaucaagucaggcaaugacaucgcuaauugccuaagaaagaacggaaaaagaguaauacagcuaucucguaaaacauuugauaccgaauaucagaaaaccaaaaacaacgauugggauuacgugguaacgacagacauaagugagaugggagcaaauuucagagccgacagaguuauagauccaaggagguguuugaagccagucauuuuaaaagauggaccggaacguguaauauuggcagguccuaugccuguaacugccgcuucggcugcacaacgcaggggacgaauaggaagaaaucaaaacaaagaaggagaccaguacauauauaugggacagccucuuaacaacgaugaggaccaugcacacuggacagaggccaaaaugcucuuagacaacauaaacaccccugaagguauuaucccugcucuauucgaaccugaaagagaaaaaucugcagccauugacggagaauaucgguuaaggggugaagcacgaaagacauucguugaguuaaugagacguggugaucuuccaguuugguuaucuuauaaagucgccucagagggauuccaauauagugauagaagaugguguuucgauggugaaagaaauaaccaaguccuagaagaaaauauggauguugaaauuuggacaaaagaaggugaacggaagaaauuacgaccacgaugguuggaugcuagaacauauuccgauccacuugcccugagagaauuuaaagaauuugcggcaggaagaaggaguguauccggggauuuaauucuugaaauuggaaaacuaccacaacaccuuacauuaagagcacaaaaugcguuggauaauuuaguaaugcuccauaacucugagcaaggaggcaaagcguaucgacaugcaauggaggaauugccugauacaauugaaaccuuaauguuauuagcucuaauagcugucuugacuggcgguguaaccuuauucuuucuaucaggcaaaggccucggcaaaacguccaucggacuccuuugcgucauggcaucauccguauuauuauggauggcaagcgucgagccacauuggauugcagcaucuaucauauuagaguucuuuuugauggucuuacuaauaccagaaccugaucgccaaagaacuccgcaagauaaucaacuugcuuauguaguaauuggacuuuuauucaugauucuaacaguugcagccaaugaaaugggguuauuagagacuacuaaaaaggacuuaggaauaggucacguuguugcugagaaccaucaucacgcgacaaugcuugauauugaucuucaucccgcgucagcauggacauuguaugccguagcaacaaccauaauaaccccaaugaugcgucacacaauugagaacaccacagcaaacauaagucuaaccgcgauagcuaaucaggccgccauucuuauggguuuagacaaggguuggccuaucaguaaaauggauaucggaguuccucuguuagcacuaggcuguuauagucaaguaaauccucucacgcuuacagcagccgugcugaugcuugucgcgcacuaugcuauuauuggcccgggccuacaagcuaaagcaacgagagaagcacagaagaggacugcggcugguauaaugaagaaccccacaguagauggcauuguagcaauagauuuagauccaguaguuuaugaugcgaaauuugaaaaacaauugggccagauaauguuacugauauuaugcaccucacagauuuuauuaaugcgaacuacaugggcauuaugugaaucaaucacucuugcuacaggcccuuuaacaacuuuaugggaaggaucacccgggaaauucuggaauacaacaauagcuguaucuauggcaaacauuuuccgaggaucauaucuugcaggagcaggacuggcuuucucccuaaugaaaucgcuaggcgguggaagaagaggaacgggagcccaaggcgaaacguuaggugaaaaauggaaaagacaauugaaucaauuaagcaagucagaauuuaauaccuauaaacggaguggaauaauggagguggaucggucagaggcaaaagaagguuuaaaaagaggggaaacaacuaaacaugcgguaucaagaggcaccgcuaaacuucgaugguucguugaaagaaauuuaguuaaaccagaaggcaaagugauugauuuagguugcgggagaggcggauggucuuacuacugcgcaggacuaaagaaaguuaccgaaguaaaagguuacaccaaaggcggaccaggucacgaagaaccuauucccauggcaacuuauggcuggaacaucgugaaauuacacuccggcagggacguauuuuucacaccaccagaaaaaugcgauacacuccuaugcgauauaggagaaagcucgcccaauccaacaauagaagaaggccgaacacuucguguucuaaagaugguagaaccauggcuaagagggaaccaguucuguauaaaaauacugaaucccuacaugcccagcgugguagaaacauuggaacaaaugcagcgcaaacacggcggcaugcuagucaggaauccuuuaagcagaaauucaacgcaugagauguacuggguaagcugugggacaggaaacauugucagcgcugucaacaugaccaguagaaugcuauuaaauagauuuacgauggcccaucgaaaaccuacuuacgaaagagacguugaucucggagcugguaccagacacguagcugucgaaccagaaauagcaaauuuggacauuauuggacagaggauagaaaacauuaagaaugaacauaaaagcacguggcauuaugacgaagacaaucccuauaaaacuugggcguaccauggaaguuaugaaguaaaaccuucggguagugcaucgucaauggugaauggagucguaaggcuacuuacaaagccaugggauguaaucccgauggucacacaaauagcuaugaccgacacgacacccuuuggacagcaaagaguguuuaaagagaaaguagauacaagaacuccccguccaaaacguggaacggcccagauaauggaaguuaccgcaaaauggcuuuggggcuuucuaagucguaacaagaaaccaagaauaugcacuagggaagaauuuacuagaaaaguacgaaguaaugccgccauaggugcagucuucguagacgaaaaccaauggaacucagcaaaagaagccgucgaggacgaaagauucugggaccuaguacaucgagaaagagaguugcacaagcaagguaaaugugcaacaugcgucuauaacaugauggggaaaagagagaaaaaguuaggugaguuuggaaaagcuaaagguucgagagcuaucugguauauguggcuaggagcaagguuccuagaauuugaggcacuaggauuuaugaacgaagaccacugguuuaguagagaaaauagucuaagcggaguagaaggggaaggguugcacaaauuaggguacauacuaagagacauaucuaaaauaccaggugggaacauguaugcugaugauacggcugguugggacacaaggauaacagaggacgaccuucaaaacgaagcaaaaauuacagauauaauggaaccggaacacgcauuacuagcuacaucgauuuuuaagcucacauaucaaaacaaaguagugaggguacaaaggcccgccaagagcggcacagucauggauguaauaucgagacgagaucaacgaggaaguggacaaguagguacauacgguuuaaacaccuuuacaaacauggagguacaauuaauacgucaaauggagagcgaggguaucuuuucgccaagugaacucgagaacucaaaucuagcagaacgcguauuagauugguuggaaaaacauggaguagagcgcuuaaaacgaauggcaauuucaggugacgauuguguagucaaaccuacggaugaucgauuugcaacugcuuuaacagcauuaaaugacauggguaaaguacgaaaggauaucccacaaugggaaccuucaaaaggauggaacgauuggcagcaaguuccauuuugcagccaucacuuucaccaauuaauuaugaaagacggccgcgaaauaguaguucccugucggaaucaagaugaauuaguggguagggccagaguaucccaaggugcaggauggagucugcgcgaaacagcuugucuagguaagucuuaugcacagauguggcaauuaauguauuuucaucgccgcgacuugcgacuagcugccaaugcuauuuguucggcgguaccugugaauuggguaccaacuucgcgcacuacguggaguauacaugcgcaucaccaauggaugaccacagaagacaugcuuaguguauggaaccggguauggauagaagagaauccuuggauggaggacaaaacucauguauccagcugggaagauguaccauaucuugggaaacgggaagaucaauggugugguucauugauugguuugacagcccgcgcgacaugggcaacgaacauacaaguugcgauuaaccaaguaagaagacuaauagggaacgaaaauuauuuggacuauaugacaucaaugaagagauuuaagaaugaauccgauccagaaggagcacuaugguaa

SEQ ID NO: 22119 - RNA, 9879 nt, Artificial Sequence
  derived and/or modified CDS sequence (opt6) from DENV-1__KM403583__SS-prME
uccguaacgaugcuacuaaugcuacugccgaccgcccucgccuuucacuuaacuacucgugguggagaaccgcacaugaucguuagcaaacaagaaagagggaaaagccuauuauucaaaacaagcgcuggugugaauauguguacuuuaaucgcuauggaucuuggugaacuaugcgaagauaccaugacauauaaaugccccagaauaacugaagcugaaccugaugauguagauuguugguguaaugccacugauacaugggucacuuacggaacuugcucacaaacuggugaacaucgccgcgaccggcgcaguguagcuuuagcuccccacguuggauugggauuagagacuagaaccgaaaccuggaugaguagcgagggagcuuggagacaaauucaaagaguugaaacaugggcacuaaggcaccccgguuucacuguuauugcucuauuucuugcacaugcgauagggacgucgaucacccaaaaaggaauaauauuuauacuacuaaugcucguaacgccgucaauggcaaugcgaugcgucgguauugguaacagggauuuuguagagggucugucaggugcaacuuggguagaugucguccuggagcauggaagcugcguuacgacgauggcuaaaaauaaaccaacccuagauaucgaauuacuaaaaacagagguaaccaacccggcggugcuaaggaaacuaugcauugaagccaaaauaagcaacacaacgacagauucucggugcccuacacagggugaggcaacauuaguggaagaacaagaugcaaauuuugucuguagacggacuuucguagaccggggauggggcaacggcugcggacucuucggcaaaggaagucugcuuaccugcgccaaauucaaauguguaacgaaacuagaagggaaaauaguccaauacgaaaauuugaaauacucaguaauuguuaccguacauacaggugaucagcaucaagucgguaaugaaacgacugaacauggcacuauugcuacgauuacuccgcaagcaccaacaagcgaaauacaacugacagauuauggagcucucacuuuagauuguagcccgaggacaggacuagauuuuaacgaaauggugcuuuugacgaugaaagagaaaucaugguuaguacauaaacaaugguuucucgaucuaccucuuccauggacaaguggagcaucaacuagccaagaaacauggaacaggcaagaucuucugguaacauucaaaacagcacaugcuaagaaacaagaagugguuguauuaggaucacaagagggugcuaugcacacugcacuaacuggugcuacggaaauacaaacaaguggcacaacgacgauauuugcggggcaccucaaauguagauuaaaaauggauaaauugacacuuaaagguguaucuuaugucaugugcacgggaaguuucaaacuagaaaaagaaguagcugaaacacaacacggaacaguucucgugcaagucaaauacgagggcacagaugcuccaugcaaaauaccaauuaguacacaagacgaaaaaggggucacccagaaugguagacuaaucacugcaaauccuauaguaacggauaaagaaaaacccguaaauauagaaacagagccuccguucggagaaaguuacaucgucauaggagcgggugagaaagcacugaaacuaaguugguucaagaaaggaaguaguauagguaaaauguuugaagcuacagcgcgaggugcgcgacguauggcgauuuuaggagauacugcgugggauuuugggucaaucggcggaguuuuuacaaguguagguaaauuaguucaucaaguuuuugguacugcuuaugggguacuauucucaggcguaaguuggacaaugaaaaucggcauugguauacugcuuacaugguuagggcuaaauucuagaucuacuucacuaagcaugacauguauagcggucgggaugguuacucuauauuuaggagugaugguccaagcagauucgggaugugugauuaauuggaaaggaagagaacuuaaaugcggaucaggaauauuugucaccaaugaaguacacacauggacugaacaguauaaauuucaagccgauucuccgaaaaggcuaagugcugccauagggaaggcuugggaggaagguguaugugguauucgaagugcaacuagguuggagaacauaauguggaaacaaauaucaaacgagcugaaccauaucuuacuagaaaaugacaugaaauuuaccguuguugugggcgaugcuaaugggauacuuacccaaggcaagaaaaugaucagaccacaacccauggagcauaaguacucauggaagucauggggaaaggccaaaauaauuggagcggacacacaaaauaccacauucauaaucgauggaccagacacaccggaaugcccagacgaccaacgagcauggaacauaugggagguugaagauuauggauuuggcguguucaccacuaauauuuggcuaaaauuaagggauagcuacacacagaugugcgaccacagacuaaugucggcugcaauuaaagacaguaaagcuguacacgcggacaugggcuacuggauagaaucagaaaagaaugaaacauggaaauuagcaagagcaaguuuuauugagguuaagacaugcaucuggccaagaucacauacauuauggagcaaugguguauuagaauccgagaugaucaucccaaaaauauacgguggaccaauaagccaacauaauuaccgaccuggcuauuuuacacaaacagcuggcccauggcauuuaggaaaauuggagcuagacuuuaaccugugcgagggaacuacuguugucguggacgaacacuguggaaauagagggccuucauuacgaacuacaaccgucacagggaaaaucauucacgaaugguguuguagaucuuguacgcuaccaccacuucgauuucguggugaagacgggugcugguaugguauggaaauaagaccaguaaaggaaaaagaagagaauuuaguacguucgauggugucagccggaucaggggaagucgacuccuucagucuagggcuauuaugugugucaaucaugaucgaagaggucaugagaucacgguggucaaggaaaaugcuaaugacggggaccuuagccaucuucuuccuacucauaaugggacaauuaacuuggaaugaucuaauaagauuauguauaauggugggcgcuaacguaucagacagaaugggaaugggaacuacguaucuggcacuaauggcaacuuucaaaaugcguccgauguuugccguaggacuccuuuucaggcgucugacuucaagggaaguguuguuacuaaccauaggucugagucuaguggcuuccguugagcuccccaacucacuugaggaauuaggcgacggccuugcaauggguauaaugaugcuaaagcuacuaacugauuuucaaucgcaccaacucuggaccaccuuauuaucacugacauucaucaaaacaacuuugucacuggacuaugcauggaaaaccauggcuauggugcugucgauugucagcuuauucccauuaugccugucaacaacaucacagaaaacaaccugguuaccgguucuucuuggaaguuuugggugcaaaccauugacuauguuucugauuacugagaacaagauuugggguaggaaaagcuggccuuuaaacgagggcauaauggcuguaggaauaguuucaauucuacuaucuucauugcucaaaaacgauguuccccuggcaggaccacugauugcaggaggaauguugauagcaugcuauguaauaucaggaagcagugccgaucuuucauuagaaagggcagcugaaguaucuugggaggaggaagcugaacauucgggagcaucacacaauauucuaguagaaguacaggaugauggaacaaugaagaucaaagaugaggaacgagaugauacccucacuauauuacucaaagcgacucuacuagcagugagcggaguauauccaaugucgauuccagccacauuguucguuugguauuuuuggcagaagaagaaacagcgcagcgguguauuaugggauacaccgagcccacccgaagucgaaagagcaguauuagaugaugggauuuauagaaucuugcaaagaggccucuuaggacgaucacaggucggagucggagucuuccaagauggaguauuccacacgauguggcacguaacaaggggagcaguacuuauguaucaagguaaaagacuggaaccuucaugggcaagugucaagaaagacuuaaucucauauggcggaggauggagauuucaagggucauggaauacuggggaagaaguucaaguaaucgcgguagagcccgguaaaaauccuaaaaauguccagacaacacccgggacauuuaaaacuccagaaggggaaguuggcgcgauugcucuagacuuuaaaccggguacaucuggcaguccuauugucaauagagagggaaaaauugucgggcuauacgggaacggcguuguaacgacuucaggaacuuauguauccgcaauagcacaggcgaaagcaucccaagaaggaccgcugccagagaucgaagaugaaguauucaagaaaagaaaucugacgauaauggaccuccaucccggcucagggaaaaccagaagauaucuacccgcgauagucagagaagcaauuaaacguaaauuaagaacucucauauuggcuccgacaagagucguugcuagcgagauggcggaagcauuaaaagguaugccaauacgcuaccaaacuacagcugugaaaagcgaacacacggguaaagaaauaguagaucuaaugugucacgcgacauuuacgaugcgucuucugucaccaguccgggugcccaacuauaauaugauaauuauggacgaagcccacuucacagaccccgcgagcauugcugcacgagguuauauaagcacuagaguaggcaugggagaagcugcagcuauuuucaugaccgcaacacccccaggaucuguagaggcuuuuccucaaagcaacgcagugauacaagaugaagaaagggauauaccagaaaggagcuggaacagugguuacgauuggaucaccgacuucccaggcaaaacaguuugguuuguaccuucaaucaaaagcgguaaugauauagcaaauugucuaaggaaaaauggaaaaaggguaauacaauuaaguaggaaaaccuuugacacagaauaccagaaaacuaaaaacaacgauugggauuacguagugacaacugacauuagugaaaugggugccaacuuuagagcugauagaguaaucgauccacgaagauguuugaaaccagugaucuugaaggacggaccugagcgugucauauuagccggaccaaugccaguaacugcagcaucugccgcacaacggagggggcgaauagguagaaaucaaaauaaagaaggggaccaauauauauauaugggccaaccacuaaauaaugaugaggaucaugcgcauuggacggaggcaaaaauguuacuugacaauauuaacacaccagaagguauuauuccagcauuguuugaaccagagcgggagaaaagcgcugcaauagauggggaauaucggcuccggggugaagcuagaaaaacauuuguagagcuaaugagacgaggugauuuaccaguuuggcuauccuauaaaguggcgagcgagggguuccaauacagugauagacgguggugcuucgacggcgaacguaauaaucaaguuuuagaagagaauauggacguugagaucuggacaaaagaaggugaaaggaagaaacuaaggccgcgauggcuggacgccagaacauacagugauccccucgcucuaagagaauuuaaggaauuugcugcagggcguaggucagugucaggugauuuaauauuagaaauuggaaaauuaccgcaacaccuaacacucagagcacaaaaugcauuagauaauuuaguaauguuacacaauagugaacaagggggaaaagcauauagacaugcuauggaagaacuaccugacacaaucgaaacccucaugcugcucgcauuaauagcgguccuuacgggagguguaacgcuguucuuuuuaagcggaaagggccuagggaaaacuucaauuggacugcuuugugucauggcuuccagcguucuauuauggauggcaucuguagaaccacauuggauugccgcaucuauuauauuggaauuuuuccuaaugguauuacuaauuccggaaccugauagacaaagaacuccgcaggacaaucaacuagcguaugucguuauaggauugcuauuuaugaucuuaaccgucgcggcaaacgagaugggacuguuggagaccacgaagaaagaucuaggcauuggucauguaguugccgagaaucaccaucaugccacgauguuagacauagauuuacauccagcgucugcguggacacuauacgccgucgcgacuacuauuauaacuccaaugaugagacacacuauagagaauacuacagcgaauauaagucuaacagcgauugcaaaccaagcagcaauccuaaugggauuggacaaagguuggccaaucagcaaaauggauauuggcguacccuuauuagcgcucggaugcuacucacagguuaauccgcugacguugacagcagccgugcuuaugcuaguagcucacuaugcuauuauaggcccgggauuacaagcaaaagcuacaagggaagcacagaaaagaacagcggcaggaauuaugaaaaauccaacaguagacggaauuguagcgaucgaccuggauccaguaguguaugacgcaaaauucgaaaaacagcuuggccagauuaugcugcuuauacuauguacaagucaaaucuuacuaaugagaaccacaugggccuuaugcgaaagcauuacccuggcaacgggcccacucacaacauuaugggaagggucaccaggaaaauuuuggaacaccacuauugcuguuuccauggcgaacauauucagagggucauaccuugcaggagcaggguuagcauuuagcuuaaugaaaagucuaggaggagguaggagaggaaccggggcgcaaggagaaacuuuaggagaaaaauggaagcgacaguuaaaccaauuaagcaaaucggaguuuaauacauauaaaagaucgggaaucauggagguagaccgaagugaagcgaaagaaggauugaaaagaggggaaacaacaaaacacgcgguuuccagaggaacagcaaaguugcguugguucguugaacgaaaccuaguaaaaccagaagguaaaguaauagaucuagguugcggacgagguggauggucauauuauugugcuggguugaagaaagugacagaaguaaaagguuauacuaaaggcggcccgggacaugaggaaccaauaccuauggcaacguaugguuggaacauuguuaaacuccacucagguagagauguauucuucacacccccggaaaaaugugauacucuccuaugcgauauaggagaaucuucaccuaacccgacgaucgaagaagggagaacgcugagaguucuaaagaugguugagccauggcucagagguaaucaauucuguaucaaaauauugaauccauauaugccuagcguuguugagacccuagaacagaugcaaagaaaacaugggggaaugcuugucagaaauccauuaucuagaaacucaacucacgaaauguauuggguauccuguggaacugggaauauaguaucagccguaaacaugacaucaagaaugcuauugaauagguuuaccauggcccauagaaaaccgacauacgaaagagacguggauuuaggugcgggcacacgacauguagcagucgaaccggaaauagcuaacuuagauauaaucggucaaagaauagaaaacauuaagaacgaacauaaaaguaccuggcauuacgacgaagauaauccuuauaagaccugggcauaucauggaucguaugaagucaaaccuucaggaagugcaucuucaauggugaauggaguaguuagacuccuuacuaagccgugggauguaaucccgaugguaacgcaaauugcaaugacugauacaacucccuucgggcagcaacggguauucaaagagaaggucgauacaagaaccccacguccaaagcggggaaccgcacaaaucauggaggugacagcaaagugguuaugggguuuccuaucaaggaauaagaaaccuagaauaugcaccagggaagaguuuacaagaaagguccgaucaaaugcggccauaggagcaguuuuugucgaugaaaaucaauggaacuccgcuaaagaagccguugaagaugaacguuucugggauuuaguacauagggagcgagaguugcauaaacaaggcaaaugugccaccuguguauauaacaugaugggcaaacgcgagaagaaauugggggaauuugguaaagcaaaaggaaguagggccaucugguacaugugguuaggagcacgcuuccuagaguucgaagccuugggguuuaugaaugaggaccacugguuuucacgcgaaaauuccuuaucugggguagagggcgaaggacuacauaaacucgguuauauacuccgagauauaaguaaaauuccuggugggaacauguacgcagacgauaccgcaggaugggauacacggauaacagaagacgaucuacaaaaugaagccaaaauuacugauauuauggaaccugaacaugcucuauuggcgacaaguaucuucaaauuaacauaucagaauaaaguuguucgaguucaaaggccugcuaaaagcggaacagugauggaugucauuaguagaagagaucaacgaggcucgggacaagugggaacauacggcuugaacaccuucacaaauauggaaguacaauugauacgucaaauggaaagugaaggaauauuuaguccaucugaauuggaaaauucaaaccuggcugagcggguacuagacuggcucgaaaagcacggcguagaaagauuaaagagaauggcgaucaguggcgaugauugcgucgucaaaccgacugaugaucgauucgcuacugcgcuaacagcccuaaacgauauggguaaaguccgcaaggauauaccacaaugggagcccucaaaaggauggaaugacuggcagcaaguuccauuuugcucccaccauuuccaucaguugauaaugaaagacgggcgagagauagugguuccauguaggaaccaagacgaacuuguggggagagcaagagugucucagggggcggguuggucucuacgugaaacugcuugccuaggcaaaucguacgcgcagauguggcaauugauguauuuccauagaagggaccuaagauuagcagcuaaugcuauuugcucagcuguacccguaaauuggguuccaacuagcagaaccaccuggaguauucaugcucaccaccaauggaugacaacugaagacauguuaucaguuuggaaccgaguauggauagaagaaaauccguggauggaagacaaaacgcauguguccucaugggaagacguuccauacuuaggaaaacgugaagaucaguggugcgguucccuuauuggccuuacugcaagagcaacaugggccacaaauauacagguagcuauaaaccaagugcgacgcuugauuggaaaugaaaauuaccucgauuauaugacuucaaugaaacgauucaaaaaugaaucagaccccgaaggugcacuuugguaa

SEQ ID NO: 22120 - RNA, 9879 nt, Artificial Sequence
  derived and/or modified CDS sequence (opt6) from DENV-1__KM403579__SS-prME
agcguaacaaugcuauugauguuacugccgacagcauuagcauuucaucuuaccaccagggguggugaaccgcacaugauuguauccaaacaagaacgaggcaaaucgcuacuuuuuaaaacaagugcugguguaaauaugugcacauuaauagcaauggaucuaggcgaauuaugcgaagacacaaugacauacaaaugcccucggaucaccgaagcagaaccagaugauguagauuguugguguaacgcaacagauacauggguaacguacggaaccuguucccagacaggugaacacagacgagauaaacggagugucgcauuagcaccacaugucggacuuggacucgaaacucggacggaaacauggaugaguucugaaggggcauggaggcagauacaaaaagucgaaacaugggcacuaagacacccagguuuuaccguuaucgcacuauuucuagcgcaugccauuggcacaagcauuacacaaaaaggaauaauauucauauuacugaugcuaguuacuccuucaauggcuaugagaugcguagggauaggcaaucgggacuucguagaaggacuuaguggagccacuuggguagauguuguacuagaacauggaucaugugugacaacaauggcuaaaaauaaaccgacacucgauauagaauugcuuaaaaccgaagucacaaacccggcaguucuaagaaaauuguguauagaagcuaaaauuaguaauaccacgacagauucgagaugcccuacacaaggggaagcaacgcuaguugaagaacaagacgcuaauuuuguuugccguagaacauuuguagaucguggauggggaaauggguguggcuuauucgggaaaggcagcuugcuuaccugcgccaaauucaaauguguaacaaaauuagaaggcaaaaucguacaauaugaaaauuuaaaguauucgguuauaguaacuguacacacaggagaccaacaccaaguugguaaugagacaaccgagcauggcaccauugccacaaucaccccacaagcuccaacauccgaaauacaauuaacagacuacggggcgcuaacucuagauuguucaccucguaccggacuagauuucaaugaaaugguucuuuuaacaaugaaagaaaagagcugguuaguacauaaacaaugguuuuuggaccuaccuuuaccguggacgucaggugccagcacgagccaggaaacauggaauagacaggauuugcuggucacauucaaaacugcccaugccaagaaacaagaaguagucguccuaggaagccaagagggagcaaugcacacagcauugacgggugcaacggaaauacaaacuucaggaaccaccacaauuuuugcaggucaccucaaaugucgacugaaaauggacaaacugacacuuaaaggugugucuuacguuaugugcacuggaucuuucaaacuggaaaaagaaguggcagaaacacaacauggcacaguguuaguucagguaaaauaugaagguacagaugcaccauguaagauacccauuucuacgcaagacgaaaaaggaguaacccaaaacggacgucuaauuacugcaaacccaauagugacagacaaagaaaagccaguaaacauugaaacagaaccuccauuuggagagucuuauauuguuauaggagcgggcgaaaaagcauuaaaacuuaguugguucaagaaagggucaucgauagguaaaauguuugaagcgacugcacggggagcgagacggauggcgaucuuaggagacaccgcaugggauuucggaagcauagguggcguguucacaagcguaggaaaacuuguacaucaaguauucgggacggccuacggaguauuauucucaggagugaguuggaccaugaagauaggaauuggaauuuugcuuacuugguuaggauuaaauagucguucaacuucguuaucaaugacaugcaucgcaguugguaugguuacauuauacuuaggugugaugguacaagcagauagcgguugcguuauaaauuggaaaggacgggaauugaaaugcgguaguggaauauuuguaacgaaugagguucacacauggacagaacaauacaaauuccaggcagauaguccaaaacgcuuaucugcagcgauuggaaaggcuugggaagaagguguaugugggauucguagcgcuacaagacuagaaaauauaauguggaaacaaauuucuaaugagcuaaaucacauccuuuuagaaaacgacaugaaauuuaccguagucguuggugacgcaaaugggauauuaacgcaagguaagaaaaugauucgcccucaaccaauggaacacaaauauuccuggaagucuuggggaaaagcuaaaauuauuggugcugauauacagaacacaacuuuuauuauugauggaccugacacacccgaauguccagaugaccagagagcauggaauaucugggaaguugaagacuacggauuugguguauuuacaacaaacauaugguuaaaauugcgagauucuuauacucaaaugugcgaccaucgauuaauguccgcagcaauaaaagauucaaaagcggugcaugcggauaugggcuacuggauugagagugaaaagaaugaaacauggaaauuagcacgagcaaguuuuauagagguuaaaacaugcauuuggccaagaucucauacucuuuggagcaacgguguauuagaaucugagaugauuauuccuaaaauauacggaggaccaauaagccaacacaacuauagaccuggauauuucacgcaaacugcugggcccuggcaucuaggcaaacuagaauuggacuucaaucuuugugaagguacuacaguugugguagaugaacauugcggaaacaggggaccaucacuuaggacaacaacuguaacaggaaaaaucauucacgaaugguguuguagauccuguacauuaccaccacuaagauuucgcggagaagauggguguugguauggaauggagaucagaccgguuaaagagaaagaagaaaaucuuguacgcagcauggugagcgccgguucaggcgaaguagacucuuucaguuuaggcuuauuauguguaucgauaaugauagaagaagucaugcguagccgguggagcagaaaaaugcuaaugacaggaacccucgccguauucuuucuuuugaucaugggacaguuaacguggaacgaucugaucaggcuauguauuauggugggcgccaaugugucagaucguaugggaaugggcacaacuuauuuagcauugauggcaacuuuuaagaugagaccaauguuugcggucggacuacuguuucgacgucuaacaagccgggaaguccuccugcuuacaauaggauuaagucuagucgcaucaguagaguuaccaaacucacucgaagaacugggagauggucucgcaaugggaaucaugaugcucaaauuauuaacagacuuucagagucaucaacuauggacgacccuacugagcuugacauuuauaaagacgacucuaagccuugauuacgcguggaaaacuauggcaauggugcuaucuauugugucucuauucccauugugucucucgaccaccucacaaaagacaacuuggcuaccaguucuacuagguucauuugguuguaagccauuaacgauguucuuaauaacugaaaauaaaauuuggggccggaagaguuggccauuaaacgaagggauuauggccguuggaauuguaagcauuuuauuaaguucacuguugaaaaacgauguuccgcuagccgggccuuugauugcuggagguaugcugauugcuuguuacguuauaagugguagcagugcugauuuaucccuagagagagcagcugaagucaguugggaagaagaagcagaacacucaggugcgucacacaauaucuuaguugaaguacaggaugaugggacgaugaaaauaaaagaugaagaaagagaugauacauuaacaauccucuuaaaagcgacauugcuagcaguaagcggaguauauccuaugaguauaccugcgacuuuguucgucugguauuucuggcaaaagaagaaacaaagaagcggaguacugugggacaccccaagcccaccagaaguggagagggccguacuggaugaugguauauacaggauucuacaaagagggcucuuagggagaucccagguagggguaggugucuuccaagacgggguauuccacaccauguggcaugucacucggggagcgguguugauguaucaagggaaacggcuagaaccuucaugggcgucugucaagaaagacuugauauccuauggugggggauggcgcuuucaagguucuuggaauaccggagaagaaguucaaguaauugccgucgaaccagguaagaauccuaagaacguucaaaccacuccugguacauucaaaacuccggagggggaagugggugcuauagccuuagauuuuaaaccuggaaccucaggaaguccgauaguuaauagagaggguaaaaucguaggauuguauggaaauggagucguaaccaccagugggacguauguaucagcgauagcgcaagcgaaagcgagccaggaaggcccacugccagaaauagaagaugaaguauuuaagaaacgcaaucuuacuauaauggaucuacacccuggguccggaaaaacacgaagguaucuuccugcaauagugagggaagcaaucaaaagaaaauuaagaacacuuauauuagcaccuacacgcguagucgcaucagaaauggcagaagcacuaaaagguaugccgauuagguaucagacuaccgccguaaaaagcgaacacacggguaaagaaauaguugaucuaaugugucacgcgacauucaccaugaggcugcuuagcccuguccguguaccuaauuauaacaugauaauaauggaugaagcgcauuuuacagauccagcaucuauagccgccagagguuauauaucuacccgaguugguaugggagaagccgccgcgauuuucaugaccgcuacucccccaggaagcguggaagcauuuccccaaagcaaugcagucauacaggaugaggaaagagauaucccagaaaggucauggaacaguggauacgauuggauuaccgauuuuccugguaaaacagugugguuuguucccaguaucaaauccggaaacgacauagcaaacugccuacguaagaauggaaaaagggugauacagcucucacgaaagacauuugauacagaguaucagaaaacuaagaauaaugauugggauuaugugguaaccacugauauaucagagaugggagcgaacuuccgcgcggauagggugaucgacccacgacgaugcuuaaaaccagugauacuaaaagauggcccugaaagggucauacuggcaggccccaugccuguaacugccgcaagugcagcucaaagaagaggccguauagguagaaaucaaaauaaggaaggagaucaauacauauauaugggucaaccacuaaauaaugaugaagaucacgcacauuggacagaggccaagauguuauuagacaauauaaacacccccgaaggaauaauaccugcacuuuuugaaccagaaagggagaaaagugcggcgauagacggagaguacagacucagaggugaagcucguaaaacuuucguggaacuuaugcggcggggcgacuuaccggucugguuaucauauaaaguagcaagcgaagguuuccaauauucugacagaagauggugcuucgauggugagagaaauaaccaaguauuggaggagaauauggacguagaaauuuggacaaaagaaggagagagaaagaaguuaagaccucgauggcuugacgcuaggaccuacagcgauccccuagcacuucgagaauuuaaagaguucgcagcaggucgacggucagucucaggggacuugauacuagaaaucggaaaacucccacaacauuuaacccucagagcgcaaaacgcauuagauaauuugguuaugcuacacaauucagaacaaggcgggaaagcauaucgccacgccauggaggaacugcccgacacaauagagacucuuaugcuccuugccuugauugccguacuaacuggugguguaacguuauuuuucuuaucagguaaagggcuugguaaaacuucaaucggacuucugugugucauggcaucaagcguauuauuguggauggcaucagucgaaccucauuggauugcggcgaguauaauccuugaguucuuucuaaugguacuauuaaucccagaacccgaucgacaacgcacaccacaagauaaccaacuagcauauguggucauuggucuuuuauuuaugauucuaacuguagcagccaaugaaauggguuugcucgaaaccaccaagaaagauuuaggaauuggucauguugucgcggaaaaucaucaucacgcaacuaugcuagacauugaucuccauccagcaucagcauggacauuauaugcuguagcuacgaccauuauaacgccuaugaugcgccacacaaucgaaaacacgacggcuaauaucucacugacagcuauagcuaaucaggcugcaauacuaaugggacuggacaaaggauggccaauaucaaaaauggacauaggugucccauuauuagcacugggguguuacucgcaaguuaacccacuaacucuuaccgcggcagugcuaauguuagucgcccauuacgcgauuauaggccccggacuacaagcgaaagccaccagggaggcccaaaaacguacggcagccggaauuaugaaaaauccuacaguagacggcauaguagcaauugaucucgauccggugguauacgaugcaaaauuugaaaaacaacugggacaaauaaugcuauuaauacucugcacaucccaaauucuuuuaaugagaacuacaugggccuuaugugaaagcauaacccucgcuacagggccacuaacgacuuugugggagggaagcccuggaaaguucuggaauacaacuauagcaguuaguauggcgaauaucuuuagagguucuuacuuagcaggcgcuggccuggcguuuucacuuaugaaaucucugggaggaggucgacgaggaacuggugcccagggugagacauuaggggagaaauggaaacggcaacuaaaucaauuaucaaaaucagaguucaacacauacaaaaggagcgguauuauggaaguagaccggucagaggcaaaggaaggacuaaaacggggagagaccacgaaacaugcaguuaguagaggaacagcaaaacuaaggugguucguagaaagaaauuuggucaaaccagaagggaaaguaauugaucuaggauguggccguggaggaugguccuacuauugugccgggcuaaagaaaguuacagagguaaaaggguauacuaaaggggguccagggcaugaagaacccaucccaauggcaacauauggauggaauauaguaaaauuacauucagguagggacgucuucuuuacaccaccagaaaaaugcgauacgcuuuugugugauaucggcgaaucgagcccaaaucccacuaucgaagaaggucgaacuuuacguguauuaaagauggucgaacccuggcuaagaggaaaccaguuuuguaucaaaauucuaaauccuuacaugcccuccguuguugaaaccuuggaacaaaugcaaagaaaacauggagggauguugguuagaaacccacuuagcagaaauucuacccaugaaauguacuggguaucuugugguacggguaacauaguaagugcuguaaauaugacgaguagaauguugcucaaccgauuuacaauggcucauagaaaacccacuuacgaacgcgacgucgacuuaggugcaggcacgagacauguagcuguagaaccagagaucgcgaacuuagauauaauuggacaacggauagaaaacauaaagaaugaacacaaaucuacauggcauuacgaugaagacaacccguacaaaacgugggcuuaucacgguaguuaugaaguaaagccaagcggcagcgcuucaucaauggucaacggagucguacgacuucuaaccaaacccugggauguuauaccaauggugacacagauagccaugacagauacaacgccauucggucagcaaagaguguuuaaagaaaaaguggauacccgaacaccgcgucccaaacgggguacugcacaaauaauggaaguuacugcuaaauggcuauggggcuuucuuucacgaaacaagaagccuagaaucugcacccgggaagaguucacacgaaaggucagaucuaaugcggcaaucggugcaguauucguagaugagaaccaauggaauagugcaaaagaggccgucgaggaugaacgauucugggaucuuguucauagggaaagggaauuacauaaacagggcaagugugcaacauguguuuauaacaugaugggaaaacgcgagaagaaauugggagaguucggcaaagcaaagggaaguagagcaauuugguacaugugguuaggggcuagguuucuagaauuugaggcuuuaggauucaugaacgaagaucauugguucagccgagagaauagccucagcggaguagaaggcgaagggcugcacaaguuaggcuacauccuaagggauauaucuaaaauaccagggggaaauauguacgccgaugauacagccggaugggacaccaggauuacagaagaugauuugcaaaaugaagcaaaaauuacugacauaauggaacccgagcaugcauuacuagccaccagcauauuuaaacugacguaucaaaacaagguaguuagggugcaaagaccagccaaaucgggaacgguuauggaugucauaucgagacgagaucagcgagggucagggcaaguagguacuuaugggcucaacaccuuuacaaauauggagguacaacuuauuaggcagauggaauccgaagguauauuuucaccaucugaacucggaaauaguaacuuggccgaacgaguccuagauuggcuagaaaaacacggcgucgagagauugaagagaauggccauaagcggagaugauugcguagugaaaccaacugacgaccgauuugcaacagcauugacagcuuuaaaugauaugggaaaagugaggaaggauauuccccaaugggagccgucaaaggguuggaaugauuggcaacaaguuccuuuuugcagccaucauuuccaccaauuaauaaugaaagauggaagagaaauaguaguaccuugcaggaaccaggaugaauuaguaggucgagcucgaguaucgcaaggugcggguuggucacuaagagaaacggcuugcuuagggaaaagcuaugcacaaauguggcaacucauguacuuccacagaagagaucugagauuagcggcaaacgcgauaugcucagccguuccaguaaauugggucccuacguccagaacaacauggagcauccacgcacaccaucaauggaugacuacagaagauauguugucaguauggaacagagucuggaucgaagaaaauccguggauggaagauaaaacccacguuuccucgugggaagaugugcccuacuuaggcaaaagagaagaucaauggugcggcagucuaauaggacucacagcaagagcuaccugggcuacuaauauacaaguagcaauaaaucaaguaagaaaacugauagguaaugaaaacuacuuggauuacaugacaucaaugaagcgguuuaaaaaugaaucugauccagagggugcuuuaugguga

SEQ ID NO: 22121 - RNA, 9879 nt, Artificial Sequence
  derived and/or modified CDS sequence (opt6) from DENV-1__HM469968__SS-prME
ucaguuacaaugcuccuuauguuaaugccaacggcuuuagcauuucaucuaacaacacguggaggugaaccacauaugauaguaaguaaacaggaaagaggaaaaagucuauuauuuaaaacgucagcgggugucaacauguguacacucauugcaauggauuugggugaauuaugcgaagauacaaugacguauaaauguccaagaauaaccgaagcagaaccagaugauguugauugcugguguaaugcaaccgacacgugggucacauacgguaccuguucucagacgggcgaacaucggcgagauaaacgaagcguugcucuagcaccacauguggguuuaggucuggaaacgcgaacagaaacauggaugucaucggaaggcgcauggaaacaaauacaacguguugaaacuugggcucuaagacacccagguuucacugugauugcacuguuucuugcgcacgcaauaggaacuucgauaacucaaaaaggaauuaucuucauuuuauuaaugcuuguaacuccgaguauggcuaugagaugcguuggcaucggaagucgugacuucguagaaggacuuaguggugcuacauggguagacguuguucuagaacacggcaguugcguaacaaccauggcaaaagauaaacccacauuagauaucgaauuacuaaaaacagaaguaacgaacccagcagucuugagaaaacuguguauagaggcaaaaauaucuaauacaacaacggacucuagaugccccacacaaggcgaggcaacccucguugaggaacaggaugcaaacuuugugugccgacgaacguuugucgacagagguuggggaaacggaugcggauuauucggaaaaggaucuuugaucacuugcgccaaguucaagugugucacaaaacucgaaggaaagauuguacaguaugaaaauuuaaaauauaguguuauaguaacugugcacacuggcgaucagcaccaaguugguaacgaauccacagaacauggaacgacugccacaauaaccccgcaagccccaacaacagaaauucaguuaacugauuauggagcauuaacguuagauuguuccccaagaacgggauuagauuuuaaugaaaugguuuuguuaaccaugaaggagaaaagcugguuggugcauaagcaaugguuccuagaccuaccacugcccuggaccucgggugcuucuacaagucaagagacguggaacagacaagacuugcuuguuacauuuaaaacagcccacgcuaagaaacaggaagucguagugcuugguucccaagagggagcuaugcacacugcucuaacaggcgccacagaaauacaaacaagcgguaccacaacuauuuucgcgggacaccuaaaauguaggcucaagauggacaaacuaaccuuaaaagguaugucuuauguaaugugcacaggaaguuuuaagcuagaaaaagaaguagcagagacucaacacggaacggugcuagugcaaauaaaguaugaaggaacagacgcaccauguaaaauaccauuuucuacacaggaugagaaaggugucacccagaauggaaggcuuaucacugccaaucccauaguuacagacaaagaaaaaccaguaaacauugaagcugaaccaccuuucggagaaucauacaucgucaucggcgcgggggaaaaggcauuaaaacuuaguugguucaagaaagggucuucaauuggaaaaauguuugaagcuacggcaagaggagcaagaagaauggcaauucuaggugauacagccugggauuucggcucuauaggaggaguauucacgucagugggaaaauuaguacaucaaauauuuggcacagccuauggaguacuguuuucaggggucagcuggacuaugaaaauagguauuggagcguuacugacuugguugggcuuaaauaguagaucaacgagucugucgaugacguguauugccguuggacucguuaccuuauauuuaggaguaaugguccaggcggauucaggcugcguaauaaauuggaaggguagagaauuaaaaugcggaaguggaauuuucguuacaaacgaaguucauaccuggacggaacaauauaaauuucaagcggacaguccaaagcgacugagugcagcuauuggaaaggcaugggaagagggcguguguggaauaagauccgcaacaagacucgaaaauaucauguggaaacaaauaucgaaugaauugaaccacauuuuacuagaaaacgauaugaaguuuacaguuguaguaggagauguagcuggcauauuagcgcaaggcaaaaagaugauacgcccucaaccuauggaauacaaguauaguuggaaaaguuggggcaaagcuaagauuauaggggcagacguacaaaauacuaccuuuauuauagacgguccaaauacuccugaauguccugaugaucaacgagccuggaauauaugggaaguugaagauuauggauucggaauauuuacaacaaacauuuggcuaaaauugagggauucauauacacaggugugcgaucauagacuaaugagugcagccauuaaagauagcaaagccgugcaugcggauaugggguauuggauagagucugagaaaaaugaaacuuggaaauuggcucgcgcaaguuuuaucgaaguaaaaacauguauauggcccaaaucgcauacacucuggucgaaugguguuuuggaaagcgaaaugauuaucccuaagauuuauggaggacccauaucacaacauaauuaucgaccaggauauuucacacagaccgcagguccauggcauuuaggcaaauuggaguuagauuucgaucuaugcgaaggcacgacuguggugguugaugaacauugugguaaucgaggaccaucgcugagaacaacgaccgucacagguaagauuauacacgaaugguguugccguucaugcacccuucccccuuuacgguuucgcggggaagacgguuguugguacggaauggagauaagaccggugaaagaaaaggaagaaaaucuaguuaaaucuaugguaucagcaggguccggugagguggacaguuucucuuuaggucuuuuauguauuucaauuaugauagaggaaguaaugcguucgcguuggagccgaaaaaugcuaaugacagggacucuagccguauucuuuuuauuaauaauggggcaacuuaccuggaaugaccugauacgcuuauguauaauggucggagcaaaugccagcgacaggaugggcauggggacuacguaccuugcucugauggcaaccuuuaagaugagaccaauguucgcggugggguuauuauucaggagguuaacuucaagggaaguuuuacuauuaacuauaggacuaucguugguagcaucuguggagcugccgaacucauuggaagaacuaggggacggauuagcaaugggcauuaugauucuuaaauuacucacagauuuucaaucgcaucagcugugggcaacccuauuaucacuuacguuuauaaagacaacauuuucucuacauuacgcuuggaaaacgauggccauggucuuaagcauuguuagucuauuuccccucugucuaucaacaaccucucagaaaacaacuuggcuuccuguguugcuggguucucuaggcugcaagccgcuaacaauguuuuuaauugccgagaacaaaaucugggguaggaaaaguuggccauuaaacgaaggaauaauggcagucggaauuguaagcauauuauuaucuucgcuacucaaaaacgauguaccucuagcggguccuuuaauagcugguggaaugcuaauagcaugcuauguuauaagcggcucgagugcagacuuaaguuuagaaaaagcagccgaagucuccugggaagaagaagcugaacauucaggagcuucccauaacauucuuguugaaguacaggaugaugguacaaugaaaauuaaagaugaggaaagagacgacacucuaacgauucuacucaaagcuacacuauuagcuguuuccggaguguacccucuuucaauuccugccacacucuucguaugguacuuuuggcaaaagaagaagcaaagaucagguguuuuaugggauacaccgagcccaccugagguagaaagagccguccuugaugauggaauuuaccgaauuaugcaaagaggacugcuagggagaucacaaguggggguagguguauuucaagaaaacgucuuucauaccauguggcauguaacaagaggcgcaguguuaauguaucaagguaaaagauuagaacccucgugggcaucaguuaaaaaggauuuaauaagcuacgguggcggauggagauugcaagguagcuggaacaccggggaagaaguccaagucauagcggucgaacccgguaaaaauccaaagaacguacaaacagcuccugggaccuuuaaaaccccagaaggagaaguaggagccauagcacucgacuucaaaccuggaacaucuggaaguccuauaguuaauagagagggaaagauuguaggauuauacggcaacggagucgucacuacaagugguaccuauguaagcgcuaucgcgcaagcgaaggcaagucaagaagguccauuaccagaaauagaggacgaaguuuuuaggaaacgaaauuuaacaauaauggaucugcaccccgguagcggaaaaacacgcagauaucugccagcuauaguuagagaggcaauuaaacgaaaacuucgcacauugauucuggcuccgacacgugugguagcuucugaaauggcggaagcguuaaaaggcaugccaauacgauaucaaacuaccgcgguaaagucagaacauacuggaaaagagaucguugaucuaaugugucacgcuacguucacaaugaggcuacugucucccgugagagucccuaacuauaauaugauaaucauggaugaggcacauuucacugauccuucaaguauagcagcucgaggguauauaaguacacguguaggaaugggugaggcagcagcaauauucaugaccgccaccccaccggggucaguugaagcauuuccucagagcaaugcuguaauacaagacgaagaacgggauauuccagagagaucguggaacucgggauaugaauggauuacugacuucccaggaaagacuguaugguucguacccucaauaaaaucaggcaaugauauagccaauuguuuacguaaaaaugguaaaagagugauacaacucucuagaaaaaccuucgauacagaauaccagaaaacuaaaaacaaugauugggauuauguaguaacuacggauaucucugagaugggggcuaacuuucgcgccgaucgugucauugauccgcguagaugucucaaaccuguuauacuuaaggaugggccugagagaguaaucuuagccggacccaugccaguaacaguagcaucugcagcgcaaaggcgcggacguauuggacgaaaucauaacaaagaaggugaucaauauauauauaugggacaaccacucaacaacgaugaagaucaugcccacuggaccgaagcgaaaaugcuguuagauaacauaaacacaccagaagguauuauaccggccuuauucgaaccagagcgcgaaaagucggccgcaauugacggugaguacagacuucguggagaggcaagaaagacauuuguggaauugaugcguagaggggaucuaccaguaugguuaaguuacaaaguugcuucggaagguuuucaauauucggauagacgauggugcuuugacggugagaggaauaaucaagucuuagaagaaaauauggauguugaaauuuggacuaaagaaggugaaaggaagaaacugaggccgcgguggcuagacgccaggacauauagcgauccauuagcguuaagggaauuuaaggaauuugcugcaggacgacgauccgugucaggagacuuaauauuggaaauugggaaacugccacaacaccuaacgcaaagagcacaaaaugcgcucgacaaucuagucaugcuccauaacagcgaacaaggcggcagagcauaccgucaugccauggaagaauuacccgauacgauagaaacacucaugcuacuagcccuaaucgcuguucuaacaggggguguaacucuauucuuucuaagugguagaggcuuaggcaaaacaucuaucggacuccuuugcguaauggcaucaaguguucuccuauggauggcuaguguggagccucauuggauagcggccucuaucauucuagaauuuuuccuaaugguuuugcucauaccagaaccggaccgucaaagaacaccacaagacaaccaacucgccuacguaguaauuggguuauuauucaugaucuugacaguugcagcuaaugaaaugggacuuuuggagacaacgaaaaaggaccugggaauaggacacguagcaguggagaaccaucaucacgcugcuaugcuagacguugaccuucaccccgcgagugcuuggacauuguaugcaguagcuacaacaauaauaacuccaaugaugcgacacacaauagaaaacaccaccgcaaacaucucguuaacagcaauagcaaaucaagcagcuauucuaaugggucuggauaaaggauggccuaucucaaaaauggacauagggguuccauugcuagcauuagguuguuauucacaagugaauccucuuacacucacggcagcgguuuuaaugcuggucgcacauuaugcaauaauagguccagguuuacaggcuaaagcaacccgcgaggcucaaaagagaacagcagccggcaucaugaagaacccaacgguggaugguauaguagcaauagaucuugauccugucguuuaugacgcaaaauuugagaaacaauuaggacaaaucauguuguuaauuuuauguacgucccaaaucuuacuuaugcgcacaacuugggcccuaugugaaucuaucacacuagcuacugggccucugacuacacucugggaaggguccccagguaaauuuuggaacacuacgaucgcaguaaguauggcaaacauuuucagaggaagcuauuuagccggugcugguuuagcuuuuucuuugaugaagagucuaggcggcggucgaagagguacaggugcucaaggagaaacccuaggagagaaauggaagcgacaauuaaaccaacuuucaaaaucugaguucaacaccuacaagagaagugguauuauggaagucgacaggucggaagccaaggaagguuuaaagaggggagaaaccacgaaacacgcggugagccguggcaccgccaaacuucguugguucguagaacggaauuuagucaaacccgaaggcaaaguaauugauuugggcugugguagaggagguuggagcuauuauugugccggucuaaagaaaguuacagaaguuaaaggcuacacuaaaggcggcccugggcaugaagaaccuauaccaauggcaacuuauggguggaaccuggugaaauugcauucaggaaaagauguauucuuuauuccaccugagaaaugugauacuuugcuaugcgauauuggugaaucuucuccaaacccaacuauugaagaagggcguacauugaggguauuaaaaauggucgagccauggcuacguggcaaucaauucuguauuaaaauuuuaaaucccuacaugccaaguguagucgaaacucuugaacaaaugcaacgcaaauacgguggaauguuaguccgaaauccuuuaagccgaaauaguacacaugaaauguacugggucaguugcggaacuggaaauauagugagcgcagugaauaugacaucgagaauguuauuaaaucgauucacgauggcacaucguaaaccuacauaugaacgagauguagaucugggagcgggcacacggcacguagcagucgaaccugaaguugcaaaucuugauauaauagggcagagaaucgaaaacauuaaacacgaacauaagucgacuuggcauuacgaugaagauaaccccuauaaaacgugggcguaccacggaucuuaugaaguaaaacccucggggucagcaagcaguaugguuaauggaguagugaaguugcucacgaaaccgugggauguaauccccaugguaacgcaaauugcgaugacggacacgacaccauucggucaacaacgaguguuuaaagaaaaggucgacacaaggaccccuaaagcgaaaagggguaccgcacaaauaauggagguuacagcacgauggcuauggggauuucugucaagaaauaagaaaccuagaaucuguacccgagaggaauuuaccaggaaaguaagaaguaacgcggccauaggugcggucuuugucgacgaaaaucaauggaacagcgcgaaagaagccguugaggaugaaagauuuugggaccuaguacaucgagaaagggaacuucacaaacagggcaaaugcgcaacaugcguauauaauaugaugggaaaaagagagaagaaacucggagaauuuggcaaagcuaaaggcagucgcgcgauaugguauaugugguugggugcccgauuucuagaguuugaggcuuuaggcuucaugaaugaagaccauugguuuucaagggaaaauagcuuaucuggaguagaaggugagggauuacauaaauuaggguacauacugcgggauauaucgaagaucccuggggguaauauguaugcagaugauacagccggaugggauacgcgcauuaccgaggaugaucuucaaaacgaagcaaagaucaccgauauuauggagccagagcacgcguuauuagcaaaagcuaucuucaaacuaacauaucaaaauaaaguaguuagaguacaaaggccagcaaagaaugggacgguuauggacgugauaucgagaagagaucaaagagguagcggccaaguaggaaccuauggguuaaacacuuucaccaacauggaagcucagcuuauacgacaaauggaaagugaaggaauauuuuuaccgagcgaguuggaaacuccgaaccuagcugagcgaguucuagauuggcuagagaaauauggaguagagcgguugaagagaauggcaauuagcggagaugauuguguuguaaaaccaauugacgauagguucgcgacggcauugaccgcccuuaaugauaugggcaaaguccggaaggauauaccucaaugggaaccaucaaagggauggaaugauuggcaacaagugccuuucuguagccaccauuuccaucaguuaauaaugaaagacgguagagagauaguaguuccgugcagaaaccaagaugaguuggugggacgugccaggguaucucagggagccggauggagccugagagaaacugcuuguuuaggaaaaucguaugcacaaauguggcaacucauguauuuccauaggagggaucuucgcuuggcagcgaacgccauuugcucagcaguaccgguggacuggguaccuacgucaaggaccacauggaguauacacgcccaucaccaauggaugacgacagaagauaugcugaguguauggaauagggucuggaucgaggagaaccccuggauggaagauaaaacacauauaucuaguugggaagacguuccauauuuagguaagagagaagaucaguggugcggaucucucauugguuuaacagcuagagcaacuugggccaccaauauacaaguugcuauaaaccaagugcgacgacucauagguaacgaaaauuaucuagacuacaugacaucaaugaaaagguucaaaaaugaaagugaucccgagggggcuuugugguag

SEQ ID NO: 22122 - RNA, 9879 nt, Artificial Sequence
  derived and/or modified CDS sequence (opt6) from DENV-1__KC172834__SS-prME
ucagucacgauguuacugauguuaaugccuacagcacuugcauuucaccuaacaacaagagggggagagccucauaugauagugaguaaacaagaaaggggcaaaagccuauuauucaaaacaucggcagggguaaacaugugcacacuaaucgcuauggaucugggagaacuuugugaagacacgaugacauauaaauguccacgaauuacagaagcugagccugaugauguagacugcuggugcaacgcgacggauacauggguaacauauggcacuuguucccaggcaggggaacaucggcgugacaaacgaucggucgcauuagcaccacauguaggacuaggacuagaaacccgaaccgaaaccuggaugucaucagagggagcuuggaaacagauacagaggguagaaacaugggcacuacgacacccaggguuuacuguuauagcccucuuucuagcgcacgcuauuggaaccagcauaacgcaaaaaggaauaauauucauucuuuuaauguuggucacaccuucgauggcuaugcgaugugucggaaucgggucgcgcgauuucgucgaagguuuaucaggagcuaccuggguagacguaguguuggagcaugguucguguguaacaacgauggccaaagauaaaccaacccuagauauagaauuauuaaaaacagaaguaacuaauccagccguacuaaggaaauuauguauagaagcuaaaaucagcaauacuacuacugauagucguuguccuacucaaggugaagcgacucugguggaggagcaggaugcuaacuuuguaugucgacgaacguucgucgaucgugggugggguaaugguugcggcuuguuuggaaagggaucguuauugacgugcgcgaaauuuaagugcguaacaaaauuggaagguaagauaguacaauacgaaaauuuaaaauauuccguaauaguuacugugcacacuggugaccagcaucaaguaggaaaugaaaguacagaacacgguaccacugcuacaauuacuccucaagccccaaccacggaaauacaguuaacggacuacggugccuuaacauuagauugcuccccaaggaccgggcuggacuuuaacgagaugguccuacuuacaaugaaagaaaaaucguggcuuguacacaagcagugguuccuugauuuaccacuaccuuggacaaguggggcuucaacaucccaagaaacuuggaauaggcaggacuuacucguaacauuuaaaacugcacaugccaagaaacaggaaguuguaguuuuagguucacaagaaggugccaugcacacagcuuuaacaggagcaacggaaauccaaacaaguggaacaacaacaauauuugccgggcaucucaagugucgguuaaaaauggacaaauuaacauugaagggaaugaguuaugucaugugcaccgguucguucaaauuagagaaggaaguugcugagacacagcacgguacgguauuaguacaaauaaaguacgaaggaacagaugcaccgugcaaaauaccauucucaacacaggacgaaaagggcguaacucaaaauggucgguugauaacggcgaaccccauaguuacggacaaggaaaaaccaguaaauaucgaagccgaaccuccauucggagagaguuacauagucauaggagcuggugaaaaagcucuaaaacugucuugguuuaagaaaggauccuccauagguaaaauguucgaagcuaccgccagaggcgcaagacguauggcaaucuugggagauacugccugggauuucggaucaauuggagggguauuuaccagugugggaaaauuaguucaccaaaucuucgguaccgcauaugguguacuauucagcggaguaucauggacgaugaaaaucgguauaggagugcuuuugacuugguuagguuugaauagucgauccacgucuuuauccaugacauguauagcuguuggacucguaacauuauacuuagguguaaugguucaagcggauuccggcugcguaaucaauuggaaaggaagagaauugaaauguggcaguggaauauuugucaccaacgagguucacacguggacagaacaguauaaguuucaagcagauucuccaaaacgcuuaucggcagcuauaggaaaagcaugggaggaaggugucugugggauacgaagugcgacuagguuagaaaauauuauguggaaacaaauauccaaugaguugaaccauauauugcuagaaaaugauaugaaauuuacagugguagucggcgacgucgcaggaauacuggcgcaagguaaaaagaugaucagaccgcaaccaauggaauauaaauauucuuggaaaagcuggggcaaggcaaagauaauaggggcugauguacaaaacaguacguuuauuauugaugguccaaauacuccagaauguccugacgaucagagagcguggaacauuugggaaguagaagacuacgguuuugggaucuuuacaacuaacauauggcuaaaacuuagagacucauacacacaagucugcgaccaucgacuuaugucagcagcaauuaaagauagcaaagcgguacaugcagacauggguuauuggauugagagcgagaaaaaugaaacauggaaacuggcaagagccucauucauugaaguuaagacauguaucuggccuaagucacacacauuauggucaaacggcguacuggaaagcgaaaugauuauacccaagauauaugguggcccgauuagccaacacaacuaucgaccagguuauuucacacaaacggcaggaccuuggcaccuuggaaagcucgaguuagauuucgaucucugcgaagguacaacuguuguaguagaugaacacugcggaaaccgggggccuucauuacgaacgacaacuguuacaggaaaaaucauccaugaaugguguugcaggaguuguacacucccgcccuuaagauuuagaggggaagacggcugcugguauggcauggaaauacgaccggugaaggaaaaggaagaaaaccuaguaaaauccaugguuucugcagguucaggggagguagauucauuuucuuuagguuuauuauguauaucaauuaugaucgaagaagugaugcgaagcagauggagccgaaaaaugcuaaugacagguacauuggcaguauuuuuccuacuuauaauggggcaauuaacauggaaugacuuaauuagacucuguauaauggugggugcgaacgccagcgauagaauggguauggggacgacauaccuagccuuaauggccacauuuaaaaugcggccgauguuugcagucggccuacuauuccgacgguuaacaucgcgagaaguucuccuuuugacaauugggcucagcuuagucgcuaguguagaacuaccaaauucacuugaggaauuaggcgacggccuagcuauggguauuaugauccugaaacuccugacggauuuucaaucacaucaguuaugggcuacguuacuuuccuuaaccuuuauuaaaacuacauuuucgcuacacuaugcguggaaaacaauggcaaugguguuaaguauuguuucgcuauuuccacucugcuuaucuacaacgucgcagaaaacuacguggcuuccgguauuguugggaucauugggauguaaaccguuaacuauguucuugauagccgaaaacaaaaucuggggaagaaaaaguuggccucugaacgaaggaauaauggcaguaggaauuguuucgauucucuuguccucauuacuaaagaacgauguaccacuugccgguccccucauagcaggagguauguuaaucgcauguuaugugaucagugguagcucugcagaucucagccuagagaaagcggcagaggugucaugggaagaggaagcagaacauagcggggccucgcacaauauccuaguugaaguacaagaugacgguaccaugaaaauaaaagacgaggaaagagaugauacucugacaauauuauuaaaagcgacgcuccuagcaguaagugguguauacccuuugagcaucccugcaacauuauuuguaugguauuuuuggcaaaagaagaaacagagaagcgguguacuaugggacacaccuaguccaccagaaguagaaagagcgguucucgaugacggaauauacagaauaaugcagcgaggacuauuaggccgcucgcaagugggaguaggcgucuuucaggagaauguuuuccauacuauguggcaugucacacguggagcgguacuuauguaccagggaaaaagacuugaaccaagcugggcuucggucaagaaagaucugauaucauauggcggagguuggcgauuucagggaucauggaauacaggugaggagguacaaguaauagccguggaaccggguaaaaacccgaagaacguacaaacagcacccggaacauuuaagacacccgaaggagaaguaggagcaauugcccuugauuuuaaaccugggacuucgggcaguccuauuguaaaucgagaaggaaaaauaguagguuuguacggaaauggugugguaacaacauccgggacuuacguauccgccaucgcgcaagccaaggcaucgcaagaaggaccauuaccugaaauugaagaugaggucuuuaggaaaaggaaucucacgauuauggaccugcacccaggcagcgguaagacacgacguuauuuaccagccauuguaagagaagcaauaaagaggaagcuccgaacauugauccuggcuccuacucgggucguugcaagcgagauggcggaggccuugaagggcaugccaauaagauaucaaaccacagcaguaaaaucagaacauacuggaaaggagauaguagauuugaugugucaugcuacuuuuacaaugagacuacuaaguccuguucgcguacccaauuacaacaugauaauaauggacgaagcccacuuuacagauccaaguaguauagcagccagaggguacauaaguaccaggguaggaaugggagaagccgcagcaauuuuuaugaccgcaaccccucccggaucaauggaggcuuuuccacaaucaaacgcuguaauccaagacgaagaacgagacauuccggagagaagcuggaaccuaggucaugaauggaucacagauuucccgggcaaaaccguaugguucguaccuaguauaaaagccggcaaugacauagcaaacugcuugaggaaaaauggcaaaagagugauacaauuaagucguaagacauuugauaccgaauaucagaaaaccaaaaauaacgauugggacuauguaguuacaacagacauauccgaaaugggugcuaacuuucgugcagaucgaguaauugauccucgaaggugccucaagcccguuauacuaaaagacgggccagaaagaguaauacuagcaggaccaaugccuguaaccgucgcuucagcugcacagcgaaggggucguauuggucggaaucauaacaaggagggggaccaauauauuuacaugggucagccucuaaacaaugaugaagaccaugcccacuggaccgaagcaaagaugcuauuagacaacaucaauacaccagaagguauaauaccagcuuuauuugagccagaaagagaaaagucagcugccauugauggagaauauagacuaagaggagaggcaagaaaaacauucguugagcuaaugcggcguggagaucuuccuguaugguuaaguuauaagguagcuagugaaggcuuucaauauucagauaggagauggugcuuugacggugaaagaaacaaucaaguauuagaggaaaacauggauguggagaucuggacaaaagaaggugagcgcaagaaacuuaggccgcgcuggcuugacgcccgaacuuauagugauccccuagcacuucgcgaauuuaaagaauuugcagcaggucggagaucuguaaguggagauuugauauuagagauagggaaauuaccccaacauuugacacaaagagcacaaaacgcuuuagauaacuuagucauacuucacaauucggagcagggaggaagggcguaccggcacgcuauggaggagcuuccugauacuauugagacauuaaugcuacuugcgcuaauugcuguauuaacuggagggguaacauuauucuuucuaucagguaaaggucuagggaaaacgagcaucggucuccuaugcguaauggcuucaucaguucuacuauggauggcaagcguagaaccucauuggaucgcagccucaauaauucucgaguucuuuuugaugguuuugcuuaucccggaaccagacagacaaagaacuccacaagauaaucaacuugcauacguggucauaggguuacuguucaugaucuuaaccguugcagcaaacgaaaugggacuacuagaaacgaccaagaaagauuuagggauaggucacgucgcggucgaaaaccaucaucaugcagcuaugcuagaugucgacuugcaucccgcaucagcauggacgcuuuacgcugucgcuaccaccauaauuacccccaugaugaggcauacuaucgaaaauacuacagcuaauauaucucuaacggccaucgcgaaucaagcagcuauacuaauggguuuggacaaaggguggccgauuucgaaaauggauauaggaguuccauugcuugcacugggcuguuacucacaggugaaucccuuaacacucacugcagcaguacuaauguugguugcucacuacgcaauaauaggcccgggguuacaagccaaagccacuagggaagcucaaaaacguaccgcggcugggauaaugaaaaaucccacaauagauggaaucguugcuauugaucuagacccgguaguauacgacgcuaaauucgaaaaacagcugggacagaucauguuguuaauauuaugcacaucacaaauucuuuuaaugagaacuacuugggcacuaugcgaaucuaucaccuuagcaacagggccacugacuacacugugggaaggaucuccggggaaauucuggaauacuacaauagcgguauccauggccaacaucuuuagggguucuuaccuggccggggcuggucuugcauucucucuuaugaaaucacuaggugguggacgcagaggaacuggagcucaaggcgaaaccuuaggagagaaauggaaaagacaguugaaucagcugucaaaaucagaguuuaacacuuacaaaagaucuggaauaauggaggucgauagaagugaagcaaaagaagguuugaagagaggugaaaccacaaaacacgcuguguccagggggacagcaaaauuacgaugguuuguugaacgcaaucuaguaaagccagaggggaaaguaauugacuuaggauguggcagagguggguggaguuacuacugcgcgggacucaagaaaguuacagaaguuaaagguuauacuaaggguggaccaggacaugaggaaccgauaccuauggccacuuacggcuggaauuuggucaaguugcacaguggcaaggaugucuucuuugugccaccugaaaagugugauacacuacuuugugacauaggugagucaaguccuaacccaacaaucgaagaaggaaggacccuaaggguauuaaaaaugguagaaccaugguuaagaggaaaucaauucuguauuaagauauuaaacccauauaugcccaguguuguugaaacacucgagcagaugcaacgaaagcacggggguauguuaguaagaaacccgcugagucgcaauagcacccaugaaauguauuggguuucaugcggaacagguaacauagucagugcaguaaauaugacauccaggaugcuacuuaacagguucacuauggcacauagaaaaccuacauaugaacgugauguugaucuaggagcagguacucgccauguagcgguugaaccagaagucgcaaaccucgauaucauuggacaacggauugaaaauauuaaacaugaacauaagagcacauggcacuaugacgaggacaauccauauaagacuugggcuuaccaugggucauaugaaguuaagcccagugggucugcgucuaguaugguuaauggaguuguaaaacuuuuaacaaagccaugggaugugauccccaugguuacacaaauagcaaugacagacacgacgccuuucggacagcaaaggguauuuaaggagaaagucgacacucggacgccaaaggcgaaacgggguacggcacaaauaauggaaguaacagcucgcuggcuuuggggauuccuaagucgcaacaaaaagccaagaaucugcacgagagaagaauuuacaagaaaaguacgcucaaaugccgccauaggugcaguauucgucgaugaaaaccaguggaacucagccaaagaggcuguagaagacgaccgguuuugggaucuugugcauagggaaagggaacuacauaaacaagguaaaugcgcaacauguguauacaacaugaugggaaaaagggaaaagaaauuaggagaauuugguaaagcaaaaggaucaagggccaucugguauaugugguuaggagcgagguucuuggaauuugaggcuuuaggcuucaugaacgaagaccacugguucagucgagaaaauagcuugucuggagucgaaggagaaggacuucauaaacuaggguauauauuaagagacauaagcaaaauaccaggugggaauauguaugcagaugacacagccggaugggauacacgaauaacagaagaugaccugcagaacgaagcaaagauuacagacauuauggaaccugaacacgcauuacuugcuaaaucaaucuuuaaacuaacguaccaaaauaaggucgugcgaguacaacguccugcaaagaacgggacuguaauggacgugauuucacgucgagaccagaggggcagcggacaagucgguacauaugggcugaauacguuuacuaacauggaagcgcaacuuauaagacaaauggaguccgaaggaauauuuaguccaaacgaauuagaaacaccaaaccuagcagaaagggugcucgacuggcuggaaaaauauggaguagaaagauuaaagaggauggcgauaucaggugacgauuguguagucaaaccuaucgaugaucguuuugcgacagccuugacggcucuaaacgauaugggaaaaguacgaaaggacauuccucaaugggaaccgagcaaggguuggaaugacuggcagcagguuccuuuuugcucucaucacuuucaccaacuaauuaugaaggacggacgagaaauuguagugcccugucgaaaccaggacgaauuaguaggcagagcaagagugagccaaggagcaggcuggggacuacgagaaaccgcgugccuuggcaaaucauaugcucaaauguggcaacuaauguauuuucacaggcgggacuuaagauuggcugcuaaugcaaucuguagugcaguuccagucgacuggguuccuacuucacgaacaaccuggaguauucacgcucaccaucaauggaugacaacggaagauaugcuuagugucuggaacagaguauggauugaggaaaaucccuggauggaggauaagacgcgaauuucuucuugggaagauguaccauaucuagggaagcgugaggaucagugguguggcagucuuauuggauuaacagcucgagcaacaugggcaacaaauauacaaguagccauaaaccaaguacgccgcuugaucggaaaugaaaauuacagugacuauaugacuucgaugaaaagauuuaaaaaugaaucagagccagagggagcacuaugguga

SEQ ID NO: 22123 - RNA, 9879 nt, Artificial Sequence
  derived and/or modified CDS sequence (opt6) from DENV-1__KJ933413__SS-prME
ucagugacaaugcuucuaaugcuauugccaacugcuuuagcguuccaucuaaccacucgaggaggugaaccccacaugauuguaucuaaacaagaaagagguaaaagccuuuuauuuaaaacauccaccggggucaauaugugcacucuaauagccauggauuugggugagcuaugcgaggacacgaugacuuauaaaugcccucgaaucacggaaaccgaaccugaugauguagacugcugguguaaugcaaccgaaacaugggucacuuaugggacguguagccaaacaggggaacauaggagagauaaacggucgguagcguuggcuccucauguaggguuaggacuggaaaccagaacugaaacauggaugucaucugagggugccuggagacaaauucaaaaagucgaaacaugggcacuaaggcaccccgguuuuacuguaauagcacuauuuuuagcccacgcuaucggaacuuccauaacacaaaaaggcauuauuuuuauacuacuaauguuaguaacaccgucaauggcaaugagaugcguagggauaggcaaucgagacuuuguugagggccuaagcggagcgacauggguugaugucguucuugaacacggaagcuguguaacaacaauggcuaaagacaaaccuacucuagacauagagcuucuuaaaacagaaguuacaaauccagcaguccuucggaaauuauguauagaagccaaaauaucgaauaccacaacagacagucgguguccgacgcaaggggaggcuacauugguggaagaacaagauacaaauuuuguaugcagaagaacucuuguagaucgggguuggggaaacggguguggacuauuugguaaagguagcuuaauaacaugcgcaaaauuuaaaugugucacuaaauuagaagguaaaaucguccaauacgagaacuuaaaauacucaguaauaguaacggugcacaccggcgaucaacaucagguuggcaacgagacuacugaacaugguacuacagcaacaauaaccccucaagcuccaaccagcgagauacaacuuacagacuauggggcucuuacauuagacuguucgccacguacggggcuugauuuuaaugaaaugguccuacuaacaaugaaagagaaaagcuggcuuguacacaaacaaugguuucuugacuugccauuaccauggacauccggagccaguacgucacaagaaacauggaaucgccaagauuuauuaguuacuuucaagacugcucacgcaaagaaacaagaagucgucguauuaggcucucaagagggggcaaugcacaccgcguuaaccggagcuacggaaauacaaacuucaggaacaacgacaauauucgcuggacaccuuaaaugccgauuaaagauggacaaguuaacauuaaagggagugaguuaugucauguguacugggagcuucaaauuagagaaagaagucgcagagacgcaacauggaacgguuuuaguucagguaaaauaugaaggaacagacgccccauguaaaauaccauuuacaucacaggaugaaaaaggagugacgcaaaacggcagauuaauaacagcgaaucccauagugacagacaaagaaaaaccaguaaauauagaagcagaaccacccuucggugaguccuauuuaguagucggcgccggcgaaaaagcauuaaaauuaaguugguucaagaaaggaucuucaauagggaaaauguuugaagcuacggcuagaggugcacgucgaauggcgauacucggugauaccgcaugggacuuuggcagcauuggcggaguguuuacauccguugggaaacugauccaccaaauauuuggcaccgcauacgguguauuguucagugguguaagcuggaccaugaaaauagguaucgggauacugcuuaccugguuaggucuaaauucacgaagcacgucauuaucgaugacgugcauagcagucggcaugguaacauuguauuuagguguaaugguccaggcugacaguggcugcguaauaaauuggaaaggaagggagcuuaaguguggaucggguauauuugucacaaaugagguucacacauggaccgagcaauauaaauuucaagccgacagcccgaaaagauuauccgcagccauaggaaaagcaugggaggaaggcguauguggaauacgguccguaacucgauuagaaaacaucauguggaaacaaauuaguaaugaauuaaaucacauccugcuugaaaacgauaugaaguucacagucgucguaggagaugugaacggaauacuagcgcaaggcaagaaaaugauaagaccacaaccuauggaacauaaguauucuuggaagucaugggguaaagccaaaguaauaggagccgacgugcaaaacaguacguucauaauagacgggccaaacacccccgaguguccugaugaucaaagagcguggaauauuugggaagucgaagacuacggguuuggaauauuuacuacaaauaucugguuaaaacuaagagacucauauacucagguaugugaccauagacuaaugucugcagcuauuaaagauucaaaagcuguucaugcagauaugggcuacuggauagaaucagagaaaaacgaaacauggaaacuaacgagagcaucauuuauugaaguaaaaacuugugucuggcccaaaagucauacccuaugguccaauggugugcuagaaucggaaaugauaauucccaagauauacggagggcccauaucucaacacaacuauagaccaggguauuucacucaaacggcaggacccuggcauuugggaaaacucgaacuugacuucggcuuaugugaagguacuacaguaguaguugacgaacacugugguaaucgaggacccucuuugcggacaacgacaguuacuggaaaaauuauacacgaaugguguugcagaucaugcacacucccaccauuacguuuuaagggugaagaugguuguugguacgguauggaaauucgaccggucaaagaaaaagaagaaaaucuugucaaaucuaugguuagugcaggguccggggaagucgauaguuucagcuuaggauuguuaugcauaucgauuaugauagaagagguaaugagaucuagguggagcagaaaaaugcuaaugaccggaacuuuggcaguauucuuauuauuaauuauggggcaauuaaccuggaaugauuuaauaagauuauguauaaugguaggggccaaugcaagugauaaaaugggcauggguacuacauacuuagcauuaauggcuaccuuuaggaugagaccaauguuugcuguaggacuuuuguuccguagacuaacaucaagggaaguacuucuauuaacuguaggucucucauuaguagcaagcguagaauugccgaauagucuggaggaauuaggugacggacuggccauggggaucaugaugcucaaguuacuaacagauuuucagucacaucaacugugggcagcuuuguuaucauugacauucguaaagacuacauuuucauugcacuacgcguggaaaacaauggcuaugauuuuguccauuguaucucucuuuccccuuugucuaucaacuacgagucagaaaacuaccugguuaccaguauugcuuggcucgcugggauguaaaccucuuacaauguuucuaauuaccgaaaaucggaucuggggucgcaaaucuuggccauuaaacgagggaauaauggcuguugguaucgucuccaucuuauuaagcagucuucucaaaaacgaugucccccuugcgggaccuuuaauagcaggggguauguuaaucgccugcuacguuauuucgggaagcagugcagaucuaucucuugaaaaagcugcagaaguguccugggaagaagaagccgaacauagcggcgcgucacauaauauccugguugaaguccaagacgacgguaccaugaaaaucaaggacgaagaaagggaugauacauuaacaaucuuacuaaaggcaacauugcuagcgauuucaggugucuacccgaugucaauacccgcaacgcuuuuuguuugguacuuuuggcagaagaagaaacaaagaucgggaguacuaugggauacuccaucuccaccugaaguagaaagggcaguucuugaugacgguauauacagaauauugcagcgagggcuccuaggaaagagucaaguagggguaggaguuuuccaagaaggcguguuucauaccauguggcauguuacacguggugcgguccuaauguaucaagggaaaagguuagaaccgagcugggccucagucaagaaagaccucauauccuaugguggagguuggcgguuucagggcucuuggaacacaggugaggaaguacagguaauagcuguagaaccaggaaagaaucccaaaaacguucagacugcucccgguacauucaagacacccgaaggagaaguuggugcgauagcucucgacuuuaaacccgguaccucuggcuccccuaucguaaacagagaaggaaagauaguaggucucuaugguaacggcguugucacgacgucuggcacguauguaagugcaauagcgcaagcaaaagcaucacaagaagggccacuucccgagauugaagaugaaguauuucguaagcgcaaucuuacgauuauggaucugcauccaggaaguggcaaaacgaggcgauaucuaccugcuauaguacgggaagccauuaaacguaaguuaagaacccuggugcuagcuccuacaaggguaguagcaagugaaauggcagaggcuuugaaagguaugccaauacgcuaucaaacuacagcaguaaagucagaacacacagguaaagaaauuguagaccuaaugugccacgcgacauucacaaugagguugcugucaccaguaaggguccccaauuauaacaugauaauaauggaugaagcacacuuuacugauccagcaucuauugcggcucguggauauauaucuacgcggguaggaaugggagaagccgcugcuaucuuuaugaccgccaccccacccgguuccauggaggcuuuuccucaaaguaaugcagcuauacaagaugaagaaagagauauacccgaacgaucuuggaacucuggguaugacuggauaacagauuucccuggaaaaacuguuugguuuguaccgucaauaaaaagcggaaaugauaucgcuaauugucuucggaaaaauggcaagagagucguucaauugaguagaaagacauucgacacagaguaccagaaaacuaaaaauaacgauugggauuacguuguuacuacagacauaagcgagaugggugcaaauuucagagcggacagagugauugauccaagaagaugucuaaaacccguuaucuugaaggacggcccagaaagagugauacuggcuggacccaugccuguaacaguggcaagcgcugcccaaagaagaggacgaauuggaagaaaccaaaauaaagagggcgaucaguauauuuauaugggucaaccauugaacaacgaugaagaccaugcucauuggacggaagccaaaauguuacucgauaauauaaacacuccagaggguauuauaccggcacuuuucgaaccagaacgugagaagagugcugcaauagacggggaauauagauuacggggugaagcacggaaaaccuuuguugaacugaugaggcgaggagauuuaccgguguggcucucuuacaaaguugcaucagaaggcuuccaauacucagaucgucgaugguguuucgauggcgaacggaauaaucagguccuagaggaaaauauggacguggaaaucuggaccaaagaaggcgagagaaagaaacugcguccccgguggcuagaugcucgcaccuacucagauccguuagcgcuacgugaguucaaggaauuugcagcaggacgaagaucaguuucgggugaucuuauauuagaaaucggaaagcuaccacaacaucugacccaaagagcacaaaaugcauuagauaauuuaguuaugcuacauaauagugagcaagggggaaaagccuaccgccacgcaauggaagaauuacccgacaccauagaaacuuuaaugcuacuagcacucauugcuguuuugacaggcggaguaacacuuuucuuuuuauccgguagaggauuagguaaaaccagcauaggcuuacuuugcgucauggcuucaagugcacucuuauggauggcgaguguagaaccccacuggauagcggcaucaauaauuuuagaauuuuucuugaugguauugcuuaucccugaaccugaccgucaaagaacuccccaagacaaucaguuggccuaugugguaauuggucucuuauuuaugauuuuaacaguagcagcuaaugaaauggguuuauuggaaacaacuaagaaagaucuugggauagggcauguagcagccgagucucaccaccaugcagcaaugcuggacgucgaucugcauccggcgucagcauggacacuauaugccgucgccacaacuguaauaacccccaugaugagacauacaauagaaaacacaaccgcuaauauuucccucacagcuauagcaaaccaagcagcaauccugaugggacuagacaaaggcuggccaauaucaaagauggacauaggagucccguuauuagcacuuggguguuacucacaaguaaacccuuugacucuaacagcugcaguuuuaauguuaguugcucacuacgcuauaauugggccaggacuacaagcgaaggcgacacgugaagcccaaaaacgaacagcagcaggaauuaugaaaaauccgacugucgaugggauagucgcuauagacuuagacccagugguuuacgacgccaaauucgaaaaacaacuugggcaaauuaugcuacuuauucuauguacaucacaaauauugcuaaugagaacuacgugggcauuaugugagucaaucaccuuagccacugggccguugacuacacucugggaagguaguccagguaaauuuuggaauacaacaauagcaguaaguauggcaaauaucuuuagaggcagcuaccuugccggcgcuggccucgccuucucucuuaugaaaagucucggagguggucgccgaggcaccggcgcacagggugagacccuaggugagaaauggaaaagacaacuaaaucagcuuucaaaaucagaguucaacacguauaaaagaagugguaucauagagguugacagaucagaagcgaaggaaggacuuaaacgaggagagacgacaaaacaugcgguaucaagaggaacugccaagcucagaugguuuguugaaaggaacuuagucaaaccagagggcaagguaaucgaccuuggaugcggacgcggagguuggaguuauuacugugcuggccucaagaaaguaacggaaguaaaaggcuauacaaaggguggaccgggccaugaagaaccuauuccaauggcaacguauggguggaaucuaguaaagcuacauagcggcaaagauguauucuuuacuccaccagaaaagugugauacucuacuuugugauaucggagaaagcagccccaacccaacaauugaagaaggccgaacacuaagaguauugaaaaugguugagcccuggcuucgagggaaucaauuuuguauuaaggugcucaacccauauaugcccucagucguugaaacucucgaacaaaugcaaaggaaacacggugguaugcuggucagaaauccccuaucgagaaacuccacacaugaaauguauugggugaguugcgguacagguaauauaguaucagcagucaauaugacaagucguauguugcuaaaccgauucaccauggcgcauagaaagccaacguacgaacgugaugucgaucuaggggccggaacaagacauguagccguagagccagaaguagcaaauuuggauauuauugggcaacgaauugagaacauuaaaaaugagcauaaaucgacuuggcauuaugacgaagauaacccauacaaaaccugggcauaucacgguucuuaugaagucaaaccaucagguucagcaucguccaugguaaacggaguaguucgucuccuaacaaaacccugggacguaauucccauggugacacaaauugccaugacggauacaacacccuuuggucaacaacgcguauucaaagaaaaagucgauaccagaaccccaaaagcaaaaagaggaacagcacaaauaauggaaguuacggcucgcugguuguggggauuccuaagucguaacaagaaaccccggauauguacacgagaagaauuuacgaagaaaguucgaucgaacgcugcgauaggagccguguuuguugacgaaaaucaauggaacuccgccaaagaagccguugaagaugaacgauuuugggaucuaguacacagagaaagggaguugcacaaacagggaaaaugcgcuacauguguguauaauaugaugggaaaaagagagaagaaauuaggcgaguuuggaaaagcaaaaggcucgagagcaauuugguacaugugguuaggcgcaagguucuuggaauuugaggcuuuagguuucaugaacgaagaucacugguucagucgagaaaauucuuuaaguggaguagaaggugaagguuuacacaaacuuggauacauucuuagagauauaucgaaaauccccggugguaauauguaugcggacgauaccgcgggaugggacacuaggauaacggaagacgaccuacagaaugaagcuaaaauaacugauauuauggaacccgaacacgcauuacuugcaacgucgauauuuaaauugacauaccaaaacaaaguagugcgaguucaaaggccugcuaagaacggaacaguaauggauguaaucucacguagggaucaaagagguuccggacaaguuggaaccuacggauugaauacauucacgaacauggaggcacaacugauuagacaaauggagucugaggguauauuuuuaccguccgaacuggaaacccccaaucuugccgaaagaguuuuagauugguuagaaaaauacgguauugaacgacugaagcgaauggcgauuucaggggaugacugcguaguaaaaccaauagaugacagguuugcuacagcauugacugcccuuaaugauaugggaaaaguucggaaagauaucccacaaugggagccaagcaaagguuggaacgauuggcaacaagugccguucuguucacaucauuuucaccaguuaaucaugaaagacgggagggaaauaguuguucccuguaggaaucaggaugaauugguuggaagggcuagagucucucaaggugcagguuggucuuuacgggagacagcauguuuagggaaaaguuacgcacagauguggcaacuaauguacuuucaccguagagacuugagacuagccgcuaaugccauuuguagcgcaguaccuguugauuggguuccgacaagucgcacuacuuggucgauucaugcacaucaucaguggaugacgaccgaagacaugcuaucuguguggaauagaguuuggauagaagaaaacccuuggauggaagauaagacgcauguaucauccugggaggaugugcccuaucugggcaagcgcgaggaucaguggugugguucguuaaucggcuuaacagcaagggcgacaugggcuacuaacauucaaguugcaauuaaucaaguucgacgguuaauaggaaacgaaaacuaucuugacuauaugacauccaugaagagguuuaagaacgagagugacccggaaggagcacuaugguag

SEQ ID NO: 22124 - RNA, 9879 nt, Artificial Sequence
  derived and/or modified CDS sequence (opt6) from DENV-1__KU666942__SS-prME
ucuguaacgaugcuucuuauguuaaugccaacugcauuggcguuccaucuaacaacaagagguggagaaccacauaugauaguuagcaaacaagaacgaggaaaaucucugcuguuuaaaaccucugcggguguaaauauguguacauuaauagcaauggauuuaggagaacuaugugaagauacaaugacuuacaaauguccucgaauuaccgaggcagaaccagacgacguagacuguugguguaaugcaaccgauacuugggucacguauggaacguguucccaaacuggagaacaucggcgugauaaacgaaguguagcucuagcgccgcacguaggcuuaggacucgaaacgaggacagaaacuuggaugaguagcgagggggcauggaaacagauucaaagaguagaaacaugggcacuuagacacccagguuucacuguaauagcucuauucuuagcacaugcaaucgguacgucuaucacacaaaaaggaaucauauuuauacuccuaaugcuaguuaccccaagcauggcaaugagaugcguuggaauaggaaguagagacuuuguagaagguuuaaguggcgcaaccuggguggacguaguacuagaacauggaagcugugucacaacaauggcuaaagauaaaccaacccuggacauagaacugcuaaaaacagagguaacuaacccugcuauacuaaggaaauuauguaucgaggcaaaaauuucaaauacaacgacugauucacgcugcccuacgcaaggcgaagccacgcuagucgaagaacaggacgcuaauuuuguuuguagaaggacuuuuguagacagaggcuggggaaacggaugcggacuguucggaaaaggcagucuaaucacuugugcaaaguucaagugugucacaaaguuagaaggaaaaauuguucaauaugagaaucugaaauauagcguaaucguaacaguacauacaggcgaucagcaccaagucgggaaugaaucaaccgaacacgguacuacugcaacgaucacgccacaagccccaaccacggaaauucaacuuaccgauuacggugccuuaacacuagacuguucaccaagaaccggucuggauuuuaaugaaaugguuuuauuaacuaugaaagagaaaaguuggcuaguacauaaacagugguuuuuggaucucccacuaccuuggacuucuggagccucaacuucucaagaaacguggaaccgacaagaccuauuaguuacauucaaaaccgcacacgccaagaaacaagaggugguugugcuggguucccaagaaggggcaaugcacacagcacuaaccggcgcuacugaaauccaaacgucagggacaacaacuauuuucgcagggcaccuaaaaugucguuuaaagauggacaaacugacuuuaaaaggaaugucauacguaaugugcacuggcucuuuuaaacuugaaaaagaagucgcagaaacacaacacggaacgguauuaguacaaauaaaauaugagggaaccgaugcacccuguaaaauuccuuucagcacccaagaugaaaagggaguaacgcagaacgguagacugauaacugcuaacccuauaguaacggauaaagaaaagcccgucaauauagaagcagaaccuccguuuggugagucauacauugucauaggugcaggagagaaggcacugaaauuguccugguuuaaaaaggguucaaguauagguaaaauguucgaagcgacggccagaggggcaagaaggauggcaauucuuggugauacagcuugggacuucgguucgaucggcggcguauuuacaucaguagggaaauugguccaucaaauauuuggaaccgcauacgggguacuauuuucaggcguuuccuggaccaugaagauaggaauaggaguacugcugaccugguuaggacucaauagccgaucaacgaguuuaucgaugacaugcauagccguuggcuuaguuacauuauacuuagggguuaugguucaagcugauucaggaugcguuauaaauuggaaagguagagaacuaaaguguggcagcgguauuuuuguaacaaaugaaguucauacauggacugaacaauacaaguuccaagcagacucaccaaagcgauugucuacggcgauagggaaggcuugggaggaaggaguguguggcauucgaagugcuacacgucuugagaacauaauguggaagcaaauaucgaaugagcuuaaucauauacuucucgaaaacggaaugaaguucacuguagucguaggcgacguugcagggauacuugcucaggggaaaaagaugaucaggccccaaccaauggaacauaaauacaguuggaagaguugggguaaggcuaaaauuauaggcgcagauguucaaaacacuacauucauuaucgauggcccgaauacaccugaaugcccagaugaucagagagccuggaauauaugggaaguagaagacuauggauuuggcaucuuuacaacaaauauuuggcuuaaacugcgagacucuuacacccaaguuugcgaucauagauuaaugucggcugcaauaaaagauagcaaagcaguacaugcagacaugggauacuggauagaaagugagaaaaaugaaacauggaaacuugcuagggccucuuucaucgaagugaaaacguguaucuggccuaaaagucauacccuauggaguaauggcguacucgaaucagaaaugauaauaccaaaaaucuacggcgggccgauaucacaacauaacuaccguccagguuacuuuacucaaacagccggaccuuggcacuuagguaaguuggaguuagacuucgaucuaugcgaaggaacuacaguggugguagacgaacacugcggaaaucggggcccgucguuacguacaacuacagucacaggaaaaauaauccaugaauggugcuguagaaguuguacucuuccuccacucagauacagaggagaagauggguguugguaugggauggagauucguccaguuaaagaaaaagaagaaaacuuaguaaagagcaugguuagugcggguucaggcgagguugacucauuuucucuaggacuuuuauguauauccauaaugauugaagaaguaaugagaagcagauggagucgaaaaauguuaaugacuggaacuuuagcgguauucuuucuguuaauaaugggacaauuaacuuggaacgaccuaaucagguuauguaucaugguaggggcaaacgcaucugauagaaugggcaugggcacuacauaccuggcucucauggcuaccuuuaaaaugagacccauguuugcugucggauuacuuuuucgaagauugacaagucgcgagguauuacuacucacuaucggucucucauuaguagcuucaauggaacuucccaacagucuagaagaacuaggggauggucuagcuauggggauuaugauauugaagcuauugaccgauuuccaaucucaccaacucugggcgacucugcuaucucuuacuuucaucaaaacaacauuuucguuacacuacgcuuggaaaacuaucgcaaugguacugucaaucguauccuuguuuccgcuauguuugucaacuacaucacagaaaaccacguggcuaccgguauuauuggguucucucgggugcaagccguugacaauguuucuaaucgcggagaauaaaauauggggaagaaagucuuggccuuuaaaugaagggauuauggcagugggaaucguuucuauccuauugaguucuuuacuuaaaaacgacgucccguuagcugggccauuaauagcuggagggaugcugauugcguguuauguuaucagcggaaguagcgcagauuuaucgcuagaaaaagcagcagaaguaucgugggaagaggaagcugagcacuccggugcaucccacaauauauuaguggaaguccaggaugauggaacaaugaaaauuaaagaugaggaaagagacgacacccucacaauauuacuuaaggcaacauuauuagcaguaaguggcguauauccauuauccauaccggcuacacuguucgucugguauuuuuggcagaagaagaaacaaagaaguggaguacuaugggauacaccgucuccuccggaaguagaaagggcuguguuagaugacggaauuuaucguauaaugcaacgagguuuacuagggcguucacaaguaggcguaggaguuuuucaagagaauguauuccauacaauguggcacguaacuagaggcgccguacuaauguaucaggguaaacgccuagagcccucaugggccucaguuaaaaaggauuuaaucaguuacggaggaggauggcgccuucaggggucauggaauacaggagaagaagugcaaguaauagcuguagagccaggcaaaaaccccaaaaaugugcaaacagcaccuggaacauuuaagaccccagaaggagaaguuggagcaauugcauuagacuucaagccaggaacgagugguaguccuauaguaaauagggaagguaaaauaguaggauuauaugguaacggcguuguaacgacaaguggaacauaugugucugcaauagcacaggcaaaggcuucgcaggaaggaccacuuccugaaauugaagaugaaguauuccguaaaagaaaucuaacaauuauggaucuucaucccgguucaggaaaaacacggagauauuuaccagcuauaguacgcgaagcgaucaaaaggaaacuuagaacacuaauucuugcgccgacacgcguaguugcaagugaaauggccgaagcucuaaaagguaugcccauuagguaucagacaaccgcgguuaagucagaacacacaggcaaagaaauuguggaucucaugugucaugcaacauuuacuaugcgucuauuaucaccuguacgugucccgaacuacaauaugaucauaauggacgaagcacauuuuacggauccaaguucaauagcagcgcgaggauacauaaguacuagaguaggcaugggggaagccgcagcaaucuuuaugacagcgacucccccgggcagcguugaagcauucccacaaucgaaugcugucauucaagacgaagaaagggacaucccagaacguagcuggaacucaggcuacgaauggauuaccgauuuuccaggcaagacagugugguuugucccgagcauaaaauccggcaaugauauugcaaauugucuuaggaaaaacgggaaaagagugauacaguuaucuagaaaaaccuuugauaccgaauaucagaagacuaagaacaaugauugggacuauguaguaacuacagacauaucagaaaugggagcaaacuuucgagcugaccgagucaucgauccaagacguugucuuaaaccaguuauauuaaaagacggcccagaaagggugauucuugcaggacccaugccuguuacuguagcuagugcagcgcaacgaagaggacggauaggucguaaucacaauaaagaaggagaucaauauauuuauaugggacaacccuugaauaaugacgaagaccaugcacauuggacggaagcuaaaauguuacuagauaacauuaauacuccugaaggaaucauaccggcauuguuugaaccugaaagagaaaagucagcugcaaucgauggugaguaucgucuaagaggggaagcgaggaaaaccuucguugaauuaaugcgacgaggcgacuuaccagucugguugaguuauaaaguagccuccgagggguuucaguauucugauagaagguggugcuucgacggcgagagaaacaaucagguauuagaagaaaauauggauguggagaucuggaccaaagagggagagaggaagaaauuaaggccacguuggcuggaugcaagaacguacucggacccucuagcuuuacgugaguuuaaagaauuugcagcugggaggcgcucaguaucaggcgacuuaauccuugaaauugguaaauuaccacaacacuuaacccagcgcgcucaaaaugcacucgacaaucucgugaugcuucauaacucugaacaaggugguagagcguacagacacgccauggaagaacuaccagacacuauagaaacgcuuauguuguuagccuuaaucgcuguguugacaggaggaguaacauuauucuuucuaucugguaagggccuugggaagacuucuauaggauugcucugcguaauggcaucaagugcauugcuauggauggcuaguguagaaccccauuggauugccgcgagcauaauauuagaguucuuucuuaugguccuccucauucccgaaccugaccgucaaagaacuccccaagauaaucagcuagcuuauguggucauuggauuauuauucaugauuuugaccguagcugcaaacgaaaugggucugcuugaaacuacuaagaaagauuuaggaauaggccauguagcagucgaaaaucaucaucacgcagcaauguuagauguggacuuacaccccgcaagcgcuuggacuuuauaugcaguagcaaccacuauaauuaccccaaugaugaggcauaccauagaaaauacuacagccaauauaucauuaacagcaauugcaaaucaagcagccauucuaaugggcuuagauaaagguuggcccauaaguaaaauggauauagguguuccucuguuagcccuuggauguuauucucaaguuaauccgcuuacgcucacggcagcuguauuaauguugguagcccauuaugcuauaauagggcccggauugcaagcuaaagccacaagagaggcucagaaaagaaccgcggcgggaauaaugaaaaaccccacaguagaugggauaguagcuauagaucucgauccaguuguauaugaugccaaauucgagaaacaauuaggacaaaucauguuauuaauacuguguacaagccaaauucucuugaugagaacaaccugggcccuuugcgaaagcaucacccuggcgacaggcccucuuacaacucucugggaggguaguccaggcaaguuuuggaauaccacaauagccgucucgauggccaauauauuccguggaagcuacuuagcuggugccggacuggcguucucguugaugaaaucacuaggaggcggacguagggggacaggggcacagggcgagacacugggcgaaaaguggaaacgacagcuuaaucagcuaucuaaaagugaauuuaacacuuacaagagguccggcauuauggaaguagacagaagcgaagcgaaagaaggcuuaaagcgaggagagacaacgaaacaugcagugagucgagguacggccaaguuacgaugguuuguugagagaaauuugguaaagccagaaggcaaaguaaucgaccuagguuguggccguggcggauggaguuacuauugcgcgggucuaaagaaaguuacagaaguaaaggguuauacgaaaggaggaccugggcacgaagaaccagucccaauggccacauauggauggaaucuaguaaaauuacacuccgguaaagaugucuuuuucauaccacccgaaaaaugcgauacccuuuugugcgauauuggggagagcucaccgaauccaaccaucgaagaggguagaacauuacgcguccuuaagaugguagaaccuugguugagaggcaaucaguucuguauuaagaucuuaaaucccuauaugcccucaguuguggaaacuuuagagcagaugcagcguaaacacggugguaugcucguccgaaaucccuuaaguagaaauucuacgcaugagauguacuggguaaguugcgguacaggaaauauugugagugcgauuaacaugacaucacgaauguuauuaaaucgcuucacuauggcacauaggaaaccgacauaugagcgagacgucgacuuaggggcagguaccaggcauguagcaguagagccugaaguagcaaaucuagacauuauuggucagcgcauagagaacauuaagugcgaacauaaaucuacauggcauuacgaugaggacaauccguacaaaacaugggcauaccacggcucauaugaagucaaaccguccggaagugcgucaagcaugguaaacggaguuguuaaacugcuaacuaaaccaugggacgugauuccgaugguuacacagauugcgaugacugacacaacuccauucggacaacaacgaguguuuaaagagaaaguugauacuagaacuccaaaagcgaagcgagguacugcacaaauuauggaaguaaccgcuaggugguuauggggauuccugagcagaaauaaaaagccacguauaugcacgcgagaagaauuuacgcgaaagguucggagcaacgcggcuauaggggccguuuucgucgacgaaaaucaauggaacagugcaaaggaagcaguugaagacgaaagauuuugggaucugguucauagggagagagaacuacacaaacaaggaaagugcgcaacuuguguauacaauaugauggguaagagagaaaagaaacuaggugaauuuggaaaggcuaaaggaagccgugccauaugguacauguggcucggggcuagauuccuugaauuugaagccuuaggauuuaugaacgaagaucacugguuuagcagagaaaacagucuaucugguguggaaggugagggucuacauaaacuggguuacauacucagggacauuucuaaaauaucuggggguaauauguacgccgacgauacggcagguugggauacgcgaauaacggaagaugacuuacaaaacgaagcgaaaauuaccgagauaauggaaccagaacaugcucaguuagcaaaggcgauauuuaaacuaacuuaucaaaauaaaguugugagaguccaaaggcccgcgaaaaacgguacuguaauggauguaauaucgaggagagaccagcgaggcucagggcaaguagguacauaugguuugaauacauuuacaaacauggaggcccaguuaauuagacaaauggaauccgaggggaucuuuagccccucagagcuugaaacaccaaacuuggcagagcgcguacuagauugguuagagaaguacggaguagaaagauuaaaacgcauggcaauaucgggcgacgauugcgucguaaaaccaauugaugacagauuugccacggccuuaacggcauuaaaugauauggggaaagugaggaaggacauaccucaaugggaaccuuccaaaggauggaaugauuggcaacaaguucccuucuguucacaccauuuccaucaacucauuaugaaagauggacgagaaauaguagucccuugcagaaaucaagaugaguuaguuggccgggcaaggguaucacaaggagcagguugguccuuaagggaaaccgcuugccuuggaaaaucauaugcucagauguggcaacuaauguacuuccaucgcagagaccuuaggcuagcagcgaacgcuauuugcagcgcaguacccguugacugggucccgacaagcagaaccacauggaguauucaugcacaucaccaguggaugacuacagaagauaugcucagugucuggaaccgcguauggauugaagagaauccauggaugaaagacaaaacacauauaucuucuugggaagacguuccauaccucggcaaacgagaggaucaauggugcgguucgcuuauaggucuuacagcgagagccacaugggcgacaaacauucaaguugcaauaaaccaaguaagacggcuaauaggaaaugagaauuaucuagauuacaugaccagcaugaaacgauuuaagaacgaauccgaccccgaaggagcuuuaugguag

SEQ ID NO: 22125 - RNA, 9879 nt, Artificial Sequence
  derived and/or modified CDS sequence (opt6) from DENV-1__KU666939__SS-prME
ucaguaacuaugcugcuuauguugaugccaacggcucuugcauuccauuuaacuacgagagguggagaaccucauaugauuguuucaaaacaagaaagagggaaaucucuacuuuuuaaaaccucagcggggguuaacauguguacucuuaucgcgauggauuugggcgaacuuugugaagacacuaugaccuauaaauguccaagaaucacugaggcagaaccagaugacguggauugcuggugcaaugcuacggauacgugggugacuuacggaacaugcucucaaacgggugaacauagaagagauaaaagaucaguugcuuuggcaccgcacguaggauuagggcuagaaacucguacugaaacuuggaugucaucagagggugcauggaaacaaauccaaagaguagaaacguggguauugcgucauccgggcuucacaguuaucgcacuauuucuggcacaugccauaggaacaaguauaacucagaaaggaauaauauucauauuacuaaugcuaguaacucccagcauggcaaugaggugcguuggaaucggaaguagagacuucguggaaggucugucaggcgcuacgugggucgacguaguauuggaacauggaagcuguguaaccacuauggcaaaagacaaaccgacauuagauauugaacuucucaaaacagaagugaccaacccugcaguacuuagaaaauuauguauugaggcaaaaauaucaaauacgacuacugauucaagaugcccgacacaaggagaagcaacgcuagucgaagaacaggaugccaauuucguauguaggcgaaccuuuguagaucgagguuggggaaauggaugcggguuauuugggaaaggcaguuuaauuacaugugcuaaauucaaaugcguuacuaaauuggagggcaaaauaguacaguacgaaaauuuaaaauauagugugauuguaacaguccauaccggagaucaacaccagguagguaacgaaagcacugagcacggaacaaccgcuacaauaaccccgcaagccccaaccacugaaauacaacuuacagauuauggggccuuaacuuuggauugucugccgaggacaggcuuagauuucaacgaaaugguccuauugaccaugaaagaaaaaucaugguuaguucauaaacagugguuucuugaucuaccacucccuuggacaaguggagcuagcaccucccaggaaacauggaaucgacaggaccuguuagucacuuucaaaacagcacaugcuaagaaacaagaagugguuguccuaggaucccaagaaggagcuaugcacacggcguuaacaggcgccacagaaauccaaaccucaggcaccacuacaauauuugcuggccaccuaaaaugucgucuuaaaauggacaaauugacauuaaaaggcaugucauauguuaugugcacgggaucguuuaaacuagaaaaagaagucgcagaaacucaacacggaacuguccugguacaaauuaaguacgaagguacggaugcgccgugcaagauacccuuuucuacccaagaugaaaaaggaguaacucaaaauggucgacuaauaacugcgaauccuauuguuacagauaaagaaaaaccaguuaauauagaagcggaaccaccauuuggggaaagcuauauaguaauaggggcaggagaaaaggcacuaaaacucucaugguuuaagaagggaucauccauaggaaaaauguuugaggcuacggcgcgaggagcccgaaggauggcaauacuaggcgacaccgcaugggauuuuggaagcauaggcggaguauuuacaaguguuggaaaguuaguccaucagauauuugguacugcguacggaguucuuuucuccggaguauccuggacaaugaaaauaggcauaggcguauugcuuacguggcucggguuaaacagcagauccacgucauuguccaugacaugcaucgcaguggguuuagucacuuuauacuugggagucauggugcaagcagacucugguuguguuauaaacuggaaaggucgugaauuaaaaugcggaagcgggauauuuguuacaaaugaggugcacacauggacugaacaauacaaauuccaagcggauagucccaaaagacuguccgcagcgauuggaaaggcaugggaggaaggagugugugggauaagaagcgcaaccagguuagaaaauauuauguggaagcaaauaaguaaugaacugaaucauauauuacuagagaaugauaugaaauuuacaguaguaguaggugacguagccggaauacuugcacaagggaagaaaaugauaagaccgcaaccuauggagcauaaauauuccuggaaaucuugggggaaggcaaaaauuauuggggccgacgugcaaaauacaacguuuauaauagauggaccaaacacaccggaauguccagaugaucaaagagcauggaacauuugggaaguagaagacuacggauuuggaauuuuuacaaccaauauaugguuaaaacuacgugacucauauacgcaaguaugugaucaucgauugaugagugcugcgauuaaagauagcaaagcaguacaugcugauaugggauauuggauugaaagcgagaaaaaugaaacuuggaaacuggccagagcuucuuuuauugaaguuaaaacuuguaucuggccaaaaagucacacgcuauggucaaauggaguacucgaaagcgagaugauuauaccuaaaauauauggaggaccuauaucucagcacaacuaucguccugguuacuucacacaaacagcaggccccuggcaccuaggaaaguuagaauuagacuuugaccucugugaaggaacaacaguaguuguggacgaacacuguggcaaucgugguccaaguuuacggacgacuaccguaacggggaaaauaauacaugaauggugcuguagaaguuguacacuaccaccacuaagauuccggggagaggauggaugcugguauggaauggaaauaagaccuguaaaagaaaaagaggagaaucucgucaaaaguaugguaagcgcgggcucuggggaggucgauaguuuuucucuaggucuacuguguauaucgauaaugauagaagagguuaugcgaagccgauggagcaggaaaaugcuuaugacugggacucuugcaguauucuuccuucuaauuaugggucaacuaacuuggaacgaccugauaagacuuuguauaaugguaggugcgaacgccucugaccgcauggggauggggacgacauauuuagcacugauggcuacauucaaaaugaggccaauguucgcggugggcuuauuguuccgacgguuaacuucacgagaaguauuguugcuuacgauugggcuauccuugguugccuccguagagcucccaaacucucuagaagaauugggagacggcuuagcuauggggauuaugauuuuaaaauuacuaacagacuuccaaagccaccaacuaugggcaacacuucuaucuuuaacuuuuauuaaaacgacuuuuaguuugcacuaugcauggaaaacaauggcaaugguuuuaucuaucgugucauuaauaccgcuauguuuaucuaccacuucucagaagacaacuuggcuuccuguucuccuggguagucuaggaugcaaaccauuaaccauguuuuuaaucgcggaaaauaaaauuuggggucgaaagucuuggccccuaaaugagggaauuauggcgguagguauaguuaguauccuacugagcucguuacuuaaaaaugacguuccgcuagcuggacccuuaauugcggguggaaugcugauagcauguuaugucaucucugguaguagcgcagacuuauuacuagaaaaggcugcagaaguuagcugggaagaagaagccgagcacucaggggcgucacauaauauauuagucgaaguacaagacgauggaacgaugaagaucaaagaugaagaacgcgaugauacuuuaacgauauuguuaaaagcuacccuucucgccauuuccgguguuuauccccucucaaucccggcaacauuguucguuugguauuuuuggcagaagaagaaacagaggucaggcguacucugggauacuccuuccccaccugaaguagaaagagcgguacuggaugacgggauauacagaauaaugcagcguggccuucuuggucgcucacagguaggcguuggaguauuccaagaaaauguauuucauacaauguggcacgucacacguggagccguccuuauguaccaagguaaacgucuggaaccaaguugggcgucugugaagaaagauuugaucagcuaugguggcggcuggaggcugcaagguagcuggaauacuggagaagagguacaaguaauagcaguggaaccgggcaaaaacccaaagaacguacagacagcacccgguacauucaagacaccagagggcgaaguaggggcaauagcucuggacuuuaaaccaggcacaaguggcagcccuauugucaauagagaggggaagauaguaggguuauauggaaacgguguagugaccaccucaggcacuuacgucucagcuauugcgcaggcaaaggccucacaggaagggccauuacccgaaauugaagaugagguuuuucgcaagagaaauuuaacgauaauggauuuacauccagguucaggaaaaacaaggagguaucuuccugcaauagucagagaagcaauuaagaggaaacuacgcacauugauauuagcaccaacaagagugguggcuagugaaauggcagaggcuuuaaaagguaugccgauaagauaucagaccacugccgucaagucagaacauacuggaaaagagauaguggaucuaaugugucacgcaacuuuuacgaugcgacuuuuaucucccguacggguaccuaauuauaacaugaucauaauggaugaagcucacuuuaccgauccaaguucuauagcugcacgaggguauaucucuaccagaguggguaugggagaggcagccgcaauauucaugacugccacuccuccugguaguguagaagcauuuccucaaucaaaugcgguaauucaagacgaagaacgagauaucccagaaagaucauggaacaguggauaugaguggauaacagacuuucccggaaagacagucugguucguucccucaauaaaaucaggaaaugauauagcuaauugucuucgaaagaacgggaaaagaguuauucagcucuccagaaagacauucgauacagaauaucagaaaacgaaaaacaacgauugggacuacguaguaacaacagacauaucagaaaugggcgcuaauuuccgagcagauagggugauagacccaagaaggugucuaaaaccagucauccuuaaagaugguccugaaaggguuauacuagcgggcccuaugccaguuacgguagcaagcgcagcucaaagaagagguagaauaggcaggaaucauaacaaagaaggugaucaguacaucuacaugggacaaccucucaacaaugaugaggaucacgcacauuggacagaggcaaagauguuauuggauaacauaaacacccccgaagguauaauaccggcuuuauucgaaccugaacgagaaaagucggcagcuauagauggggaguaucgauuaagaggagaagcgagaaagacuuucguagaguugaugagaagaggagaccuaccuguauggcucaguuauaaaguagcaucugaaggauuccaauauagugacaggagaugguguuuugauggagaacggaauaaucaaguacuagaagagaacauggacguagaaauuuggacgaaagagggagaaaggaagaaacuaagaccacguugguuagacgccagaacauacucugacccauuggcacuacgugaauuuaaagaauuugcagcaggucgaagaucuguaucaggcgaucuaauauuagaaauaggcaagcuaccacaacauuugacacagagggcucaaaacgcuuuagauaaucuagugauguuacauaacucagaacaaggagguagagcauauagacacgcaauggaagaauuaccggauacuauugaaacacuaaugcucuuagcgcuaaucgccguucuaacagggggugucaccuuauucuuuuugucaggaagagggcuuggcaaaacgaguauugguuugcuaugcguuauggcauccagcgugcuauuguggauggcauccguggaaccacacuggauugcagcuucgaucauucuggaauuuuuccuaaugguauuacugaucccagaacccgaccgccaaaggaccccgcaagacaaucagcuagcuuacguuguaauaggauuauuguuuaugauccuuacuguagcagcgaacgaaaugggauuauuagaaacaacuaagaaagaccuuggaaucggacaugucgccguagagaaucaccaucaugcuacuaugcuugauguagaccuacaucccgccucggcauggacacuguaugccguugccaccacaaucaucacuccaaugaugagacacacaaucgaaaauaccacagccaauauuucacuuacagcaaucgcaaaucaagcagccauacuaaugggacucgauaaagguuggcccauuucaaaaauggacauugggguacccuuguuagcacuugguuguuauagccaagucaauccacuaacauuaacagcagcaguauuaauguuagucgcccacuacgcaaucauaggcccagguuuacaggcgaaggcaacgagagaagcccaaaaacgaacugcagcaggaauaaugaaaaacccuacaguugacggaaucguagcuauugacuuggauccagugguuuacgacgcaaaguuugaaaaacaacucggacaaaucaugcuccuaauccucuguacaucucaaauacuacugaugcgaacuacaugggcauuaugugaguccaucacacuagcaaccggaccacuuacuacacuuugggaagguucaccuggaaaauucuggaacacaacuaucgcugugaguauggcgaacauauuucgagguucuuaucuugccggugcaggcuuagcauuuagcuuaaugaaaaguuuggguggaggucgaagaggaacaggugcccagggugaaacauugggugaaaaauggaaaagacagcuuaaucaacuaucaaaaucagaauuuaacacauauaaacgaucggggauuauggaagucgaucguucagaagcuaaggaaggacucaagagaggagagacuacaaaacaugcagugagcaggggaacagcgaaauuaagaugguuuguagaaagaaauuuaguaaaaccugaagguaaagugauagauuuaggguguggacguggaggguggagcuauuauugugccggacucaagaaagucacagagguuaaggguuauacuaaagguggaccaggacaugaagaaccaauaccgauggcgaccuacggauggaauuuagucaaguuauacagugguaaagacguauucuuuauucccccagaaaaaugcgacacauuacuuugugacauaggcgaaucaucccccaacccgacaauugaagaagguagaacccuuaggguccucaagaugguggaaccguggcucagaggcaaucaauuuugcauuaaaauccucaauccuuacaugccuuccguuguagagacguuggaacaaaugcaacgaaaacacggagggaugcuuguucggaacccauuaucgaggaacucgacacacgagauguacugggugucaugcggaacugggaacauaguaucggcugucaacaugacaagucguaugcuuuuaaauagguuuacgauggcgcacagaaaaccaacauacgaaagagacguagaccugggcgcaggaacaaggcacguugccgucgagccagaagucgcuaaucucgauaucauaggccaacgcauugaaaacauaaaacacgagcauaaaucgaccuggcauuaugacgaagauaacccauacaaaacuugggcuuaccacgggagcuacgaaguaaaaccaucaggcuccgccaguaguaugguuaacggaguaguaaaauuguuaacuaaaccaugggacguaauuccaaugguuacacagauugcgaugaccgacacaacgccauucggacaacaacggguguucaaggaaaaaguagauacucggacaccaaaggcaaaacgcggaacugcucaaauaauggaaguuacugccagauggcuauggggauuuuugucacgcaacaagaaaccuaggaucuguacgcgcgaagaauuuacuagaaagguaagaucaaaugcugccaucggagcgguguuuaucgacgaaaaucaguggaacagcgcgaaagaagcgguggaggaugaacguuucugggaucuaguacacagagaaagagaacuccacaaacagggaaaaugugcgacauguguauauaacaugaugggcaaacgggagaagaaauuaggagaauuugguaaagcaaagggaaguagagcuauuugguauaugugguuaggggcgcgcuuucuggaauuugaggcuuugggauucaugaaugaagaucauugguuuaguagagaaaacagucucucggguguugaaggagaaggguuacauaaauuaggauacaucuugagggauauaaguaaaauaccaggaggaaacauguacgcagacgauaccgccggaugggauacaagaauaacugaagaugaccuacaaaacgaagcaaagauaacugacauaauggaaccggaacacgcguuacuugcaaaagcaauuuuuaaauugacuuaucaaaauaaaguagugagaguccagagaccagcaaagaacgggacgguaauggauguaauaucacgaagagaccagagaggaucaggucaaguagguacauacggguuaaacacauuuaccaacauggaagcucaacuaauuagacagauggagucggagggaauuuuuaguccguccgagcuugaaacgccuaaucuggcugaacgcguguuagauuggcuugggaaauaugguguagagagauugaaacgaauggcuauaagcggcgaugacugcguagucaaaccaauugaugacagauucgcaacggcuuuaacugcgcuaaaugauauggguaaggugaggaaggauauaccacaaugggaaccuucgaaagguuggaaugacuggcagcaaguaccguuuuguagccaccauuuucaucaacuaauuaugaaagacggcagggaaauagucguuccgugucguaaucaagaugaguuggucggucgcgcccgcgugagucaaggugcaggguggucacuccgcgaaaccgcuugccuugggaagucuuacgcucaaauguggcagcuaauguacuuucauagacgugauuuacgacucgcagcaaacgcuauuuguucagcggucccaguagauugggugcccaccucgcgaacuacauggaguauucacgcacaucaccaguggaugacaacagaagauauguuaucaguauggaauagaguguggauagaagaaaaucccuggauggaggacaaaacacacauaucgaguugggaagacguaccuuauuugggaaaacgggaggaucaauggugcggcaguuuaaucggucuaaccgccagagccacuugggccacgaacauucaaguugcuauaaaccaagucagaaggcuaauagguaacgaaaauuacuuagacuacaugacgucaaugaaaagauuuaagaaugagagugacccggaaggagcauugugguag

SEQ ID NO: 22126 - RNA, 9879 nt, Artificial Sequence
  derived and/or modified CDS sequence (opt6) from DENV-1__KU666940__SS-prME
agcguuacaaugcugcuaauguugacuccuacagcgcuagcguuucaucuaacuacgagaggaggugaaccacacaugauagucaguaaacaagaaagagguaaaagucuacucuuuaaaacuagcgcugguguaaauauguguacauugauugcaauggaucugggagaauuaugugaagauacgaugacuuauaaaugcccaagaauuaccgaagcggaaccagaugacgucgauugcuggugcaaugcaaccgacacaugggugacauacggaacauguucacaaacaggugaacauagacgagauaaacguucgguugcuuuggccccacauguggguuuaggucuagagacaaggacugaaaccuggaugaguucugaaggagcguggaaacaaauccaacgaguagagacgugggcucuaagacauccgggauucacaguaauugccuuauuucuagcgcacgcaaucggaaccucaaucacccaaaaaggcauaauuuuuauauuacuuauguuaguaacuccauccauggccaugcgcugugugggcauagguuccagagauuucguagaaggguugucuggcgcaacuuggguugaugucguacuugaacacgggucaugcguuacuacuauggccaaagauaaacccacauuagauauagagcuucugaaaacagaaguaacgaaucccgcgguacugcguaaauuaugcaucgaagcaaaaauaaguaacacgacgacagauagucgaugcccaacucaaggugaggcaacuuugguggaagaacaagaugcgaacuuuguguguagaagaacauucguugacagaggcuggggcaacggauguggacuauuugguaaagguucuuuaauuacaugugcgaaauuuaaaugugucacuaaacucgaagggaaaauuguucaguaugaaaaccugaaauacuccguuaucguaacaguucauacaggggaucaacaucaaguggguaacgaaaguacagagcacggaacaacagcuacuauaacgccccaagccccaaccaccgaaauucaacuaacagacuauggagcguuaacucucgacugcagcccaaggacagggcuugauuuuaacgagauggucuuauugacaaugaaagagaagaguuggcuaguacauaaacaaugguuuuuagaucugccucuaccuuggacauccggagcuaguacgagccaggaaacuuggaauagacaagaucuucuagucacuuucaaaacagcacaugcuaagaaacaagaagucgugguccuugguagucaggaaggggcuaugcauaccgcucuaacaggagcuacugaaauacaaacaucaggaacaacuacaauauucgcgggacauuuaaaaugucgacuaaaaauggacaaacuaacgcuuaaaggaaugucguauguaauguguacugguucuuucaaacuagaaaaggaagucgcagagacacaacacggaacaguuuuaguucaaauuaaauacgaaggaacggacgcucccugcaaaauaccauucucuacucaagaugaaaaaggugucacacaaaacggacgccucauuacagcaaauccuauaguaacggacaaagaaaaaccggugaacauagaagcagaaccuccuuuuggagaaagcuacauaguuauuggagcaggagaaaaagcucuaaaauuaucaugguuuaaaaaggguucguccauugguaagauguucgaggcaacagcacgaggugcaagaaggauggcaauacuuggggacacugccugggauuuugguucaauuggaggaguauuuaccaguguuggcaagcuaguacaccagaucuuugguacugccuaugguguuuuauuuaguggcguuagcuggaccaugaagauaggcauuggugucuuacuaacuuggcuugggcuaaauucucguucgacgucacucaguaugacauguaucgcagucggccuaguaaccuuauaucuaggaguaaugguccaagcagauucuggcuguguaauaaauuggaaggggcgcgaguuaaaaugugggucugguauuuuuguuacuaaugagguucauacauggacugagcaguauaaauuucaagcagacaguccuaaacgauuaagcgcugcaauagguaaagcaugggaggaagguguaugugggauaaggucggcgacacgguuagagaauauuauguggaaacaaauuagcaacgaguuaaaccacauacugcuagaaaaugauaugaaguuuacuguaguaguuggagacguugcagggauacuagcacaaggcaagaaaaugauucguccccaaccaauggaacacaaauacagcuggaaaucaugggguaaagcgaagauuauaggcgcugaugugcaaaauacgacauuuauaaucgacgggccuaauacaccggaaugccccgacgaccaacgggccuggaauauuugggaaguugaggacuauggguucggaauuuuuacuaccaacaucugguuaaaacuuagagauaguuacacacagguaugugaucaucgauuaaugagugcugcaauuaaagacucuaaggcuguucaugcagauaugggauauuggaucgaaagugaaaagaacgaaacuuggaagcuggcaagagcaaguuucauagagguaaagacauguauauggccaaagagucacacauuauggucaaauggaguauuggaaucagaaaugauaaucccuaagauauacgggggcccaauuucucaacauaacuacagacccggguauuuuacucaaacagcagggccuuggcauuuaggaaaacucgaauuagauuuugaucuaugcgaagggacaaccguugugguugacgaacacugcggaaacagggguccaaguuugaggacaacuacaguuacugguaaaauuauacacgaauggugcuguaggagcuguacguuaccaccauuaagguauaggggugaagacgguuguugguacggcauggaaauuagaccaguuaaagaaaaagaagaaaaucuaguaaaaagcaugguuagcgcugguucaggcgaaguggauaguuuuagucugggacuccuauguaucucaaucaugaucgaagaaguaaugagaucuaggugguccaggaaaaugcuaaugacaggcaccuuagcugucuucuuuuuauugauuaugggacaacuaacuuggaaugaccuaaucaggcuuugcauaauggugggagcaaaugcauccgaccggauggguaugggcacuacguauuuagcgcuuauggcgacuuuuaaaaugaggcccauguucgcaguaggccucuuauuuagaagacucaccagcagagaaguucuauuacuaaccauuggacuaaguuugguagccuccguagaacuuccaaacucacuugaggaacucggagauggauuagcaaugggaauuaugauacuuaaguuacuuacagauuuccagucgcaccaguuaugggcaacacuguuaucacuuacauuuauuaaaacuacauuuagucuacauuaugccuggaaaacuauagcgaugguacugucgauuguuagccuguucccccuauguuuaucuaccacaucacagaaaacaacuuggcuuccgguacuguuaggaucacuaggaugcaaaccacuuacaauguuucuaauagccgagaauaaaauaugggggagaaaaucuuggccacucaaugagggaauuauggcaguagguauuguaaguauauuacuuagcucguuguugaaaaacgaugugccacuagcagguccguuaauugcuggaggaauguugauagcauguuauguaauaucgggaucguccgcggauuuaagucuagaaaaagcggcugagguguccugggaagaggaagcagaacacucgggagcaucucacaacauucuuguagaaguucaggacgauggcacgaugaagaucaaggaugaagaaagggaugauacacuaacgauacuauuaaaagcgacgcuauuagcaguaaguggcguuuacccacuaucaauaccugcaacauuauuugugugguacuuuuggcagaagaaaaagcaacgaucaggaguauugugggacacacccucaccucccgaaguagaaagggccguauuagacgaugguauauauagaauuaugcaacgaggucuauuagggcgaagccaaguagguguaggaguuuuucaagagaauguguuccacacaauguggcauguuacaagaggcgcagucuuaauguaucaggggaaacgguuggaaccgucaugggccucaguuaaaaaggaccuaaucaguuacggagggggauggcgacuccaaggaucuuggaacacaggagaagaaguccaaguaauagcaguagaaccagggaaaaauccgaagaauguacaaacugcaccuggaacuuucaagacaccagaaggggaaguuggcgcuauagcguuagauuuuaaaccaggaacuagcggaaguccaaucguuaauagggaaggcaagauuguagggcuauacgguaauggcgucguaacaacgucagguacauacgucucagcuauugcccaggcaaaagcaagccaggaggguccacuuccagaaaucgaagacgaaguuuucaggaaaaggaauuuaacgauaauggauuugcaccccgguucaggcaaaacacgacgcuaucuuccagcaauaguaagggaagcgaucaagcguaaacuacgcacucucauacucgcuccuacacgaguaguagcuucugagauggccgaagccuuaaaaggaaugccgauaagauaucagacgacagcugucaaaucugaacauacuggaaaagaaauaguagaccugaugugccacgccacauucaccaugagacugcucaguccgguaagagugccaaauuacaauaugauuauaauggacgaagcccauuuuaccgacccuucauccauugcagcuagagguuauaucaguacacgcguuggaaugggagaagcagcagcuauuuucaugaccgcuacaccacccggauccguggaagccuuuccacaaagcaaugccgucauucaggacgaagaaagagauauaccagagagaucauggaacucaggguaugaauggaucacugacuucccugguaaaaccguuugguuuguacccucaauaaaaucagguaaugauauugcaaauugucuaaggaaaaaugguaaaagaguaauucaguugagucggaagacauuugauacagaauaucagaaaacaaagaacaaugauugggacuauguggucacuacagacauaucagaaaugggagcaaauuucagagcagacagaguuauagauccuagaagguguuuaaaacccguuauucuuaaagacggaccggaaagagugauucuugcgggaccuaugccugugacagucgcaucggcugcucaaagaagagguagaauugguaggaaucacaacaaagaaggggaccaauacauauauaugggacaaccacuuaauaacgacgaagaucaugcccauuggaccgaagcgaaaaugcuucuagauaauaucaacacgcccgagggaauaauaccagcuuuguucgaaccagaacgggaaaagagcgcagcuauagauggugaauaccgucuaagaggagaagcaagaaaaacauuuguugaacuuaugagaaggggcgaccuuccaguuuggcuaucauauaaagucgccuccgaaggguuccaauauucugaucgacgaugguguuuugacggagaaaggaacaaccaaguacuugaagagaauauggauguugaaaucuggacgaaagagggugaaaggaagaaacuaagacccagauggcuagacgcaaggaccuacagugauccacuagcguugcgagaguucaaagaauuugcagcuggaagacgaagcgucucaggggaccuuaucuuagagauugguaaacugccucagcacuuaacccaaagggcgcaaaaugcccucgauaauuugguaauguuacacaacucagaacagggcgguagagcauauaggcaugcaauggaagaacucccagacacaauagaaacacugauguuacuggcgcuaaucgccguauuaacuggaggcgugacucuauucuuuuuaucaggaaaaggauuagguaaaacaucgaucggacuauuauguguaauggcaaguucugucuuguuguggauggcgaguguagagccgcauuggauugcggcguccauaauccuugaauuuuucuuaaugguacuucucauaccugagccagaucgucaacgaacaccucaagacaaucaacuggccuacguaguuauaggauuauuauuuaugauucuaaccguggccgccaacgaaaugggacuacucgaaacaaccaaaaaggacuuaggaauaggacacgucgcaguagaaaaucaccaccaugcagcaauguuggacguagauuuacauccugcaagugcauggacacuuuacgcuguugccacaacgauuauaacaccaaugaugagacauaccauagaaaauacaacagcgaacauuucauugacggcuauagcaaaucaagcugcaauuuuaaugggacuagacaagggauggccgaucaguaagauggacauaggcguuccucuuuuggcauuagguugcuacagucagguaaacccgcuuacguugaccgcugcagucuuaauguuaguagcgcauuacgcaauaauaggcccaggacuacaggcaaaagcaacacgcgaagcccagaaaagaaccgcagcaggaaucaugaaaaacccuacaguugauggcaucguagccauagaucuggacccgguuguguaugacgccaaauuugagaagcaauuagggcaaauaaugcuccuaauacuaugcacaagccaaauuuuacuuaugaggacaaccugggcccucugcgaaucuauuacuuuggcuacugggccucuuacuacccucugggaagguucuccagggaaguuuuggaauaccacaauagcaguuaguauggcaaauauauuucgagggucauaucuugcaggagcuggacuugccuuuucauuaaugaaaucacucggcggaggucgaaggggaacuggugcacaaggggaaacccuuggugagaaauggaaacgccaacuaaaucagcucaguaaaucugaauuuaauacuuauaagagauccgggauaauggaaguagacagaucagaagcuaaggaaggacugaagcgaggcgaaaccaccaaacaugccgucagucgagggacagcgaagcuacgaugguucguugagcgaaaccuaguuaaaccugaagguaaaguaauagauuugggcuguggaagaggggguuggucuuacuauugcgcgggucucaagaaaguuacagaagucaaagguuauacaaaaggagguccuggccacgaagaaccagucccaauggcuaccuacgguuggaacuugguaaaauuacauucaggaaaagauguguucuuuaucccaccagaaaaaugugauaccuugcuuugcgauauuggagaaaguaguccaaauccaacuauugaagaaggcagaacgcuacgaguucugaaaaugguagaacccugguuacgugguaaucaguuuuguauaaaaauccugaacccauauaugccuuccguaguggaaacgcuagaacaaaugcaacgaaaacacgggggaaugcuaguaaggaacccucuuucuagaaacucgacacaugaaauguacuggguaucaugugguacggggaacauagugucagcgauaaacaugacauccaggaugcuauuaaaucgauucacaauggcacauagaaaaccgacuuaugaaagagauguagaucucggugcuggaacaagacauguugccgucgagccggagguagcuaaucuagacaucauuggccaaagaauugaaaacauaaaaugcgagcauaagucuacauggcauuaugacgaagacaacccauacaaaacgugggcuuaucacgguucuuacgaagucaagccaagcggcagugcaagcucaaugguuaacggggucguuaaguuacuaacaaaaccaugggaugugauaccgaugguuacacagauagccaugacugacacaacuccauuuggacaacagagaguguuuaaagaaaaggucgauacacgaacuccuaaggcaaaaagaggcacagcucaaauaauggaaguuacggcccguugguuaugggguuuucugucucgcaauaagaaaccuagaauauguacaagagaggaauuuaccagaaaagugaggucaaaugcagcaaucggugcuguguuuguagaugaaaaucaguggaacucagcuaaagaagcggucgaggaugagagauuuugggaccucgugcaucgggaacgcgagcuacauaaacagggaaagugugcgacuugcguauacaauaugaugggaaagcgugagaagaaacucggagaauuugguaaggcuaaggguucgcgagcuauuugguacauguggcucggggcuagauucuuagaguucgaagcauuagguuucaugaaugaggaucauugguucagccgcgaaaauuccuuaucggggguggagggcgaaggacugcauaaacuaggcuauaucuuacgggacauaucuaaaauuucaggagguaacauguacgcagacgauacugcgggaugggauaccagaaucaccgaagaugacuuacaaaaugaagcaaaaaucacugaaauuauggaaccugaacacgcacaauuagcuaaggccauauuuaagcuaacauaccaaaauaaaguggugcguguacagcgaccugccaaaaaugggacggugauggacguuauaucaagacgagaucaaaggggcuccggacaaguaggaacuuauggguuaaauacuuucacgaauauggaagcucaacuaauucgucagauggagucagaagggauauucucaccgagugaguuagagacaccgaacuuagccgaaagggucuuagauuggcuagaaaaauauggcguugagcguuuaaaaaggauggcuauuaguggggacgauuguguaguuaaacccauugacgauagguuugcaacagcacugacagcgcuaaacgauaugggcaaggugagaaaagauaucccacaaugggagccaucgaagggauggaacgacuggcagcaaguaccauuuuguucgcaccauuuucaccaauuaauuaugaaggacgguagagaaauaguaguaccaugccgcaaucaggaugagcuaguuggaagggcucguguuucacaaggagcaggauggucuuugagggaaacagcaugcuugggaaaaucauaugcacaaauguggcaacucauguauuuucaccgaagagauuugcgcuuagcagcuaacgcuauauguuccgccgugccaguagauuggguuccgacauccaggacaaccuggucaauacaugcgcaucaucaauggaugacuacagaagauauguuaagugucuggaaccgcguauggauagaagaaaauccguggaugaaagacaagacccacauuagcagcugggaagauguaccuuauuugggaaaaagagaagaccaauggugcgguagccuaaucggucuuacagccagagcgaccugggcaacaaacauacagguugcgauaaaccaagucagaaggcuaauagggaaugagaauuauuuggacuacaugacgucuaugaaaagguuuaaaaaugagucagauccugaaggagccuuaugguag

SEQ ID NO: 22127 - RNA, 9879 nt, Artificial Sequence
  derived and/or modified CDS sequence (opt6) from DENV-1__KU666941__SS-prME
uccgucacaaugcuuuuaauguuaaugccgaccgcccucgcuuuccaucugacaacccgugguggggagccccacaugauuguaucgaaacaagaaagaggaaaaucuuuauuauuuaaaacaagcgcuggugugaauauguguacccuaaucgcgauggaccugggagaacuaugugaagacaccaugacauauaaauguccucguaucacugaagcugaaccggaugacguagacuguuggugcaacgcgaccgauacuuggguaaccuauggcacguguucucaaacaggcgaacaccguagagauaaaagauccgucgcccuugcgccacacgugggcuugggucucgaaacgcgaacagaaacguggaugucuuccgaaggagcauggaaacagauucaaaggguagagacuugggcacugagacacccaggauuuaccguaauugcucuguuccuagcucaugcuauaggcacuucuauuacacagaaagguauaauauuuauuuugcuaauguugguuacgccaucaauggcgaugagaugcguugguaucggaucuagagacuuugucgaaggacuuucuggagcaacguggguugauguaguauuggaacaugggagcugcguuacaacaauggccaaagauaaacccacccuggauauugaauuauuaaaaacagagguaacuaauccugccguauuacgcaaacuuugcauaggggcgaaaauaagcaauaccaccaccgauaguagguguccaacucaaggggaggcuacgcuuguagaagaacaagaugcaaacuuugugugucgacgaaccuuuguagaccgugguuggggcaacggcuguggacuguuuggcaaaggcucuuugauaacuugugcaaaauucaaauguguaacuaaacuggaggggaaaauaguacaauaugaaaaccuaaaauauuccguaauuguaacuguucauacaggagaucaacaccaaguggguaaugaaagcacagaacauggaacaacagccaccauaacaccacaggcacccacuacagaaauacagcuaacagacuacggcgcuuugacuuuagacugcucuccacgaaccggcuuagauuuuaaugaaaugguuuuauuaaccaugaaggaaaaaucaugguuaguacacaagcaaugguuucuagaucucccauuaccuuggaccagcggagcaucaacgagucaagagacuuggaauaggcaagaucuauuggucacauucaaaacggcacacgcuaaaaagcaggaaguaguuguccuaggaucucaagagggcgcaaugcauacugcgcugacaggugcuacagaaauucaaacgucaggaacaacgacaauauuugcuggucacuuaaaauguagguuaaagauggacaaauugacuuuaaaaggaaugaguuacgucauguguacuggaucguucaaacuugagaaagaaguagcagaaacacaacaugguacaguauugguucaaauuaaauacgaagggacagacgcaccaugcaaaauaccuuuuuccacucaagaugagaaaggagugacgcaaaacgguagguuaauaacagcaaauccuaucgucacugauaaggaaaaaccagugaauauagaggcagaaccuccauucggugaaucauauauagugauaggggcgggagagaaggcucuaaaauuaaguugguuuaagaaagggucgucgauugggaaaauguuugaggccacggcucggggagcacgacgaauggccauauuaggcgauacagcuugggacuuuggcucuaucggagggguuuuuacaagcguuggaaaacugguacaucaaaucuucggaacugcauaugguguauuguuuaguggcguaucuuggacgaugaaaaucgguauugggguucuauuaacaugguuaggacuuaacaguagaaguacgagcuuaagcaugacaugcaucgccguugggcugguaacccuuuaccuagggguuauggugcaagcagauaguggaugugugauuaauuggaaaggaagggaacugaaaugcggauccgggauuuucgugacaaaugaggugcauacuuggaccgagcaauauaaauuccaagcagauucucccaaacgacugagcgccgccauagggaaagcaugggaggagggagucugugguauucgaucugccacacgguuggagaauaucauguggaaacaaauuuccaaugagcuuaaccacauuuuauuagagaacgacaugaaauucacagugguagucggagaugucgccggaauacuagcucagggcaagaaaaugauccggccacaaccuauggaacauaaauacuccuggaaauccuggggaaaagcgaaaauuaucggugcugacguccaaaauacuacuuuuauuauagacggucccaacacuccggaaugcccagacgaucaacgagcauggaauaucugggaagucgaagacuauggauuuggaaucuuuacuacaaacauaugguuaaaacuacgagauucauauacccaaguaugcgaucacagauuaaugucugcggcaauaaaagauucaaaagcaguccaugcagauauggguuacuggauugagucugaaaagaacgaaacuuggaaauuagcaagagcuuccuucauugaaguuaaaaccuguauauggccaaaaucacauacguuauggucaaacgguguacuugaaagugaaaugauaauuccgaaaauauaugguggaccgauaucgcaacauaauuaccgcccaggauauuucacucaaacagcaggaccauggcaccuuggaaaacuggaacuggauuucgacuugugugaagguacaaccgucgugguagacgaacacugcggaaacaggggaccuaguuugcgaacgacaaccguaacggguaaaaucauucaugaauggugcugcagaucgugcacguuaccacccuuacgcuauaggggagaagacgguugcugguacgguauggagauuagacccguaaaagaaaaagaggaaaaucuugugaaguccaugguuagugcgggaaguggugaaguugauucuuucagcuuaggucuguuguguauaaguauaaugauugaggaaguuaugcguaguagguggucaagaaaaaugcuaaugacaggaacgcucgcugucuucuuucuauuaaucaugggacaauugaccuggaaugacuugauccggcucugcauaaugguaggggcaaaugcuucagacagaaugggaaugggcacgacauaccuagcucugauggcaacauuuaaaaugagaccgauguuugccgucgggcugcuguuuagacgacucacaucgcgagaaguucuacuucuaacaaucggauuaucucuaguugccuccguagaauuaccuaacucacuagaagaacuaggagacggauuagcaauggguauaaugauauuaaaacuauugacggauuuccaaucacaucaauuaugggcuaccuuauuaucccuaacuuuuauuaaaacgacuuuuucacugcacuaugcauggaaaacuauagcuaugguauugaguauaguuagccuauucccacuauguuuaaguaccacaucucagaaaacaacuugguuaccaguauuacuugguaguuugggaugcaaaccgcuaacaauguucuuaauagcagaaaacaaaauauggggaagaaaaagcuggccauuaaacgaagguauuauggcgguaggaauuguuucaauacucuugucgucacugcugaaaaaugauguuccacuagccggcccacugaucgcaggagguaugcuuauagcaugcuauguaauaaguggcagcucagcugaucucucuuuagaaaaagccgcggaaguaucaugggaagaagaagcagaacacucaggcgcaucacacaauauauuaguagaaguacaagacgacggaacaaugaaaauuaaagaugaagaacgugaugacacauuaacuauccugcucaaggcgacucuacuagcaguaucggguguuuacccacuaucaauaccagcuacacuuuuugugugguauuuuuggcagaagaaaaagcagcggucuggaguccuaugggacacuccgagcccuccugaaguagaaagggcgguucuggaugacggaauuuacagaauuaugcaaagaggacuguuaggucgaagucaagucgguguaggugucuuucaagaaaacguuuuucacacgauguggcauguaacuaggggugcaguguuaauguaccaaggaaagcgauuagagccaagcugggcuucggucaagaaagauuuaauaagcuauggaggggguuggagacuucaagguaguuggaacacaggagaggagguccaaguuauagcagucgagccugguaagaacccgaaaaacguacaaacagcgccuggaacguucaaaacaccggaaggugaaguaggugcuauagcucuugauuucaaaccgggcacgagcgguucucccauaguuaauagggagggaaaaauagucggauuauacggaaacgguguagucacaacaagugguaccuauguuagugcaauagcucaagccaaggcuagccaagagggcccgcuacccgaaauagaagacgaaguuuuucggaaaagaaaccucacaauaauggaucuccacccaggaucagguaaaaccagaagauaucugccugcuauaguacgagaagccaucaaacguaaauugcgcacccugauacuggcaccaacuagagucguugccagcgaaauggccgaggcuuuaaaagggaugccuauaagguaccagacuacugcagugaagagugagcacacugguaaagaaauaguggaucuaaugugucaugcuaccuuuacaaugagacuacuaaguccgguaagaguaccuaacuacaacaugaucaucauggaugaagcacauuuuacugauccaaguaguauagccgcaagagguuacauaucaacacgagucgguaugggugaggcggcagccauuuucaugacugccacuccacccggauccguggaggcuuuuccccagucgaacgcaguaauacaagaugaggaacgggauauuccugagagaucauggaacagugguuaugaauggauuacggauuuuccaggaaaaacggucugguuuguaccuaguauaaaaucuggaaaugacauagcaaauugccuuaggaagaauggaaaaagggucauucaguuaagccgaaaaacauucgauacugaguaucaaaagaccaaaaauaacgauugggacuauguaguaacaacggacauaucagaaaugggcgcaaauuuuagggccgacagagugauagauccgcgucguugcuuaaaaccagugauacuaaaggauggaccagaacguguaauucuagcuggaccgaugccgguaacagucgccucagcagcacaacgucguggucgcaucggaagaaaccauaauaaggaaggugaucaauauauauacaugggucagccauugaacaacgaugaggaucaugcacauuggacagaagccaagauguugcuagacaacauaaacaccccugagggaauaauucccgcucuauuugaaccagaaagagagaaaucugcagcgauugauggagaauauagacuacgaggugaagcuagaaaaacuuuuguagaacugaugcgaaggggugaccucccaguaugguuaucuuacaaaguagcaucagaagguuuucaguauucagacagaagauggugcuucgauggagaaagaaacaaccaaguacuggaagaaaacauggaugucgagauauggacaaaggaaggagaacggaagaaacuaaggccucgauggcucgacgcccgaaccuauucugauccuuuggcuuuacgagaauuuaaagaauuugcggcggggaggagaucagucucgggugaucuuauuuuagaaauaggaaaauugccccaacaccuuacacagagagcucaaaaugcuuuggauaaucucguuauguuacauaauucggaacaaggcggucgugcauaucgacaugcuauggaggaauuaccagauacgaucgagacacugauguuguuagcacuaauagcaguacugacagguggagucacucucuucuuucugucaggaaaaggucuggggaaaaccagcauuggccugcuuugugucauggcaucgucgguccuucuguggauggcgaguguagagccgcacuggaucgcagcgucuauaauauuagaauuuuuccuaaugguuuuauugauaccagaaccggauaggcaaagaacuccgcaagacaaccaauuggccuauguagugauugguuuacuauuuaugauccuaacaguagcugcuaacgaaaugggccuacucgaaacuacaaagaaagaucugggaauuggacauguagcaguugaaaaucaucaucacgcagcaaugcuagauguagaucuucacccggcauccgcuuggacauuguacgcaguagcuacaacuauaaucacuccuaugaugagacacacuauagaaaacacaacagcaaacauuagucucacagcaauagcuaaucaagcagcaauacugauggguuuagacaaaggguggccaauaagcaaaauggacauaggaguccccuuauuagcgcucgguugcuauagucaaguuaauccauuaacccugacagcggcaguauuaaugcugguagcucauuaugcaauaauaggacccggccuucaggcaaaagccacaagagaagcacagaaacgaacagcagcaggaaucaugaaaaaucccaccguugaugguaucgucgcuauagacuuagaccccgugguguaugacgcaaaauucgaaaaacaacuuggccaaaucaugcuucucauccuauguacaucacaaauauuauuaaugcgaacuacuugggcacucugcgagucaauaacgcuggcgacaggcccgcuaacuacgcucugggaagguucuccaggaaaauuuuggaauaccacaauugcgguaagcauggcaaacaucuuuagaggaucauacuuagccggugcggggcuagcuuucagccuaaugaaaucauuaggaggagggcggagaggcacaggugcucagggagagacacuuggcgagaaauggaaacgucaauuaaaccaacucucuaaaagugaguucaacaccuauaaaagaucaggaauaauggaaguagaccguucggaagcaaaagaaggacugaaaaggggagaaacgacaaaacaugcugucagucgcgguacagcuaaacugcguugguucguggaaagaaaucuaguaaaaccugaagggaaaguuauugaccucggaugcgguagaggggguuggucauacuacugugcaggccuaaagaaagucaccgaggucaagggauauacuaaaggugguccaggacaugaagaaccagucccuauggcaacuuauggcuggaaccugguuaaguugcauucagggaaagacgucuucuucauaccaccugaaaagugugacacacuauuaugcgauauuggugaaucaucaccaaauccaacuauagaagagggacgcacauugagaguucuuaaaaugguugagccauggcugcgcggaaaucaguucuguaucaaaauuuuaaauccuuacaugccgaguguagucgaaacucucgaacaaaugcaacgaaaacauggagggauguuaguacgcaacccccuaagucgaaauucgacacaugagauguauugggucucaugcggcacugguaauauuguaagugccauaaauaugacgagcaggauguuauuaaaccgauuuacaauggcacaccgaaaacccacguacgaaagggacgucgaucuaggcgcugguacaagacaugucgccguugagccagaaguugcaaauuuagacauuauaggccaaagaauugaaaacaucaagugugagcauaaaagcacauggcauuacgacgaagacaacccauauaaaacgugggccuaccacggaagcuaugaaguaaagccuucagggagugccaguagcaugguaaacggaguaguaaaguuacucaccaaaccuugggauguuauaccaaugguuacacaaauugcuaugaccgacacaacuccuuucggccaacaaagaguuuuuaaagaaaaaguagauacacguaccccaaaagcaaaacgcggaacggcgcagauaauggaaguaacugcaagaugguuaugggguuuucucuccaggaacaaaaagccuagaauauguacucgagaggaguuuacacguaaaguacgaucgaacgcagcuaucggugcuguuuuuguugacgaaaaucaauggaacucggcgaaagaagcugucgaggaugagagauucugggaccuaguucaccgggaacgggaacuccacaaacaaggcaagugugcaaccugcguauauaauaugauggguaagagagagaagaaacucggggaauuugggaaagcgaaaggcucaagagcuauaugguauaugugguugggagccagguuucuagaauuugaagcacuaggguuuaugaacgaagaucauugguucucacgcgaaaauucuuuaucaggaguggaaggagaaggucuucacaaacuaggcuauauuuugcgcgacauaagcaagauaucuggaggaaacauguaugcagaugacacugccggaugggacacacgaauuacugaagaugauuugcagaaugaagcaaaaauaaccgaaauuauggaaccugaacaugcacaauuagcgaaagccauuuuuaaacuuaccuaccagaacaaaguuguacgcguccaaagaccggcgaaaaacggaacggucauggacguaauuucuaggagagaccaaagaggaucaggacaaguagguacuuauggacuaaauacuuucacgaacauggaagcacaauugaucagacaaauggagucggaagguauauuuucaccaagugaacuagaaacucccaacuuagccgaacgaguacucgacugguuggaaaaguaugguguagagcgacucaagagaauggccauaaguggagaugauugcguagucaaaccaauagaugaucgcuuugccacugcucuuaccgcccuaaaugacaugggcaagguaagaaaagauauuccacaaugggaaccgaguaagggcuggaacgacuggcaacaagugccuuucuguucgcaccacuuccaccaguugauuaugaaagacggccgggaaauaguuguccccugcagaaaccaagaugaauugguuggccgagcaagagugagccaaggagccggguggucgcuuagagaaacugcuugucuuggaaaaucauaugcacaaauguggcagcucauguacuuucauagaagagaucuaagguuagcugcaaaugcuaucuguagugcugucccuguggauuggguucccacuagccggacgacguggaguauacaugcucaucaccaauggaugacgacagaagacauguuaucaguauggaaccgaguauggauugaagaaaauccuuggaugaaggauaaaacucacauuagcagcugggaagauguuccuuauuugggaaaacgagaagaccagugguguggcagccucauagguuuaacagcacgagccacuugggcaacgaacauacaaguggcuaucaaucaagugcggagacucaucggaaaugaaaauuacuuagauuauaugacaucaaugaagagauucaagaacgagagugauccagaaggagcauuaugguaa

SEQ ID NO: 22128 - RNA, 9879 nt, Artificial Sequence
  derived and/or modified CDS sequence (opt6) from DENV-1__KC172835__SS-prME
ucgguuacuaugcuucuaauguuaaugccaacugcacuggcuuuucaccucaccacucgagggggagaaccgcacaugauaguaucaaaacaagaaagagguaaaagccuucuauuuaaaacaucugcuggaguaaauaugugcacacuuauagcaauggaucuaggggaacucugugaagauacgaugacauacaaaugccccagaaucacugaagcggaacccgaugauguugauuguugguguaaugccacggauacauggguaacauacggaacauguucucaaacaggagaacaucgacgcgacaaacguucaguugccuuagcaccgcauguagggcuuggacuggaaaccagaacagaaacuuggaugagcagugaaggggcuuggaaacaaauccaacggguugaaaccugggcuuugagacacccaggauuuacuguaauugcgcuuuuucuugcacaugcuauagggacaucuaucacgcaaaaagguauuauuuuuauacuucugauguugguaacaccauccauggcaaugcgauguguaggaaucggcucacgugacuuuguagaagguuuauccggugcaacauggguagacguaguuuuggaacacggaucuugugugacaacaauggcgaaagauaaaccgacguuagacaucgaauuguugaaaacagagguaacgaauccggcagugcuccggaaacucuguauugaagcuaaaauuaguaauaccacgacggauaguagaugccccacccaaggggaggccacauuaguugaggagcaagacgcaaauuuuguaugucggcgaacguuuguagaucgugguugggggaaugguugugguuuauucggcaaaggcucucuuauuacaugcgcgaaguucaaauguguuacaaaacuugaagguaagauagugcaguaugaaaaccugaaguauucuguuaucgugacaguacacacuggugaccaacaucaaguaggaaacgagucaacagaacacgggacuacagcaacgauuacaccgcaagcaccaacuacagagauccaacuaacugacuacggugcacuaaccuuagacugcagcccacguacuggauuggacuucaaugaaaugguuuuauuaacaaugaaagaaaaauccugguuaguucauaaacaaugguuucuugaucuacccuuaccauggacuucaggcgcaaguacgucgcaggaaacuuggaauagacaagauuuauuaguuacuuuuaaaaccgcucaugcaaagaaacaggaaguugugguguugggaucucaggaaggggcaaugcauacagcucucaccggcgccacagaaauccaaacaagugggaccaccacuauauucgcaggucauuuaaaauguagacuaaaaauggacaaacugacucuaaaaggaaugaguuacguuauguguacggguagcuuuaaacuagaaaaagaaguagcagaaacgcagcauggcaccguccugguucaaaucaaauacgaaggaacugacgcaccauguaaaaucccuuuuagcacucaagaugagaaaggggugacacaaaauggucgucuaauaacagccaauccuauaguaacugauaaagagaaaccuguaaauauagaagccgagccaccauucggcgaaaguuacauugucauaggcgccggcgaaaaagcacuaaaauugagcugguucaaaaagggaucaagcauaggaaaaauguuugaagcaacggcaagaggagcacgucgcauggcuauacuaggugauacugcaugggacuuuggaucgauaggcgggguauuuacgucgguaggaaagcuagugcaccaaauauucggcacggcauacgguguauuauuuucaggagugucauggacaaugaagaucggcauagguguccuacuaacgugguugggacuuaauucaagauccacuagccuaaguaugaccuguauugcagucggacucgucacguuauauuuagguguaaugguccaagcugacuccggauguguagucaauuggaaggguagagaacucaagugcggaagugguauuuuuguaacgaacgaaguacacacuuggacagaacaauauaaguuucaggcugauagcccuaagaggcuaagcgcugccauagggaaggcuugggaagaagggguaugugguauaagaucagcuacuagauuagagaacguuauguggaaacaaaucucaaacgaacuuaaccacauccuauuggagaaugauaugaaauucacuguuguugucggagacguugcagguauacuugcacaaggcaagaaaaugauaaggccgcagccaauggaauauaaauauaguuggaaaucauggggaaaggcuaaaauuauuggugcugacgugcaaaauaccacuuucauuauugauggaccaaauacuccggagugccccgacgaucaaagagcuuggaauauaugggaaguugaagauuauggcuuuggcauauuuacuacaaacaucuggcuuagacuaagagacucauacacucaggucugugaucaccgucuuaugagugcugcaauaaaagacucaaaagcaguccacgcagacaugggauacuggauagaguccgaaaagaaugaaacuuggaaacucgcgcgagccucauuuauagaaguaaaaacuuguauuuggccaaaaucacacacguuauggucgaacggcguucuagaaagugaaaugauaauacccaaaaucuauggagguccaauuagucaacacaacuaccgccccggcuauuuuacacagacagcugggccauggcaucuuggaaaguuagaacuugacuucgacuuaugugaaggcacgacaguagugguagaugaacauuguggaaaucgagguccaagucuaaggacaacuacaguaaccgggaaaacgauacaugaaugguguuguaggucauguacucuucccccuuuaagguuucgaggagaagauggguguugguacggaauggaaaucaggccuguaaaagaaaaggaggaaaauuuaguaaaaagcaugguaucggcaggcagcggggaaguggacaguuucagccuagguuuacugugcauuucuauaaugauagaagaaguuaugcgcuccagauggucgcgaaagaugcucaugacagggacauuagcuguauucuuucuuuuaaucauaggucaacugacauggaacgaccuaauuagauuaaguauuaugguuggugcuaacgcauccgauaagaugggaaugggcaccacauacuuagcguugauggcuacguucaagaugagaccuauguucgcuguugggcuccuauucaggcgacuuacauccagagaaguucuauuguuaaccauuggucuaaguuugguagcaucagucgaacuacccaauucgcuggaagaauuaggggacggccuggcuaugggaaucaugauauuaaaauuauuaacagauuuucaaccacaucaauuaugggcuacacuacuaucuuuaacuuucaucaaaaccacauuuucccuacauuaugccuggaaaacaauggcaaugguacuaaguauugucucacuauucccacuauguuuaucaacgaccucucagaaaacuacuugguuaccugugcuuuuaggaaguuuagguugcaagccauuaacuauguuucucauuacugaaaacaaaauauggggaagaaaaagcuggccauuaaacgaaggaauuauggcgguugggauaguuucaauacuauuaaguucucugcucaagaaugacguaccgcuugcgggacccuuaauagcaggcgggauguuaauagcauguuaugucaucaguggaaguuccgccgaucuuucucuggagaaagcugcagaggucucgugggaagaagaagccgaacauuccggcgcuucgcauaacauacucgucgaaguacaagacgaugguacuaugaagauaaaagacgaagagagagacgacacacuuacaaucuuauugaaagcuacacuacuagcggugucuggugucuacccucuuaguaucccagcaacucuuuuugugugguacuucuggcagaaaaagaaacaacgauccggaguauugugggacacacccucaccaccugaaguagagcgugcugccuuagaugacgguaucuauaggauuaugcaacguggauuacuaggcaggucacagguggguguugguguuuuucaagaaaauguauuccacacgauguggcauguaacuagaggagcgguuuugauguaccaggggaaacgucuagaaccaucuugggcaucagucaagaaagacuuaauuucauacggaggcggcuggagacuucagggcucauggaacaccggggaagaaguucaaguaauugcugucgaaccagguaaaaauccuaaaaauguacaaaccgcgccugguaccuuuaaaacaccagaaggugaaguaggcgcgauagcauuagacuuuaaaccuggcacaucuggauccccuauuguaaaucgcgaggggaaaauaguaggauuauaugguaauggaguaguaacuacaagcgguaccuacgugucggccauagcacaagcaaaggccucgcaagaaggucccuugccagaaauagaagaugaagucuuuagaaagcgaaaucuaacuaucauggaucugcacccuggaaguggcaaaacccgcagauaucuuccagccauagugcgagaagccauaaaacgcaaacuacgcacccugauacucgcaccaacgagagucguugcaagugaaauggcggaagcauugaaaggcaugcccauaagguaccaaacaacagcaguaaaaucagagcauaccggaaaggaaauuguggacuuaaugugccaugcaaccuuuacaaugagauuacuuucgccugucaggguccccaacuacaacaugauaauuauggaugaagcacauuuuacggauccaucuucaauagcggcacgaggauauauaaguacucggguugggaugggugaagcagcagcgauauuuaugacagcaacuccuccugggaguguggaagcauuuccacaaucaaaugcgguaauucaagacgaagaacgagauauaccugagcggucauggaacucuggcuaugaguggauaacagauuuuccaggaaaaaccguaugguuugucccaagcaucaaaucaggaaacgacauagcaaauugccugaggaaaaaugggaagagggucauucaauuaucacgaaagacuuuugauaccgaauaucagaaaacaaagaauaaugacugggauuauguaguaacaaccgacauaucagaaaugggcgcgaauuuucgugcugaccguguaauagauccgcgaaggugucuaaaacccgucauccugaaggacggacccgaaagaguaauauuggcagguccuaugccaguaacaguugcaagcgcugcucagagaagaggucguaucgggagaaaucauaauaaagaaggagaucaauacauuuauaugggucagccacuaaauaacgacgaggaccacgcacacuggacugaagcaaaaaugcugcuagacaacauaaauaccccggagggaauaauccccgcauuauuugaaccagaaagagagaaaagcgcggcaaucgauggagaauaucgauuacguggggaagcaagaaaaacauucguagaguugaugagacguggagaucuacccguguggcuaucuuauaagguagcaagugaaggauuucaauacagugaucguagaugguguuuugacggagaaaggaacaaccaaguucucgaggagaauauggacgucgaaauauggacuaaagaaggcgagaggaagaaauugcgaccaagaugguuggaugcuaggacguauagugacccauuagcccuaagagaauuuaaggaauuugcggccggaagacgauccgucaguggugaccuuauauuagaaauugguaaacuuccacaacaccucacacaaagagcacaaaaugcucuugacaaucuagugaugcuacauaacagugaacaaggcggacgagcuuauagacacgcgauggaagaacuucccgacacgaucgaaacuuugaugcuauuagcgcugaucgcuguccuuacaggaggagugacacuauucuuuuuguccggacguggucuagguaaaaccaguauuggacuacucuguguaauggcuaguucuguccuucuuuggauggcuucuguagaaccccauuggauugcugccaguauaauucuugaguucuuuuuaaugguacucuuaauaccagaaccggauagacaacggacuccgcaagacaaccaauuggcauauguuguaauaggacuuuuauucaugaucuuaacugucgcagcaaaugaaaugggacuacucgagaccacgaagaaagacuuaggaauaggccauguagcagaugagaaucaucaccaugcugccauguuagacgucgaucuccauccugcaagcgcuuggacgcuauaugcaguagccacgacuauuauaacacccaugaugcgacauacuauagaaaacacgaccgcuaacauaucacuaacagcuauagcaaaccaagccgccauucugaugggauuggacaaaggauggccuauaaguaaaauggacaucgggguaccauuauuggcacuaggguguuauagccagguaaauccacuuacuuuaacagcugcaguccugaugcuaguagcgcauuacgcuauaauaggaccuggauuacaagcgaaagcuacgagagaggcacagaaaaggacggccgcugggauuaugaaaaacccuaccguagauggcauagucgccauugacuuggacccugucguauacgaugcuaaauuugaaaaacaacuugggcagaucaugcuccuaauacuuuguacgagucaaauauugcuuaugagaacuacuugggcacuaugugaaucaauaacguuggcaacaggaccccugacaacuuuaugggaaggcagcccuggaaaguucuggaauacaacgauagcuguaagcauggcgaauaucuuccgcggaucuuauuuggcaggagcaggccucgcuuucuccuugaugaaaagucuggguggaggacgacgcggaacaggcgcacagggagaaacccugggugaaaaguggaaaagacaacuaaaucaauugagcaaaagugaauuuaacacauacaagagaucuggcauaauggaaguagauaggagugaggccaaagaagguuuaaaacgaggggagaccaccaaacaugcgguaucaaggggaacugcaaaauuaagaugguuuguagagcgaaaucuagucaagccagaaggcaagguuauagaccucggcuguggcagaggaggcuggucauacuacugcgcaggucuuaagaaaguuacugaaguaaagggauauacaaaagguggaccuggacacgaagaaccgauaccaauggccacauacgguuggaaucuaguuaaacuucacaguggaaaagauguuuucuucauaccgccggagaaaugcgacacccuacuaugugauauaggagaaucaaguccaaaccccacaauagaagaaggaagaacucuaagaguacuaaaaaugguagagcccugguugaggggaaaccaguucuguauaaaaauucugaauccguauaugcccuccguaguagaaacccuagaacagaugcaacgaaaacaugguggaaugcuuguaagaaacccauugucccgaaacaguacacaugaaauguacugggugucuuguggaacuggaaauauagucuccgcuguuaauaugacaaguagaauguuacuaaaucguuucacaaugguacacagaaaaccuacauaugaaagagauguugaccuaggagccggcacucggcauguggcuguagaaccagaaguagcaaaucuugacaucauuggacagcgaauagaaaacaucaaacaugagcacaaguccaccuggcacuaugaugaagauaaucccuauaagacaugggcuuaccacggaaguuacgaaguaaaaccauccggguccgcaucauccauggugaacggagucgugaaacucuugacgaaacccugggauguuaucccaaugguuacucaaaucgcaaugacggauaccacaccauucggccaacagagaguuuuuaaggaaaaaguagauacuaggacuccgaaggcaaagagaggaacagcacaaauaauggaagucacagcccguuggcuuugggguuuucucucaagaaauaagaaaccaaggauauguacaagggaagaauuuacaagaaaaguaaggaguaacgcugcgauaggugcaguauuuauagacgagaaucaauggaacucagcaaaagaggcgguggaagaugagagauucugggaucuaguucaucgagaacgggaacuacauaagcaaggaaaaugugcuacaugcguguacaauaugaugggaaaaagggagaagaaauuaggugaauuuggcaaagcuaaaggaucacgagcgaucugguacauguggcucggagcgagauuucuagaauuugaggcuuuaggcuuuaugaaugaagaucauugguuuucgcgugaaaauaguuuaucggguguagaaggugagggacuacauaaauugggauauauauugcgagacauuucuaaaauaccaggaggcaacauguaugcagaugauacagccgguugggacacucgaauaacggaagaugauuuacagaacgaagcgaaaauaaccgacauaauggagagcgagcaugccuuacuagcaaaaucuauauuuaaacuaacuuaccaaaauaaagugguucggguacaacggccugcaaagaauggaaccguaauggaugugauuaguagacgagaucagagaggaucuggucaagugggaacauauggacuaaauacguuuaccaacauggaagcacaacuaauccgacagauggagucggaagguauauuuucuccuucggaacuagagacaccgaaucuugcagaaagggcucucgauuggcuugagaaacauggcgucgagagauuaaaaaggauggcuauuuccggugaugacuguguagucaaaccaauagacgauagauucgcuaccgcucuaacagccuuaaaugauauggggaaaguacguaaagauauuccccaaugggagcccucuaaaggcuggaacgacuggcaacaaguaccauuuugcagucaccacuuccaucaauuaaucaugaaggauggaagagaaauaguuguuccaugccguaaucaagaugaauugguaggcagagcaaggguaucucagggagcagguugguccuuacgggagacagccuguuugggaaagucguacgcccaaauguggcaauuaauguacuuucaucggagagaucugagacuagcagcgaacgcuauauguucagcaguaccuguggauugggugccgacaucuagaacaacauggaguauccacgcucaucaucaauggaugacuaccgaggacaugcuguccguuuggaauagagucuggauugaagaaaacccauggauggaggacaaaacucauauaucaaguugggaagacguaccauaucucggcaaaagagaagaucaaugguguggaucccucauagguuuaacugcccgagcuacaugggccaccaacauccagguagcaaucagccaaguccgucgacugauaggaaaugaaaauuauuuagacuauaugacgucaaugaaaagauuuaagaacgagucagacccggaaggagcacucugguga

SEQ ID NO: 22129 - RNA, 9879 nt, Artificial Sequence
  derived and/or modified CDS sequence (opt6) from DENV-1__EU848545__SS-prME
ucuguaacgauguuguuaauguuacuacccacugcgcuagccuuucaucugacaacaagggguggugaaccucacaugauugugaguaaacaagaacgugguaaaucacuucuauuuaagaccucagccggagugaacaugugcacuauaauugccauggaccuaggagaauuaugugaagacaccaugacauauaaauguccucgaauuacaaaagcagaaccagacgauguagacuguuggugcaaugcaacggauacuugggucacauaugguacuuguucaagaaccggggaacaucguagggauaaaagaagcguugcgcuggcaccacacgucggccucggucuugaaacccgcgcggagaccuggaugucauccgaaggagcauggaagcaaauucaaaaaguagaaaccugggcguuaagacauccggguuuuacugucauagcccuauuuuuagcucacgccauuggaacgagcauaacccaaaaagggauaauuuuuauuuugcugaugcugguaacaccaaguauggcaaugcgcugugucgguauaggaaaccgagacuuuguagaaggacuaaguggcgcgacauggguagauguuguacuugagcaugggagcugugugacaacuauggcaaaggauaaaccaacacuagacauugaguuacuuaaaaccgaggugacaaagccagcuguacuucguaaacuguguauugaagcaaagauuucgaauacaacaacagauucuagauguccaacacaaggagaggcaacacuaguggaagagcaggaugcgaauuucguuugcaggagaacauucguagauagaggcugggguaauggcuguggauuauuuggaaaaggaaguuuaaucacgugugcgaaauuuaaaugcguaacaaaauuagaaggaaaaauuguucaguaugaaaaccuaaaauauagcguaauaguuacaguacacacuggugaucaacaucaggucggaaacgaaacgacggaacacggaacaauugcgacgauuacgccccaggcaccaacaucggaaauacaacuaaccgauuauggagcacuaacauuagauugcucgccuaggaccggcuuggauuuuaaugagaugguacuacuuacuaugaaagaaaaaucauggcuaguucacaaacaaugguucuuagauuuaccacuaccauggacaaguggagcuaguaccccucaggagacauggaauagggaagaucuauuaguaacauuuaagacagcucaugcgaaaaaacaagaggugguaguauuggggucacaggaaggugcaaugcacaccgcgcuuacaggggcaacagagauccagacuucagggacgacuaagaucuucgcagggcaccuuaagugccgguugaaaaugaacaaacuuacacuaaaagggaugaguuacguaaugugcacgggaucuuuuaaacuagagaaagaagucgcggaaacacagcacgguacaguccugguccaaguaaaauacgagggaacggaugcaccuuguaaaauaccuuuuucaacgcaagaugaaaaggguguaacacaaaauggucgauuaauuacggcgaauccuauugugacugauaaagaaaagccagugaauauugaggcugaaccuccuuuuggagaaagcuacauaguaguaggggcuggagaaaaagcauuaaagcuuucuugguucaaaaagggaucuaguauaggaaaaauguuagaagcgacagcaaggggagcgcgucgaauggcaaucuuaggagacacagcuugggacuuugguagcauuggaggcgucuucacaucgguaggcaaauuaguucaccaaauuuuuggaacugcuuacggugugcuguuuuccggugucucuuggacuaugaagauagguauaggaauacuacugacauggcuaggcuugaacucucggucagccagucugucaaugacuuguauugccguaggaaugguaacauuauauuugggugugaugguacaggccgauagcggcuguguaauuaauuggaagggcagggaauuaaaauguggguccgguauauuuguuacaaaugagguacacacauggaccgagcaguauaaauuucaagcagauucaccuaagagauuaagugcugcaauagguaaggcgugggaggaagguguauguggcaucaggucugcgacaagacuugagaacauaauguggaagcaaauaucuaaugaauuaaaccauauacuccuagagaaugauaugaaauuuacaguuguaguuggggauguaucgggcauuuugacccaaggcaggaaaaugaucggaccccaaccgauggaacacaaauacagcuggaaaaguuggggaaaggcaaaaauaauuggcgcugauguacaaaauaccacauuuaucaucgacggcccaaauacgccugaaugucccgaugaucaaagggccuggaauauuugggaaguagaggauuauggcuucgggauauuuacaaccaauauauggcuaaaacuacgugacaguuauacccagguuugcgacccaagguuaaugagcgcagccaucaaagauucuaaagcuguacaugccgauaugggcuacuggauagagucugaaaagaacgaaacguggaagcuagcuagagccaguuucauagaagugaagacaugcgucuggccgaagagucauacgcuaugguccaacgguguucuagaaucugaaaugaucauuccgaaaauauauggaggcccaauuagucaacauaacuacaggccaggguacaguacucaaacagccggcccuuggcauuuaggaaaacuagaauuagauuuugaccugugcgaaggaacuaccgucgugguagaugaacauuguggcaauagaggaccgaguuuaagaacuacuacugugacugguaaaauuauacaugaguggugcugcagaucuugcacucugccucccuugcguuucaaaggagaagauggcugcugguauggcauggagaucaggccuguuaaagauaaagaagaaaauuuagucaaaucacuuguaucagcuggcuccggugaaguagauaguuuuagccucggacuacuguguaucucaauuaugauugaagaaguaaugcggucaagguggucccgaaaaaugcuuaugacugguacuuuagcagucuuuuuacugcuaauaaugggucaauuaaccuggaaugauuugauacgcuuaugcauaaugguaggggcaaaugcaagugaccgcaugggcaugggcacuacauaucuagcacuaauggcaaccuucaaaaugcgaccuauguuugccgucgguuuguuguuccgaagauuaacaucaagagaaguucuguuauuaacaauaggccucucacucguagcgucgguagaacuaccgaauagucuagaagaacuuggggacggacuugcuaugggaauaaugauuuuaaaacugcuaacagauuuucaaucacaucaguuaugggcggcgcuacuaagucugaccuucauaaaaacuacuuuuucauugcauuaugccuggaaaacgguagcaaugguacuaucaauaguaucacuauuuccccuuugccuuaguacuacaagucagaaaacgacaugguugccuguuuuguuaggcagccucggauguaagccucugacgauguucuuaaucgccgaaaauaaaauauggggccgaaaauccuggccguuaaaugaagguauuauggcugucggaauaguuucaauauuauuaaguaguuuacucaaaaacgaugucccgcuagcaggcccucuuauugcgggcggaauguuaauagcaugcuauguaaucagcggcucauccgcugaucuaagccuagaaaaggcugcugaaauaaguugggaagaagaagcugaacacaguggggcgagucacaacauacugguagaaguucaagacgauggaacaaugaaaauuaaagacgaagaaagagaugauacucuuacuauacuucuuaaagccaccuuacuagcuguaagugguguuuauccaauauccaucccugcuacacuuuuugugugguauuucuggcaaaagaaaaaacagcgaagugguguauuaugggauacaccaucuccaccagagguagagcgagcaguuuuggaugacgguauuuaccgaauuuugcaacgcgguuuauuagguagaucucaaguuggaguaggggucuuucaagagggaguguuucacacgauguggcacgugacaagaggagcgguuuuaauguaucaagggaaaagauuggaaccaucaugggcaucuguaaaaaaagaucugauuaguuacggggggggauggcgauuucaaggauccuggaauacaggagaagaaguacagguuauagccguugaaccuggaaagaauccaaagaacgugcagacugcaccggggacuuuuaaaacccccgaaggcgaaguuggagccauagcacucgauuucaaaccaggaacuucaggcagcccaauagucaauagggaaggcaagauuguaggucucuauggcaacggcguagugacuacaaguggaacuuaugugagugcaaucgcgcaagccaaagcaagucaagaagguccauugccugaaauagaagacgaagucuuuagaaaaagaaaucuaaccauaauggaucuacacccagguucaggaaagacaagaagguaccuccccgcgauaguccgcgaagcuauaaaaaggaaauuacgaacacuaauauuggcuccuacgcgcguuguugcaagugaaauggcugaagcgcuaaaaggaaugcccauccgauaucaaacuacagcaguuaagucugagcauaccggaagagagauaguugaucuuaugugccacgcuacguuuaccaugagacuuuuauccccagucaggguuccuaacuauaacaugauaauuauggacgaggcucauuucacagacccagcauccauagcagcacgaggguauaucucgacgagggugggcaugggugaggcugcagcuaucuuuaugaccgcaacgccuccuggcucuguagaagcguuuccgcaaagcaacgcaguaauacaagacgaggaaagagacauaccugaacguucuuggaacucaggcuacgauuggauaacagauuucccugguaaaaccgugugguucguaccuaguauaaagucaggaaacgauauugccaauugccuuaggaaaaaugguaaacgcguaauccaacuaucaagaaaaaccuuugauacagaguaccaaaaaacgaaaaauaaugacugggauuaugugguuacgacugacauaagugaaaugggagcuaauuuucgugcagaccgcguaauugauccaagacguugucuaaaaccuguuauucucaaagacgguccagagagggucauauuggcugggccaaugccgguuacagucgcuagcgcugcccaaaggagaggucgaauaggucggaaucaaaauaaagagggcgaucaauacaucuacaugggacagccauuaaauaaugaugaagaccaugcccauuggacagaagccaaaaugcuacuugauaacauuaauacaccugaaggaauaauaccugcgcuauucgaaccugaacguggaaaaucugcggccauagauggagaauacaggcuucgaggagaagcaagaaagacuuucguagaacuaaugagaagaggagacuugccuguauggcuuucguacaaagucgccucggaaggcuuucaauauucagaccgaaagugguguuuugacggcgagcguaacaaccaaguguuagaagaaaauauggacguugaaauuuggaccaaagaaggagaaagaaaaaaauuacgaccaagauggcuggaugcaagaacguacucugauccccaagcucucagagaauuuaaagaauuugcugcgggccgacgaagcgucaguggugacuuaauauuggaaauuggaaaguuaccccaacaucuuacucaaagagcgcagaaugcauuggauaaucucguaaugcuacauaauucagagcaaggugguaaagcguaccgacaugcuauggaggaacuacccgauacuauugagacauuaaugcuccuugcauuaauugcaguguuaacaggaggaguaacccuauuuuuucuaucaggcaggggcuuagggaagacaucuaucggacuacuauguguaauggcaucgagcguacuacuuuggguagcuucaguagaaccacacuggaucgcugccucaauaauauuagaauucuuccuaaugguacugcuaauacccgaaccugauagacaaagaaccccucaagauaaucaacuagcuuacgugguuauaggauuguuauucaugauacuaacagucgcggcaaaugaaaugggucuauuggaaacuaccaagaaagaccuggguauugggcauguagccguagaaaaucaccaucaugcuacuaugcuagaugucgacuuacguccagccucagcuuggacucuuuacgcaguagccacuacgauaaucaccccaaugaugaggcauacaauagaaaacacaacagcaaacauaucccugacagcaaucgcaaaccaggccgcaauccucaugggccuagauaagggauggccuauuucaaaaauggauauuggaguaccauuauuggccuuaggcugcuauucucaaguaaauccacuaacuuuaaucgcagcuguguuaauguugguagcccauuacgcgauaaucgguccggguuuacaggcuaaggccacuagagaagcucaaaagcgaacggcagcagggaucaugaagaaucccacgguugauggaauaguagcaauagaucuagaucccguaguauacgaugcuaaauuugaaaaacagcucggacaaauaauguuguuaauucucuguacuucacagaucuuacugaugcgaacaacaugggcguugugugaaucuauaacacuugcuacaggcccccuuacuacauugugggagggaagcccaggaaaguucuggaauacaacuaucgcuguaucgauggcaaacauauucaggggcagcuauuuagccggagcgggacuagcuuucucauuaaugaagucgcuagguggagggcggagaggaacgggagcacagggagaaacacugggagaaaaauggaaacgacaguuaaaucaguuaagcaagagcgaauucaauacuuacaaaagaagcgguauuauggaaguugauaggucggaagcgaaagaagguuugaaacggggcgaaacgacuaagcaugcaguaucaagagguacagccaaacugagaugguucguugaacguaauuuaguaaagccagaaggcaaaguaaucgaucuugggugugggagagggggcuggucauauuauugcgccggacuuaaaaaaguuacugaaguuaagggcuauacgaaagggggacccgggcaugaggaaccaauuccgauggcuacauauggguggaauuuagucaaauuacauagcggaaaggauguguuuuuuacuccuccagaaaaaugcgauacucuacucugugauauuggagaaaguucaccuaaucccacaauugaagaagggaggaccuuaagaguguuaaaaaugguggaaccuuggcuacggggaaaucaauuuuguauuaaaauauuaaauccauacaugcccucagucguagaaacgcuugaacagaugcaacgaaaacaugggggcauguuagugagaaauccuuuaucucguaacucaacgcacgaaauguauugggucucuugcggaacaggcaacauagucuccgcagugaauaugacaagucggauguugcuaaacagguuuacaauggcacauagaaaacccacauaugaacgagacguagacuuaggggcugggacacgucauguagcaguagaaccggaaguagcaaauuuagacaucaucggucaaagaauagaaaauauaaaaaacgaacacaaaagcacauggcauuacgaugaagauaauccauacaaaacgugggcauaucauggaagcuaugaaguaaaaccgucaggaucugcgucgucaaugguuaauggaguggucagguuauuaacuaagccgugggauguuauaccaauggucacccaaauagcuaugacagauacaacaccauucgggcagcaaaggguguuuaaagaaaagguugacaccagaacuccgaaagcgaagagaggaacugcacaaauaauggaagucaccgcgagauggcuguggggguuuuuaucucgaaacaaaaagccccgaauaugcacacgggaagaguucacaaggaaaguucgaaguaaugccgcgauuggagcgguauuuguagacgaaaaccaauggaacagugccaaagaagcaguggaagacgaacgauuuugggauuugguacaccgagagcgagaauuacacaagcagggcaaaugugcaacgugcguguacaauaugauggguaaaagagagaaaaaacuaggggaguucgggaaagccaagggaucaagagcgauaugguacaugugguuaggugcucgcuuccucgaguuugaagcacucggauuuaugaacgaagaucauugguucucacgggagaauuccuugaguggaguagaaggggaggggcuacauaaauuagguuauauauuaagggauaucucaaaaauaccuggaggaaacauguaugcagacgauacggcgggaugggacacucgaauuacggaagacgacuuacaaaaugaagcaaaaauaacagacauaauggagccagagcaugcauuguuagcaaccucaauauucaaacugacuuaucaaaacaaagucguaaggguccagcggccagcuaaaaaugggacgguaauggacguuauuagcaggagagaucaaagaggcucuggccagguagguaccuaugggcuaaacacuuuuacaaacauggaaguucagcuuauacgucaaauggaaagugaaggcauauuuucgcccagcgagcuagaaacaccaaacuuggcagaacgaguauuggauugguuagaaaaacauggaguagagcgacugaaaagaauggcuauauccggugaugauugugucguaaaaccuacggaugauagauucgccacggcauugacggcacuaaaugauauggguaaagucagaaaagauauaccucagugggaacccagcaaaggguggaaugauuggcaacaaguucccuuuuguucacaucacuuucaccaacuaauuaugaaagacggacgggagauugugguaccuuguaggaaccaagaugaguuaguaggacgagcgcgaguaucucagggggcuggauggucauuaagggaaacagcaugccuaggaaagucuuacgcacaaauguggcagcuaauguacuuccauaggagagaucuaagguuagcagcuaaugcuaucuguagcgcaguaccaauugacugggucccaaccagucgaacuacuuggucuauacacgcacaucaccaauggaugacuacugaagauaugcuuaguguauggaacagaguguggauagaggaaaaucccuggauggaggacaaaacucacguaaguucaugggaggacguuccauaccuagguaaaagagaagaucaauggugcgguucucucauugguuuaacugcaagggcaacuugggcuacaaacauccaaguagcuauaaaccaagucagacgauugauagguaaugaaaauuaccuagacuauaugacgagcaugaaacgcuucaaaaacgaaagugauuuagagggagcauuaugguag

SEQ ID NO: 22130 - RNA, 9879 nt, Artificial Sequence
  derived and/or modified CDS sequence (opt6) from DENV-1__KR024708__SS-prME
agugugacaaugcuuuuaauguugcuaccuacugcgcuagcauuucaccugacaacacgaggaggagaaccacacaugauugugucaaaacaagaacguggaaaaucauuacucuucaaaacaucugcuggcguuaauauguguacacuuauagcaauggaucuuggagaacucugcgaggacacaaugacguacaaaugcccaaggauaacagaggcggaaccggacgauguggauuguuggugcaacgcaaccgacacguggguuaccuacgggacuuguucacaaacgggcgagcauaggagagacaaacgauccgucgcacuagcgccccacguaggacugggacuggaaacuaggacagaaacuuggaugucuucugagggcgcuuggaaacaaauacagaaaguagaaacuugggcacugcgucauccuggauucacaguaauugcgcuauuccuagcacacgcaauugguacgaguauaacccaaaaaggaaucauauuuauuuuacuaauguuaguaacacccagcauggcaaugcgaugcguugguauaggaaaucgagacuuuguagagggucuaucaggagcgacauggguagauguuguacucgaacaugguagcuguguaacuacuauggcgaaaaacaaaccuaccuuggacaucgaacuccugaagacagaggucaccaauccugcuguuuuaaggaaacucugcaucgaagcaaaaauuaguaauaccacgacggauucaagaugucccacacaaggugaagcaacauuaguggaagaacaggaugcuaauuucguauguaggagaacauuuguggacaggggauggggaaacggaugcggcuuauucggcaaaggaucauuacuuacuugugcuaaguucaaaugcgugacaaaguuagaaggcaaaauuguacaauacgaaaaucuaaaguauaguguaauaguaacaguccauacuggugaucaacaccagguaggaaaugaaacaaccgaacaugguacuauagcuaccaucacuccacaggccccaacuucagaaauacaguuaaccgauuacggugcacuuacuuuagauugcucccccagaacgggauuagacuucaaugagaugguauuacugaccaugaaggaaaagaguugguugguucacaaacaaugguuccuagaucuaccacuuccguggaccucuggugcgaguacuucucaagaaacuuggaaccgacaggaccuuuugguaacuuucaaaaccgcucaugccaagaaacaagaaguaguaguauuaggcagccaagaaggugcgaugcacaccgcacucacuggagcaaccgaaauccaaacuucagguaccacgaccauauucgcuggacaucucaagugucgucuaaaaauggauaaacuaacacugaagggaguuucauauguaaugugcaccggcagcuuuaaauuggaaaaagaaguugcagaaacccaacauggaacagucuuaguccaaguaaaauaugaaggcacugaugcuccauguaaaauucccauuucaacacaagaugaaaagggggugacacaaaacggaagacuaauaacagcuaauccuaucgucacagauaaggagaagccagugaacauagagacagagccuccuuuuggggaaucauauauugucauuggagccggugagaaggcuuuaaagcuauccugguucaagaaaggcucauccauaggcaaaauguuugaagcaacagcuagaggggcacggagaauggcaauuuuaggagauacggcaugggauuucggaucaauaggcgggguauuuacuucaguaggcaaacugguacaucaaguauucgguacugcuuacggaguacuauucaguggagugucauggacuaugaagauaggaauagggauauugcugacguggcuagggcuuaauucuaggucgacuucccuaagcaugacguguauagcuguuggcaugguaacguuguaccuugguguuaugguucaagcggacucagggugugucauuaacuggaaggggcgugagcugaaaugugguuccgguaucuuugugacgaacgagguccauacauggacagagcaauacaaauuucaagcugauaguccaaaaagacucucugcagcgauaggaaaggccugggaggagggaguguguggaauuagauccgcuacacgguuagaaaauauuauguggaaacaaauuaguaacgaauuaaaccacauucuauuagaaaacgacaugaaauucacagugguugugggcgacgcaaaugggauacuuacccaaggcaagaaaaugauuagaccccagccaauggaacauaaauauaguuggaagucuuggggcaaagcaaaaaucauaggagcugacacacagaacacaacauuuauaauugacgggccggacacacccgaaugcccagaugaccaaagagcauggaauauuugggaaguggaagauuacggcuuugguguauucacgaccaauauaugguuaaaguuaagggacucuuacacgcaaaugugcgaucauagauuaaugucggccgcgaucaaggacucaaaggccguccaugcagacaugggauauuggaucgaaagugagaaaaaugaaacauggaaguuggccagagccucauucauagagguuaaaacauguauauggccgaggagccauacuuuauggucuaacggaguguuagagagugaaaugaucaucccaaaaaucuaugggggacccaucucacaacacaacuauaggccaggguacuucacccaaacugcagggccauggcauuuagguaagcucgaguuagacuuuaaucugugcgaaggaacaaccgucguagucgaugaacauugugggaaccgaggacccucauuacgaacuaccacagucacgggaaagaucauucacgaaugguguugucgaucguguacucuuccaccauugagauucagaggagaagacggaugcugguauggaauggaaauaagaccagugaaggagaaagaggaaaaccugguuaggaguauggugucggcugguagcggagaagucgauucauuuucacucgggcuacucugugugucaaucaugauagaagagguuaugcguucccgaugguccagaaagauguugaugacggggacgcuugcaguauucuuccuacucauaaugggacaguugacuuggaacgaucuaauuagacuauguaucaugguuggagcuaacgugagugacagaaugggaauggggacaacauauuuagcguuaauggcaacauuuaaaaugagaccgauguucgcagucggucuguuauuucgacgguuaacuucacgugagguacuacuacugaccaucggauuaucgcuaguagcuucaguagaauuaccuaauagcuuagaagaacuaggcgauggccuggcgauggguauaaugauguuaaaacugcuaacagauuuccaaucucaucaauuauggacuaccuuacugucuuuaaccuuuauaaaaacuacgcuuaguuuagauuaugcauggaaaacaauggcgaugguacucaguauagucagccucuucccccuaugucuuagcacuacgucgcaaaagacgacuuggcuuccagugcuacuugguucuuucgguugcaagcccuuaacaauguucuuaauaaccgaaaauaaaauauggggcagaaagucuuggccccucaacgagggaauaauggcagugggaauugugaguauauuacugucaaguuuauugaaaaaugaugugccacuagcagggcccuuaauagccggaggaauguugauagcguguuauguaauaagcggauccucggccgaccuaagccuagaaagagccgcagaaguuuccugggaggaagaggcugaacauagcggagcuucgcauaacauucuggucgaaguacaagacgauggcacgaugaaaauuaaagaugaagaaagagacgacacacuuacaauccucuugaaagcuacacuucuagccgugagcgggguguauccaaugucuaucccagcaacucuauucguuugguacuucuggcagaaaaagaaacaacguucaggagugcuuugggacaccccuagcccaccggaaguugagagggcaguguuagaugaugggauuuacaggaucuuacagcgaggacuuuuaggucgaucacagguuggaguggguguauuccaagacgggguauuccauacgauguggcaugucacacguggagcuguauuaauguaccaaggaaaaagauuagaaccaaguugggcgucuguuaagaaagacuuaauaucauaugguggcggguggagauuucaagguaguuggaacacaggcgaggagguacaaguaauugcaguggagccggguaaaaauccuaaaaauguucaaacgacccccggaaccuuuaaaacaccagaaggcgaagugggagcaauugccuuagauuuuaaaccagguacaagugggucaccaauaguaaaucgagaaggaaaaauugucggacuauauggaaacgguguaguaacaacuagcgguacguauguaucugcaauugcucaagccaaagccagucaagagggaccgcuacccgagauagaggacgaaguauucaagaaacgaaaucuaacuauuauggaccugcauccugguuccggaaagacgagaagguauuuaccagccauaguucgagaggcaaucaaacguaaauugaggacccugauauuggcaccgacuagaguaguugcaucggaaauggcagaggcguuaaaagggaugccgauaagauaucaaacuaccgcuguaaaaagugaacauacgggaaaagaaauagucgacuuaaugugccacgcaacauucacgaugagacuacucagccccguaagaguaccuaauuacaauaugauuauuauggacgaagcacacuucacugauccagccucaauugcagcaagggguuacauaucaacacguguugguaugggugaggcagcagcgauauucaugacugccaccccuccgggaucugucgaaucauucccgcaguccaacgcugucauccaagacgaggagcgugauauuccugaaaggucuuggaacucaggguacgacuggauaaccgacuuuccagguaaaacuguaugguuuguaccaucaaucaaaaguggaaaugacauagcgaauuguuuaaggaaaaauggcaaaagaguuauacaacuaucacgcaaaacauuugacacugaguaccagaaaacuaaaaauaaugauugggauuauguaguuaccacagauauaucugaaaugggugcaaauuuucgugcggaucggguaauagaucccagacguugccuuaagccaguaauuuugaaagacggaccugaaagaguaauuuuagccgggccaaugccggucacagcugcaucagccgcucagcguagaggacguauuggcagaaaccaaaauaaagagggugaucaguauauuuauaugggacaaccacuuaauaacgacgaggaucaugcacacuggacagaagcaaagaugcucuuagacaauauaaacacacccgaggguaucauuccagcacuuuucgaaccagaacgagaaaagucagcagcaaucgauggagaauauagauuacguggugaagcacgcaaaacuuucguagaguuaaugcguagaggggaucucccuguuugguuaagcuacaaaguagcaagugaaggcuuucaguacucagauagaagauggugcuuugauggcgaacgaaacaaccagguacuagaagaaaauauggauguggaaauauggacgaaagaaggagaaagaaagaaauugaggccuagaugguuagaugcgaggaccuauagugauccucuagcucuaagggaauuuaaagaauuugcugcagguagaagaucagucucaggagaucuuauacucgaaaucgggaaacuaccucaacaucucacguuacgagcccagaaugcacuugacaaccuugucauguuacauaauucugaacaaggcggaaaagccuauaggcacgcaauggaagaacuaccagauacaauagaaacauugaugcuacuagcacugauugcggugcuaacagggggagucacgcuauucuuuuuaucuggcaaaggacuuggcaaaacuagcauaggauugcuaugcgucauggcaucuaguguacuacuuuggauggcaucgguggaaccacauuggauagcugcgucuauaauccuagaguucuuuuuaaugguauuauugauucccgaaccagacagacaaagaacaccccaagacaaucaacuugccuacguagugauaggccuccuuuuuaugauacugacuguugcagccaacgagaugggacuccuagaaacaacaaagaaagauuuggguauuggacaugugguagccgaaaaucaucaucaugcgacuaugcuagacauugaccuacauccugcuuccgcauggacccuguaugcugucgccacaacaauaauaacaccaaugaugcgacacacaauagaaaacacgacggcuaauauaaguuugacagcaauagccaaccaagcugcaauacugaugggauuggauaaaggcuggccuauaucgaaaauggacauugguguuccauuacucgccuuaggauguuacagucaagucaacccucugacauugacugcagcugugcuaaugcuaguggcacacuaugcaaucaucgggccgggacuccaagcuaaagcaacaagggaagcucaaaaacguacagcagcaggcaucaugaaaaauccuacuguugauggaauaguagcuauugauuuagacccaguggucuaugaugccaaguucgagaaacagcugggccaaauaaugcugcuuauucucugcacaucacagauacuauugaugagaacaaccugggcauuaugugaaucuauaacccucgcuacugggccauuaaccacacucugggaagguucaccaggaaaguuuuggaauacaacaauagcaguuucaauggcaaacauauuccgcggaaguuaccuagccggugcaggucucgcauuuucacuaaugaagucauuaggaggggguagaagagguacaggagcgcaaggugagacgcuaggggaaaaauggaaacgucagcuaaaucaacuaucgaaaucagaauuuaacacuuauaaacgcucugguauaauggaaguugaccgaucugaagccaaagaaggucuuaaaagaggagaaacaacuaaacacgcgguaucacgaggcacagcaaaauugagaugguucguggaacgaaacuuaguuaaaccagagggaaaagugaucgauuugggaugugggcggggcggauggaguuauuauugugcaggucucaaaaagguaacagagguaaaaggguauacuaaagguggaccgggacacgaagaaccaaucccuauggcaacauauggcuggaacaucguaaaacuccauuccggaagagacguauuuuucacaccgccagaaaagugugacacucuucuaugugauaucggagaaucgagucccaauccuacuauagaggagggcaggacacuacgaguucugaaaauggucgaaccuuggcucaggggaaaucaauuuuguauuaaaauacuaaacccauacaugcccagcguaguagagacuuuagagcaaaugcaacgaaaacacggaggaaugcuuguacgaaauccgcuuaguaggaacucuacacacgaaauguauuggguaagcuguggcacugguaauauaguuagugcggugaacaugacguccagaaugcuuuugaacagauucacaauggcgcauagaaagccuacuuacgagagagacguggaccuaggcgcagguacccggcacguugccguagaaccggagauugcaaauuuagacauuauuggucaaaggauugaaaacaucaaaaaugaacauaaguccacauggcauuaugaugaggauaacccauauaaaacgugggcauaccauggcagcuaugagguuaagccuucaggaucugcaucuucaauggucaacggcguggugcgcuuacucacaaaaccaugggauguuauaccaaugguaacucaaauugcgaugacugauaccaccccauucggccaacagaggguuuucaaagagaagguagauacuagaacuccaagaccuaagcgagggacagcacaaauaauggagguaacugcaaaaugguuauggggauuccuaucaagaaacaagaaaccgagaauuugcacccgagaagaauuuacucguaaaguucgaaguaacgccgcaauaggagcuguauuuguggaugaaaaucaauggaacagugcgaaagaagcuguagaagaugagagauucugggaccuaguacacagagaaagagaauuacacaaacaaggaaagugcgccacuugcguguacaauaugauggguaaaagagagaagaaacugggcgaguuugguaaagcuaaaggcucaagagcaauaugguauaugugguuaggagccagauuucuagaauuugaggcauuggguuucaugaacgaagaccauugguuuagucgggaaaacucuuuaagcggaguagaaggcgaaggucuucauaaacuaggauauauauuacgugauauaucaaagauaccaggaggcaacauguacgcugaugacacugcggggugggauacacguauuacugaagaugacuuacaaaacgaagcuaaaauaaccgacauaauggaaccugagcaugcauugcuugcaacuuccauauucaaacugacauaucagaauaaaguagugcgaguacaacguccugcaaagucagguacaguaauggauguaauaucacgcagagaucagagagggaguggucaagugggcacauauggucuuaacacauuuacaaauauggagguacaacuuaucaggcaaauggagucagaagguauuuucucaccuagcgaacuggaaaauucaaacuuagcagagaggguacuagauuggcucgaaaaacacgggguggaaagacuaaaacgaauggccauuucgggugaugauugcguuguuaaaccuacagacgauagauuugcuaccgccuuaacagcccucaacgauauggguaaaguaagaaaagacauaccacaaugggaacccagcaagggauggaaugauuggcaacaaguaccuuucugcucacaucacuuucaucaacugauuaugaaggacgggagggaaauaguugucccuugucgaaaucaagaugaguuaguaggacgagcacgaguaagucaaggagcagguuggucauuaagggagaccgcaugccuagggaaguccuaugcccaaauguggcaauuaauguauuuccaucgaagagauuugagacuugccgccaacgcgaucugcucagcaguuccugugaacuggguaccaacuucuagaacaacauggucuauccaugcacaucaucaauggaugacaacugaagacaugcuuucaguuuggaacagaguguggauagaggaaaauccguggauggaagauaaaacgcacguuucgagcugggaagacguaccauaccuuggcaaaagagaagaucagugguguggcucacuaauuggcuuaacggcacgagcaacgugggcaacuaacauacaaguugcaauuaaucagguucgaagauuaauugggaacgagaauuaucucgauuacaugacaucaaugaaaagauuuaaaaacgaaagcgacccugaaggcgcucucugguaa

SEQ ID NO: 22131 - RNA, 9879 nt, Artificial Sequence
  derived and/or modified CDS sequence (opt6) from DENV-1__KR024705__SS-prME
uccguaaccaugcuccuaaugcuacuaccaacugcacuggcauuucaccuaacuacucgaggaggagaaccacauaugauuguuucuaaacaagaacgugguaaaucucuuuuguucaaaacaagugcaggagucaauauguguacccuaauugcaauggaccuaggagaauuaugcgaagacacaaugacauacaaaugcccacgcauaaccgaagccgaaccggacgauguagacuguugguguaaugcuacggacacguggguaacuuauggaacauguucucaaacaggagaacaucgaagggauaaacggaguguugcuuuagcgccccauguaggucuuggguuagaaacgaggaccgaaacauggaugaguucagaaggggcuuggaaacaaauucaaaaagucgaaacaugggccuuacggcauccaggauuuacugucauugcucuuuuucuugcccaugcuauugggacaaguauaacacaaaaagggauaaucuuuauauuacuaaugcuaguaaccccaaguauggcaaugaggugcguagguauugguaauagagacuucguagaggggcucuccggugcaaccuggguugaugugguacuugaacauggauccugcguaaccacaauggcuaaaaauaaaccuacuuuagauauugaacuucucaaaacugaagucacuaauccggcgguauuacgcaaacucugcauugaggcuaagauaucuaaugcaacaacggauagucgauguccaacacagggugaagcgacuuuaguagaggaacaagaugcgaauuuugucugucgccgcaccuuuguagauagaggguggggaaacggauguggcuuauuugguaaagguucacuauuaacaugcgcaaaguuuaaaugugucaccaaacucgagggcaagauuguucaauaugaaaaucuaaaguauucaguuauaguaacuguacacacgggugaccagcaucaaguaggcaaugagacaacugaacaugguacgauagcgaccauaacaccucaagcccccacaucagaaauucaacuaacagacuacggcgccuuaacacuagauuguucaccucgaaccggacuugauuucaacgaaaugguauuacucacaaugaaggaaaaaucauggcuuguucauaagcagugguuccuagauuugccauugcccuggaccucuggcgccuccaccagucaagaaacauggaaccgccaggaucuauuagucacuuuuaagacagcacacgccaagaaacaagaggugguaguacuaggaucgcaagagggagccaugcauacugcccucacgggugcgacggaaauacaaacuucugggacaacaaccauuuucgccggccauuuaaaauguaggcuuaaaauggauaaauugacacugaaaggagucucuuaugucauguguaccgguagcuucaaacuugaaaaagaggucgcagaaacacaacauggaacaguucuaguacaaguuaaauacgaaggaacugaugcaccguguaaaauuccuauaucgacucaagacgagaaggguguuacacaaaauggacgccuaauaacggccaauccuaucgucacggacaaagaaaaaccgguuaacauagaaaccgaaccaccauucggugaaagcuauauagugauaggcgcuggagaaaaagcacuaaaguuaucuugguucaaaaaggguucaucaauugggaaaauguucgaagcuacagcacgaggugcaaggcguauggcaauauuaggugauacagcaugggacuuuggaucgaucgguggcguauuuacaucgguaggcaaguuaguacaucaaguauuuggaacagcuuacgguguauuguuuucugggguaucauggacaaugaagauugguauagguauucuauugacaugguuggggcuaaauucgagaucuacaagucuuucgaugacauguauugcaguagguaugguuacucuuuaucucggaguuaugguccaagcugacaguggcugcgugaucaauuggaaggguagggaauugaaguguggcucagggauauucguaacaaacgaaguacauacguggacagaacaauacaaauuucaagccgacucaccuaaacgacuaucugcagcaauuggaaaagcaugggaggaagggguaugcggcauuagaagugccacaagacuagaaaacauaauguggaagcagauuaguaacgaacuaaaucauauacuacuugaaaaugauaugaaguucacaguugugguaggggaugcaaacggcauauuaacgcagggaaagaaaaugauacggccucaaccaauggagcacaaauauuccuggaaaaguugggguaaagcaaaaauaauuggagccgauacucaaaauacgacuuucaucauagauggaccugacacaccagaaugccccgaugaucagagagcauggaauauaugggagguugaagauuaugguuuuggcguauuuacgaccaacaucuggcuaaaauuaagagauaguuacacgcaaaugugugaccaccggcuaaugagugccgcaauaaaggauucaaaggccguacacgcagauauggguuauuggauugaaucagaaaagaaugagaccuggaaacuagcacgcgccagcuucauagagguaaaaacguguauauggccgcgaucucauacucuauggucuaacgguguccuagaauccgagaugauuauaccaaagauauauggugguccuaucucgcagcauaauuacagacccggcuacuucacacagacagcaggaccguggcauuugggaaaacuagagcuggauuucaaucuaugugaaggaacgacuguggucguagacgaacauugcggaaacagaggaccaaguuuaaggacaaccaccgucacaggaaaaauuauccaugaauggugcugccggucaugcacacuaccuccgcugagauuuagaggcgaggacggaugcugguaugggauggagauaaggccagugaaggaaaaagaagaaaauuuaguaaggucaaugguaagugcuggcaguggugaaguagauuccuucucucuuggauugcuguguguuagcauaaugauugaggaaguuaugcggucgcgauggucacgaaaaaugcucaugacggggacauuagcgguauucuuucucuuaauuauggggcaacucaccuggaaugaucuaauaagacuaugcauaauggucggagccaacguaucagacaggauggguauggggacaacauaucuagcauuaauggcuacauuuaaaaugcguccaauguucgcaguggguuuauuauuuagacgacuaacaucacgggaaguauuacuacuuacaauaggccuaucacugguagcgucgguggaauuaccaaauucucuugaagaacucggagauggauuagcuaugggaauuaugauguuaaaacuucucacggacuuccagucucaucagcuauggacaacacuucuuagcuuaacauuuauaaaaaccacacucagucuugacuaugcuuggaagacuauggcuaugguacuaucuauagucagucuguuuccauuaugccugaguacaacaagucagaaaaccacguggcuuccuguucuauuaggcuccuucggaugcaaaccguugacaauguuucucaucacagaaaauaagaucuggggacguaaaucuuggccauuaaacgaagguauaauggcuguggguauagucaguauauuauugaguucauugcuaaagaacgaugucccauuagcgggaccguugauagcagggggcaugcuaauagccugcuacguuauaagcggauccucagcugaccucucacuugaaagggccgcagaagucuccugggaagaggaagccgaacacucuggagcuagccauaacauccuaguagagguccaagaugacgguaccaugaaaauuaaagacgaggaaagagacgauacauugaccauauugcucaaagcaacauuacuagcgguuucugguguguauccaaugaguaucccagcaacucucuucgugugguauuucuggcaaaagaagaaacaaagaucaggcguccucugggauaccccguccccuccagaagucgaacgcgcuguacuagacgauggaaucuaccgcaucuugcaaagagguuuacuaggucgcagucaaguuggugucgguguuuuucaagacggcguauuucauacaauguggcaugugacaagaggugcaguacugauguaccagggaaaacgguuagaacccaguugggcuucugucaagaaagaucuuaucagcuauggugguggauggcguuuccaagggucauggaacacgggagaagaagugcagguaauagcuguggaaccuggcaaaaaucccaaaaacguacagacgacuccuggaaccuuuaaaacuccagaaggcgaaguaggagcuauagccuuagauuuuaagccugggaccucgggcucaccaaucguaaauagggaagggaagaucguaggacuauacggaaaugguguaguuacaaccaguggcacauauguuuccgcaauagcucaagcgaaagcaagucaagagggacccuugccagaaauagaagacgaagucuucaaaaagaggaaucuuaccauaauggaucugcauccugguagcggaaagacucgaagguauuuacccgcuaucguacgggaggcuauaaaaagaaaguuacguaccuugauccuugcaccaacacgaguaguagccucagaaauggcagaagcacugaaaggaaugccaauuagauaucaaacuacggcgguuaaaucagaacauaccggcaaggagauuguggaccuaaugugccaugcaacauucaccaugcgccuacuuagcccaguaaggguaccaaauuacaauaugaucauuauggaugaagcucauuuuacagauccagcgucuauugcagcgaggggauauaucagcacaagagugggcaugggagaagcugcugcuauauuuaugacggccacaccaccuggaagugucgaagccuuuccucagaguaaugcagucauacaagacgaagaaagagacauaccugagcgaaguuggaauaguggguacgauuggauaacugauuuccccggaaagacaguaugguucguaccaucaauaaaaagugguaaugauaucgcgaauuguuuaagaaagaacgggaaacgagugauccagcuaucuagaaagacuuucgacacagaguaucagaaaacuaagaauaacgauugggacuaugugguuacaacagacauauccgagaugggggcgaacuuccgugcugaucgaguaauagacccuaggcguugucuuaagcccguaauacuuaaagauggcccagaacggguuauauuagccggucccaugccuguuacggcugcauccgcagcacaaaggagaggacguauaggccgcaaccaaaacaaagagggcgaucaguauauauauaugggacagcccuuaaacaacgaugaagaucaugcacauuggacagaagcuaaaaugcuuuuagacaacauuaacacgcccgaaggaaucauuccugcguuauuugagccggaaagagaaaaaucagcugcuauugauggagaauaccgacugcgcggcgaagcacgcaaaacauuuguggaacuuaugcgacguggagauuuaccaguuuggcugucauacaaaguagcaagcgaggguuuccaauacucggacagaagaugguguuuugacggugagcggaauaaccaaguauuagaagaaaauauggaugucgaaaucuggaccaaagaaggagagaggaagaaacuacgaccacgaugguuggacgcuaggacguacucagauccacucgcacuaagggaguucaaagaguucgccgccgguaggcguagcguaucaggcgauuuaauauuagaaauagggaaacucccacaacaucuaacgcuaagagcucaaaaugcucuagacaacuugguaauguugcacaacucggaacagggaggaaaggccuacaggcaugccauggaagaguuaccagacacgauagaaacgcuuaugcuauuagcacucaucgcgguacuaacuggaggaguaacauuauucuuccuaagcggcaaaggguuagguaaaacaagcaucggacuuuugugcguuauggccucaucaguccuccuauggauggccagcguggaaccucauuggaucgcagccucaauuaucuuagaguucuuucugauggucuuauuaauuccagaaccagacagacagagaacaccacaagacaaucaacuagcuuauguggugauaggguuacuauuuaugauacuuaccguagcagcaaaugagaugggauuacuugagacaacuaagaaagaucugggaauaggacauguuguggcagagaaccaccaccacgcuaccauguuagauauugaccuccauccggccuccgcguggacgcuauacgcaguugcuaccacuauuauaaccccuaugaugagacacacaauagaaaauacaacggcaaauauaucuuuaacagccauugcaaaucaggcagccauucucauggguuuagauaaaggguggccaauaucgaaaauggacauaggugucccauuauuagcguuaggcugcuauagccaagucaauccucucacacugacggccgcugugcuaauguuggucgcacauuaugccaucauagggcccggucuucaagcaaaggccacaagagaagcacaaaagcgaacggcagcggggauaaugaaaaacccuacaguagacggaauaguagcgaucgacuuggauccugugguauaugaugcuaaguucgagaaacaacuaggccaaauuaugcuguuaauacuauguacaucgcaaauacucuuaaugaggacgaccugggcgcugugugagucaauaacgcuagcaacugggccccuaacuacgcuaugggaagguucgccaggcaaauuuuggaacaccaccauagcagucagcauggcuaauauauuuagggggaguuaucuagcaggagcugguuuagcauucagccuaaugaagagucucggaggcggcagacgagguacuggagcacaaggagaaacguuaggagaaaaauggaaacggcaacuaaaucaacuuucaaaaucugaauuuaauacauacaaaagaucaggaaucauggaaguugacagaagugaagccaaagaaggucucaaacgaggcgagacaacuaaacaugcuguauccagaggaacagcgaaauuacgaugguucguagaacggaauuuaguuaaaccugagggcaaaguaauugaccuuggcuguggccggggagguugguccuauuacugcgccggccuaaagaaagucacugaggugaagggguauacgaaaggagggccaggacaugaagaacccauuccaauggcaaccuacggguggaauaucguaaaacuacacucuggcagagauguauucuucacaccgccugaaaagugugacaccuuauuaugcgauauaggagagucaaguccuaauccgacaauugaagaaggaagaacucucagaguacuaaaaaugguugagccuugguuacgaggaaaccaauuuuguauuaaaauucuaaauccauauaugccauccguaguggaaacacuagagcaaaugcaaagaaaacauggagggaugcuaguaagaaacccguuaagcagaaauucaacccaugagauguacuggguaaguuguggaacagggaauauagucucugccgucaauaugacaaguaggauguuacucaaucguuuuacaauggcgcauagaaaaccaacauacgaaagggaugucgaucuaggugccggaaccagacacguagcggucgaaccugaaauagcuaaccuagauauaauaggacagcggauugagaauaucaaaaacgagcauaaaucaaccuggcauuaugacgaagauaacccuuacaaaacuugggcuuaccauggcucguacgaaguuaaaccuucagggucugcaucuucaaugguaaaugguguagugcgauuauuaacaaagccaugggauguaaucccuauggucacucaaauugcaaugacugauacgacgcccuuuggucagcagcguguauucaaagaaaagguagacacccgaacgccaagaccaaaaagaggaacagcgcaaaucauggagguaacagcuaaauggcuauggggauuuuuaucccgaaacaagaaaccacguaucuguacuagggaagaguucacacgcaaaguacgcaguaacgcagcaauaggagcaguauuuguagacgaaaaccaauggaauagcgcaaaagaagcgguggaagacgaacgguuuugggaucuuguccauagggagagggaauuacauaaacagggcaaaugcgcuacauguguauacaacaugaugggaaaaagagaaaagaagcuaggagaauuuggaaaagcuaaagggucaagagcaaucugguauaugugguuaggcgcuagguuucuagaauuugaagcucuuggauucaugaacgaagaucauugguuuucuagagaaaauuccuuaucuggagucgagggugagggauuacauaaacuugguuauaucuuaagagauauaucaaaaauaccgggcggcaacauguaugcagaugacacagcuggcugggauacaaggaucacagaagaugacuugcaaaacgaagcaaaaauuaccgauaucauggaaccagaacaugcauuauuagcuacaaguauauuuaaacuuacauaucaaaacaaagucgucagaguacaacgaccagcaaagagugggacaguuauggauguaaucucucgaagggaccaaagagguucaggacaaguaggcacauacggacugaacacuuucacaaauauggaaguacaacuaauaagacaaauggagagugaaggaauauuuucuccaucugaauuggaaaauucuaacuuggccgagaggguauuggauugguuggaaaaacacgggguagaacgauuaaagagaauggccaucucaggagacgauuguguugucaaacccacggacgaccguuucgcaacagcguuaacagcauugaaugauaugggaaaaguaaggaaagauauaccacagugggaaccgagcaaaggauggaaugacuggcaacaggucccauuuuguucgcaccauuuucaccaacugauaaugaaagacggaagggaaauagucgugccaugucguaaucaagacgaguugguaggucgagcccggguuucgcagggugcagguuggagucugagagaaacagcuugccuaggaaaauccuacgcccaaauguggcaauuaauguauuuucaucgaagagauuugaggcucgcugcuaacgcgaucugcucugcaguuccgguaaacuggguaccaacaaguagaacaacuuggagcauucaugcucaccaucaauggaugaccacagaagauaugcuaaguguuuggaauagaguauggauagaggagaauccauggauggaagacaagacacacguaaguucuugggaagacguucccuauuugggaaagagagaagaucaauggugugguucuuugauaggucugacagcgagagcaacaugggcuaccaauauacagguggcgauuaaucaaguuaggagacuaauuggaaacgaaaacuauuuggacuacaugacgagcaugaaaagguucaaaaacgaaagcgaccccgagggcgcacugugguaa

SEQ ID NO: 22132 - RNA, 9879 nt, Artificial Sequence
  derived and/or modified CDS sequence (opt6) from DENV-1__KR024706__SS-prME
aguguaacgaugcuauuaauguuauuaccaacggcacuggcauuucauuuaacuacucgaggaggggagccucacaugauaguuucuaaacaagaaagaggaaaaucacuacuuuuuaaaaccucagcaggaguuaauaugugcacacuaauagcuauggaucuuggagagcuaugcgaagacacuaugacauauaaauguccacgaauaacuggugcagaaccagaugauguagauugcugguguaacgcuacugacacauggguaacauacggaacauguucacaaacaggcgagcauaggcgagauaaaaggagcguagcacuagcgccccacgugggguuagguuuagaaacacgaacugaaaccuggaugucgucagagggggccuggcgacaaauucaaaaaguugaaacaugggcuuuacgucauccaggguuuacaguaaucgcauucuuucucgcccacgcaauaggaacaaguauaacucaaaaaggaaucaucuuuauccuacugauguuaguaacuccaucgauggcgaugcgauguguaggaauuggcaaccgagauuucguagagggauuaucaggcgcuacuuggguugauguagugcuagaacaugguucauguguaaccacaauggccaaaaacaaaccaacuuuagacaucgaguuauugaaaacagaaguaaccaauccggcaguauuaagaaaauuaugcaucgaagcgaaaauaagcaauacuaccacagacagucggugucccacccaaggagaagccacacugguggaagaacaagacgcgaauuuuguuugucgaaggacccuuguagaucgagggugggguaaugguuguggucucuuugguaaaggcucauugcuuacuugcgcgaaauuuaaaugcguuacaaaacuggaaggaaaaauaguucaauacgaaaauuuaaaauauaguguaauuguaacuguacacaccggugaccaacaucaaguaggaaaugaaacaacagaacacgguaccauagcuacaauuacaccacaagcaccaacguccgaaauucaauuaacagauuacggcgcccuuacacuugacuguucuccgaggacgggucucgacuuuaaugaaauggugcuuuugacaaugaaagagaaaaguuggcuuguccacaaacaaugguuuuuagauuuaccauugccuuggacaucgggagcaucaacaagccaagaaacauggaauaggcaagaucugcuaguaaccuucaaaacugcucaugccaagaaacaagagguaguuguauuagguucucaagagggugcgaugcauacagcgcuuacaggggcaacugaaauacaaacaucugguacgaccacuauauucgcugggcauuuaaaaugccgacucaaaauggauaaguuaacauuaaaaggugugucauauguuauguguaccggaucguuuaaauuagagaaagaaguggccgaaacacagcaugggaccguuuuaguucagguaaaauacgaaggaacugaugcacccugcaaaauacccauaagcacucaggaugaaaaaggcguaacacaaaauggaagacugauaacugccaauccuauaguuacagauaaagaaaaaccaguaaauaucgaaacagagccuccuuuuggagaaagcuauaucguaauaggugcaggagaaaaagcacuaaaacugucaugguucaagaaaggaucgucgauaggaaaaauguucgaagcuaccgcgaggggugcuagaagaauggccauucuuggagauacagcaugggacuuugguagcauaggagggguuuuuacuuccguaggaaaacuuguucaccagguauuugguacagcuuacgggguucuauuuagcggagucaguuggacaaugaaaauaggaaucggcauacuucuaacauggcugggauuaaauucaagauccaccaguuugagcaugacauguauagcaguaggcaugguuacucuguauuugggugucaugguccaagcggauucagguuguguuauaaacuggaaagggagagagcucaagugugguuccggaauuuucguaaccaaugaaguccacacuuggacagaacaguauaaauuucaagcagacagucccaaaagacuaucagccgcaauugggaaggcuugggaagaagggguguguggaaucagaucagccacaagauuagaaaauauaauguggaaacaaauaaguaaugaauugaaucacauacuucuugaaaacgacaugaaauuuaccgucguagugggagaugccaaugguauccucacccaaggcaagaaaaugauacgaccacaaccaauggagcacaaguacaguuggaaaagcugggguaaagcaaaaauuauuggagccgauacucagaacacgacauuuaucauagauggaccugauacgccugaaugucccgacgaccaacgagcguggaacauaugggaaguagaagauuaugguuucgguguuuucacaacuaauauauggcuaaaauuaagagacucauauacacaaaugugugaucaucguuuaaugucugccgcgauuaaagacuccaaagcaguucaugccgauauggguuacuggauagaauccgagaaaaaugaaaccuggaagcuggcacgagcuucuuucauagagguuaaaacuugcaucuggccacggucucauacucuaugguccaaugguguacuugaaucggaaaugaucauaccgaaaaucuacggaggaccaauaagccaacauaacuaucgacccggguauuucacucaaacggcuggcccauggcaucuaggaaaacuagaguuagauuuuaaccuaugcgaaggcaccacaguaguggucgacgaacauuguggcaaccgcgguccgucuuugcggacaacgacgguaacagguaaaauaauacaugaauggugcugccgaucaugcacccugccuccgcugcguuuucguggagaagacggauguugguaugggauggaaauccgaccgguaaaggaaaaagaagaaaaucuagucagaaguaugguuucggccgguucuggugagguagacucauuuucauugggguuauuauguguaucuauaaugauugaggaaguaaugagaagcagauggagucggaaaaugcucaugacuggaacuuuggcaguauucuuucugcuuaucaugggucagcuuacguggaacgauuuaauacggcuguguauaaugguaggggcuaacguaucggaucguaugggaauggguacaaccuaccuagcacucauggcgacauuuaaaaugcggccuauguuugccgucggacuccucuucagacgucugacauccagggagguauuauuacucaccauaggucuaagucugguggcgucaguugaauugccaaauagcuuagaagaacuaggugacggucuagcaauggguauaaugaugcuaaaacuacuaaccgauuuccaaagucaccagcuauggacaacauuauuaagucuuacuuucauaaaaacuacucuaucuuuagauuaugcauggaaaacaauggcuaugguucuaaguauugucagcuuauucccucuaugucuaucaacaacuucgcagaaaacuaccuggcuaccaguacugcuugguaguuuuggauguaaaccauuaacuauguuucucauuacugaaaauaaaauaugggguagaaaaucauggccgcuuaaugaagguauuauggcuguaggcauuguaucaauauuacuauccagccuauuaaagaacgauguuccuuuagccgggccguuaauagccgguggaaugcuaaucgcaugcuauguaauuucaggcaguucggcagaucuuucucuagagagagccgcugagguuucaugggaagaagaagcagaacauagcggagcaucgcacaacaucuuggucgaagugcaagaugacgggacaaugaaaauaaaagacgaagaaagagacgacacauuaacgauacuccucaaagcuaccuuauuagcaguaagcggagucuauccaaugucuauacccgccacgcucuuuguuugguauuuuuggcagaagaagaaacaacguucuggaguccuuugggacaccccaucaccuccagaaguugagcgagcuguauuagacgauggcauauaucggauacuucaaagaggacucuugggaaggucgcaaguaggcguaggaguauuccaggaugguguguuucacacuauguggcauguaacaagaggagcagucuuaauguaccaaggaaaacgucuagaaccaagcugggcaucagucaagaaagaucuaauaucuuauggugguggauggcgguuucaaggaaguuggaauaccggggaggagguacaagucauagcuguagaaccaggcaaaaauccgaagaauguucaaaccacccccggaacauuuaaaacccccgaaggugaaguaggugcaauagcucucgauuucaagccgggaaccaguggaaguccaaucguaaauagggaaggcaagauuguagguuuguauggaaacggaguaguuacgacgucaggaacguacgugagcgcuauagcccaagcaaaagcgagccaggaaggaccauuaccugagauugaggaugaaguauuuaagaaaaggaacuuaacaauaauggaucuacauccugguucuggcaagacucgaagauacuugccggcuaucgugcgcgaagcuauuaagagaaaacugagaacccuaauacuagcaccgacuagagucgucgccagugagauggcagaggcacucaagggaaugccgauuagauaucagaccacagcgguaaagucugagcauacaggaaaagaaaucguagaccucaugugccaugcuacuuuuacgaugcguuuacuaagcccaguuaggguucccaacuauaauaugauuaucauggaugaagcacauuucacagacccagcuuccaucgcagcaagaggauacauaagcacaagagucggaaugggcgaagcugcugcuaucuucaugacggcuacaccaccugguucagucgaagccuucccucaaucuaaugcuguuauucaagacgaagaaagagacauaccugaaagauccuggaacucgggauacgauuggauuaccgacuuucccggcaaaacugucugguucguaccaaguauaaaaucagguaaugauauagcaaauuguuuacguaaaaaugguaaaagaguuauacaacuaaguagaaaaacauucgacacggaauaucagaaaaccaaaaauaaugacugggacuauguagugacaaccgauauaucagaaaugggugcaaacuuucgagcugaccgggucauugacccgaggagaugucugaagcccguuauauuaaaggaugggccugagagaguaauuuuggcuggaccaaugccaguaaccgcugcuucagcagcucaaagaagaggccggaucgggagaaaucaaaauaaggaaggagaccaauacauauacaugggacaaccuuuaaacaaugaugaagaucaugcgcauuggacagaagcuaaaaugcugcucgauaacauaaauacuccagaaggaauaauuccagcccuuuucgaaccagaaagagaaaagucugcagccauagauggggaauaccgcuuaggaggagaagcccggaaaacuuuuguagaauugaugaaacgaggagaccuaccaguuugguuauccuauaaaguggcuagugaggguuuucaauauuccgaccguagguggugcuucgauggggagagaaauaaucaaguauuagaggaaaacauggacguggaaauauggaccaaagagggcgaacgaaagaagcuaaggccacgaugguuggacgcacgaacauauagugauccucucgcccuucgcgaguuuaaagaguucgcugccggccgaagaaguguaaguggagauuuaauacucgaaauugguaaacugccucaacaccucacacuaagagcccaaaaugcgcuggacaaccucguaauguuacacaauucagaacaaggcgguaaagccuaucggcaugcaauggaggaauugccagauaccauagaaacacuaauguuacuagcacucauugcuguucuaaccggcggcgucacuuuauucuuuuuaucagggaaaggacuaggaaaaacuucgauagggcuucugugcguaauggcaucgucagugcuacucuggauggcuucaguugaaccgcauuggauugccgccagcauuauccuagaguucuuucucaugguccuguuaauccccgaaccagauaggcaaaggacgccacaagauaaucaacucgcauacgugguaauaggcuugcucuuuaugauucuaacuguggcagcuaaugaaaugggauuguuagaaaccacuaagaaagacuuaggaauaggucauguuguagccgaaaaucaccaccacgccacuaugcuugauauagaucuccaccccgcaucugcauggacguuguacgccguugcaacuacgaucauaacacccaugaugagacauacgauagaaaacacaacggcuaauauaucguuaacagcuauagcuaaucaagcugccauccucaugggucuugacaaagguuggccaaucucaaagauggacaucgguguuccucuuuuggcacuuggcugcuacagccaaguaaauccauuaacacuuacagcagcuguacuuauguuaguugcacauuacgcaaucauaggcccgggacuacaagcgaaagcuaccagagaagcacagaaaaggacagcagcagguauuaugaaaaauccaacaguugauggaauaguugcaauagauuuggaucccgugguauacgacgcaaaauucgagaaacaauuagggcagauaauguugcuaaucuuaugcacuucucagauauuauuaaugagaacuacgugggcucucugugaaucaauaacacucgcuacgggacccuuaacgacauuaugggaaggcucccccggaaaauucuggaacacaacgauugcgguaucaauggcgaacauauucaggggaucguauuuagcgggggccggacuagcauuuagcuuaaugaaaucucuuggaggaggucgaagagggaccggcgcacaaggagaaacacuuggcgaaaaauggaaaagacaauuaaaucaacuuaguaaaucagaguucaauacguacaaaagaaguggcauuauggagguggauagaucugaagccaaagaaggauugaagaggggcgaaacaacuaaacaugcaguaucaagggguacugcaaaacuaagaugguuuguagaacgaaauuuagucaaaccugaaggcaagguuauugaucucgguuguggacgcggagguuggagcuauuauugcgcaggacugaagaaaguuacggagguaaaaggguacacaaaagggggaccaggccacgaggaaccuauaccuauggcaacuuacggauggaacauugucaagcuacacagcgggcgagacguauucuuuacuccacccgagaaaugcgacacucuauuaugcgacauuggugaauccucuccuaauccaacgaucgaggaagggcggacacuaagaguacucaaaauggucgaaccaugguugagggggaaucaauucuguaucaaaaucuuaaauccauauaugcccagcgugguagagacuuuggaacaaaugcaaaggaaacacggagguauguuaguuaggaauccacuaagcagaaauucaacccacgagauguauugggugucuugugguaccggaaauauuguuagcgcuguuaauaugacgagccggaugcuccuuaauagguucacgauggcacauagaaaaccaacauaugaaagagauguagaccuuggugcagggaccagacacguagcagucgaaccagagauugcaaaucuagauauuauaggacaacgaaucgaaaacaucaaaaaugaacauaaguccacauggcauuaugaugaagauaaucccuacaaaacuugggccuaucauggcucauacgaaguuaaaccgaguggaucggcaaguagcaugguuaauggugucguucgacuauuaaccaaaccgugggaugucauacccaugguaacccaaauugcuaugaccgacaccacccccuuuggacaacaaagaguauuuaaagaaaaagucgauacgaggacaccuagaccaaaaaggggaacagcccaaauaauggagguaacugcuaaaugguuauggggauuucuaagucgaaacaagaaaccuagaauaugcacaagagaagaguuuacgcggaaaguaagaucaaaugcugcuauuggagcaguauuuguagacgagaaucaguggaauagugcaaaggaagcuguugaagacgaaagauuuugggaucucguucauagagaaagagaauuacacaagcaggguaaaugcgccaccuguguguauaacaugauggggaaaagagagaagaaacuaggcgaauuuggcaaagcgaaagguagccgggccaucugguacauguggcuuggcgcccgcuuccuggaauuugaagcguuaggguuuaugaacgaagaccauugguuuaguagagagaacucguugucugguguggaaggugaaggauuacauaaguugggguauauccuacgcgauauuucuaaaauaccgggaggaaacauguacgccgaugauacggcuggaugggauacaagaaucacagaagacgacuuacaaaacgaagcgaagauaacagacauuauggagccggaacacgcucuccuagcaacaucuauauuuaaacuaaccuaucaaaauaagguaguucguguucaaagacccgccaaaagugguacagugauggaugucauuucgcgacgagaccagaggggguccggucaaguaggaacguaugggcuuaauacuuuuacuaauauggaaguacaacuaauacgacaaauggaaucggaaggcauauucucuccaagcgaauuggagaacucuaaucucgcugagagagugcuagauuggcucgagaaacaugggguagaaaggcuuaaaagaauggcaauaucuggagaugacuguguggucaagccaacugacgauagauuugcgacugcauuaacugcauuaaacgauauggguaaaguacgaaaagauauuccucaaugggaaccgaguaaagguuggaaugauuggcaacuugucccauucuguucccaucacuuucaccaauuaauaaugaaagacggcagagagauuguaguaccgugccgaaaccaggaugaacuuguagggagagcacgagucucacagggugccggauggagccucagagagacagccuguuuaggaaaaucguacgcucagauguggcagcuuauguauuuucaucgaagagacuuaagguuagcagcgaaugcgaucuguucugcaguaccaguaaauuggguaccaacaagucgaacuacguggucgauucacgcccaccaccaauggaugacuacugaagacauguugagcgucuggaauagaguauggauagaggaaaauccauggauggaagauaagacacauguaucauccugggaagauguaccguaccuaggaaaaagggaagaucaaugguguggaagucuaaucggcuuaacagccagggcgacgugggcaacgaauauacaagucgcuauaaaccaaguaagaagauuaauuggaaaugagaauuaucucgauuauaugacgucaaugaaaagauucaaaaacgagagcgacccggagggagcguuaugguag

SEQ ID NO: 22133 - RNA, 9879 nt, Artificial Sequence
  derived and/or modified CDS sequence (opt6) from DENV-1__KR024707__SS-prME
agcgucacuaugcuacuaaugcugcuaccuacugcuuuagccuuucaucuaacaacacgagggggugagccucauaugauaguaaguaaacaagaaagagguaaaucgcuucuauucaaaacgagcgcaggaguuaauauguguacucuuauugcaauggacuugggagaacuaugcgaagauacaaugacauacaaaugucccagaauaacggaagcagaaccggaugacguugauuguugguguaaugcgacugauaccuggguuacauauggaaccuguagucaaaccggagaacacaggagggauaaaagaucgguagcacuggcaccccauguuggucuaggccucgaaacaaggacagagaccuggaugucuucagagggggcauggaggcaaauacaaaaaguugagacaugggcgcuuagacauccaggguucacgguuauagcacuauuuuuggcacacgcuauagguacaucaauaacacaaaaagggauaauauucauacucuuaaugcucguaacgcccucaauggcaaugagauguguggguauaggaaauagagauuuuguggaaggauugagcggagcaaccuggguagauguaguacuggagcaugguucauguguaacaacaauggcuaaaaauaaaccaacauuagauauagagcuacugaaaacagaaguaacaaauccagcaguacuccguaaauuguguauagaagcuaaaaucucuaauacuacgacagauucucgcuguccgacacaaggcgaagcaacuuuaguggaagaacaagacgcgaauuucgugugucgcaggaccuucguagaccgaggcuggggaaauggcuguggauuguuuggaaaaggaucucuacuaacaugugcaaaauuuaaaugcguuacgaaacuggaaggcaaaauuguucaauaugagaauuugaaauauuccguaauaguuacuguccacacuggagaccaacaucaaguaggaaaugaaacgaccgaacauggcacgaucgccacaauuacgccacaagcgccuaccagugagauacaauuaacugacuauggagcauuaacucucgacuguucaccucgaacuggguuagauuucaaugaaaugguguuguuaacaaugaaagaaaaaucuuggcuuguccacaaacaaugguuuuuggacuugccucuccccuggaccagcggggcuucgacaagccaagaaaccuggaaucgacaagacuugcuggucacguuuaaaaccgcucacgcuaagaaacaggagguuguuguacuagguagucaagagggugcaaugcacacugccuuaacgggagccaccgaaauacaaacaucagguacaaccaccauauuugcuggccaucucaaaugucgauuaaaaauggauaaauuaacucuaaaaggaguaucguacguaaugugcacaggcucauuuaaauuagaaaaagaaguagccgagacacaacacggaacaguucugguccaaguuaaauaugaaggaacagaugcuccguguaaaauuccaauaucgacgcaggacgagaaaggagugacacaaaauggcagguuaauuacugcaaauccaauaguuacagauaaagaaaaaccaguaaauaucgaaacagagccaccauuuggugaaucguacauagucauaggcgcaggcgaaaaagcucuuaaauuguccugguuuaaaaagggaucuucaauugggaaaauguuugaagccacugcgcgcggcgccagaagaauggcuauuuuaggagacaccgcuugggacuuuggaaguauuggcggcguuuuuacaucagugggcaagcugguccaucaaguauucggaacagcguauggagugcuuuucuccggcgucucauggacgaugaaaaucggaaucggaauauuguuaaccuggcuaggguuaaacaguagauccacaaguuuaucgaugacaugcauagcuguaggcauggugaccuuauaccuuggugugaugguucaagccgacagugguugcgugauaaacuggaagggucgagaauuaaagugcggcagcggaauuuuugucaccaaugaaguucauacauggacagaacaauauaaauuccaggcagacucaccaaaaagacuuucagccgcaauugguaaagcgugggaagaagguguauguggaauuaggagugcgacaagacuugaaaauauuauguggaaacagaucaguaaugaauugaaccacauuuuguuggaaaaugauaugaaguuuacaguaguaguuggcgaugcgaauggcaucuugacccaagggaagaaaaugauucgcccacagcccauggaacauaaguacaguuggaaauccugggggaaggccaagauaauaggagcagacacccaaaauacgacuuuuauaauagauggcccagauacucccgaaugccccgaugaccaacgagcauggaauauuugggaggucgaagacuaugguuucgggguuuuuacuacgaacauaugguugaaacuuagagauagcuauacucaaaugugugaccauagauuaaugucagccgcgauaaaagauucuaaagcaguucaugcugacaugggauauuggaucgaaagugagaaaaacgaaacuuggaaacucgcccgcgcgaguuucauugaggucaaaacguguauuuggccuagaagucauacacucuggaguaauggcguuuuggaaucagaaaugauaauaccgaaaauauauggaggcccaauaagucaacauaauuauagaccagguuauuucacucaaacugccgggccauggcaucuagguaaauuggaacuggacuuuaaccuaugugaagguacaacaguuguaguagacgaacauuguggaaacaggggcccauccuuacguaccacgacgguaaccggcaaaauaauucaugaaugguguuguagaucauguacguuaccaccccuuagauuucggggagaagaugguuguugguacggcauggagauucgaccgguuaaggaaaaggaagaaaacuuaguaaggucaauggucucagcuggaucgggugaagucgauuccuucagucuaggcuuguuauguguaucaauaaugauagaggaaguuaugagaucaagauggucucguaagauguuaaugaccggaacuuuagcuguauucuuucuccugaucaugggucagcucaccuggaacgaccuaauuagacuaugcaucaugguaggagcaaaugucucugaccguaugggaauggggacuacauaucuugcuuuaauggcgacguucaaaaugcguccuauguucgcaguaggacuguuauuuagaagauuaacaagcagggaaguacuucuacucacaauugguuuaagccuagucgcaucugucgaguuaccaaauucauuggaggaacuuggagauggcuuagccaugggaaucaugaugcuuaagcugcuuacagacuuucaaagccaucaauuauggaccacccuacuaucccugacauuuauaaaaacuacacuuucauuagauuacgcauggaaaacaauggcaaugguucuuagcauugucucuuuauuuccacucugucugucgacuacaagucagaaaacuacuugguugccuguacuuuuaggaucauucggauguaaaccuuugacaauguuucuuauaacagaaaacaaaauuugggguaggaaaucuuggccacuaaacgagggaauuauggcaguugguauaguuagcauccuauuauccuccuuacucaaaaaugaugugccacucgcagguccccuaauagcuggagguauguugauagcgugcuacguaauuucaggcagcucagcggaucuaucauuggaacgugcugcagagguuucuugggaagaggaagcggagcauuccggagcaucccauaauauccuaguggagguccaagacgaugguacgaugaagauaaaagacgaggaacgugaugacaccuuaacuauauuacuaaaagccacguuguuggcgguuagcggaguguauccuaugucaauuccagcaacucuauuuguaugguauuucuggcagaaaaagaaacaacgcucaggcguuuuaugggauacaccaagcccuccugaaguggaaagagcaguauuggacgacggaauauauagaauacuacaacgagguuuauuggggagaucccaagucggggucggcguauuccaggaugguguuuuccauacuauguggcacgugacaagaggugccguuuuaauguaucagggaaaacgauuagaaccuuccugggcaucaguuaagaaagaucucaucagcuacggagguggauggagguuucagggcucauggaacacaggagaagaaguucaagugauagccguagaaccaggcaaaaauccuaaaaauguacaaacaacaccugguacauucaaaacgccagaaggagaaguaggcgcuauagcacucgauuuuaagccgggcacaucaggaucuccaauaguuaauagggaaggcaaaauaguagguuuauaugggaacgguguagugacuacaaguggcaccuaugucuccgcuauugcccaagcgaaggcaucucaggaagggccgcuaccagaaauagaggacgaaguauucaagaaaagaaaccuaaccauaauggauuuacauccgggcagcggaaagacacgcagauaucugcccgcaauagugagagaggcuauuaaacggaaauugaggacacuaaucuuagcuccgacgagagucguagccuccgagauggcggaagcccucaaggguaugccuauacguuaucaaacuacagcuguuaaaagcgaacacacuggaaaagaaaucguggacuuaaugugccacgcaaccuuuacaaugcguuuacuaaguccugucaggguccccaauuauaauaugauuauaauggacgaagcucauuuuacagauccggcaagcauagcggcuaggggauauauuaguacacgaguagguaugggugaagcagcagcaauauuuaugacugccacuccgccaggaagcgucgaggcguuuccucaaucgaaugcaguaauacaggacgaagaaagggauauuccugaaagaucuuggaacagcggauacgacuggauuacagacuuuccaggcaagacaguaugguucguuccuucaauaaaguccgguaacgauauagcgaauugucucaggaaaaaugggaaacgagugauacaauuaucacgaaagacauuugacacagaauaucagaaaacgaaaaauaaugacugggacuacgugguuacaacagacauaucugaaaugggcgcaaauuuucgagcggaucggguuauagacccgagaagauguuugaaaccggugauuuuaaaagauggaccagaacgaguaauuuuagcagguccuaugccgguaacggcagcaucggcggcacaacggcgcggaagaaucggucgcaaccaaaauaaagaaggagaccaauacguauacaugggacagccguuaaacaaugaugaagaccaugcucauuggacggaagcaaaaauguuauuagauaauauaaacaccccggaagguauaauaccggcucucuucgaacccgaacgcgagaaaucagcugcgauugauggagaauauagacucagaggugaagcuaggaagacauuuguugaguuaaugcguaggggugaucugccggucuggcuaucguacaaaguagccucugaaggauuucaauacucagaccggagaugguguuuugacggggaacguaauaaucaggugcuggaagaaaacauggacguggaaauauggacuaaagaaggcgaaagaaagaaguuacgcccuagauggcuugaugcaaggacauacagcgauccuuuagcuuugagagaauuuaaagaauuugcagcgggcaggcguagcguaaguggagaucuaauacuagagauugguaagcugccccagcacuuaacucuacgugcccaaaaugcucuugacaaccuuguaauguuacauaauagugaacaaggaggaaaagcauaucggcacgccauggaggagcuuccugauaccauugaaacauugauguuguuaacacucauagcgguauugacaggcggagucacacuauucuucuugucagguaaaggacuagguaagaccucgauaggauuguuauguguaauggcgaguaguguucuauuauggauggcgucuguggaaccacauuggauagcggccaguauuauccuagaauuuuucuugaugguccuguugauuccggagccugauaggcagagaacaccgcaagauaaccaauuggcuuacguagucauaggacuacuuuuuaugaucuugacagucgcagcuaacgagaugggucuuuuagaaacuacuaagaaagauuugggaauaggacauguaguugcugagaaccaccaccaugcaacaaugcuggauauugauuugcacccagcuagcgcauggacacucuacgcuguggccacuacgaucauaacaccgaugaugagacacacgauagaaaauacaacagcaaacauaucguugacagcaauagccaaucaagcggccauauugaugggauuagacaaaggcuggcccauaaguaaaauggauauaggagucccgcuacuagcuuugggcuguuauucacaggugaauccauuaacuuugacggcagcugugcucauguuaguagcucacuacgcuauuaucgggcccggacugcaggcuaaagccacacgagaagcgcagaagagaaccgccgcaggaauaaugaagaauccuacaguggauggaauaguagccauugaucuagauccaguaguuuaugaugcaaaauuugagaaacaacuaggucagaucaugcuauugauacuuugcacaucucaaaucuuacuaaugagaacgacgugggccuuaugugaaagcauuacauuagccaccgggccccugaccacucuaugggagggcagcccaggaaaguuuuggaauacuacaauagcuguaucaauggcuaacauauuucggggcaguuaucuugcaggagcaggacuagcuuuuucacucaugaaaucauuagguggagggagaagagguacgggugcucagggugaaaccuuaggagaaaaauggaaaagacaauuaaaucaacuaaguaaaagcgaguuuaauacuuauaagcgaucagggauaauggagguugacagaagugaagccaaggaagguuugaaaagaggagaaacgacuaaacaugcaguaucaagagguacugcaaaacuaagaugguuuguggagagaaacuugguuaaaccagaagguaagguaauugauuuaggaugcggaagagguggauggucguacuacugcgcaggucugaagaaaguaacagaggugaaagguuauacaaagggcgggccagggcaugaggaaccaauaccgauggcaaccuacggguggaacauagugaaguuacacagugguagggacgucuuuuucaccccaccggaaaaaugugauacacuacuaugugacauaggagagucaaguccgaacccaacuauagaagaaggaagaacacuuagaguauugaaaaugguagaaccauggcuacgugguaaucaauucuguauuaaaauacucaauccguacaugccuucuguaguagagacgcuagagcagaugcaaaggaaacacggggguaugcuaguaagaaauccccugaguagaaauagcacacacgaaauguauuggguuucauguggaaccgguaauaucguauccgcuguaaacaugacaaguaggauguuguuaaauagauuuacaauggcacauagaaaaccaaccuaugaacgugacguagaucugggcgcaggaacaaggcauguagccguagagccggaaaucgcaaaccucgauaucauaggucaacggauugaaaacaucaaaaaugaacacaaaaguacguggcacuacgaugaagauaauccuuacaaaacuugggcauaucacgggucauacgagguaaaaccaaguggcagugcuuccuccaugguaaacggggugguacgacuguugacaaagccuugggacgugauaccuaugguuacacaaauugcaaugacugauaccaccccuuuugggcaacaaagaguauuuaaagaaaagguagacacacguacaccaagaccaaaacguggcacagcacagauaauggaaguuacagcaaaauggcuauggggauuuuuaucuagaaauaagaaacccaggaucugcaccagggaagaguuuacucgaaaaguuaggagcaaugcagcgauaggugcuguauucgucgaugagaaucaauggaacucggcuaaagaagcaguagaagaugagagauucugggaucuaguccacagagagagagaacuacauaaacagggcaaaugugcaacuugcguguauaauaugauggguaagagagaaaagaaauugggagaauuuggaaaagcaaaaggcagucgggcaauuugguauaugugguugggggcucguuuccuugaauuugaagcacuaggauuuaugaaugaggaucauugguuuagccgugaaaacucauuaaguggaguugaaggagaggguuugcacaaauuaggauacauauuaagagauauuucaaagauaccaggagggaacauguacgcggacgauaccgcaggcugggacacacgcaucacugaagaugauuuacagaaugaggccaaaauaacagauauuauggaaccggaacaugcuuuguuagcuacguccaucuuuaaacucacuuaucaaaauaaaguuguaaggguccaaaggccggccaaaagugggaccgucauggaugugauaucaagacgagaccaaagaggaucaggacagguugggacauauggcuugaacacguuuacuaauauggaaguccaguugauucggcagauggaaucggagggcaucuuuaguccuucagaacuugagaacuccaaccuagcagagcgaguucuagacuggcuugagaaacacggcguggaaagguugaaacgaauggcgauaaguggagacgauuguguaguuaaaccaacagaugaucgauucgccacagcacugacagcuuuaaacgacaugggaaagguaagaaaagauauaccccaaugggagcccucuaaaggguggaaugacuggcaacaaguuccuuuuugcagucaucacuuucaccaacuaauaaugaaagaugguagggaaaucguagucccuuguaggaaccaagacgaauuagugggucgggccagaguuagccaaggugccggauggucauuaagagagacagcauguuuaggcaagucauaugcucaaauguggcaacucauguauuuccauagacgugauuuaagauuagcggccaacgcuaucugcagcgcaguuccagucaauugggugccgacauccaggacaacuuggucuauacacgcacaucaccaauggaugaccacugaagauaugcuuuccguauggaacaggguguggaucgaagaaaauccauggauggaagauaagacacauguaaguagcugggaagauguuccauauuuaggcaaacgagaggaucaguggugcgggaguuugauuggccuaacggcacgggcaaccugggcaacuaacauacaaguagcgauaaaucaaguaagaaggcuaauuggaaacgaaaacuaccucgauuacaugaccagcaugaaacgguuuaagaacgaaagcgacccugaaggcgcucuaugguag

SEQ ID NO: 22134 - RNA, 9879 nt, Artificial Sequence
  derived and/or modified CDS sequence (opt6) from DENV-1__KC172829__SS-prME
ucaguuacuaugcuucuaauguugaugccuacagcucucgcauuucacuuaacaacaagaggaggagaaccacauaugauagucucuaaacaagaaagagggaaaucacuucuauuuaaaacuucggccgguguuaauauguguacucuuauugcaauggauuuaggagaacugugugaagauacgaugacauauaaauguccgcgaauuaccgaagcggaaccugaugauguagauugcugguguaaugcaaccgauacauggguuacauauggaacauguagucaaaccggugaacaccggagagauaaaagaucuguggcguuagcuccacaugucggauuaggacuagaaacgcguaccgaaacguggauguccucagaaggagcguggaaacaaauacaaagaguagaaaccugggcucuacgacacccaggguucacagugauagcuuuauuccuugcacaugccauagguacuucaauaacucaaaaaggaauaauauucauacuucuaaugcuaguuaccccaucgauggcaaugagauguguagggauugguaguagagacuuuguagaaggucucuccggagccaccugggucgauguaguacuagaacacggaucaugcguuacuaccauggcaaaagauaagccaacgcuugacauugaacuacuuaaaacagaaguaaccaacccugcaguauuaagaaagcuauguauugaggcgaagaucucaaacacaacaacagauucacgauguccaacccaaggagaggcgacguuagucgaggaacaagacgcaaauuucguaugcagaagaacguucguagauaggggauggggaaauggauguggauuauucgggaagggaucacugaucacaugugcaaaauuuaaaugcguaacuaaacucgaagggaaaaucguucaauaugaaaaucuaaaguacagugugauaguaacgguacacacuggggaucaacaucaaguuggaaaugaaagcacagagcauggcacuacagccacaauuacuccacaagcaccaacuacugaaauucagcuuacggacuauggugcuuuaacccuugauuguaguccaaggaccgggcuugauuucaaugaaaugguccucuuaacaaugaaagagaaaagcuggcuaguacacaagcagugguucuuagaucugccucuuccuuggaccucgggagcuucaacuagccaagaaacauggaauagacaggacuuacucgucacuuucaaaacugcucaugcaaagaaacaggagguuguaguacuuggcagucaagagggagcuaugcacaccgccuuaacaggggcaacggaaauacaaaccucggggacuacaacaauauucgcaggacaccucaaguguagacucaaaauggauaaguugacguugaaggggaugucauacguuauguguacagguacauucaaauuggagaaagagguagcagaaacacagcauggaaccguguuaguacaaauuaaauacgaggguacagacgcaccguguaagauacccuuuucaacacaagacgaaaaaggaguuacacaaaauggucgauuaaucacagcaaauccgauuguaacugacaaagaaaagccaguaaauauugaagcagaaccgccauucggcgaauccuauauaguaauuggggcgggagaaaaagcauugaaacuauccugguuuaaaaaggggagcuccaucggaaaaauguuugaggcaacagcgcggggagcacggagaauggcaauccuuggcgauacagccugggauuuugggucuauagggggaguauuuaccucuguuggaaagcuaguucaucagauauuuggaacagcguauggcgugcuauuuagcgguguuucauggacaaugaagauaggaauagguguauugcuuacgugguuaggacuaaacagccgcaguacgucauuaaguaugaccuguauagccgucgguuuaguaacucuuuauuuaggcguaaugguacaagcagauucggguuguguaguaaacuggaaagggcgcgaauuaaaauguggaagugguauauuuguaacuaaugaaguacacacuuggacagaacaauacaaauuccaagcugacucacccaaacgacuuuccgcagccauagguaaagcgugggaggagggcguaugugggauaagaagcgcaacacgucuggaaaauaucauguggaagcaaauuucaaacgaguugaaucacauccuuuuggaaaaugauaugaaauuuacggucgugguuggcgacgucgcagggauucuagcucaagguaaaaagaugauaaggccacaaccuauggaauauaaauacagcuggaaaagcugggguaaagcaaagauuauaggugcugauguucaaaauacaaccuucaucaucgaugguccuaacacaccggagugucccgacgaccaacgugcguggaauauaugggaaguagaagauuacggauuuggaauauucacuacuaacauuuggcugaggcucagggacagcuacacacaaguuugugaccaucgauuaaugucugcagcaauaaaagauucuaaagcagugcacgcugauaugggcuauuggauagagagcgagaaaaaugaaacauggaaacuagcuagagcaucuuuuauagaaguaaagaccugcaucuggccaaaaagucauacuuuauggaguaauggaguauuagaaucagaaaugauaauuccgaaaaucuacgguggaccaauaucucaacauaauuaucgaccaggcuacuuuacccaaacagcaggcccguggcaucuaggaaaacucgagcuugauuucgaccuaugugaaggcacuacaguagucgucgaugagcacugugggaauagagggccaucacugagaacaacaacaguuaccggaaagauaauucacgaauggugcugccgaucgugcacacuaccaccccuaagauucagaggcgaagacggauguugguauggaauggaaaucaggccaguaaaagaaaaagaagaaaacuuaguaaagucuauggugagugcagggucgggcgaaguugauaguuuuaguuugggacuuuuguguauaucuaucaugauagaagaaguuaugagaaguagauggagccguaaaaugcuaaugacagguacacuugcaguauucuuucuucuaaucauuggacaacuaacuuggaaugaucuuauucgccuaucuauaaugguaggagcaaacgcauccgacaagaugggcaugggcacuacguaucuugcacuaauggccacuuuuaaaaugagacccauguucgcgguaggguuacuuuuucgacggcuaacaagccgagagguauuacuucuuacaaucggauuaagucuaguagccucgguagaguuaccuaacucauuagaagaauuaggugauggauuagcuaugggcauaaugauccuuaaguuguuaacagauuuccagucacaucaguuaugggcaacacuauuaagucucacguuuauaaagaccacuuucagucuacauuacgcauggaagacuauggcaauggucuuaucgaucgucucacuauuuccauuaugccuaaguacuacaucacagaaaacaacuugguugccaguguuacuaggauccuuagguugcaaaccucuuacaauguuucuaaucacagaaaacaaaauaugggggcguaaaaguuggccacuuaacgaggguaucauggcaguaggaauaguaaguauucuauuauccagucuccuaaagaacgauguuccauuagcuggcccucuaauagcaggcggcaugcuaauagccuguuauguaaucuccgguucaucagcugaucuuucguuggaaaaagcagccgaagucucgugggaggaggaagcugaacauucaggcgcaucccauaauaucuuaguagagguacaagacgaugguaccaugaaaauuaaagaugaggagagagacgauaccuuaacaauauuauuaaaagcaacgcuucucgcaguaagcgguguguauccguuguccauaccggcaacacuauucguaugguauuucuggcagaagaagaaacaaagaagcggaguucuaugggauacaccgaguccaccagagguugaacgggcgguacuagaugacggaauuuaucgaauaaugcaaagaggacuacuaggaagaucacaaguaggaguuggaguauuucaagaaaauguauuucacaccauguggcaugugacacgcggagcgguguugauguaccaaggaaaacgacuugaacccucuugggcuuccgucaaaaaggacuuaauaucauacggaggaggauggcgauugcaggguagcuggaauacuggagaagagguucaaguaauugccguugagccagguaagaauccuaaaaauguacaaaccgcuccaggcaccuuuaagacuaccgaaggggaaguaggagcgauagcgcucgauuucaaacccgggacaaguggcucuccaaucguaaacagagaaggcaaaauaguggguuuauacggaaacgguguuguuacaaccagcgggacguacguaucugcuaucgcucaggcaaaagccucccaagaggguccacucccugagaucgaggaugaagucuuuagaaaaagaaacuuaacaauaauggaucugcauccugguucgggcaagaccaggagauacuuaccugcaaucguacgagaagcaaucaaacgaaaacucaggaccuugauuuuagcacccacaagagucguagcgagugaaauggcagaagcucugaaagggaugccaauaagguaucagacuacagcugucaaaucagaacauacuggaaaagagauaguugaucucaugugccaugcaacauucacaaugagacuauuaagcccuguccgaguuccuaacuauaauaugaucaucauggaugaagcacauuuuacagauccaucuagcaucgcagcaagaggcuacauaucgacgcgugugggaaugggggaagcagcugccaucuuuaugacugcaaccccuccaggaucuguggaagcguuuccacaaucgaacgccguaauccaggaugaggaaagggauaucccugaaagguccuggaacucgggauaugaauggaucacggacuuuucaggaaaaacaguuugguuugucccaaguauaaaaucagggaacgauauagcuaauuguuuaaggaaaaaugggaagcgaguuauccaauugagucgcaaaacauucgauacagaauaucaaaagacgaaaaacaacgacugggauuauguagucacaacugacauaagugagaugggagccaauuuccgagcagaucguguaaucgauccgaggcgaugccugaaaccugugauacuuaaggauggaccugaacgugucauuuuggcaggccccaugcccgugacuguggcuagugcagcacaacggcggggccgaauagguaggaaucacaauaaagaaggagaccaguacaucuauaugggacaaccauuaaacaaugacgaagaucaugcgcacuggaccgaagcuaaaaugcuauuggauaauauaaacacucccgaggggauaaucccagcacuguucgaaccggaaagagaaaagagugcugcaauugacggcgaauaucgucuuaggggugaggcccgaaaaacuuucguugagcuaaugaggcgcggugacuugccaguuugguuaucauacaaaguggcaucggaaggauuccaauacagugauagaagauggugcuuugauggugaacggaacaaccaaguacuagaagagaacauggacguagaaaucuggacuaaggaaggagaacguaagaaacuucguccgagguggcuagaugcucggacauacucggauccguuggcucuaagagaauuuaaggaauuugcggcugggagacgaagugucucaggugaccucauauuagagauagggaaauuaccccaacaucuuacacaaagggcucaaaacgcuuuggauaaucuggucaugcuucauaauucggagcaaggaggcagagcguauagacaugcaauggaggaacugccugauacuauagaaacuuugauguuauuggcauuaauagcagucuuaaccggugguguaacauuguucuuuuuaucaggaaggggauuagguaaaacauccauuggguuauugugcguaauggcgucaucugugcuacuauggauggcguccguugaaccacacuggauugcagcauccaucauucuagaguucuucuuaaugguccuacuuauaccagaaccagacaggcaaaggacaccucaggacaaucaguuggcauauguaguaauaggacuauuauucaugauauugacaguugcagcaaaugaaauggggcuucuagaaacaaccaagaaagaucuagggauagggcauguagcagacgagaaucaccaccaugcugcaaugcuagauguagaucugcauccagccagugcauggacgcuuuacgcagucgcaaccacuaucauaacucccaugaugagacauacgauagagaacacuaccgcuaauauaucauuaaccgcuauagccaaccaagcggcaauccugaugggucuggauaagggcuggccuaucucgaagauggacauagguguaccguuauuggcacuaggaugcuacagccagguuaauccccuuacucuaacagccgcgguccuaaugcuaguagcacacuacgcaauaauagggcccggauuacaagcaaaagcaacucgagaggcccagaagcggacggccgccggcauaaugaaaaauccgacaguugacggaauugucgcaauagaccucgaucccguagucuaugaugcuaaguuugaaaagcaauuagggcaaauuauguuacuaauacuauguacgucgcaaauauuauuaaugcgaacaaccugggcacugugcgaaucaauuacuuuagcgacugggccacuaacuacccuaugggaagguuccccuggaaaauuuuggaacacaaccaucgccgucaguauggcgaacauauuuagagggucguaucuugcaggagcaggauuagcauucaguuuaaugaagucuuuagguggaggaagacguggaacuggagcacaaggggagacauugggcgaaaaauggaaacgucaacuaaaucaguuguccaagucggaauuuaauacuuauaaaagaucaggaauuauggaaguagauagaagugaagcgaaagaggguuuaaaacgaggagaaacaacaaaacaugcuguuucgcgagguacggcaaaguuaagaugguuuguugaacgaaacuuagucaaacccgaagggaaaguaauagaccucgguugcgggagaggaggcuggaguuauuauugugcaggauuaaagaaaguuacugaaguuaagggauacacgaaaggagguccgggacaugaggaaccuaucccaauggcaacauauggguggaaucuagugaaauuacauucaggcaaggacguauucuuuauaccaccugaaaagugcgacacucuucugugugauaucggcgaaucaaguccaaaucccacgauagaagaaggaagaacucuccguguauuaaaaaugguggaacccuggcuuagaggaaaucaauuuuguauaaaaauucuaaacccauauaugccaagugucguggaaacauuagaacaaaugcagaggaaacauggugguauguuagugagaaauccacuaagcagaaacagcacucacgaaauguauugggucucauguggcacaggaaacauagugagugcagugaacaugacauccagaauguuauugaauagguuuacgaugguccauaggaaacccacauaugaaagagauguagauuuaggagcuggaacaagacauguagcaguagagccugaaguugccaacuuagacaucauaggucagaggauugagaauauaaagcacgagcacaaaucuacauggcauuaugaugaggacaauccauauaaaaccugggcauaucaugggucuuacgagguaaaaccauccggcagcgccaguucaaugguuaauggagugguaaagcuauuaacgaaaccgugggacguuauuccgaugguaacccagauagcuaugacagauacaacccccuucgggcaacaaagaguuuuuaaagaaaagguagauaccagaacgccuaaggcaaagagaggaacugcccagaucauggaaguaacugcaagguggcuauggggauuuuuaucgcgaaauaagaaaccaaggauauguacuagagaagaauuuacacggaagguaagaucuaaugcagcuauuggagcaguauuuguagaugaaaaccaauggaacagcgcuaaggaagcuguugaagaugaaagguucugggaucuaguucaucgagaacgcgaauuacauaaacaggguaaaugcgcuacaugcguuuacaacaugaugggaaaacgggagaagaaacuuggugaauuuggaaaagcgaaaggaucaagagcuauuugguacaugugguuaggagcuagauuuuuagaguucgaagcccuaggauuuaugaacgaagaccauugguuuagccgagaaaauagcuugucuggaguagagggugaaggguuacauaaauuagguuauauacucagagacauaaguaaaauuccgggugggaacauguacgcugaugauacagccggaugggauacaaggauuacggaagacgauuuacagaaugaggcaaaaauuacagauauuauggaaucagaacacgcccuauuagccaagucaauauuuaaauuaacauaucagaacaaggucguacggguacaacgaccagccaaaaaugguaccguaauggacgugauaucucgaagagaucaacgugguaguggacagguagguacauaugguuuaaauacauucacgaacauggaggcacaauugauucgucaaauggagagugagggaauauuuucucccuccgaacuagaaacuccuaaucucgcagaaagagcauuggauugguuagaaaaacaugggguggagcgguuaaaacgaauggcuauuuccggggacgauuguguuguuaagccaauugacgaucgauuugcuacggcacuuacagcacugaacgauaugggcaaaguuagaaaagauaucccgcaaugggagccaucgaaagguuggaacgacuggcaacagguuccauucuguucacaucauuuccaccaacuuauaaugaaagauggacgugaaauaguaguacccugucgaaaucaagacgaguuaguagguagggcgagggugucacagggcgcaggcuggagccuaagggaaacugcuugccuagggaaaaguuacgcacaaauguggcaacugauguacuuccacaggagagacuuaaggcuagcugcaaaugcuauuuguagugcuguccccguggacuggguaccaacgucgagaaccacauggagcauucacgcacaucaucaauggaugacgacagaagacaugcuuucaguauggaacagaguauggauugaagagaaucccuggauggaagacaaaacacauauaucuuccugggaggacguaccuuacuuaggcaaaagagaggaccaauggugugguucauuaaucgggcucacugcccgagcaacuugggcuacgaauauccaagucgcuaucucucagguaagaaggcuaauaggaaacgagaacuacuuagauuacaugacauccaugaaacgcuuuaaaaaugaaucagacccagagggugcacuaugguga

SEQ ID NO: 22135 - RNA, 9879 nt, Artificial Sequence
  derived and/or modified CDS sequence (opt6) from DENV-1__EU359008__SS-prME
ucggucacgaugcuguuaaugcucaugccuacugcacuggcguuucaucuuacaacuagagguggugaaccacauaugaucguaucaaaacaagaaagagguaaaagucucuuauuuaaaacuuccgcaggaguaaauauguguacccuuauagcaauggacuuaggagaauuaugcgaagacacauuaacauauaaaugcccaagaaucaccgaagcagaaccagacgacguugacuguugguguaacgcaacugauacaugggucacguacgggacauguucacagacuggagagcaucggcgugauaaacgaucgguugcauuagcgccgcauguuggcuuaggccuagagacacgcaccgaaaccuggaugucaagcgaaggggcauggaaacagauucaacggguggaaacaugggcguuacggcauccaggcuucacuguaauagcucuuuuucuagcacaugcuaucgguacaaguauuacucaaaaaggaauuaucuucauacuguuaauguugguaacaccuucuauggcaaugcgcugugugggcauagggaguagagauuucguagaagggcuguccggggccacuugggucgauguaguuuuggaacauggaagcuguguaacaacaauggcuaaggacaaaccuacccuugacauagagcuccuuaaaacugaagugacgaacccagcaguucuaagaaaguuaugcauugaagcuaaaauaucaaacacuacaacagauaguagaugcccaacacagggggaagcaacccucguagaagaacaagacgcgaauuuuguuugcaggagaaccuucguagaccguggaugggggaacggcugcggacuuuuugggaaaggcagucugaucacaugugcgaaauucaaauguguaacaaaauuggaagguaagaucguacaauaugaaaauuuaaaguauucagugaucguaaccgugcacacaggagaucaacaccagguagggaaugaaaguacggaacauggaacuacugcgaccauaacaccacaagcuccgacaacagaaauacaacuuacugauuauggcgcccuaacguuggauuguaguccacggaccggacuggacuucaacgaaaugguccuacuaacaaugaaagagaaaaguuggcuaguucacaaacaaugguuucuagauuuaccacuacccuggaccucgggagcaagcacaacacaagaaacguggaaucgacaagacuuauugguaacauucaaaaccgcacacgcuaaaaagcaagaagucguggugcuggggucacaagaaggagcaaugcauacugcuuuaacaggagcuacggaaauacaaacaaguggaaccaccacaaucuucgcagggcauuuaaaaugcaggcuuaaaauggauaaacucacacuuaaaggcaugucauaugugaugugcaccgggucauucaaacuagagaaagaaguagccgagacucagcacgggacaguauuaguacaaaucaaguaugaaggcacggaugccccaugcaaaauaccguucuuaacgcaagacgaaaaaggaguaacucaaaauggacgucucauaacagcaaauccaaucguuacggauaaagagaaaccaguuaauauagaagccgaacccccauucggugagagcuacauaguaauaggggcuggcgaaaaagcguugaaacucucaugguuuaagaaagguucuuccauaggcaaaauguuugaagcuacugcgagaggugcacggcgaauggcuauucuaggagauaccgcaugggauuucggaagcaucggaggcgucuucacaucaguuggaaaacucguucaucaaaucuuugggacagcauacggaguuuuauucucgggagucucuuggacuaugaagaucggaauuggugcccuccuaaccugguugggauuaaauucucgaucaaccucucuaucgaugacaugcaucgcaguaggucucguaacacuuuacuuaggcguuaugguccaagcagacuccggcuguguuauaaauuggaaaggucgagagcuaaagugcggaagugguaucuucguaaccaaugaaguucauacguggacagaacaguauaaauuucaagcagauaguccaaaacgcuuaagugcagcaaucggaaaagcaugggaagaaggagugugugguauuagaucagcaacacgacuagaaaacauaauguggaaacaaauaucaaaugaauuaaaccacauacuacuagaaaaugacaugaaauuuaccguuguagugggagauguagcgggcauauuagcccaaggcaagaaaaugauucguccccaaccgauggagcauaaguacagcuggaagaguuggggaaaagcuaaaauuauaggcgcagacguccaaaauacgacuuuuaucaucgauggaccaaacacaccggaaugcccagaugaucaaagagcauggaauauaugggaaguugaagauuauggcuucgguaucuuuacuacaaauauauggcucaaacuaagggacucuuauacucaaguaugcgaccacagacuaaugucagccgccaucaaagauucaaaggccguucaugcagauaugggguacuggaucgaaucugaaaagaacgaaacuuggaaauuagcgagggcuagcuuuauagaaguaaaaacuuguaucuggcccaaaagccauacguuguggagcaacgguguauuagaaagugaaaugauuauucccaaaauuuauggcgguccuauaucgcagcauaauuaccgcccaggcuacuuuacacaaacagcaggaccauggcaucuagguaaauuagaacuggauuucgaucucugcgaaggaaccaccgucguuguagaugaacacugcggcaacagagggccuucacugaggacaacaacuguaacuggaaaaauaauacacgaaugguguugucgaucgugcacacuuccaccgcuaagguuuagaggagaagauggauguugguacgguauggaaauuaggccuguaaaagaaaaggaagaaaauuuaguaaaaaguaugguuucagcuggaucuggugaaguugauucauucucucuaggacuccuuuguauaucgauaaugauagaggagguuaugcgaucaagguggucuagaaaaauguuaaugacagguacuuuagcaguauucuuuuuauuaauuaugggacaagucacauggaaugaucuaauaagacuaugcaucaugguaggcgccaaugcgagugaucgaaugggcauggggacaaccuaucuggcuuuaauggcuacuuucaaaaugaggccgauguuugcaguuggacuauuauuucgacgcuugaccuccagagaaguguuauugcuuaccauuggacuaaguuugguagccucgguugaauuaccgaacagucuugaggaacuaggugacggacuugcgaugggaauaaugauacuaaaauugcuaacagauuuucaaucacaucaacucugggccacccuacuuaguuuaacauuuaucaagacaacguuuagucuucauuacgccuggaaaacgauggcuaugguacugucaauagucucauuguucccuuuauguuuaucuacaacaucacaaaagacuacauggcuuccaguauugcuuggaucucuaggaugcaaaccacucacaauguuccuuauugccgaaaauaaaaucuggggacggaaaucuuggccccuaaaugagggcauaauggccguuggaauuguaucaaucuuacuaagcagucuacuuaaaaacgacgucccacuagcugggccauugauagccggugguaugcugauugcuugcuaugucauauccgguaguagugcggaccucagucuggagaaagcagcggaaguaucaugggaagaagaagcagaacacucuggggcaucccacaauauccucguugaaguacaggaugaugggacuaugaagaucaaagaugaagaaagggacgauacacuaaccauauuacuuaaagcuacacuauuagcuguuucgggcguuuauccccucucuauuccggcgacguuauuuguuugguauuuuuggcaaaagaagaaacagcgaucaggaguauuaugggacacaccaaguccaccagagguugaacgcgcagugcucgaugaugguauauaucgaauuaugcagcgaggccuguuaggccgaucgcaaguaggugucggaguguuccaagaaaaugucuuucacacaauguggcacguaacgcgcggagcaguucugauguaccaaggaaaaaggcucgaaccaagcugggcuucgguaaagaaagaccucauaucuuacgguggagguuggagacuucagggcucauggaauaccggagaggaaguucaagugauagcaguagaacccgggaaaaaucccaaaaacguacaaacugcaccagguacauucaaaacaccggaaggggaagugggggcaaucgcauuagauuuuaagccuggcaccaguggaaguccuauaguaaaucgggaagguaaaauaguaggacuuuaugguaauggugugguuacaacuucggguacauacgucagugccauagcgcaagcuaaagcaagccaagaaggcccucuaccugaaauagaagacgaaguauuuagaaaaaggaaccuaacaauuauggaucuccauccaggaucagguaaaaccagacgauauuugcccgcaauuguucgugaagcuauaaaacgaaaauuaaggacacuaauauuagccccuaccaggguaguagcaucagagauggcggaagcguugaaaggaaugccgauaagauaucaaacaacagcuguaaaaucagagcacacaggaaaagagauugucgaucuaaugugucaugcaacuuucaccaugcgacuacuaagucccguacgggucccgaauuauaauaugaucauaauggaugaagcccacuuuacugacccguccagcauugcagcaaggggauauauauccacuagaguaggaaugggagaagcagcugcgauuuuuaugacagcuacuccuccgggaagcguagaagccuuuccucaaaguaaugcugcaauccaggacgaagaacgcgauauuccugagagaaguuggaacagcgguuacgaauggaucacggacuucccuggcaaaacgguaugguuugucccaaguauaaaaagugguaaugauauagcuaacugccuaagaaagaaugggaaaagagucauucaauuaaguaggaagacauuugacacagaguaccagaaaacuaaaaauaacgauugggacuaugucgucacgaccgacaucucagaaaugggcgcuaauuuuagagcagacaggguaauugaucccagaagauguuuaaaaccugugauccugaaagacgggccugaacgcguuaucuuagcuggucccaugccugucacuguagcaucagcagcucagcguagagggcgcauagguagaaaucauaacaaagaaggugaccaguacauuuacaugggacaaccacuuaauaaugacgaagaccaugcccacuggacugaagcgaagauguuauuagauaacaucaacacaccggaagguauuaucccagcguuauuugaacccgagagagagaaaagcgcagcuauagauggugaauauagacuaagaggcgaagcucgcaaaacauucguagaacuaaugagaagaggcgaucuaccaguaugguuaucguacaaaguugcaagcgaagguuuccaauauagugaccggagauggugcuuugauggugaaagaaacaaucaggugcuagaagaaaacauggauguagaaauauggacuaaagaaggagaaaggaagaaauuaaggccaagauggcuagaugcacggacguauagcgauccuuuggcucugcgugaauuuaaagaauuugcugcaggacggcgaucuguaucaggcgaccuuauucuggaaauugguaaacuaccucaacaucuuacucaaagagcgcaaaaugcauuagauaacuuaguuaugcuucacaauucugaacagggaggaagggcauauagacacgcaauggaggaacuaccugauacuauagaaacguuaauguuacuagcguuaauagccguauuaacugguggagugacauuguucuuuuuaucgggaagaggauuaggaaaaacaucuauugguuugcuuugcguaauggcaucgucaguguuacucuggauggcauccguagaaccacacuggaucgcggcauccauuauccuagaguucuuucuaaugguuuuguugauaccagaacccgauaggcaaagaacgccgcaggauaaucagcucgcauauguaguaaucggccugcuguuuaugauccuuacaguagcggcuaacgaaaugggccucuuagagacaacuaagaaagaucugggcauagggcauguugcuguugagaaccaccaucaugcugcaauguuagaugucgacuuacauccagcgucggcauggacucucuaugcagucgcaacaacaauaauaacgccuaugaugcgacacacaauugaaaauaccacggcaaacauaagucucacagccauagcaaaucaggcugcaauucuuaugggacuagacaaagguuggccaauaaguaaaauggacauaggugucccauuacuugcauuaggcuguuauagccaggugaacccuuugacuuugacggcugcaguccugauguuaguggcucauuaugccauuaucgguccgggauuacaagcaaaagcgacuagagaagcccagaaaaggacagcagccggaaucaugaagaaccccacaguggacggaauuguagcgauagacuuagauccgguugucuacgaugcaaaauucgaaaaacagcuuggucaaauaauguuauuaauacuauguacuagccaaaucuuguugaugcgaacgacgugggcauuaugugaaucgauuacacuugccacuggaccucuaaccacgcucugggagggaucaccuggaaaguucuggaacaccaccauagcagugucaauggcgaauauuuuuaggggauccuauuuagccggugcaggucuugcauucucacuuaugaaaaguuuaggaggcgguagaaggggcacuggugcgcaaggagaaacccugggcgaaaaguggaaacgacagcuaaaucagcuuucuaaaagcgaauuuaauacuuauaagaggucaggaauuauggaaguugaucgaucugaagcuaaagaaggauuaaaaaggggcgaaacgacgaagcacgccguaagccgugguaccgcgaaauuaagaugguucguggaaaggaaucucguaaaaccggaggguaaaguuauagacuuagguugcggacguggugguuggucauacuauugcgcaggauugaagaaaguaacagaaguuaaaggcuauaccaaagggggucccggucacgaggaaccuaucccuauggccaccuauggcuggaaucuggugaaacuucauagcggaaaagauguauucuucaucccgccagaaaaaugugacacacuacugugugacauaggagaaagcaguccuaaccccacaauugaagaaggacguacacuacguguucuaaaaaugguggagccauggcuaagagggaaccaguuuuguauuaaaauccuaaauccauauaugccaucagucguagaaacauuagaacagaugcagagaaaacaugguggaaugcugguuagaaauccguugaguagaaauagcacccaugaaauguauuggguaucuuguggaacuggaaacaucguuucugccgucaauaugacgagccgaauguuauuaaacagauuuacuauggcacauaggaagccuacguaugaacgagauguggaucuaggagcuggcacuagacacguggcuguugaaccugagguugcuaaucuggauauuauuggacagagaauugaaaacauaaaacaugaacacaaaucuacguggcauuaugacgaggauaaucccuacaaaaccugggcauaucaugguucauacgaaguuaaacccaguggaagugcauccagcaugguuaauggaguagugaaauuacuuacaaaaccaugggacgucauaccaaugguaacacagaucgcaaugacagacaccacaccauuuggacagcaaagaguguucaaagaaaagguagauacucgaacaccgaaagccaaacgggguacggcucagauaauggaggugacugcuagguggcucuggggauuuuugagcagaaacaaaaagccgagaauauguacaagagaagaguucacgcgcaaaguuagaucaaacgccgcaauaggagcgguuuucguugaugaaaaucaauggaacucugcuaaagaagcaguagaagaugaacguuuuugggaccuggugcaucgagaaagagaacuacauaagcagggaaaaugugcuaccuguguauauaauaugaugggcaagagagaaaagaaacucggugaguuugguaaagcuaaaggaucuagggcuaucugguauauguggcuaggugcccgcuuccuagaauuugaagcguuagguuucaugaacgaagaucacugguuuuccagggaaaacucguuaucaggcguagaaggagagggucugcauaaauuaggauauauuuugcgagacaucaguaagauaccgggcggaaauauguacgcagacgacacagcugguugggauacaagaauaacagaagacgaucuucagaaugaggcaaagauuacugacauaauggaaccugaacaugcccuauuagcuaaagcuauauucaaacuaacguaccaaaauaaagucguacgaguccagcguccugccaaaaauggaaccguaauggacgugaucucuaggcgggaucagagggguucaggacaagucggcacauacgggcuuaacacauuuacaaauauggaagcucagcugauaagacagauggaauccgaaggcauauuuucaccaagugaacuagaaacuccgaaucucgcagagcggguauuggacuggcucgaaaaauacggagucgagaggcugaaaaggauggcaaucucgggggaugauuguguaguaaaacccauagacgacagauuugcuacagcccucaccgccuuaaaugauauggggaaaguaagaaaagauaucccucagugggaaccuaguaagggcuggaaugauuggcaacaaguuccauuuugcucacaccauuuucaccaauuaaucaugaaagauggaagagaaauagucgugccuuguagaaaucaagacgaacuuguaggaagggcuagaguuucucaaggugcuggauggucacuacgagaaacugcguguuuagguaaaaguuaugcacagauguggcaguugauguauuuccaucgcagggaucuacgacuagcagcaaaugcuauuuguucugcgguaccaguugauuggguucccaccucccgaacgacauggaguauacacgcacaucaucaauggaugacuacugaagacaugcuaucgguauggaaucgaguauggauagaggaaaauccauggauggaggauaaaacucacauaucauccugggaggacguaccauaucuggguaaacgggaagaccaauggugugggucacuaaucggguugacagcgagagcaacuugggcuacuaauauacaaguugccaucaaucaaguaagacgacucauaggcaacgaaaacuacuuagacuauaugacaaguaugaagagauucaagaaugagucggauccugaaggagcauuaugguaa

SEQ ID NO: 22136 - RNA, 9879 nt, Artificial Sequence
  derived and/or modified CDS sequence (opt6) from DENV-1__AY835999__SS-prME
ucuguaaccaugcuucuaauguuaaugccaacagcguuagccuuucaccugacuacgcggggaggagaaccucauaugauuguaucaaaacaagaaagagguaaaucauuacuuuucaaaacgagugcaggaguuaauaugugcacccuaauagcaauggaccuuggggaacucugugaagacacgaugacguacaaaugcccucgaaucacggaagcugaacccgaugauguugacuguugguguaacgcaacggauacguggguaacauaugguacauguucucaaacuggugaacaucgaagagauaaaaggaguguggcgcucgccccacacguugggcucggucuagaaacaaggacugaaacauggaugagcagugaaggagccuggaaacagauacaaagaguagaaacgugggcauuaagacauccgggauucacgguaauagcauuauuucuagcacacgcgauagguacaaguauaacucaaaaaggaauaaucuucauuuuacugaugcuaguaaccccauccauggcuaugagaugcgucgggauaggaucacgagauuucguagaaggauuaucgggugcuacauggguugaugugguacuagaacauggaagcugcguuacaacuauggcaaaagacaaaccgacacuugacaucgaacuccuaaagacagaagucacuaaccccgcuguguuaagaaaauuauguauugaagcuaaaauaagcaacacaacgacugauucuagaugcccgacucaaggagaagcaacccuaguugaagaacaggaugcuaauuucguaugcaggagaaccuucguugacagaggaugggguaaugguugcggacucuuugguaaaggaucauuacucacuugcgcaaaguuuaaauguguaacgaaauuggaagggaagauaguccaauaugagaaccuuaaauauaguguaauaguuaccguacacacgggagaucagcaccaagugggaaaugagaguacagaacacggaacaacagcaaccauaacgccacaagcacccacaaccgaaauccaacuaacagacuacggagccuuaacgcuagacugcaguccacgcacuggacucgauuucaaugaaaugguauuauuaacuaugaaagagaaaaguugguuaguucacaaacaaugguuuuuagacuuaccacuuccauggacaaguggagcauccacaucucaagaaacauggaauagacaagaucuguuaguaacauuuaaaacagcccacgcuaagaaacaggagguuguaguauuggguagccaggaaggugcaaugcacacggcacuaacuggagcaacagaaauccaaacuucagguaccacaacuauauuugcaggucaccuaaaauguagacuaaaaauggauaaauuaacauuaaaagguaugaguuauguaauguguacgggaucuuuuaaauuagaaaaagaaguugcagaaacacagcaugggacaguucugguacaaauaaaguaugaaggaacggaugcaccaugcaaaaucccauuuuuaacacaagaugagaaaggugugacacaaaauggacgucuuauaacggccaaucccauagucacagauaaggagaaaccaguaaauaucgaggcugagccaccauucggagagucuuauauugugauaggugcuggugaaaaagcucuuaaguuaaguugguuuaaaaagggcaguaguauugggaaaauguuugaagccacagcaagaggggcgcgcagaauggcaauuuuaggagacacagccugggauuuuggcaguguaggugggguauucacaucggugggcaagcuaguacaucaaauauucgggacugccuauggaguucuauucagcggcgugucauggacuaugaaauuaggaauagguguguuacugacgugguuaggauugaacucuagguccacuagccucaguaugacuugcauugcuguaggucuagucacuuuauaccuuggaguaaugguucaggccgacagcgguuguguaaucaauuggaaagggagagaauuaaaaugcgggagcgguauauucguaaccaaugaaguacauaccuggacugaacaguauaaguuucaagcagacagccccaagaggcugucagcugcuauagguaaagccugggaagaaggagucugcgguaucagauccgcgacgagacuagaaaauauaauguggaaacaaaucaguaacgaacucaaucacauuuugcuagagaaugauaugaaguuuaccgucguaguuggagacguagcaggaaucuugguacagggcaagaaaaugaucaggccucagccaauggaauacaaauauucauggaaaagcuggggaaaagcaaagauaauuggcgcagacguacagaauaguaccuucauuauagacgggccaaauacaccggaauguccagaugaucaaagagcguggaacauuugggagguugaagacuacgguuucggaauauucacuaccaauauaugguuaaaacuucgggacucauauacccaaguuugugaccaccgauuaauguccgcggcgauaaaagauucaaaggccguccacgccgauaugggcuauuggauagaaucugagaaaaaugaaaccuggaagcuagccagagcaucauuuaucgaaguaaaaacgugcauuuggccgaaaucccacacccuauggucgaacgggguucuagaaagcgaaaugauaaucccgaaaauuuauggagggccgauaucccagcacaauuacaggccaggauauuuuacccaaacugccggucccuggcacuuagggaagcuagagcuagauuucgacuuaugugaagggacaaccgugguaguugaugaacauugcggcaaucguggaccaucucuaagaacgacuacaguaacugguaagauaauacacgaauggugcugcagaaguuguacucuuccaccccucagauucaggggcgaaaauggaugcugguaugguauggagaucaggccggucaaagaaaaagaagaaaaucuuguaaaaaguaugguaucggcgggaagcggcgagguggacucauuuucgcugggacuacuguguaucuccauaaugauagaagaagucaugcgcagcagauggucacguaaaauguuaaugacuggaauauuagccguuuucuuucuacugauaaugggacaguugaccuggaacgaccugauucguuuaugcaucaugguuggugcuaaugcaucggacagaaugggaauggggacuaccuaucuagcucugauggccacauuuaaaaugagaccgauguucgcgguaggacuucuguuucguaggcuaacaucccgagaaguacuauuauuaaccauaggguugaguuugguagcgucuguagaguuaccuaauagucuggaggaacuaggugacggccuagccaugggaaucaugauuuugaaacugcuuacagauuuucaaucgcaccaacuuugggcaacauuauuauccuugacuuucauuaagaccacauucucucuacauuacgcauggaagacuauggcaauggugcuaagcauaguaagucuuuuuccguuaugccuaaguacuacaucacagaaaaccacaugguuacccguauuauuagguagcuuagguuguaagccacuaacaauguuuuuaauugcugaaaacaaaauauggggaaggaagucguggccuuuaaaugaaggcauaauggcggucggaauaguuaguauuuuguuaagcucuuuacugaaaaacgacguaccgcuagcgggacccuugauugcgggaggaauguugauugcauguuauguuauuucggguucaucagcagaucuaagccucgagaaagcggccgaagugagcugggaggaggaagcagaacauaguggcgccucacauaacauccuaguagaaguccaagaugauggaacuaugaagauuaaagaugaagaaagggaugauacucucaccauacuguuaaaagcaacucuguuggcgguaagugguguauacccacuaucgauucccgcaacucuuuucguaugguacuucuggcaaaagaagaaacaaagauccggaguuuuaugggauacuccgaguccaccugaaguagaaagagcuguauuggaugacgguauauaccgcauaaugcaaagaggauuauuaggacgaagccaagucgggguaggcguauuccaagagaaugucuuucacacaauguggcauguaacacguggugcaguccuaauguaccaagggaagcgauuagaaccgucaugggccucagucaagaaagauuuaaucaguuauggcggugguuggagauuacaaggauccuggaauaccggagaagaagugcaagugauagcaguugaacccgggaaaaaucccaaaaauguccaaacagcacccggaaccuucaaaacgccagagggugaggugggagcaauagccuuagauuucaagccagguacaagcggcucacccauugugaaccgagaaggcaaaaucguagguuuauauggaaauggaguaguaacaacaucggguaccuacgugucggcuauugcucagacaaaagcgucgcaagaaggaccacuacccgaaauugaagacgaggucuuuagaaaacggaauuuaacgauuauggauuugcacccaggaucggguaaaacgagaagauacuuaccagcuauaguaagggaggcaauuaagaggaaacuacguacgcuuauacuugccccaacaagggugguggccucugaaauggcggaagcccucaagggcaugccuauacguuaccagaccaccgcagugaaguccgagcacaccgggaaagaaauuguagaucugaugugucacgcaacauucacuaugagauuacuuucaccuguacgaguaccuaacuacaacaugauaauaauggaugaagcacauuuuaccgauccaucaucuauagcagcacgaggcuacauaaguacacguguggggaugggagaagcugccgcaauauucaugacugcaacuccaccaggaucuauggaggcguucccucaaucgaaugcuguaauucaggacgaagaaagggauauaccagaacgaucguggaauaguggcuacgaauggauaacagauuuuccagguaaaacgguaugguucguacccucuaucaaggcgggaaacgauauagcgaacugucuaaggaaaaacggaaaaagaguaauacaacuuagcagaaaaaccuucgauacugaauaucagaaaacuaagaauaacgauugggacuauguagucacaacagauaucucagaaaugggugcaaacuuucgugcagacaggguaauugauccccguaggugcuuaaaaccagucauucucaaggacggaccggaaagggugauacuagcuggcccaaugccagucacugucgcgucagcagcccaacgucgaggcagaaucgggaggaaucauaauaaagagggagaucaauauaucuauaugggacaaccacuaaacaacgaugaggaucacgcacauuggacagaagcaaaaaugcuauuggauaauauaaacacaccugaaggcauuauuccugcucuuuuugagccugagcgugaaaaaucggcagcaauagauggugaguaccgucuaagaggggaagcacgaaaaacauuuguagaguuaaugcgcagaggugaccuuccaguuugguugucguauaaaguugcaucagaggguuuucaauacagugaucgucgauggugcuuugacggugagcguaauaaucaaguacuagaggaaaacauggacguugaaauauggacuaaagaaggagagaggaagaaacucagaccuagauggcuagaugccagaacauacagcgauccgcuagcacuuagagaguucaaagaguucgccgccggacgaaggucaguauccggggaucugaucuuggaaauaggaaaguugccucaacaucuuacacagagagcacagaaugcacuggacaaucuaguuaugcuacauaacucagagcaaggaggcagggccuauagacacgccauggaagaauuaccagacaccaucgaaacuuuaauguuacuagcacucauugccguacuaacaggaggggugacucuauucuuucugagcgggaaaggguuagguaaaacgucaauaggauuacugugugucauggcguccuccguacuucuauggauggcgucagucgaaccccauuggauugcugcaaguauaauuuuagaguucuuuuuaaugguuuugcugauaccagaaccagauagacagcgaacaccacaagacaaucaauuggcuuauguaguaauuggucuuuuauuuaugauacuaacuguugccgcuaaugagaugggucugcuagaaacaacuaagaaagaucuugguauaggucaugucgcaguggaaaaucaucaccaugcagcuaugcuugauguugaucuacauccagcaagugcauggaccuuauacgccguggcaacuacuauaauuacaccuaugaugaggcacacaauugagaacacuacagcuaacaucucauuaacagcuauagccaaccaagcugcuauuuuaauggggcuggauaaaggcuggccaauaucaaaaauggauauugguguaccuuuguuagcucuugguuguuauagucaaguuaauccauuaacucuaacggcugcacuucuaauguuaguggcucacuaugccauuauuggacccggauuacaagccaaagcaacgcgugaagcacaaaagcgaacagcagcaggaaucaugaaaaacccaacaauagaugggauuguagcgauagaccuagauccggucguuuaugacgccaaauuugagaagcaguuaggucagaucauguuacuaauccuguguacuucucaaauuuuguuaaugcggacaacaugggcauuaugcgaaucaauuacccuagccaccgguccguuaacuacauuaugggaaggaucuccuggcaaguucuggaacacgacaauagccguaucaauggcuaauaucuuucgaggguccuacuuagcaggggccggcuuggcguucucguuaaugaaaagccucgguggcggacggcgggguacaggggcucaaggcgaaacauuaggagagaaguggaagaggcaguuaaaucaauuaucuaaguccgaguuuaacaccuacaaaaggagcggcauaauggagguagauaggucugaggcaaaagaaggacuuaaaaggggugaaacgacuaaacacgccguaucaagagguacggcaaaacuucguugguucguggaacguaaucuggugaagcccgaaggcaaaguuaucgaccugggaugugguagagguggcuggagcuauuacugugcgggacuuaaaaagguuacagaagugaaagguuauacaaaaggagggcccggucaugaagaaccgauaccgauggccacauauggguggaaucuugucaaauuacacagcggaaaagaugucuuuuucaucccaccagaaaaaugugauacauuacuaugugacaucggugagaguucaccgaauccaaccauugaagagggacgaacauuaagaguuuuaaaaaugguagaaccauggcugcgagguaaucaauucugcauuaaaauccuuaauccauauaugcccucagugguugaaacucuugaacaaaugcaaaggaaacaugggggaauguuaguccguaauccacucucaagaaacagcacacaugaaauguauuggguguccuguggcacaggaaauauaguuagugccguuaauaugacaagcaggaugcuuuugaaucgguucacuauggcgcauagaaaaccaacuuaugaacgugauguagaccuaggagcugguaccagacauguggcugucgaaccagaagucgcuaaccucgauauuauuggacaacgcauagagaauauaaaacacgaacauaaaucaacauggcauuaugacgaagauaauccuuauaaaacaugggcauaccaugggagcuacgaaguuaaaccauccggcucagcuaguucaaugguaaauggagugguaaaacuauuaacuaaaccuugggauguuauaccaaugguuacccaaauagccaugacggacacaaccccguuuggacagcaaagaguuuuuaaggagaaaguagacacgcgaaccccgaaagcuaaaagaggcacagcacaaauaauggaaguaacggcgcgauggcuauggggauuucuuucucggaauaagaagcccaggauaugcacuagagaggaguucacacgaaaaguaagaagcaaugcugcgauuggugcaguuuuuguugaugaaaaccaguggaauagcgcgaaagaagcaguugaagaugauagauuuugggaccugguucaucgggagagagaauuacauaagcaaggaaaaugcgcgaccugcguauauaauaugaugggaaaacgugagaagaaacugggugaguucggcaaagcgaaagguucacgugcaauaugguauaugugguugggggcgagguuucucgaguucgaagccuuaggguucaugaacgaagaucauugguuuaguagagaaaauucacucucaggaguugaaggagaaggauuacauaagcucggauacauucuacgugauauaucaaaaaucccgggagguaauauguaugcugaugauacugcagggugggauacucgaauuaccgaagaugacuuacagaaugaagcaaaaauaacggauauaauggaaccggaacacgcacaacucgcaaagaguauauuuaaauuaacuuaccaaaacaaaguuguaaggguacaaagacccgcuaaaaaugggacugucauggacguaauaucuaggagagaccaaaggggcucgggccaaguagguacauacggacugaacacauuuacgaacauggaagcacaacuuauacgacagauggaaucagaaggaauauuuaguccaaaugaauuagaaacuccuaauuuagcugaaaggguacuagacugguuagaaaaauauggaguugaaagguuaaaaaggauggcuaucuccggugacgauugcguaguaaaaccuauugacgacagauucgcuacagcuuugacugcacuuaacgacaugggcaaagucagaaaggacauaccacaaugggagccaaguaaaggcuggaacgacuggcaacaaguaccauucuguucucaucauuuucaucaacuuauaaugaaagaugguagagaaauagucguuccuugcaggaaccaagacgaacucguaggccgugcaagagugagccagggagccggcuggucccuaagagagaccgcguguuuagguaaaaguuaugcucaaauguggcaauuaauguauuuccaccgacgagauuuacguuuagcggcaaaugcuauauguucugccgugccuguugauugggugccuacaaguaggacaacuuggucgauacacgcccaucaucaguggaugaccaccgaagacaugcucuccguuuggaaccggguuuggauugaggaaaauccauggauggaagauaaaacgcguauuucaaguugggaggaugugcccuaccuaggaaagagggaagaucaguggugugguaguuugauaggucuuacugcacgggcuacgugggcuacaaauauucagguagcuauaaaccaagugagacguuuaauaggaaaugaaaauuauagcgacuauaugacguccaugaaacgauucaaaaaugaaagugaaccggaaggugcucuaugguaa

SEQ ID NO: 22137 - RNA, 9879 nt, Artificial Sequence
  derived and/or modified CDS sequence (opt6) from DENV-1__KP686070__SS-prME
ucaguaacgaugcuacuaauguuauuaccaacugcacuugcauuucaucuaacuacaagaggaggagaaccacacaugauuguaucaaaacaagaaaggggaaaaucgcuccuguuuaaaacaagugcuggaguaaauauguguacacuuauagcaauggaucuaggcgaacuuugugaggacaccaugacauacaaauguccccggauaacagaagcugaaccagacgauguagacugcugguguaaugcgacagauacaugggugacauauggaacguguagucaaacuggugaacaccgaagagauaaaaggucuguugcauuggcgccgcauguuggacugggucuagaaacaaggacagaaacauggaugucaucagaaggggcuuggaggcaaauucagaaaguggaaacuugggcacuccgacacccaggcuucacgguaauagcauuguuuuuagcacacgcgauugguacgaguauuacacaaaaaggcaucauuuuuauacuuuuaauguugguaacuccuucaauggccaugcgauguguugggaucgggaauagagauuucguugaaggccugucgggggcuacauggguagauguaguguuagaacacggaaguugcgugacgacuauggccaaaaauaaaccaacucuugacauagagcuuuuaaaaacagaagucaccaaucccgcuguguuaaggaaauuauguauagaagcaaaaauaaguaauacgacaaccgacucaagaugcccgacccaaggugaggcuacccucguagaggaacaagaugcaaauuuugucugucggcguaccuucguagaucgaggaugggguaauggcugugguuuauuuggaaaagggaguuuauuaacaugugccaaauuuaaaugcgugacuaaauuagaaggcaaaauaguucaauaugaaaaucuaaaauauucagugauaguaacuguucacacgggugaccaacaucaaguggguaacgaaacaacugaacauggaacaauugcuacuauuacaccucaagcuccaacaagcgaaauacaauuaaccgauuauggggcacuaacauuagauugcaguccccguacuggauuagacuuuaaugagaugguccuacuuacuaugaaagagaaaucguggcuaguccacaaacaaugguuuuuagaucuaccacucccauggacgagcggggccaguacaucucaggagacguggaauagacaggaucuccuuguaaccuuuaaaacagcccaugccaagaaacaagaaguaguaguccuuggaucacaggaaggggcuaugcauacagcuuuaaccggagcuaccgaaauacaaaccuccgguaccacuacaaucuuugcuggacaucugaaauguaggcuuaaaauggacaaauuaacucugaaagggguaaguuauguuaugugcaccgguuccuucaaacuugaaaaagagguggcugaaacacagcauggaaccguuuugguacaaguaaaauacgaaggcacggacgcgccuugcaaaauacccauaagcacacaggacgagaaaggugugacucagaauggucgauugauuacagcaaauccaaucguaacugacaaagaaaagccaguuaauauagagacagaaccgcccuuuggagaaucuuacauaguaauaggagcaggagaaaaggcuuugaaauuaagcugguuuaagaagggaucaucaauaggcaagauguucgaagcaacugcaagaggggcucgacguauggccauucuaggagacacggcaugggacuucggcaguaucggagguguauucacaucagucggaaaguuaguccaucagguuuucgguacugccuauggcguucuauucuccggcgucucauggaccaugaaaauagguaucgguauacuguuaacgugguugggauuaaauucacguucaacaaguuugucaaugacuugcauagcagucgggaugguaacuuuauaccuaggaguaaugguacaagcugauucaggcugcguaauuaauuggaaaggucgggaacugaaauguggcaguggcaucuuuguaacaaaugaaguacacacguggacagaacaguacaaguuccaggcugauucgccgaaaagacuaagcgcagcuauagguaaggcaugggaagaaggcguaugugggauaagaucagccacaagauuggaaaacauaauguggaaacaaauaucaaaugaauuaaaucacauauuauuagagaacgauaugaaauuuacaguaguaguuggagaugcuaauggaauacuaacucaggggaagaaaaugaucagaccccaacccauggaacacaaauacagcuggaaaucauggggaaaagcuaagauaauaggggcugacacacaaaacaccaccuuuauaauagacgggccugacacgccagagugcccggaugaucaaagagccuggaacauaugggaggucgaagacuauggcuuuggcguauucacgacuaauaucugguugaagcuccgagauaguuacacacaaaugugcgaucacagacucaugucugcggcaaucaaagauuccaaagccgugcaugcagauaugggauauuggauagaaucugagaaaaaugaaaccuggaaacuggcgagggccagcuuuauagaaguuaaaacaugcauauggccaaggucacacacacuuuggucuaacggaguacuugaauccgagaugauaauccccaaaauauacggagggccgaucucccaacacaacuacagaccugguuauuuuacgcaaaccgcuggacccuggcauuuaggaaagcuggaauuagauuuuaauuuaugcgagggaaccaccguaguaguugacgaacauuguggcaaucgcggucccagucuacgaacgacuacaguaacagggaagauuauucaugaauggugcuguagaaguuguacucuuccuccuuuaagauucagaggagaagauggguguugguacggaauggaaauaagaccagucaaggaaaaggaggaaaaccuaguucgaagcauggucucagcugggucgggggaaguggauucauuuaguuuaggauugcuuugcguaagcauuaugauagaagaaguuaugcggagccgauggucucgaaagauguuaaugacaggaacuuuagcugucuucuuuuuauuaaucaugggccaauuaacguggaaugaucugauccgccuaugcaucauggucggagcgaacguuuccgauagaauggguauggggacgacauaccuagcucuaauggcuacguucaaaaugagaccuauguuugcaguaggauugcuuuuuagacggcuaacgucgcgugagguucuuuuguugacaaucggauuaagucuaguagcuuccguagagcugcccaacucauuagaagaacuaggagauggauuagcgauggguauaaugaugcuuaaguuacuuacagauuuccaaucccaucaauuguggacaacauugcugucccuuacauuuauuaaaacaacguuaucacuugauuacgcguggaaaacuauggcaaugguucuaucuaucgucagcuuauuuccuuuaugccucucuacgacuagccaaaagacuacaugguuaccagugcuacuuggaucuuuuggauguaaaccacuaacgauguuuuuaauuacugaaaacaaaauauggggucgaaaaucauggcccuugaacgaaggaauuauggcuguaggaauaguaagcauacuucuaucaucuuuacuaaagaaugacguucccuuagcuggaccauugauugcaggcggaaugcuaaucgcuuguuauguaauaucggggucgagugcugaucucagcuuggagagagcagcagaaguaagcugggaagaagaggcugaacauucuggagcuagucacaacauucuagucgaaguucaagaugauggaacaaugaaaaucaaagacgaggagagagacgacacacuuaccauccuguuaaaagcaacacuauuagcaguuagcggaguguacccaaugucaauaccagcaacuuuguuugucugguacuuuuggcagaaaaagaaacaacgauccggaguauugugggacacacccagcccuccagaaguugaacgcgcaguacucgaugacggaauuuaccgcauuuuacaacgcggcuuauuaggacguagucagguuggaguuggagucuuccaagacgguguguuucauacuauguggcauguaacgagaggagcuguguuaauguaccaaggaaaaagacuagaaccaagcugggcgucugucaagaaagaucucauaucauacggaggcggauggagguuucaaggcucguggaauacaggugaagagguacaaguaaucgcuguggaaccaggcaaaaauccuaaaaauguucagacuacaccgggaacguuuaaaacacccgaaggagagguaggagcaauugcucuagauuuuaaaccuggaacaucagguucuccgauuguuaaucgagaagguaaaauuguugguuuguauggcaacgguguaguaaccacuucugggacguauguauccgcuauugcgcaagcaaaagcaucacaagaaggaccucuuccagaaauugaggaugaaguauucaagaaaagaaaccuaacaauaauggauuuacaucccgggucagguaaaacucgaagguaccuaccugcaauaguaagagaagcgauaaaaagaaaacugagaacccuaauucuagcaccaacacgggugguugcgucagaaauggcagaagcgcuaaaagggaugccaauuagauaucaaaccaccgcggucaaaagugaacacacgggcaaagaaauagucgaucucaugugucacgcaacuuucacuaugcguuuacuuucaccaguacggguuccgaauuauaauaugauaauuauggaugaagcacauuucaccgaucccgcaucaauugcggcucgagguuauauaucaacaagaguggguaugggagaggcggcagcaauuuucaugaccgcaacaccaccaggaaguguagaggcuuucccccagagcaaugcaguuauacaggaugaagaaagagauauaccggaacgcucauggaacuccggcuaugauuggauuacugacuuccccggaaagacaguaugguuuguaccaucgauuaaaucaggaaacgacauugcaaauugucuuaggaaaaauggcaagcgcguaauccaacuuuccagaaaaacuuuugacaccgaguaccagaaaaccaaaaauaacgauugggauuaugugguaacaacagacaucagcgaaaugggagcuaacuuuagagcugaucgaguaaucgaccccagacguuguuuaaaaccaguaauacucaaggaugggccagaacggguuauauuagcugggccuaugccaguuacggcugcaucagcugcacaacgccggggaaggauaggacguaaccaaaauaaagaaggagaucaguauauuuauaugggccagcccuugaauaaugacgaagaccaugcacauuggaccgaagccaaaauguuguuggauaauauuaauacuccagaagguauuauuccggcacuguucgaaccggagcgagaaaagagugcagcgaucgauggagaauauagauuacgcggagaagcaagaaaaacauuugucgaacucaugcgaagaggugaccuccccguaugguuaaguuauaagguagccucggagggcuuccaguauucagaucgaagaugguguuuugauggagagcguaacaaccaaguccucgaagaaaacauggauguagaaauauggaccaaagaaggcgaacguaagaaauuacgaccaagauggcuugaugcccgaacguacucagacccacuugcccuaagagaauuuaaagaguucgcagcugggcgaagaucaguuucaggugaucuaauuuuagaaaucggcaagcucccacaacaccuaacauugagagcgcaaaaugccuuagauaaccuaguuauguuacacaacagugagcagggaggaaaggccuauaggcacgcuauggaagaacuaccugauacaauugagacccuuaugcuauuagcauuaauugcuguauuaacaggagguguaacucucuucuuccuuucuggaaaaggccuugguaaaacuuccaucggacuucuuugcguaauggcuaguuccguauuguuauggauggcaaguguugaaccucacuggauugccgcaagcauaauauuagaguucuuuuugaugguauuacuuauaccugaaccagacagacaaaggacaccucaagauaaccaauuagccuaugucguaaucggauuguuauuuaugauacucacgguugcagcaaacgagauggguuugcuggagacaacuaagaaagaucucgggauuggucaugucguugcugaaaaucaccaucaugcaacaauguuggauaucgauuuacauccagcuuccgcguggacucucuaugcuguggcaacuacgauaauaacacccaugaugagacacacgauagagaauacaacagcaaacauaucucugacggcgauagccaaucaagcggcaauacuaaugggcuuggauaagggcuggccaauaagcaaaauggauauuggagucccguuauuagcucuugggugcuauucucaaguaaacccuuugacacuuacagcagcaguuucaaugcuuguugcgcauuaugcaauaauuggucccggauuacaagccaaggccacuagagaagcacagaagagaacggcugcaggcaucaugaaaaauccgacagucgacggaauuguugcaauagaucuagauccagucguauacgaugccaaauucgaaaagcaauugggucaaauaauguugcuaauuuuaugcacaucacaaauauugcuuaugagaacuacuugggcauugugugagucuauuacccuggcaacaggcccuuuaacuacauuaugggaaggguccccaggaaaauuuuggaauacaacuaucgcaguaucaauggccaauauauuuagagguucuuaucucgccggggcuggauuagcauuuucucucaugaagucauuaggagguggcaggagggggacgggagcucaaggcgaaacacugggagagaaauggaaacgacaauugaaccaguuaucaaaaucugaauuuaauacauauaaaagaaguggcaucauggaaguggacaggucagaggcuaaagaaggcuugaaaagaggagaaacaacaaaacacgcaguaaguagggggacagcgaaguugagaugguucguggaacgaaaucuugugaaaccagaagguaaaguaauagauuuagguugcggccggggugguuggucguauuauugugcgggacuaaagaaagucaccgaaguaaaaggcuacacaaagggaggaccgggacaugaagaaccgauaccaauggcaacuuacggauggaacauuguaaaguuacauucaggacgugauguauucuuuacaccuccagagaaaugcgacacccuacuuugugauauaggggaaucgucaccaaauccaacaauugaggaggggcgcacccucaggguuuuaaaaaugguagagccauggcuacgaggcaaccaauucugcauaaagauccugaaucccuauaugccuucugucguagagaccuuagaacagaugcaacgaaaacacggaggaaugcuugugagaaauccauuaucccgaaauaguacucaugagauguacuggguaucaugcggaacagggaauauaguuucagccguuaauaugacaaguaggaugcuacucaaucgauucaccauggcccauaggaaaccaacuuaugaacgagacguagaucucggugccggaacaagacacguugcaguugagccagaaauugcuaauuuagacauaauaggucaaagaauagaaaauauuaagaacgaacacaagaguacauggcauuacgaugaagauaauccuuauaaaaccugggcguaucauggaaguuaugaagucaaacccucuggaagcgcgagcucuauggugaaugggguagugcgguuauuaaccaaaccaugggacguaauuccgaugguaacucaaauugcuaugacggacacuacuccguucggucaacagcgugucuucaaagaaaaaguugacacaagaacaccaaggccuaagagagguacugcacaaaucauggagguaacagcaaaauggcucuggggauucuuaucgcgaaacaaaaagcccaggauauguacacgcgaagaguucacaagaaaaguaagaucuaaugcagccauaggugcaguauucguagacgagaaucaguggaacucugcaaaagaagcuguagaagaugaacgauuuugggaucuaguucauagggaaagagaacuacauaaacagggaaaaugugcuacauguguauauaacaugauggguaaacgugagaagaaacuaggggaauuugguaaagccaaaggaucacgagcuaucugguauauguggcuaggggcacgauuccuagaauuugaagcacuaggauuuaugaaugaagaccauugguuuucucgagaaaauucucuaagcggaguagaaggagagggauugcauaaauuggguuacauuuuacgugauaucagcaaaauacccggcgggaauauguaugcugacgauacagcuggaugggauacuagaauuacugaagaugaccuucagaaugaggcuaaaaucaccgacauaauggagcccgagcaugcacuacuggcuacaagcauauuuaaacuuacauaucaaaauaaaguggugagaguccaaaggcccgccaaguccggcacugugauggacgugauaagcagacgagaccaacggggaucagggcaaguggguacguauggacucaauacauuuacaaauauggaggugcaacuaauaagacaaauggagagcgaagguaucuuuucaccuagcgaacuagagaacaguaacuuggcagaaagaguuuuagauuggcuggaaaaacaugguguagagcgauuaaaacgcauggccaucucaggggacgauugcguuguaaaacccacugacgauagauuugccacugcacuaacugcguuaaaugacaugggcaaaguccgaaaagacauaccccaaugggagccaaguaaaggcuggaaugacuggcaacaggugccuuucuguagccaucacuuucaucaacugauaaugaaggacggaagagaaaucguugucccaugcagaaaucaagacgaauuaguaggccgcgcucgcgugucacagggugcuggauggagucuucgggaaacagcuugucucggcaaaucauaugcccaaauguggcaauuaauguauuuucaccgucgugauuugagguuagcagcuaacgcaauuuguucugcugugccaguaaauuggguuccuaccagcaggacaacauggucuauucacgcacaccaccaauggaugacaacggaagacaugcuuaguguguggaacagaguuuggaucgaggagaauccguggauggaagauaaaacccacguuucaucgugggaagacgugccauaccuagguaaacgagaggaccaaugguguggaagucuuauuggacuaacagcaagggcaacaugggcaaccaacauucaaguagcaauuaaccagguaagacgacuaauaggaaacgaaaacuauuuagacuacaugacaaguaugaagagguuuaagaaugaaucagauccagaaggagcauuaugguga

SEQ ID NO: 22138 - RNA, 9876 nt, Artificial Sequence
  derived and/or modified CDS sequence (opt6) from DENV-1__KF672760__SS-prME
agcguaacuaugcugcuuaugcuacuuccuaccgcacuugcauuccaucucacaacucgagggggagaaccucacaugauugucagcaaacaagaacgcggaaaaucccuuuuauuuaaaaccucggcaggggugaauauguguacacuuauagcuauggacuuaggagaacuuugugaagacacaaugacauauaaaugcccgaggauaacagaagcagagccugaugacguugauuguuggugcaaugcaacugauacauggguaacauauggaacauguagucaaacgggcgaacacagaagggaaaaacguaguguggcgcucgcgccgcacguaggcuuaggucuagaaacuaggacagagacguggaugucgagugagggagcuuggaaacaaauucaacguguugagacgugggcccugcgucauccagguuuuacaguaauugccuucuuuuuagcacaugcaaucggcaccucaaucacucaaaaagggauuauuuuuauacuuuugauguuaguuacaccuuccauggcuaugagaugugugggaauaggaaaccgugauuucguugaaggcuugaguggcgcuacuuggguugacguugucuuagaacauggaucauguguaacuacuauggccaaaaauaaacccacauuagauauugaauuguuaaaaacagaaguaacuaauccugcgguacucaggaaacuaugcauagaagccaaaauaagcaauacaacgacagauucacgcugcccaacgcaaggggaggcuacgcucguugaggagcaagaugcuaacuuuguaugucgaaggacauucgucgauagagguugggggaacgguuguggccuuuuugggaaagggucguuacuaacgugugcgaaauuuaaaugcguaaccaaauuggaaggcaaaauaguacaguaugaaaaccucaaauauucaguuauaguuaccguucacaccggcgaucaacaucaaguuggaaacgagaccacggagcacgguaccauugcuacaaucacgccucaggcgccgacuagcgaaauccagcuaacagacuauggggcucucacucuagacuguucaccaagaacaggacuugauuuuaacgagaugguacuauuaacaaugaaagaaaaaucauggcuaguacauaaacaaugguucuuagaccuaccguugcccuggacauccggggcaucgacuucacaggaaacuuggaaucggcaagaucuucucguaacuuuuaaaacagcucaugcaaagaaacaagaaguagucguucuaggaagucaggaaggcgcuaugcacacugcuuuaacuggugcaacagaaauacaaacuucagguacaacgacaauauuugccggccauuugaaaugcaggcuuaagauggacaaacuuacuuuaaaggguaugucuuacguaauguguacuggaucguuuaaacuugaaaaagagguagcagaaacacagcaugggacaguccucgugcaggucaaauacgaagggacagaugcuccgugcaagauaccuuucagcacccaagaugaaaaaggagucacacaaaacgguagauuaauaacggcgaacccaauugucaccgauaaagaaaaaccagucaauauugaaacugaaccaccauucggugagucuuacauuguaguuggggcuggugaaaaagcucuaaaacuuuccugguuuaaaagagguagcucuaucgguaagauguuugaagcaacagcacgcggagcccggcgaauggcaauauugggggacacagcgugggacuuuggaaguaucgggggcguguucacaucuguagguaaacuugugcaucagguauuuggaacagcauacggcguuuuguucucagguguaucauggacaaugaagaucggaauaggaauacuuuuaacguggcugggacuaaacaguagaaguaccucccucuccaugaccugcauugccguugggaugguuacucuguauuuaggggugauggugcaagcugacagugguugcguaauuaacuggaagggccgugaauuaaaauguggauccggaauuuucguaacaaacgaaguucauacguggacagaacaguauaaauuccaagcagauagcccaaagcgacuaucagcagcgauagguaaggcuugggaagaaggaguuuguggaauuagaucugcaacaagacuugaaaauauaauguggaagcaaauaucgaacgagcuaaaccacauucugcuggaaaaugacaugaaauuuaccguuguagucggugaugcuaaugguauuuuagcacaaggcaagaaaaugauaagaccccaaccaauggaacauaaauauucuuggaaaagcuggggcaaagcaaagaucauaggggcagacauacagaacacaacuuuuaucauugauggacccgauacuccagaaugccccgauggacaaagagcauggaacauuugggaaguggaagauuacggguucggaguguucacuaccaauauaugguuaaaacuccgcgauagcuacacgcaaaugugugaucaucgacuaaugagugcagccaucaaggauagcaaggccguucacgcugacaugggauauuggaucgaaucagagaagaaugaaacauggaaguuagcacgugccucguuuauugaagucaaaacgugcaccuggccuaaaucacacacguuauggucgaaugguguauuagaaagugaaaugauaaucccuaaaaucuucggcggcccaauuucacaacauaauuacagaccggguuacuuuacucaaacagcaggaccguggcaccuugggaaacuagaacuugacuucgauuuaugugagggcacuacgguuguagucgaugaacacuguggcaacagaggccccagcuuaagaacuacgacaguuaccgggaaaaucauucaugagugguguugucggaguuguacauuaccuccgcuacgauuuaggggagaagaugggugcugguacggcauggaaauccgcccaguuaaagaaaaagaagaaaaccuuguuagaaguaugguaucagcugggucgggggagguugacagcuuuagucucgggauucuauguguaucuaugaugauagaagaagucaugcguucccgcuggucaagaaaaauguuaaugacagguacauuagcagucuuccuccuauuaauuaugggccaacugacauggaacgacuuaauccgacucugcauaaugguaggagcaaaugcaagugauaggaugggaaugggaacaacuuauuuagcucuaauggcaacguucaagaugcguccaauguuugcuguuggacuccuauuucguagauugacaagcagagaggucuuauuauugacaauaggauuaagccuaguagcauguguugaacuccccaacaguuuagaagaacugggagacggcuuagcgaugggaauaaugaugcuuaaauuauuaacagaauuucaaccacaucagcuauggacaacauuauugucccuaacguucguaaaaacaacauuaucucuggauuaugccuggaagacgacugccauggugcuuucaaucguuucuuuauuuccauuauguuuaaguacgacaucacaaaagacaacguggcuaccaguccuucucgggaguuuuggcuguaaaccauuaacaauguucuuaauaacagaaaacaaaauuugggguaggaagaguuggccucuaaacgaagguauuauggcuauuggaaucguaucuauuuuauugucaucucuauugaaaaaugauguuccauuagcaggaccauuaauagcaggagggauguuaauagcaugcuacgucauaagugguaguagugcugaucuaucgcuugagaaagccgcagaaguaucaugggagcaagaagcagaacauaguggagcaagucauaacauauuaguggaaguucaagacgacggaacaaugaagauaaaggaugaggaacgagacgacacucucacuauucucuuaaaggccacacuacuagcuguaucuggaguauauccuaugucgauacccgcaacucuauuuguuugguauuuuuggcaaaagaagaaacaaaggaguggaguucuaugggauacaccaucaccuccagaaguagaacgugcagucuuagacgaugggauauaucguauauuacaacggggauuguuaggacgcucccaaguaggcguaggcguauuucaagauggaguuuuccauacaauguggcacguuacuagaggagcuguucuaauguaccaggguaaacgauuagaaccuagcugggcgagcgugaagaaagaucuaauaagcuaugguggagguuggagauuucaaggaucauggaauacuggagaagagguucaaguaauugcuguugaaccaggaaagaacccgaagaauguacaaacgaccccugguacauuuaagaccccagaaggagaagugggugcaauugcuuuggauuuuaaaccugguacuucagguucgccuauugucaacagagaaggaaaaauagugggguuauauggaaauggagucguaacaacaaguggcacguacguaucugcuauagcacaagcaaaagccucacaagagggaccauuaccagaaauagaagaugaaguuuuuaagaaacgaaaucucacaauaauggaucuucacccaggaucugggaaaaccagacgauaucucccggcuaucguccgggaagcaauuaaacgaaaauuacggacucuuauacuagcaccuacuagaguaguagccagcgaaauggcagaagcauuaaagggaaugccgauuagauaccaaacaacagccguaaaaagugaacauaccggacgagaaaucgucgauuuaaugugccaugcgacuuucacuaugcggcuauugucgccuguaaggguaccaaacuauaacaugauaauaauggacgaagcacacuuuaccgauccagcgagcauagcagcaagagguuacauuuccacaagagugggaaugggagaagcagccgcuauuuuuaugacagcaacaccucccggcaguguagaagcauuuccucagucaaaugcuguuauccaggacgaagaaagagauauaccggaacgaucuuggaacagugguuacgacuggauaacggauuuucccgggaagaccguaugguuugugcccaguauaaagucuggaaacgauauugcaaauugucuuagaaagaacggaaaaagagucauucaauuaagucgaaaaaccuuugauaccgaauaucagaaaacuaaaaauaacgacugggauuauguagugacaacagauauuagcgagaugggggcgaauuuucgagcagacagaguaaucgauccacggcggugucugaaaccgguaaucuuaaaagacggucccgaacgcguuauauuagcuggaccaaugccaguaacaguagcaucagcggcacaaaggagaggcaggauagggagaaaccaaaauaaagaaggcgaucaauacguauauaugggacaaccguugaacaacgaugaggaccaugcgcauuggacagaagcaaaaauguuguuagauaauauuaauacaccggaggggauaaucccagcauuguucgagccagaaagggaaaaaucugcugcgauagacggugaguacagacuuagaggagaagcgcgcaaaacuuuuguagaacuuaugagacggggagaccuuccgguguggcuaucauacaaaguggcauccgagggcuuucaauacucagauaggcgaugguguuuugacggagagcguaacaaucaaguccucgaggaaaauauggauguugaaaucuggacgaaagaaggggaaagaaagaaacuuagaccaaggugguuggaugcuagaacuuacagcgacccguuagcguuaagggaauuuaaagaauuugcagcaggcaggcgaucuguaucuggagaucucauucucgagauuggcaaacucccccagcacuuaacccuacgagcgcagaaugcauuggacaaccuaguaauguugcacaacagcgaacaagggggaaaggcuuacagacacgcuauggaagaacuuccagacacaauugaaacuuuaauguuauuagcucuuauagcgguuuugacuggcggagucacgcuauucuuuuugucagguaaaggcuuggggaaaaccaguaucggauuguuaugcguuacugcuuccucugccuuacuguggauggcuaguguugagccgcauuggauagcggcauccauaauucuugaguucuucuuaauggucuuacucauaccugaaccagaucgacaacggaccccacaagauaaccaacuagccuaugugguaauaggcuuauuauucaugaucuugacuguggccgccaaugaaaugggccucuuagaaacaacgaaaaaggacuuagggauaggguauguagccgcugagaaucaucaacaugccacgaugcuagauguagaucuccauccagcaucggccuggacacucuacgcagucgcuacaacggucaucacaccuaugaugcggcacacaauugagaacacgacagcgaauauaucuuuaacggcgauagcgaaucaagcggcgauauuaaugggacuggauaaaggauggccuauaaguaaaauggauauaggaguaccauuacuagcucuaggcuguuauagccagguuaauccucuaacacucacugcagccguauugaugcucguggcgcauuacgcaauaauuggaccuggucuucaggccaaagcuaccagggaagcgcaaaaacgaaccgcugccggaauaaugaaaaacccuacagucgauggcauaguugcgauagaccuagacccuguaguuuaugaugccaaauuugaaaaacaauuagggcaaauuauguuguuaauacugugcacuucucaaauauuacuaaugagaaccacuugggcacugugugagaguaucacacucgcaacagguccacucacaacacugugggaaggaucacccggaaaauucuggaauacgacgauagcggucaguauggccaacauauuucgaggcucauaucuggcaggagcuggacuagcuuuuucucuaaugaaaucgcuuggcggcggacgcagaggaacaggugcacaaggagaaacacuuggcgaaaaguggaaacgucaacuaaaccaauuaagcaaauccgaauuuaacacauauaaaagaucugguauuauggagguggaucggucagaggcuaaggaaggccucaagcgaggugagacuacgaaacaugcgguuucgaggggaacagcuaaguuacgaugguuuguugagcguaacuuaguaaagccagaagguaaaguuauagacuuaggauguggaagaggaggauggaguuauuauugugcuggucucaagaaagugacagaaguaaagggcuacaccaagggagggcccggacacgaggaaccaauaccaauggcaacuuacggcuggaaccucguuaaauugcacucugguaaagaugucuucuuuaugccuccagagaaaugcgacacuuuguuaugugauauaggagaaucuucaccaaacccaaccauagaagagggaaggacacuccggguauuaaaaaugguggaaccuugguuaagaggaaaucaguuuugcauaaaaauccuaaaucccuauaugccaucuguuguagaaacucuagaacgcaugcaaagaaaacacggcggaaugcuagucaggaauccgcucucccguaauaguacacaugaaauguacuggguuuccuguggcacuggcaauauaguauccgcagucaauaugacaaguagaaugcuacugaauagauucaccauggcccauaggaaaccaacguacgaacgcgaugucgaucuuggagcagguacuagacauguugcaguggaaccagaagucgcgaaccuagauauaauaggacagagaauugaaaauaucaaaaaugagcacaagaguacauggcauuaugacgaagacaauccguauaagaccugggcuuaucauggcuccuaugaggugaagccuagcggaucugcgaguucaaugguaaauggaguagugcgucuucucacgaaaccuugggacguaauuccaaugguuacgcaaauagcaaugacggauacaaccccuuuuggccaacaaaggguguuuaaagagaagguggauacuagaacgccgcgggcaaaaagagguacuacacaaaucauggaaguaacugcgaaauggcuuuggggauucuugucacgaaacaagaagccaagaauauguacuagagaagaguucacaagaaaaguucgcaguaaugcugcuauuggagcaguuuuuguugaugaaaaccaauggaauagugcaaaagaggcaguagaagaugaacgguuuugggacuuaguacacagggaacgagaacuacauaaacaaggaaaaugugcgaccuguguuuauaacaugaugggcaagcgagaaaagaaacuaggagaguuugggaaagccaaagggucgcgcgcuauaugguacauguggcuaggagcaagauucuuagaguuugaagcacuuggauuuaugaacgaggaccacugguuuagcagggaaaauucauuaaguggaguugaaggagaaggccuacauaaacuuggcuauauacuaagagauauaucaaaaauucccggaggaaacauguaugcagacgacacagcagggugggacacacgaauaacggaagaugaucuacaaaacgaagcaaaaauaaccgauaucauggagccugagcaugcuuuauuagcuaccucuauauuuaaacugaccuaucaaaauaaaguaguaagagugcaaagaccugccaaaaacggaacuguaauggacguaauaagucggcgggaccaacgugguucugggcaaguaggcacauauggucuaaauacauuuaccaauauggaagugcaauuaauucgucagauggaaagugaaggcaucuuuuugccuucagaacuagaaaccccaaacuuagcugaaagagcccuugacuggcuugagaaacacggggcugaaaggcuuaaacgcauggcuaucucaggcgacgauugcguuguaaaaccaauagaugacagauuugcaacggcccuaacggcauuaaaugauaugggaaaaguaagaaaagauaucccgcaaugggagccaagcaaaggauggaacgauuggcagcaaguuccuuucuguucacaucauuuucaccaacucauuaugaaagauggaagagaaauagugguaccaugcagaaaucaagacgagcuaguaggaagggcucgagugucacaaggcgccggauggucucuucgggaaacggccuguuuagguaaaucauacgcgcaaauguggcaacucauguauuuucacagaagagaucuuagauuagcagcuaaugcaauuuguucagcaguuccggucgacuggguaccagcaagccgaacuacuuggucuauacaugcacaucaccaguggaugacaacggaagacauguuaucaguuuggaaccggguguggauagaagagaacccauggauggaagacaaaacacauguuucaagcugggaagaaguaccuuaccuuggaaaacgagaagaucaauggugcggaucacuaauaggcuuaacugcgagggcgaccugggcgacuaauauucaaguugcuauaaaucaaguacguagacucaucgguaaugagaacuauuuagauuauaugacaucaaugaaaagauuuaaaaacgaaucagacccagagggggcauuaugg

SEQ ID NO: 22139 - RNA, 9876 nt, Artificial Sequence
  derived and/or modified CDS sequence (opt6) from DENV-1__KF672759__SS-prME
ucagucaccaugcuacuuauguuacucccgaccgcuuuagcguuucacuuaacgacuagaggcggagaaccacauaugaucguaucaaaacaagaaagaggaaaaucucuucuguuuaaaacuucaguuggaguaaauaugugcacguuaauugcaauggaccuaggagaauugugcgaagauacaaugacauacaaaugcccuagaauaacagaagcugaaccugacgacguagauuguugguguaacgcaacagacacuugggugacguacggaacuuguagucaaacgggagaacaccgaagagauaaaagaucaguggcacuagccccacacguaggcuugggauuggaaacgagaacagaaacauggaugucaucagaaggugcuuggaaacaaauucagaaaguggaaacgugggcuuugagacaccccggguuuacaguaauagcguuauucuuagcgcaugcuauaggaacgucgauuacccaaaaagggaucaucuucauacuacuuaugcucgugaccccaucuauggccaugagauguguugguauagggaaccgcgacuuuguagaaggcuuaucaggcgcgacuuggguagauguaguuuuagaacauggaucuugcgucaccacuauggcgaaaaacaaaccgacccuugauauugaacuucugaaaaccgaagugacuaacccagcaguuuuacgcaaacuauguauagaggcaaaaauaucuaacacaacaacagacaguagaugccccacucaaggagaagcgacccuaguagaggaacaagaugcaaauuucguaugccggagaacuuuuguagacagaggaugggggaauggaugcggauuauuuggcaaaggaucucugcuuacgugcgccaaauuuaaguguguaaccaaacuagaggggaagaucguacaauacgaaaaucuaaaguacagcguaauagugacaguccauacaggugaucaacaucaagugggaaaugaaacaacugagcaugguacaauagcuacuauuacaccgcaagcuccuaccucagagauccaauugacggacuauggagcuuugacacuggauuguucaccucgaacaggauuagauuuuaaugaaaugguacucuuaacaaugaaggaaaagagcuggcuaguacacaaacaaugguucuuagacuuaccguugccauggaccucuggugcuaguacaagucaagaaaccuggaacagacaggaucuauuggugacauuuaagaccgcgcaugccaagaaacaagagguaguuguacuaggcagucaagaaggcgcaaugcacacagcauuaacaggagcaacugaaauucagacgucggggacgacuacgauuuucgccggacauuugaaaugucguuugaaaauggacaaacugacucucaaagguaugagcuauguuauguguacgggaaguuuuaagcucgaaaaagaaguugccgagacgcaacacggaacuguccugguacaaguaaaguaugaaggaacagacgcuccuuguaaaauuccauucuuaacacaagacgaaaaaggggucacacaaaauggaagguuaauaaccgcaaacccuaucgucacugacaaagaaaaaccagucaacauagaaacagagccaccuuuuggugaaucauauaucguuguuggggcaggagaaaaagcauuaaaauugucuugguuuaagaaaggaucaucaauaggcaagauguucgaagcgacagcucguggggccaggcgaauggccauucugggggauacagcaugggauuuuggguccaucgguggauuauuuaccagugucggaaaacugauccaucaaguauuuggcacggcauacgggguauuauuuuccggaguaucuuggacaaugaagauuggaauuggcauucuauuaacaugguuagggcuaaauucgaggagcacaagccugaguaugacaugcauagcaguuggcaugguaacccucuacuuagguguaaugguacaggcugauagugguugcgugauuaacuggaaagggagggaacugaaaugugguagugguauuuucgucacuaaugagguacacacauggacagaacaauacaaguuucaagcagauucgccuaaaagauuaucggcagcaauaggaaaagcaugggaagaaggagugugugguauaaggucggcuacaaggcuagaaaacaucauguggaaacaaaucucgaaugaguuaaauuacauccuguuggaaaaugauaugaaauucaccguagugguuggagacgugaacggaauacucgcgcaggggaagaaaaugauuagaccacaaccaauggaacauaaauacucauggaaaagcuggggaaaggcuaaaauaauaggggcagauauacaaaauacgacuuucaucaucgauggaccugauacacccgaaugcccagacgaucagagagcguggaacauaugggagguagaagauuaugguuucggaauauucacuaccaacauauggcuuaaacuaagagacagccacacacaaaugugcgaccaucgauuaaugagcgccgcgauaaaagauaguaaagcgguacaugcggauauggguuauuggauagagagcgaaaagaacgaaaccuggaaacuagcgcgugcaucguuuauagaaguaaaaacauguauuuggccaaaaagucacacauuauggaguaauggcguauuagaaagugagaugguaauuccaaagauuuauggagggccgauuucucaacacaauuaccgacccggcuacuucacucaaacugcaggcccauggcaccucggaaagcuagaacuagauuuugaucuaugugaagguacgaccguugugguagaugagcauugcggauaucgcgguccuucacugagaacuaccacggugacagggaaaaucauccaugaaugguguugucgaaguugcaccuuaccaccguuaagauuuagaggcgaagauggauguugguacggaauggagaucaggccggucaaagaaaaggaagagaauuugguacguucaaugguuagugcagguucgggagaagucgauaguuuuagcuuagguauauuauguguuucaauauuaauagaagaggucaugagaucacgauggagucgcaaaauguugaugaccgguacacuggccguauuuuuauuauuaauuaugggacaguugaccuggaacgacuugaucagguuguguauuaugguuggagcuaaugcaucggaccgcaugggaaugggaaccacauaucuagcacuuauggcuacauuuaagaugagaccuauguuugcuguaggguuguuauuuagaagauugacaugucgagaaguacuucuccuuaccguaggauuaucucuaguugcaucagucgaauuacccaacaguuuagaagaacuuggagauggccuagcgaugggcauuaugaugcugaaguuauuaacagacuuccaaccucaucagcuauggaccacguuacugagccuaacauucauuagaacgucuuugaguuuggacuacgcuuggaagacuauggcuauggcguuaucuauuguuucauuauuuccucuuugucuuaguacaacaucucagaaaacuacuuggcuaccuguacuucuaggauccuuuggauguaaaccccuaacgauguuccugauaacggaaaacaaaauaugggggagaaaaucuuggcccauaaacgaggguauaauggcugugggcaucgucuccauucuauuaucgucuuugcuaaagaaugauguaccauuagcggguccccucauagcgggagggaugcucaucgccuguuauguaauaucuggguccucagcggauuuaaguuuggaaaaggcugccgaagugaguugggaagaagaagcugaacacucgggaacaucacauaauauucuaguugagguacaagacgauggcacuaugaaaauaaaagaugaggagagagacgauacacuaacaauuuuguugaaagccacuuuguuagcuguaucagggguuuaucccaugagcauccccgcaacacuauucguaugguauuucuggcagaagaagaaacagagaagcgggguuuuaugggauacuccaucaccaccgaaaguagaaagagcaguucuggaugacggcaucuacagaauacuccaacgaggacuauuggguagaucucaaguugguguuggaguauuucaagacgguguauuucauacaauguggcaugugacacgaggugcaguguuaauguaucaagguaagagauuagaaccuucuugggcaaguguaaagaaagaccuaauaucuuauggugggggcuggcguuuucaggggagcuggaacacaggcgaagaaguacaagugauugccguagaaccaggcaagaaccccaaaaauguucagacuacgccaggcacauuuaaaaccccugagggagaagugggugccauugcacuagacuuuaaaccuggcacaaguggcucaccgauugucaacagagaaggcaaaauuguuggacuuuaugguaacggaguugucacgacuagcggaacauauguguccgccauagcccaagcgaaagcgacucaagaaggaccccugccagagaucgaagaugagguauuuaagaaaagaaaccugacuaucauggaucuucauccggguagugguaaaacgaggagauauuuaccagcgauugugagagaagcuauaaagaggaaauuaagaacucuaauuuuagcgccaacucgaguuguggcgucagagauggcagaggcuuuaaagggaaugccaauaagguaccagacgaccgcagugaaauccgaacauacagguagagaaaucguugauuuaaugugccaugccacauucacaaugcguuuguuaucuccuguaagaguaccaaauuauaauaugauaauaauggacgaggcucauuuuaccgacccagcuagcauagcagcacguggauauauuagcacucgaguuggcaugggugaagcugcugcuauauuuaugacggcuacaccgccaggcuccgucgaggccuuuccacaaagcaacgcuguaauucaagaugaagaaagggacauaccagagcggucuuggaacucagguuaugauuggaucacagacuuucccggaaagacagugugguucguaccgucaauaaaaaguggaaaugauauugcuaauuguuuaaggaagaacggaaaaagaguaauucaacuaucacgaaagacguuugacacagaauaucaaaagacgaaaaauaaugauugggauuauguagugacuacagauauaucagagaugggagcuaauuuucgugccgauagagucauagacccacgaaggugucuaaagccuguuauacucaaagaaggaccagaaaggguaaucuuggcaggaccuaugccgguuacaguagcuagcgcagcacaaagaagaggacguauuggaagaaaccaaaauaaggaaggggaccaguacaucuauaugggccaaccuuugaauaaugacgaagaucacgcacacuggacggaagcaaaaaugcuucuugauaacauaaauacuccagaagggauaauacccgcacuguucgaaccggaaagagaaaagucugcagcaauagauggggaauaccgguugagaggagaggcgaggaagacauuuguggaauuaaugcguaggggcgacuuaccagucugguuaucauauaaaguggccucagaaggauuccaguauagugaucggagaugguguuuugauggggaaagaaacaaccaaguguuggaagaaaacauggauguagaaauauggacuaaagaaggugaacgaaagaaacuaagaccacgcuggcuagaugcgaggacauacagugacccgcuagcauuacgcgaauuuaaagaguuugcagccggcagacgcucuguuucgggcgaucuuauacuugaaauaggcaaauuaccacaacaccuaacguuacgugcucaaaacgcuuuagacaaccuagucaugcuucauaacagcgaacaaggaggaaaagcauauagacacgcaauggaggaauugcccgauaccaucgaaacgcucauguuauuagcuuuaauagcagucuuaacagguggagucacauuauuuuucuugucuggaaaaggauuagggaaaaccaguaucggacuauuaugcguaauggcgaguagcgcacuucuauggauggcuaguguagagccgcacuggauagcugcaaguauuauauuagaguucuuccuaaugguuuuguuaauaccagaaccugaucgucaaagaaccccacaagacaaucagcucgcuuauguagucauugguuugcuuuuuaugaucuuaacgguugcagccaaugaaauggggcuccuagaaacuaccaagaaagaucuggguauaggacacguagcaguggaaaaucaucaucaugcuacaaugcuggauguagaccugcgcccugcuucugcauggacacuuuacgcuguagcgacuacgguaaucacuccgaugaugcggcauacgaucgaaaacacaacugccaauauaagccuuacagcaauagcaaaccaagccgcgauacuuaugggacuagauaaaggauggccgaucucaaaaauggauauaggagugccguuauuagcacuggguugcuauucucagguaaauccauuaacucuaaccgcagcuguauugaugcuuguugcacacuaugcgauaaucgguccagguuuacaagccaaagcaacaagggaggcccagaaacggacugcagccggaauaaugaagaauccuacaguagaugguauugugacgauugacuuagauccaguaguauaugacgcaaaauuugagaagcaacuuggccaaauuaugcuguuaauuuuauguacuucgcaaauacuacugaugcgaacuaccugggcgcuaugugaauccauaacauuggcuacggguccgcugacaacguugugggagggaucccccggaaaguucuggaauaccacuauagcuguuucaauggcgaacauauuucguggaucauauuuagcgggugcgggucucgcauucucucuaaugaagucguuaggagguggacgacgugggacaggggcucaaggagaaacauugggugaaaaguggaaaagacaacucaaucagcuaucuaaaucggaguucaauaccuauaagaaaucggguaucauggaaguggaucguucggaagcgaaggagggccucaaacgcggugaaacaaccaaacacgccguuucgagagguacagcgaaacucagaugguucguugagagaaacuugguuaaaccugaaggaaaggucauugauuuaggaugcggacggggagguuggaguuauuauugugcaggacucaagaaagugaccgaaguaaaaggguacacaaaagguggaccaggacaugaagaaccgauaccaauggcaacauaugguuggaauuuaguaaaauuacauagcggaaaagacguauucuuuacgccuccugaaaaaugcgauacccuucuuugugauaucggggaaagcucaccgaauccuacaauugaagaagggagaacauuaagaguauuaaaaaugguagaaccuuggcucagaggaaaccaguuuugcauaaaaauauuaaauccuuauaugccuucagugguugaaacccuagaacaaaugcaaagaaaacaugggggaauguugguccggaacccguuaagcagaaacagcacacacgaaauguauuggguauccuguggcacaggcaacauaguaagcgcaguaaauaugacaagucgaaugcucuugaauagguuuacaauggcacacagaaaaccaacuuacgaaagagauguugauuuaggggcuggaacgcgucacgucgccguagagccggagguugcuaaccuagauauuauaggccaaagaaucgaaaauauaaagaaugaacauaaaucaaccuggcauuacgaugaggacaacccauacaaaacaugggcguaucaugggaguuacgaaguuaaaccgucugggucugccucuucaaugguaaauggagugguaagacuguuaacaaaaccaugggauguaauaccaauggucacucaaaucgcuaugacugauacuacaccguucggacagcagagaguauucaaagaaaaagucgauacgagaacaccaagggcuaagagaggcaccgcacaaauuauggagguaacggcuaaauggcuauggggauucuuaaguagaaauaagaaaccaaggauaugcacuagggaagaauuuaccagaaaaguacggucgaaugcagcaauaggagcaguauucguagacgaaaaccaauggaacuccgccaaggaagcagucgaagaugagagauuuugggaucuaguacaccgugaaagggaacuacauaaacaaggaaaaugugcuacgugcgucuacaacaugaugggcaaaagagaaaagaaacuuggugaauuuggcaaagcaaaaggaaguagagccaucugguauauguggcuuggugcgcgauuuuuggaguucgaggcguugggauuuaugaaugaggaccauugguuuagccgggagaacagcuuaaguggaguugaaggagaagguuuacacaaacuaggauacauuuuaagggauauuuccaagauaccaggcgguaacauguacgcagacgauacagcaggcugggacaccagaauaacggaggaugacuugcaaaaugaggcuaaaauuacggauauaauggaaccagaacaugcauugcuagcuaccaguauauuuaagcugacuuaucagaacaaaguuguuaggguacaaagaccggcuaaaucaggaacaguuauggauguaauuucaaggagagaucaaagaggaaguggacaaguaggaaccuauggauugaacaccuucacaaacauggaaguacaauugauaaggcaaauggaaagugagggaauauuuucuccgucugaguuggagacaccaaauuuggcaaagaaagucuuggauuggcuagagaaacacggggcugaacgauugaaaaggauggcuauaagcggugaugacuguguugucaaaccuauagaugauagauucgcaaccgccuuaacugcacuuaaugacauggggaaagugagaaaagauauuccgcaaugggaacccucuaaaggauggaaugauuggcaacaagucccauucuguucccaucacuuucaucaacuaaucaugaaagacggacgugagauuguagucccaugcaggaaucaagaugaguugguugggagagcuagagucucccaaggagccggguggucauugcgcgaaacugccuguuuaggcaagagcuaugcacagauguggcaacugauguauuuucauagaagagaucuucgucuggcugcgaacgccauauguucagcugugccaguggauuggguaccaacuucacgcacuaccuggucgauacaugcgcaucaccaauggaugacaacugaagauauguuaucaguuuggaacaggguuuggauagaagaaaacccuuggauggaagauaaaacccauguaucuucgugggaggagguuccguaucugggaaaaagggaggaucaguggugcggauccuugaucggauuaacggcaagagcuacaugggcaacgaauauucaaguugcaauuaaucaaguuagaagauugauaggaaacgaaaacuaucuugacuauaugacaagcaugaaacgguuuaagaaugaaucagaccccgaaggggcccucugg

SEQ ID NO: 22140 - RNA, 9876 nt, Artificial Sequence
  derived and/or modified CDS sequence (opt6) from DENV-1__KF672761__SS-prME
uccgucacuaugcuauuuauguuacucccgacagcauuagcauuucacuuaacgacacgcgggggcgaaccccacaugaucguaagcaaacaagaacgugguaaaucucucuuguucaaaacaagugcggggguuaauaugugcacacuaauagcuauggaccucggggaauuaugcgaagacacaaugacauauaaaugcccgaggauuacagaagcugaaccagacgacgucgauuguugguguaacgcaaccgauacaugggucacauauggaaccugcucccagacgggcggucaucgacgagauaaaaggucuguagcuuuagcgccccauguaggacuaggacuugaaacaaggacggaaacauggaugucauccgaaggagcauggaaacaaauacagaaaguugagacaugggcauuaaggcaucccggauuuacgguaauugcacuauuuuuagcucacgcgauuggaacaaguaucacacaaaaaggaauaauuuuuauauuauuaauguugguaaccccuucgauggcaaugaggugcguggggauaggaaauagagacuuuguugaaggcuuaucaggagcuacguggguugauguuguacuagaacauggcucauguguuacgaccauggccaaaaauaaaccgacuuuagacauugaauugcugaaaacagaaguaaccaauccagcuguuuuacgcaaguugugcauagaggcaaaaauaucgaacacuaccacagauagccgguguccaacacaaggugaggcuaccuuagucgaagaacaggaugcuaauuucgugugucgucgaaccuuuguggaucgcggcugggggaacgguuguggccucuuuggaaaagggucgcuucuuacaugugcuaaauuuaaauguguaacuaaacuagagggaaaaauuguacaauaugaaaauuugaaauacagcgucauaguaacagugcauaccggggaucaacaucagguagguaacgagacaacugaacauggaaccauagcaacuaucacaccacaagccccuacauccgaaauacaauuaacggauuauggugcgcuuacacuagacuguucuccuagaacuggauuagacuuuaaugaaauggugcuucucacgaugaaagaaaaaucaugguuaguacauaaacaaugguuucuagaccuaccauugccauggacaagcggcgcuaguaccucacaagaaacuuggaauagacaagaccuauuaguaacauuuaaaacagcacacgcuaagaagcaagaaguaguagugcuuggcucacaagaaggagcaaugcacacagcacucacuggggccacagaaauucagacaagcgguacaacaaccauauuugcuggacauuuaaaauguagauuaaaaauggauaaauuaacgcucaaaggaacuucauauguaauguguacuggauccuucaaauuagaaaaagaaguugcugaaacccagcauggaacaguacuuguccaagucaaguacgaagggacagaugcuccuuguaaaaucccauucuccacacaagacgaaaaaggcguaacacaaaauggaagacuaaucacagcaaaucccaucguuaccgauaaggaaaaaccaguuaacaucgaaacugaacccccguucggugaaucauacauaguuguuggagcgggcgaaaaggcuuuaaagcucucuugguuuaagaaagggaguucaauagguaagauguuugaggcuacagcuagaggagcuaggaggauggcuauucuaggugauacugcaugggauuucgguucuauaggagguguauuuacaagcguuggcaaguuaguacaucagguauucggaacggcauacggaguacuauuuucaggugucagcuggacuaugaaaauugguauuggaauacuguugacauggcuaggacuaaacucaagaucaaccucccucucaaugacuugcaucgcgguggggauggucacccucuauuuagggguaaugguacaagcggacucaggcugugucauuaauuggaaggggcgagaauuaaaaugcgguaguggaauuuuugugacuaacgaaguucacacguggaccgaacaguauaaauuucaagcugauagucccaaacgcuuaucggcugcuauaggaaaagcaugggaagaaggaguauguggaauuagaagugcuacaagguuagaaaauauaauguggaagcaaauuucaaaugaauuaaaccacauauuacuugaaaacgacaugaaauucacggugguugugggcgaugcaaauggaauauuagcucaagguaagaaaaugauaaggccccagccuauggaacacaaauauucauggaaaagcuggggcaaggcaaaaaucauaggagccgacauacaaaauaccacauucauaaucgauggcccagauaccccagaauguccagacgaacaaagagccuggaauauaugggaaguagaggacuacgguuucggaauauucacaacuaauauaugguuaaaauuacgugacucguauacacaaaugugcgaucaccgauuaaugagcgccgcaauaaaagauucaaaagcaguacaugccgauaugggcuauuggauagagucggagaaaaacgagacauggaagcuggcgcgagcuucauucaucgaggucaagacuugcauauggccgaaaucccauacgcucuggaguaaugggguucuugagagugaaaugaucauaccgaaaauauacgguggucccaucucacaacauaacuauagaccaggauauuucacacaaacugcaggaccauggcauuuagguaaacucgaacucgacuuugauuugugcgagggaacuacaguuguagucgacgaacauugcggaaauagagggccaagucuaagaacaacuacugucacaggaaaaaucauacaugaaugguguugucguuccugcacuuuaccaccccugagauuucgaggggaagacggaugcugguauggaauggaaauuagaccaguuaaggaaaaggaggaaaauuuagucaggaguaugguaagugcagguaguggagaaguggauaguuucucucuagguauccuuuguguuagcauaaugauagaagaaguaaugagaaguagguggaguaggaaaaugcugaugaccgguacccuagcuguguuucuuuuacucaucaugggacaguuaacguggaaugacuugauacgacuaugcauaauggucggugcaaaugcuagcgacaaaaugggcaugggcacaacguacuuggcguuaauggcaaccuuuaaaaugaggccuauguucgccguagguuuacuauucaggcgucuaacaucgagagagguauugcucuugacgauuggccuaagccuaguagcaucugucgaauugccaaauaguuuggaggaauugggagacgggcuagcgaugggcauaaugauguuaaaacuccucacggaauuucaaccucaucaauuauggacaacgcuuuuaagccucacuuuuauaaaaaccacacucagccuugacuaugcuuggaaaacaacugcaaugguucucucaaucguuagucuauuuccuuuguguuuaaguacaacaagucagaaaacaacaugguuaccaguuuuauuagggucguuuggguguaaaccgcuaacuauguucuuaauaacagagaauaaaauauggggaagaaaaaguuggccacuaaaugaagguauuauggcaauaggcaucguuaguauuuuauuaucgucgcuucugaagaacgauguaccgcuagcugggccuuugauagcaggaggaauguuaaucgccuguuacgucaucucaggaaguucagccgacuuguccuuggaaaaggcugcugaagucucuugggaagaagaggcagaacauagcggcacaucgcauaauauucuuguagaaguccaggaugacggaacaaugaagauuaaagaugaagaaagagaugauacucuuacaauauuacugaaagcuacacugcucgccguuucuggcguuuacccaaugucgauacccgcaacauuauucgugugguauuucuggcagaagaagaaacaaagaucaggcguuuuaugggacacaccgagucccccugaaguggaacgagcaguucuggacgauggaauauauagaauacuucagaggggccuucuaggccgcucacaaguaggcguuggaguauuucaagaugguguguuccauacaauguggcauguuacaagaggugccguguuaauguaccaagggaagagacuugagccgucuugggcaucaguaaagaaagaucuaauaucauacgggggcggauggagauuucaagggucauggaacacuggagaggaaguucaaguaauagcgguagaaccagguaaaaauccgaaaaacguccaaacaacaccagggacuuuuaagaccccagaaggugagguuggggcuauugcccuggauuuuaagccaggaacaagcgguucuccaauuguuaaucgagaagguaaaauuguuggacucuauggaaaugguguuguuaccacgucgggaacauacguuucagcaauagcacaagcuaaagcaucacaagaagguccacucccggaaaucgaagacgaggucuucaagaaacguaacuugaccauuauggaccuucacccggguagcggcaagaccagaagauauuugccagcgauuguccgagaagcgauaaaaagaaaacuaagaacucugauauuagcuccaacgcgugugguggcaagugaaauggcggaagcacuaaaaggaaugccaauacguuaucaaacaacagccguuaaaucagaacacacgggccgggagauaguagacuugaugugucaugccacauucaccaugagacucuuaucaccgguucgcgugccuaacuacaacaugaucaucauggaugaagcucacuucacggauccagcaucuauagcugcaaggggcuauauauccacgcgaguaggaaugggcgaagcugccgcaauauuuaugacugccacaccgccggggagugucgaggcguucccucaauccaaugcagucauccaagaugaagaacgcgacauuccagagcggucuuggaauagugguuaugauuggauaacugacuuuccugggaaaacgguaugguuuguaccuucaauaaaaucugguaaugacauugcuaacugcuuacgcaagaauggaaaacguguuauacaacugucaagaaaaacauuugauacggaguaucaaaagaccaaaaacaacgauugggauuauguaguaacuacugauauaucggaaaugggcgcaaacuuuagggcagaccguguaaucgauccuagaagauguuugaaaccugugauauuaaaggauggacccgaacgagucaucuuggcaggccccaugccaguuacgguugcaucagcugcucaaagacgggguagaaucggccguaaucagaauaaagaaggagaucaauacgucuauauggggcaaccgcuuaacaacgaugaagaccaugcccauuggacagaagcgaaaaugcuacuggauaauauuaauacccccgaaggaauuaucccagcacuuuucgaaccugaaagagagaaaucagcagcaauugauggagaauaucgguuaagaggugaagcaagaaaaacguucguugagcuuaugagaagaggagauuuaccagucuggcuaucauauaaagucgcaagugaaggauuucaauauucggacagaagaugguguuuugacggggaaagaaauaaucaaguccuugaagaaaauauggauguggaaauuuggacaaaagagggagaacguaagaaauuaagaccuagguggcuugaugcacgaacuuauagugauccgcucgcauugcgagaauuuaaagaauuugcagcugguaggcgcucagugucgggagauuugauuuuagagauaggaaaacuaccacaacaucuaacauuacgggcccaaaacgcuuuggauaacuuaguuauguuacauaacucagagcaaggagguaaggcauaccggcaugcuauggaagaguuaccagauacaauagaaacccuuaugcuucuagcacucauagccguacuaacuggaggaguaacacuuuucuuccuuucgggaaaagguuuggggaagaccucuauaggucuauuaugcguuacggcaucaucagcauuacuuuggauggcgucugucgagccucauuggauugcugcaagcauuauacuagaguucuuuuuaaugguccuccucauaccggaaccugacaggcagagaacaccucaagauaaucaacuagccuacguugugauaggacuucuuuuuaugauucuuacaguagcagcaaacgaaaugggacuauuagaaacaacaaagaaagauuugggaauuggucauguugcugccgaaaaccaucaacacgcaacgauguuggauguagaccugagaccggcaucagcauggacccuguaugcgguugcaacaaccguaaucacaccaaugaugagacacaccauugaaaacacaaccgcuaauauaucuuuaaccgccauagcuaaccaggcggccaucuugaugggacuagauaaaggcuggccuauaaguaaaauggacauagggguaccgcuuuuggcucuuggguguuauagccaaguuaauccuuuaacauuaacggcagcuguacuuauguuaguagcucacuaugccauuaucgggccaggucuucaggcgaaagcaacgagagaagcacaaaagcgcacagccgcaggcauuaugaagaaucccacaguagacggaauaguugcuaucgaucuagacccagucguauaugacgccaaauuugagaaacaacuuggacaaaucaugcuacuuauucucuguaccucucaaauuuuguuaaugagaacaacaugggccuuaugugaaucuaucacacuagcuacuggcccucuaacaacuuuaugggaaggaucgccuggaaaguuuuggaauacaacaaucgccguaucuauggcuaauauuuuuaggggaagcuaucucgcuggugcggggcuagcauucucgcuuaugaaaucucucggagggggucgaagaggaacgggagcacagggagaaacuuugggugaaaaauggaaaagacaauuaaaccaacugucaaagagugaguucaacacauacaagcguagcgggauuauggaaguagauagaagugaagcaaaagaaggauugaaacgcggugaaacuacaaaacaugcagucucaagggguacagcuaaacuuaggugguucguggaacguaaccuuguaaaaccggaaggcaaaguaauugaccuugggugcggucgugguggaugguccuauuauugugcuggguuaaagaaaguuacugagguaaaaggauacacaaaaggaggaccgggccaugaggaaccgauuccuauggcaacauauggauggaauuuagugaaacuacauucuggaaaagauguguuuuucaugccgccugaaaaaugcgacacauuauuaugugauauaggugaaaguucgccuaaucccacaauagaagaggguagaacgcuuagagugcucaaaaugguagaaccgugguuaaggggcaaccaauuuuguauuaagauacuaaauccuuacaugccaaguguggucgaaacauuagaacaaaugcagagaaagcauggagguaugcuugucaggaauccgcuuucgcgcaacaguacacaugaaauguacuggguuaguugcggaacuggaaacauaguuucagcaguaaauaugaccucgcggaugcucuuaaacagguucaccauggcucauagaaaacccacauaugaaagagauguagaucuuggugcaggaacaaggcacgucgccguagagccagagguggcuaaucuagacauaauaggacaaaggauagaaaauauuaaaaacgaacauaaaucaacauggcauuaugacgaagacaacccguacaaaacaugggcuuaccaugguuccuaugaggucaagcccagcgguagcgcgucaaguaugguuaauggaguaguuagacuacucacgaaaccuugggauguaauuccuaugguaacacaaauagccaugacagauacgacgccuuucggccagcaaagagucuuuaaagaaaagguggacacacgaacaccuagagcaaaaagagguacggcccaaaucauggaaguaacugcaaaguggcuuuggggauuccuguccaggaauaagaaaccaaggaucugcacccgcgaagaauuuacucggaaaguucgaucgaacgcugccauuggagcaguuuucguugaugaaaaccaauggaacuccgcaaaggaagcggucgaagaugaacgauucugggaucucguacauagagaacgugaacuccauaagcaaggcaaaugcgcgacguguguuuauaauaugaugggaaaacgagaaaagaaguugggagaguucggcaaagcgaaaggaucacgagccaucugguacauguggcucggagcgagguuccuagaguucgaagcccuuggcuuuaugaaugaggaccauugguucagccgugaaaauaguuugucugguguagagggggaagguuuacauaaacuagguuauaucuugagagauauuagcaagauaccuggagguaauauguaugcggaugacacagcagguugggacacacgcauaaccgaagaugauuugcaaaacgaagcaaaaauuacugauauuauggagccagaacaugcucucuuggcuaccucaauauucaaacucacauaccaaaacaaaguaguacgaguucagaggccggccaaaaauggaacagucauggaugugauuagccgacgagaccaaagggggucaggccaagucggcacuuaugggcuaaauacauuuacuaacauggagguccaacucauuaggcaaauggaaagcgaaggaauauuuuugcccagcgaauuagaaacuccuaaucucgccgagaggguucuagacuggcuggaaaaacauggugcagaaaggcucaaaagaauggcuaucucaggagaugauuguguuguuaaaccaauugaugaucguuucgcaacggcguugauagcucuuaacgacaugggaaaaguaagaaaagauauaccgcaaugggaaccaucaaaggguuggaacgacuggcagcaaguuccguuuuguucacaccacuuccaccaacuaauuaugaaagauggaagagaaauugucgucccaugccguaaccaagaugaacuggugggccgugcuagggugagccaaggugccggauggucauugagggaaacggccugccuggggaaaagcuaugcacaaauguggcagcuaauguauuuucaucgccgcgaucuaagacuugcagcaaacgcaauauguucagcgguuccggucgacuggguacccaccucaagaaccaccuggucgauacacgcacaucaccaguggaugacuacagaagacauguuaaguguguggaaucgagucuggauagaggaaaauccuuggauggaagauaaaacacaugugagcaguugggaagaaguuccuuaucucggaaaaagagaagaucaguggugcggaucauuaauuggacuaacagccagagcuacaugggcaacuaauauacagguagcaauaaaccaggucagacgguuaauaggcaaugaaaacuauuuagauuauaugacaucuaugaaacgguucaagaaugaaagugacccugaaggcgcucuaugg

SEQ ID NO: 22141 - RNA, 9876 nt, Artificial Sequence
  derived and/or modified CDS sequence (opt6) from DENV-1__KF672762__SS-prME
ucaguaaccaugcuucuuaugcuauugccgaccgcacuagcuuuccauuugaccacccgcgggggugaaccgcauaugauaguaucuaaacaagaacggggaaaaucauuacuauucaaaacaucagcuggaguuaauauguguacucuaauugcuauggacuuaggagaguuaugugaagacacuaugacauauaaaugcccaagaauaacggaagcagaaccugaugacguugauuguuggugcaacgcaacugauacuuggguaacauacgguacauguucacaaacaggagaacaucguagagauaaacgaaguguagccuuagcaccacacgugggccuuggucuugaaacaagaacugaaaccuggaugaguucagaaggagcauggaaacaaauccaaaaaguagaaacuugggcuuuaaggcaccccggcuuuacuguaauugcguuguucuuagcccacgcuauaggcacaucaauaacccaaaaaggaauaauauucauacuuuuaaugcucguaacaccuuccauggcaaugcgaugugucggcauagguaaucgugauuuuguggaaggccucagcggugcaaccuggguagauguaguucucgaacacggcucaugcguuacuacaauggccaaaaauaaaccaacuuuggauauagaauuguuaaaaacggaaguuacaaauccagcggugcugagaaaauuauguauagaagccaaaaucaguaauacuacaacagauagccgcuguccuacccagggugaagcuacucuagucgaggaacaagaugcuaacuuuguaugccgccggacuuuuguggauagaggguggggcaauggaugcgguuuguuuggaaaaggaucuuuauuaacuugcgcuaaauuuaaauguguaaccaaauuagaaggaaaaauaguacaauaugagaaccuuaaguacucaguuauaguaacaguacacacaggcgaucagcaucaaguagguaaugaaacaaccgaacauggaacgaucgcuacuauuacaccacaagcccccaccucagaaauacaauugacugauuacggcgcauuaacgcuagauuguagucccagaacgggguuagauuucaaugagaugguauuacuaaccaugaaagaaaaaucaugguuaguacacaaacagugguuuuuagacuugccguugccuuggacaucgggcgcuucgacgucacaagagaccuggaacagacaggaucuccuagugacuuuuaaaacagcacacgcuaagaagcaagaaguaguagugcugggcucacaagagggagcaaugcauacagcucuaacuggugcaacagaaauacagacaagcggaacuacgacaaucuucgcgggucaucuaaaauguaggcuaaaaauggauaaauuaacgcuuaaaggcacaucauauguuauguguacggggucuuuuaaacuggaaaaagaggucgcugaaacgcagcacgguacggugcuaguccaaguuaaauacgagggcaucgaugcuccuuguaaaauaccuuuuucaacacaggacgagaaaggagucacacagaacgguagguuaauuacagcgaacccuauuguaacugauaaagagaaaccagugaauaucgagacagaacccccuuuuggcgaauccuauauuguaguuggagccggugaaaaagcacugaagcucagcugguucaagaaaggcucaaguauugguaaaauguuugaagcuaccgcacguggggcacgccggauggcgauucucggggacacagcuugggacuuuggaucaauagguggaguuuucacaucugucggaaaacuuguacaccaaguacuuggcacagcguauggaguguuauucucugguguaucuuggacaaugaaaauugguauagguauccugcucacauggcucgggcuaaacucuagaagcacgagcuugucgaugacauguauugcaguaggaauggugacauuguaccuaggaguaaugguacaggcugacagcggaugugugauuaauuggaaagguagagaauuaaaaugcgggagcggcauauucguaacgaacgaagugcauacauggacugaacaauauaaauuccaggcugacuccccgaagcgauuaagugccgccauagggaaagcgugggaagaaggagucuguggaauacgaagugcaacaagauuggaaaauauuauguggaaacaaaucucgaacgaacuaaaucauauucuucuggaaaaugacaugaaguuuacgguggugguaggagaugcaaaugguauacuagcccaagguaagaaaaugaucagaccgcaaccaauggaacacaaauacucuuggaagaguugggggaaagcaaagaucaucggagcagacauucaaaauacaacguuuauaauagacgggccagacaccccggaauguccagacgaacaaagggcuuggaauaucugggaaguagaagacuauggauuugggaucuuuacaacaaauaucugguuaaaacuacgagauuccuauacucaaaugugcgaccacagacuuaugucagcugcaauuaaggauaguaaagcuguacaugccgauaugggauauuggauugaaucagagaaaaaugagacauggaaauuggcuagagcuucauuuauagaggucaaaaccuguauauggccaaaaucucacacacuauggaguaauggagucuuggaaucagaaaugaucauaccaaaaauuuaugguggaccaauuagucaacauaauuauagaccgggcuauuuuacccaaacagcuggcccauggcauuuaggcaaacuagaacuugauuucgauuuaugugagggaacaaccguuguaguggacgaacauuguggaaaucgaggcccaucguugaggacaaccacaguuacuggaaaaauaauucaugaguggugcugucguucaugcacgcuaccaccgcuacgauucaggggagaagaugguugcugguauggaauggaaaucaggccugucaaagaaaaagaagaaaacuuagugcgaagcauggucagcgcaggcucuggugagguagacaguuuuagcuuagguauauuauguguaaguaucaugauagaggaaguaaugagaucuagguggucgcgaaaaaugcuaaugacuggaacguuagcaguauucuuauuacuaauaaugggucaauuaacauggaacgauuuaauaagguuauguauaauggucggcgcaaaugccucggacaagaugggcaugggcacaacauauuuagcucugauggcaacauuuaaaaugagaccaauguucgcuguugggcuguuauucaggcgccuaaccuccagagaaguauugcuacuaacaaucgguuuaagccuaguagcuucaguugaacuuccaaauagucuagaggaacucggugacggucuggcuaugggaauaaugaugcuuaaacuguugacggaauuucagccucaccagcuauggacgacgcuuuugagcuuaacguuuauuaaaacgacauuaucacuagauuacgccuggaaaacaacagcuaugguacuuuccauagucagcuuauuccccuugugucuaucgacgacaucucaaaagacuacuugguuaccaguguuacucgguaguuucgguugcaagccacuuacuauguuucuuauaacagaaaacaaaauuugggguagaaaaaguuggccauugaaugaagggauuauggcuauagggauaguaucaauacuccuaucuucauuauuaaagaaugauguaccguuggccgguccucuuauugcuggcgggaugcugauagcuuguuauguaauaagugggucaucagcggaccuaucacuagagaaagcugccgaaguaucaugggaagaagaagcugagcauucggguacgagucauaauauacuggucgaaguccaagaugacgggacaaugaaaauaaaagacgaagagagagaugacacccuaacaauuuuauuaaaagcgacucuuuuggcagugucugggguuuacccgaugucuauaccagcgacguuauuuguaugguauuuuuggcagaagaagaaacaacgaucagguguuuugugggauaccccaucgccaccagaaguagagcgagcaguauuagacgaugguaucuauagaauuuuacaacgcggacuauugggacguagucaaguaggaguaggggucuuccaagacgggguauuccauacaauguggcauguuacucgcggugcgguacuuauguaucaagguaaacgucuagaaccuucuugggcgucagucaagaaagauuugauuucauacggagggggauggcgguuccaagguucuuggaauacgggggaggagguacagguaauugcugucgaaccuggcaaaaaccccaaaaauguucagacuaccccaggaacauucaaaacaccagaaggagagguuggagcgaucgcccuagacuucaaaccagggacaucaggcaguccuauaguuaauagggaaggcaaaauaguagggcuauacgguaacggaguuguaacgaccuccggaacuuacguuagugcaauagcccaggccaaagcaucccaagaaggcccucuaccagagaucgaggaugagguuuuuaaaaagagaaauuuaacaaucauggaccuucauccagguucuggaaagacccgacgcuaucucccagcuaucguacgugaagcaaucaaaagaaaacuucgaacauugauucuagcaccgacaagagugguggccagugaaauggcagaagcgcugaaaggaaugccuauuagauaucaaacgacagcuguaaagucagagcauacugguagggagaucguagaucuuaugugccacgcaacauucacgaugagguugcucagucccguuagggugcccaauuauaauaugauaauaauggaugaggcacacuuuacugacccugcaagcaucgcugcaaggggcuauaucucaacgagaguugguaugggcgaggccgcagccauuuucaugacugcaacuccgcccgggagcguagaggcauuuccacaaagcaaugcggucauucaggacgaggagagagauauaccggaaagaucuuggaacucuggauacgauuggauaacagacuuuccuggaagaacuguaugguuugugccuaguaucaaaucagggaaugacauagcuaauugucucaggaaaaaugggaaacgagucauacaauuaucacggaaaacguuugauacagaauaucaaaagacuaaaaauaaugacugggauuaugugguaacuacagacauuuccgaaaugggggcaaacuuccgagcugauagggugaucgacccuaggcguugcuuaaagccaguuaucuuaaaagauggaccugaacguguuauuuuggccgguccgaugccggugacagucgcaucagcggcacaaagaagaggcagaauuggacgaaaucaaaauaaagaaggagaccaauaugucuacaugggccaaccuuuaaauaaugacgaagaucaugcucauuggacagaagcaaaaaugcucuuagauaacauaaacacuccagaaggcauaauacccgcuuuauucgaaccugagagagaaaagucagcagcgauugacggagaauacagacugaggggagaagcaagaaagacguuuguagagcugaugagaagaggagaucugccuguaugguuaucuuauaagguugcuucugaaggauuccaguacagugaccgccgcuggugcuucgauggugaacggaauaaucaaguucuagaggaaaauauggauguagaaauuuggaccaaagagggcgaaaggaagaaacuacguccucgaugguuagacgcucggaccuauagugauccauuggccuuacgugaauuuaaagaauuugcugcgggucgacggagugugucuggugaccucauuuuggaaaucggaaaacuuccucagcaucuuacccuucgagcgcaaaacgccuuagauaauuuaguaauguuacauaauagugaacaaggagguaaagcguaucgacacgcuauggaagaacuaccugauacuauagaaacguuaauguugcuagcucugauagcuguacucacaggugguguaacguuauucuuucuaagugguaaaggucuugggaaaacgucaauaggguugcuuugcguaacugcaucuucagccuuauuauggauggcuaguguugaaccccauuggauagcugcaucuauaauacuggaguucuuucuuaugguauuauuaauccccgaaccagaucgccagaggacaccacaagauaaccaacuggcauauguuguaauaggccuuuuauuuaugaucuuaaccgucgcugcaaacgaaaugggacuacuagaaacaacuaagaaagauuuggggauuggucauguugccgcugaaaaccaucaacaugcuaccaugcuggauguagaucuuaggccagcguccgcuuggacuuuauacgcagucgcaacuacugucauaaccccuaugaugagacauacaauugaaaauacuaccgcaaacauaagccugacagccauagccaaucaagcugcaauacuaauggguuuggacaagggauggcccauaucuaagauggacauagguguuccacuacucgcauuaggauguuauagccaaguuaacccuuuaacacuuacagcagccguguugauguugguugcucauuaugcaauuaucggaccaggacuacaagcgaaagcuacuagggaagcucagaaaagaacagcagcaggaauuaugaaaaauccgacugucgaugguaucguagccauugaucuugaucccguaguuuacgaugcaaaauuugaaaaacagcuuggucaaaucaugcuacuaaucuuaugcaccucgcagauuuugcuaaugcgaacgacuugggcucucugugaaucuauaacacuugcgacaggaccucuuacaacguuaugggaaggaucaccuggcaaauuuuggaauacuacgauagcaguaucaauggcaaauauauuccgaggaucauauuuagcaggggcgggucuggcauucaguuuaaugaaaaguuuaggaggagguagacgggggacuggagcgcagggagagacguuaggugaaaaauggaagaggcagcuuaaccaacucaguaagucagaguuuaauacauacaaaagauccggcauuauggaaguagaucgguccgaagcaaaagaaggacuuaaacgaggugaaacaacaaaacacgccguuucgagagguacagccaaauuacgaugguuuguagaaagaaaccuagugaagccugaagguaaaguaaucgaucuuggaugcggaaggggcggguggucguauuauugcgcuggucucaagaaggugacggagguuaaaggauacacuaaaggggguccuggucaugaggaaccaauaccaauggcaaccuacgguuggaaucucguaaaauuacacucggggaaagacguguuuuucaugccaccagaaaaaugcgacacuuuauuaugcgacauaggggaaucgucaccaaauccaacaauugaggaaggcaggacucuuaggguauugaaaaugguagaaccauggcuaagaggaaaccaguuuugcauaaaaauucugaacccguacaugccuucuguugucgaaacguuggagcaaaugcaaagaaaacauggugggaugcuugugagaaacccgcugagcagaaauuccacacacgaaauguauuggguauccuguggaacggggaacauagugucggcagucaauaugacaucgaggauguuguuaaacagguuuacgauggcacaccgaaaaccuacauaugaaagagacguagauuuaggagcugguacuagacauguugcgguugaaccggaaguugcaaaucuagacauaauaggacaaagaauagaaaacaucaaaaacgaacacaaaaguacuuggcauuacgaugaggacaaccccuauaagacuugggccuaucauggaagcuaugaagucaaacccagcggaagcgcgaguucaaugguaaacgguguugugagacucuugacaaaaccuugggauguuauuccaaugguaacccaaaucgcuaugacagauacuacaccuuuugggcaacagagagucuuuaaagagaaaguugacacuagaacaccgcgagcuaaacgaggaacugcacaaauaauggaagugacagcuaaauggcuuuggggauuucuuucucggaauaagaaaccacgaauaugcacaagggaggaauuuacuagaaaaguaagaucaaaugcagcuaucggagcgguuuuuguagacgaaaaucaauggaacuccgcuaaggaagccguggaggaugagagauuuugggaucuaguucaucgggaacgagaguuacacaagcaagguaaaugugcaacaugugucuauaauaugaugggcaaacgugagaagaaacuaggcgaguucggaaaagcaaaaggaucuagggcaauuugguauauguggcuaggagcuagguuccuugaguuugaggccuuaggcuucaugaaugaagaucauugguuuagucgagaaaauucucuuucaggagucgaaggagaaggucugcacaaacuaggauauauucugcgagauauaaguaaaauaccugguggaaauauguaugcugaugauacagccggaugggacaccagaauaacagaagaugaucuucaaaaugaggcaaaaauuacggacauaauggaaccagaacaugccuuacuagcuacaaguauuuuuaagcuaaccuaccaaaacaagguagucagaguucaaagaccagccaaaaacgguacgguaauggauguaauuucgagacgagaccagcgggggagugggcaaguuggaacuuacggguugaauacuuucacaaauauggaaguucagcuaauuagacaaauggaaucagaaggaauauuucuaccaucugaauuagaaacuccgaaccuugcagagagaguccuugacugguuagaaaagcauggagccgaaagauuaaagagaauggcuauaaguggcgacgauuguguaguaaaaccaaucgaugauagauucgcuacugcgcucauugcccugaaugauauggguaaaguaagaaaagacauaccucaaugggagcccucuaagggauggaaugacuggcaacaaguuccauuuuguucccaccauuuccaucaacuuauaaugaaggauggucgagaaauagucguccccugcagaaaccaagaugagcuaguaggaagggcgagagucagccaaggcgcagguuggagucucagggagacagcuuguuuaggcaagucauaugcucaaauguggcagcuaauguacuuucauagaagagauuugcgucucgcagcuaaugcaaucugcucagcaguaccuauagacuggguaccuacaagccgaacaacaugguccauccacgcacaucaucaauggaugacgacagaggauaugcuuagcguuuggaaccgaguauggauugaggaaaacccuuggauggaagacaaagcacauguaagcuccugggaagaagucccuuacuuggggaaacgggaagaucaauggugcggaagucuaauaggauugacggcaagagcaacgugggcaacaaauauacagguagcgauaaaucagguacggaggcuaaucgggaacgagaauuaccuagauuacaugacuucuaugaaaagguuuaaaaacgaaagugauccugaaggggcucucugg

SEQ ID NO: 22142 - RNA, 9879 nt, Artificial Sequence
  derived and/or modified CDS sequence (opt6) from DENV-1__JF459993__SS-prME
uccgugacgaugcuauuuauguuauuaccuacgagcuuagcauuucacuuaacaacuaggggcggagaaccgcauaugauuguuagcaaacaagaacgaggcaaaucauuauuauucaagacaagugccggcguaaacauguguacguuaauugcgauggaucuuggagaauugugcgaagacaccaugaccuauaaauguccucgaauuacugaaacugaaccagaugacguugauugcuggugcaacgcaacugaaacuuggguaacuuacggcacauguucacaaaccggcgagcauagaagagacaaacgauccguugcauuagccccgcauguaggguuaggucuagagacuagaaccgaaaccuggaugucaucagaaggugcauggaaacagauucagaaagucgaaacaugggcauuagggcacccggguuucaccgucauugcucuauuccuagcgcaugcgauaggcacaaguauaacucaaaaagggaucauauucauccuacugauguugguuacuccaucaauggcgaugcgcuguguuggcauaggcaauagagauuucguagaaggguuaucuggugccacauggguggauguuguauuggagcacggaucaugcgucaccacgauggcaaaagauaagccaacauuggauauugaauuauuaaagacagagguaacuaacccagccauauuacgcaaacucuguauagaagcuaaaauaucaaauaccacaacugauaguagauguccaacgcaaggugaagccacgcugguagaagaacaggauacgaacuuuguuuguaggcggaccuuuguugaucgaggaugggguaacggguguggacuuuuuggcaaaggaaguuuaauaacuugugcuaaauuuaaauguguaacaaaacuggaggggaaaauaguucaauaugagaaucuaaaguacucggucauuguuacugugcacacuggcgaucaacaccaaguggguaacgagacaacagagcaugggacuacagcuacaauuaccccccaagccccaaccucggagauacaacuaacugauuauggagcgcuuacauuagacugcuccccaagaaccggacucgauuuuaaugagaugguuuuauugaccaugaaagaaaaaagcuggcugguacauaaacaaugguuccuggaucuaccguuaccauggacaucaggagcaaguacuucacaagaaacguggaacagacaggaucuccuaguuacauucaaaacagcucaugcuaaaaaacaagaaguaguugucuuggggagucaagaaggagcaaugcauacagcccugacaggggccaccgaaauacaaacaaguggaacuacgacaauauuugcgggccaccucaaaugcagauuaaaaauggauaaacuuacucucaaggggguaagcuaugugauguguacaggaaguuucaaguuagaaaaggaaguagcagaaacacaacauggaacuguccuuguacagguaaaauaugaagguacugaugcuccaugcaaaauaccauucucaucccaagacgagaaagguguaauacagaacggaagauugauaacggcaaaucccauaguuacagacaaggagaaaccaguaaacaucgaagcggaaccaccuuucggagaaucguauaucgucguaggagccggugaaaaagcacuuaaauuaucuugguucaagaaaggaaguucgauaggaaaaauguucgaagcaacagcucgcggagcuagacggauggccauauuaggugacacagcuugggacuucggcucgauaggcgguguauuuacgaguguagggaaauuagugcaucaaaucuuuggaacggcguacggaguccucuuuagugggguuagcuggacuaugaaaauugguauaggcauuuuauuaacaugguuaggauuaaacagcaggucaacaaguuuaagcaugacaugcauagccguaggaaugguuacgcuuuauuuagggguaaugguacaggcagauucugggugugugaucaacuggaaaggucgggaacuaaagugcgguucaggaauauucguuaccaaugaggugcacacguggacggaacaauauaaguuccaagcagauuccccaaaacgccugagugcugcaauaggcaaggcaugggaggagggaguuugcgggauacgaucagcaacacgcuuagaaaacauuauguggaagcaaaucucaaacgaauugaaucauauucucuuagaaaaugacaugaaauuuacuguagucguaggagaugucgcuggaauacuugcacaagggaagaaaaugauccgaccacaaccaauggaauauaaauacucauggaaaagcuggggaaaagcgaaaauaaucggagcggacgugcaaaaugccacauucauaauagacggcccaaacacgccagaguguccugaugaucagcgcgcauggaauauaugggaagucgaagacuacggcuuuggcauauuuaccacaaauauauggcuaaagcuucgagauucuuauacucaaguaugugaccaucgccuuaugagcgcagcgaucaaagacucgaaagcuguccaugcagacaugggguauuggauugaaagcgaaaaaaaugaaaccuggaaacuagcccgugcaucguuuauugaagucaaaacauguguuuggccgaaaagccauacccuuuggucuaacggaguauuagaaucugaaaugauaauuccgaaaauauacgguggcccaauaucucaacacaaucaucggccaggauacuucacccaaacugcugggccuuggcaccugggaaaauuggaacuggauuuugaucuaugcgaaggaacaaccgucguagucgacgaacauugugguaauagagggccaucacuuaggacuacaacaguaacugguaaaauaauucaugaauggugcugccgaagcuguacgcuaccaccucuccgauuuagaggcgaagacgguuguugguacgguauggaaauaaggccaguaaaggaaaaagaagagaauuugguaaaaaguaugguaagcgcagguuccggagaaguagacaguuuuucauugggccuauuaugcauaucuauaaugauagaggaaguaaugagaaguagauggagucguaaaauguugaugacgggaacuuuggcuguauucuuucuauuaauaauggggcaauuaaccuggaaugauuuaauaagacuauguauaaugguaggugccaaugccucggacaggaugggaauggggacgacuuaucuggcauuaauggcuacuuuuaaaaugagaccuauguuugccgugggacuauuauuucgacgguuaacaagccgagaagucuuguuauuaacuauaggacuaucgcuuguugcaucggucgagcugccaaacagcuuggaagaacuuggcgacggguuggcuauggguauuaugauacuuaaguuauugacugauuuccaaucccaucaacugugggcaacucuccucucgcuaacguucauaaaaacaacguucagucuccauuaugcauggaaaacuauggcaaugguauuaucgauuguuaguuuauucccucuaugucuuucuacgacaucucaaaaaacgaccuggcuaccaguccuauuagggucccucggaugcaagccccuaacaauguuccugauugcagaaaauaagauuuggggcaggaagagcuggccacuuaaugaggggauaauggcaguaggaauugugucuauuuuauuaucgucacuauugaagaaugacguaccucuagcaggcccacucauugcaggaggaaugcucaucgcguguuacguuauaagcggcucgagcgcggaccucucuuuagaaaaagcagcagagguuucaugggaagaggaggcagagcauucuggugccagucauaauaucuuaguggaggugcaggaugacggaacgaugaagauuaaagacgaagaaagggaugauacuuuaacaauucuauuaaaagcgacccuguuagcagucaguggaguauauccucuaucaauacccgcaacauuauucguaugguacuucuggcagaaaaaaaaacaaagaagcgggguacuaugggacacucccaguccacccgaagucgaaagagcaguauuagacgacggcauuuacaggauaaugcagcgaggcuugcuagguagaucccaaguuggaguaggaguauuccaggaaaacguguuccauacaauguggcauguaacucgaggugccguccuaauguaccaaggaaaaagacuagaaccaucgugggcaagcgugaaaaaagaccugauaagcuacggaggaggauggagacuacaaggaaguuggaauacuggagaagaaguacagguuauagcugucgaaccugguaaaaaucccaagaacguacaaacagcaccaggaacauucaagacgccugagggagaaguuggagccauugcacuagauuuuaagccaggcacuagcgguagcccaauaguuaacagggaaggaaaaauaguuggguuguacggcaacggagucgucacuacaaguggcacauacgugagugcuaucgcucaagcaaaagcaucacaggaaggaccucucccagaaauagaagacgagguauucagaaaaaggaaccuuacgauaauggacuuacacccgggcucugggaaaacccgaagauaucuaccggcgaucguucgagaagccaucaaaagaaaacugagaacgcugauccuugcacccacacgaguagucgccagcgagauggcagaagcauuaaaagguaugcccauuagauaccaaacaacugcgguuaaaagcgagcauacugggaaggaaauuguggaucuuaugugccaugcaacauuuacuaugcguuuacugucgccggugagaguacccaauuacaacaugauaauuauggacgaagcccacuuuaccgacccuaguaguauugcagccagagguuacauuucuacccguguuggaaugggcgaagcagcugcuauuuuuaugacagcgacgcccccggguaguguggaagccuuuccgcaaucaaaugcaguaauccaagaugaagaacgugacauucccgaaaggagcuggaauuccggguaugaguggauuaccgauuuuccugguaaaacagucugguucgucccuagcauaaaaaguggaaacgauaucgccaacugccugcgcaaaaacggcaaacggguaauucaauuaaguagaaagacauucgacaccgaauaccaaaagacgaaaaacaaugauugggauuacguaguaacuacugauauuagcgagaugggugccaauuucagagccgaucgagucaucgauccaagacgauguuuaaaaccagugauucucaaagauggaccagagcgcgucauacuugccgguccaaugccggugaccguugcaucggcggcacaacgacgaggcaggauagguaggaaccauaauaaagagggcgaucaauauauauauaugggucaaccuuuaaacaacgacgaggaucaugcacacuggacugaagcaaaaaugcugcuagacaacauuaacaccccagagggcauuauaccagcuuuauuugaaccagaacgcgagaaaagugcagcaauugacggcgaauacagauuacgaggagaggcgaggaaaacuuuugucgaauugaugcgaagaggagaccuuccaguauggcuaucuuacaaaguugcuucagaaggguuucaguauucagaucgacguugguguuuugauggugaaaggaauaaccaaguuuuggaagaaaacauggacguugaaaucuggacuaaagaaggggaacguaaaaagcuccgaccaaggugguuagaugcacgaacauacucggacccacuagcguuaagagaauucaaagaauuugcugcagggaggagaaguguuagcggggaucugauacuugagauaggaaaacugccccagcacuuaacacaacgagcccaaaaugcccuugacaauuugguuaugcuacacaauucagaacaaggagguagggcauacaggcaugcccuagaagaguuacccgauacaauagaaacauuaaugcuauuagcguugauagccgugcuuacgggaggaguaacuuuauuuuucuuaucaggaagaggguuaggcaaaacaagcauagggcugcuaugugugauggcuagcucggcacugcuuuggauggcaucuguagaaccucauuggauagcagcuuccaucauucuggaguucuuccuaaugguacuauuaauaccagaacccgaucggcaacgcacaccgcaagauaaucaauuagcauacguaguaauagguuugcuguucaugauucugacgguagcugcaaaugaaaugggcuuguuagaaacgacgaaaaaagauuugggaauugggcacguagcgguggaaaaucaucaucacgcguccaugcuagauguugauuuacacccugcgucagcauggacacucuacgcgguugcaacuaccaucauuacaccuaugaugaggcauaccauagagaauacaacugcuaauauaagucuuacagcgauagccaaucaggcagcaauacucaugggucuugauaaaggauggccaauaucaaagauggauauuggagucccacuacuggccuuagggugcuacagccaggucaauccauuaacauugacagcugcgguauuaauguuaguugcgcauuaugcaauuauugggcccgggcuucaagcaaaggcuacgcgagaggcacaaaaaagaacagcugcaggaauaaugaaaaauccaacaguugaugggaucguugcgauagaccuagauccuguagucuaugaugccaaauucgaaaaacaacugggacaaauuauguuguugauuuuauguacuagccaaauacuacuuaugcgaacaacaugggcguuaugcgagaguauaacccuugcuacaggaccccucacuacacucugggaaggcucaccgggaaaauucuggaacacaacaaucgccgugaguauggcaaacauauuccgaggaagcuauuuagccggagcaggacucgccuuuagucucaugaaaucauugggaggaggcagacguggaaccggugcacaaggugaaaccuuaggugaaaaauggaaaagacaauugaaucaacuuucgaaaucugaauucaauacauacaaacguagugguauaauggaagucgaucgaucagaagcaaaggaaggucuaaagcguggggaaacaaccaaacaugcagucagucgagguacugcaaaauuaagaugguucgucgagaggaaucuaguuaaaccagaagguaaggucauagaccuggguugugguagagguggguggucauauuacugcgcaggccuaaaaaaaguuacagagguuaaaggcuauacaaaaggagggcccggacacgaagaaccaauaccaauggcuaccuaugguuggaacuuaguuaagcuucacaguggcaaggaugucuuuuucaucccgccggagaagugcgauacuuuacuaugcgacauaggugaaaguagcccaaauccgaccauugaggaagggaggacacuucggguucuaaaaaugguugaaccauggcuacgaggcaaucaauucuguaucaaaauacuaaacccauauaugccgaguguugucgaaacucuagaacagaugcagagaaaacauggugguauguugguacgaaacccccuaagucgaaacucaacccaugagauguacuggguaucgugcggaaccggaaauaucguuagugcuguuaauaugacaagucguauguuguuaaauagauuuacuauggcccaccguaaaccuacauacgaaagagauguugacuuaggagcagggacucgacacgucgcaguagaaccggaaguagcuaauuuagauauuauuggacaaaggaucgagaauauuaaacaugagcacaaaaguaccuggcacuacgaugaagauaauccguacaaaacgugggccuaucacggaucauaugaaguaaaaccgaguggaagugcaucaagcaugguuaaugguguaguuaagcuauuaacaaaaccuugggacgucauacccauggucacacaaauagcaaugacagauacaaccccuuucggacaacagcgggucuucaaagaaaaaguggauacccggacucccaaagccaaaagaggaacugcccagauaauggaagucacagcacguuggcuuuggggcuuccuuucgagaaauaaaaaaccuagaauuuguacacgcgaggaguucacccguaaaguuaggaguaaugcagcuauuggagcgguguucguugaugagaaccaauggaauucagccaaagaggcuguagaagaugaaagauuuugggauuuaguacaucgggaacgggaacugcauaaacaagguaagugcgcuaccuguguauauaauaugaugggcaaacgagagaaaaaacugggcgaguuugguaaagcaaaaggaucuagagcuauaugguauauguggcuuggugcaagauuccuagaauucgaagcauuaggguuuaugaaugaggaccacugguuuaguagagagaacucacugucggguguugagggggaagguuuacauaaauuaggauacauuuuaagggauauaaguaaaauuccaggaggaaauauguaugcagacgauacugcaggaugggacacgcggauaacggaagaugaucuucaaaacgaagcgaaaauaaccgacaucauggagccagagcaugcccuucucgcaaaaucuauauucaaauuaacuuaucaaaauaagguaguucgugugcaaaggcccgccaaaaaugguacaguaauggacguuauaagucgacgagaucaaagaggguccggucaagucgggacguauggccugaauacuuucaccaauauggaagcacagcucauaagacaaauggaaucugaagaaauuuuuucacccucagaauuagaaacuccaaacuuggcagaaaggguacuagacugguuagaaaaauauggaguggaaagauugaagaggauggcuauaaguggagacgauuguguggugaaacccauagaugauagauuugcgaccgcucuaacggcucuuaacgauauggguaagguaagaaaagacauaccucagugggaaccaaguaaggguuggaacgacuggcaacaaguuccauuuugcagucaucacuuucaucaauugauaaugaaggauggacgggagguuguaguuccauguagaaaccaagacgaauuggucggucgagcaagagugagucagggcgcaggauggucauuacgcgaaacugccuguuuaggaaagaguuaugcacaaauguggcagcuaauguauuuucaucgccgggaucugagacuugcagcaaacgcgauuugcucugcaguaccuguugauugggugccuacauccagaacuacaugguccauccaugcacaccaccaauggaugaccacggaagauaugcuaucuguuuggaaucggguguggauagaggaaaacccauggauggaagauaaaacucauguuaguagcugggaagauguaccguaucuuggaaaaagagaggaucaaugguguggcucuuuaauuggauugacugcacgagcuacaugggcaacaaacauacaaguagcaauuaaccaaguaagaagauuaauaggaaacgagaauuauuuagauuacaugacuucaaugaaacgauucaagaacgagucugacccagaaggugcauuaugguaa

SEQ ID NO: 22143 - RNA, 9876 nt, Artificial Sequence
  derived and/or modified CDS sequence (opt6) from DENV-1__KF672763__SS-prME
ucaguuacuaugcuacuaauguuacuacccacugcucuagcuuuucaucuaaccacucgggguggcgaaccgcacaugauagucucuaaacaagaaagagguaaaucucuccuuuuuaaaacuuccgcugguguaaauauguguacguugaucgcaauggaucuaggagaauugugugaagauacuaugacguacaaaugcccaagaauaacugaagcagaaccagaugacgucgauuguuggugcaaugccacugauacuuggguuacauacggaacaugcagccaaacuggcgaacacagacgggacaaacgaucuguugcauuggcaccacacguaggucuuggacucgaaacgagaacugaaaccuggaugaguagugaaggggcauggaagcaaauucaaaaaguagaaaccugggcauuaagacauccaggcuucaccguuauugcucuauuuuuagcacaugcuauagguacaaguauaacacaaaaagggauaaucuuuauucuucucauguuaguaacaccaucgauggcaaugagauguguaggaaucgguaaucgagacuuugucgaaggccuuaguggggcuaccuggguggauguuguguuagaacauggcuccuguguaacaacaauggccaaaaauaaaccuacuuuagauauagaacuuuuaaaaacugaagugacuaacccugccguucuaagaaaacuuuguauagaagcaaaaauauccaacacuacaacggauucgagauguccgacccaaggagaagccacauuaguggaagaacaagacgccaauuucgucugcagaagaacuuuuguagacaggggauggggcaauggauguggacuauuuggcaaaggcuccuuacuaacuugcgcaaaguuuaaaugugugacaaaauuagaaggcaaaauagugcaauacgaaaaccugaaguacucagugauaguaacuguacauacaggagaucaacaucaagucgguaaugaaaccacugaacauggaacaaucgcuacgauaacaccucaagcaccaacaucagaaauacaauuaacagauuacggagcacuuacuuuagauuguucaccgagaacggggcuagauuucaaugaaaugguacuguuaacgaugaaagagaaaucauggcucguacauaaacaaugguuuuuagaccugccauugccguggacaaguggagcuaguacaucucaagagacuuggaauagacaagauuuguuggucacauuuaaaacugcucaugccaagaaacaagaagucgucguauuagggucccaggagggggcuaugcauacagcauuaacaggugccaccgaaauacagacaucugguacuacuaccauuuuugcaggacacuuaaagugcagacugaaaauggacaaacuuacguugaaagguacgucuuacguuaugugcacuggcucuuuuaaacucgaaaaagaaguugcagagacacagcauggaaccgugcuaguucagguaaaauaugaaggcacagacgcgccuugcaagauccccuucucgacacaagacgaaaaaggaguaacgcaaaacggucgccuaauuaccgccaacccaauaguaacagacaaagaaaagccuguuaacauagagacagagccgccauuuggggaaaguuacauaguaguuggcguuggagaaaaagcucuuaaacuuucaugguuuaagaaagguaguucuauuggcaagauguucgaggcaaccgcucggggagcuagacgaauggcaauauuaggagauacugcaugggauuucggaucuauugggggaguauuuacaucuguaggcaaauuaguacaccaaguauuugguacugcguacggagugcuuuuuaguggaguuagcuggaccaugaaaauaggcaucggaaucuuacuuacaugguuagggcucaauucaagaaguacuagccuuucuaugacguguauagcgguugguaugguuacccuauaucugggaguaaugguucaagcggauucagguugcgucauuaacuggaaaggucgagaauuaaaauguggauccgggauuuuuguaacaaaugaaguucacacguggacagaacaguauaaauuucaagcagacucgccaaaaagauuguccgcagcaaucgggagagcaugggaagaaggcgugugcggcauccgaagcgcuacucgcuuagagaacaucauguggaaacaaauaucaaacgaguuaaaccacauauuguuagaaaacgauauaaaguuuacaguuguuguaggaaaugcugacgguauucuagcacaagggaagaaaaugauaagaccucagccaauggaacauaaauacagcuggaaaucguggggcaaggccaagauaaucggggccgauauacagaauacuaccuuuauaauagacgggccugauaccccugaaugcccagaugagcaaagagcauggaacauuugggaagucgaagacuauggcuuuggaaucuuuacuacuaauaucuggcuuaaacuucgagacucuuacacgcaaaugugcgaucaccgucugaugucagccgccauaaaagacagcaaagccguucaugcagacaugggauauuggauugaaucggagaaaaaugagacauggaagcuagcaagagcgucauuuauagaagucaagaccugcauuuggccaaagucccauacguugugguccaauggaguucuagaaucagaaaugauaauuccaaaaauguauggagguccaauaucgcaacacaacuaccgaccuggauauuuuacacagaccgcagggcccuggcacuuagggaaacuagaauuagacuuugaccuaugugaagguaccacaguggucguugacgaacauugugguucacgaggacccagcuuacgaacaacaacuguuacuggaaagauaauacaugaaugguguugucgcucaugcacacuuccaccuuugagauuucggggugaggacggaugcugguauggaauggaaaucaggccagucaaagaaaaagaagaaaaccugguaagaucaauggucagugcagguucaggggaagucgacagcuucucacucggaauauuaugcguaagcauaaugaucgaggaaguuaugagaucucgcuggucuagaaagaugcuuaugacaggaacucuagcgguguuucuacucuugaucaugggacaauuaacauggaaugauuuaauuagacucuguauuaugguaggagcaaaugccucagauaaaaugggcauggggacuacauaucucgcgcucauggccaccuucaagaugaggcccauguuugcaguagguuuauuauuuagaagauugacauccagagaaguuuuauuguuaacuauugggcuaaguuuaauggcaucagucgaguuacccaauucccuugaagaacugggcgauggacuggccaugggaauuaugauguuaaagcuauuaacugaauuucagccucaucaauuguggacaacgcucuugucccugacguucaucaaaacaacauuaucgcuagauuacgcauggaaaacgacugcaaugguacugagcauaguaagucucuucccucuaugccuaaguacgacgucucagaaaaccacgugguuaccuguuuuguuagguaguuuuggauguaaaccauuaaccauguucuuaauaacugaaaaugaaauaugggggcggaaaucauggccacucaacgagggcauaauggcuauugggauuguaucgauacuuuuaucauccuugcugaaaaaugacguuccuuuagccgguccacuaauagcaggaggaauguugauagcuuguuacguaauuucuggaagcucggcggaucucucgcuagaaaaagcugcagaagucucaugggaagaagaagccgaacacaguggaacaucgcacaauauauuagucgaaguucaggaugacggaacaaugaaaaucaaagaugaagaacgcgacgacacacuaacuauccuacuaaaagcaacauuacucgcugucuccggagucuacccgaugaguaucccagccacccuauuugugugguacuucuggcagaagaagaaacagcgaucugguguucuaugggacacaccgaguccacccgagguagaacgugcaguuuuagaugacggaauauaccggauuuuacagcgaggcuuauuggggcgcagucaggugggcguaggcguauuucaggacggaguauuccauacuauguggcaugugacacguggagcuguguuaauguaucaagguaaacgacucgaacccucaugggcaaguguaaagaaagauuuaauuagcuauggaggugguuggagauuccagggcaguuggaacacgggcgaagagguacaagugauugcuguagagccugguaagaauccgaaaaacguacaaaccacgccagggaccuucaaaacccccgaaggagaagugggcgccauugcacuagauuuuaaaccugguacaucagguaguccaauagugaauagagaagguaaaauuguaggucuauacgguaacggaguuguaacaaccucagggacguauguuucugcaauagcacaagcaaaggcaagucaggaagguccccugccagagauugaagacgaagucuuuaagaagcgcaacuuaacaauaauggauuuacacccgggaucagguaaaacgcguagguacuuaccagcuauugugagggaggccauaaagcguaaauugagaacauuaauccuggcucccacaagaguaguagccucugaaauggcagaagcauuaaaagguaugccuauuagauaccaaacaacggcaguuaaaagcgaacauacgggaagggaaauaguugaccugaugugucaugccacuuucacgaugaggcuccuaaguccuguacgagugccgaauuacaauaugauaauaauggaugaagcacauuuuacagacccggcuucaauugcagcaagaggauauaucaguacgagagugggcaugggggaagcagcugcaaucuuuaugacagccacgccaccagguagcguagaagcauucccgcaaagcaacgcggucauucaagacgaagaaagagauauaccagaacgaucauggaacuccggguaugauuggaucacagacuuuccgggaaaaacaguaugguucgucccuaguauaaagucaggcaaugacauugcuaauugccuacguaaaaacggaaaacggguaauacaacugucacgaaaaacauuugauaccgaauaucagaaaaccaagaauaacgacugggacuacguagugacuacugacauaucagaaaugggugcaaauuuuagggccgaucguguaauugauccaagaaggugucuaaagccaguaauacuaaaagacggaccugagagaguaauacuagcaggaccgaugccugugacgguugcuucagcagcacagagacgaggacguaucggucgaaaucaaaacaaggaaggcgaccaguaugucuauaugggccaaccccucaacaacgacgaggaucaugcgcacuggacagaagcuaaaaugcuacucgauaacaucaacacaccagaagggauaaucccagcuuuauuugagccagaacgugagaaaagugcugcgauagauggggaauacaggcucagaggggaagcucgcaagacuuuuguagaauuaaugcgaagaggugaccucccggucuggcuaagcuauaagguggccagugaaggcuuucaguacagugaucggagguggugcuucgacggagaacgcaauaaccaaguacuugaagagaauauggauguggaaaucuggacgaaagaaggagagaggaagaaacuacgaccaagaugguuggaugcucgcaccuauucugacccucuagcauuaagagaauuuaaagaauuugcagcuggacgaaggucggucuccggugacuuaauauuagaaaucggaaaacuuccucaacauuuaacacuaagagcacaaaaugcccucgauaaucuuguaauguuacauaauucggaacaaggagggaaggcauacaggcacgcgauggaagaacucccugauacaaucgaaacauuaaugcuauuagccuugaucgcgguacuaacgggaggcgugacauuauuuuucuugaguggaaagggcuuagguaaaacaucuauugggcuacucugugugaccgcuucaucagcgcuacuguggauggccucaguagaaccucauuggauagcugccagcauaauucuagaguucuuucuaaugguccuucuaaucccagagccagauagacagagaacaccacaggacaaucaauuagcuuauguagugaucgggcugcuuuuuaugauuuuaacaguagcggcaaacgagauggggcuuuuagaaacuacgaagaaagauuuagggaucggacauguagcugcugagaaccaccaacacgcaacuaugcuggacguugauuuacauccagcaucagcuuggacucucuaugcaguagcgacgaccguaauaaccccaaugaugcggcauacaaucgagaauacaaccgcaaauauaucacuuacagcuauagcgaaucaagcugcaauacucauggguuuggacaaaggcuggccuaucucuaagauggauuuaggagucccccugcuggcucuagguuguuauucacagguaaauccauuaacgcuaacugcagcuguauuaaugcuuguugcucacuaugcaauuauagggcccggacuucaagccaaagcgacccgcgaagcccaaaaacggaccgcagccggcauaaugaaaaauccaacaaucgacgggauaguagccauagaccucgauccugucguguaugacgcaaaguuugaaaagcaacuaggacaaaucauguuacuaauacuaugcacaucacaaauacuauuaaugagaacaacuugggcauugugugaaucgauuacacuagcuacgggacccuugacuacacuaugggaagguaguccggguaaauuuuggaauacaacaaucgcagugaguauggcaaauauauuucggggcuccuaucuugccggagcgggucuagcuuuuagucuaaugaaauccuuaggaggaggcagacgggggacuggagcgcagggugagacuuugggggagaaauggaaaagacaauuaaaucagcuuaguaagucugaauuuaacacuuacaaaagauccgggauuauggaaguagacaggucagaagcuaaagaggguuugaaaagaggagaaacuacuaaacacgcggugucgcgaggaacagcaaaacugcgaugguuuguggaaagaaaccuagugaagccagaaggaaagguaauugauuuaggguguggccgaggaggauggaguuauuauugugcuggauugaagaaagucacagaaguaaaaggcuauaccaagggaggaccagggcacgaagaaccgauacccauggcaacauauggauggaaucuagucaaguuacauuccgggaaggacguauucuuuaugcccccugaaaaaugugacacucuucuaugcgacauaggcgagucaucgccaaauccaacaauugaagaagggagaacuuuacggguucuaaaaaugguagagccauggcugcgugguaaccaguuuuguaucaaaauuuugaauccuuauaugcccucugucguugaaacgcuagagcaaaugcaacgcaaacauggugggauguugguacggaauccacuaagccgaaacagcacacacgaaauguauuggguaucaugcggaacgggaaauauaguuagcgcagugaacaugacuucucguaugcuucugaaccguuuuacgauggcucauagaaaaccgacauaugaaagagauguagacuuaggggcuggaacaaggcaugucgcuguugaaccugaggucgcaaaucucgauauaauaggacagcgaauagagaacaucaaaaaugaacauaagucaacguggcauuacgaugaagacaauccuuacaaaacaugggcauaccauggaucuuacgaaguaaaaccgagcggaucagccucaucaauggugaacggcguuguaagauuacugacuaaaccaugggaugucauaccuauggucacacaaauagcaaugacggauaccacgccauucggucaacaacgugucuuuaaggagaaaguagacacgcgaacacccagagcaaaaaggggaacugcacagauaauggaagucacugcaaaauggcuauggggcuuuuuaucaaggaacaagaaaccacguauaugcacucgcgaagaguucacaagaaaagugcguaguaacgcagcaaucggcgcaguauuuguggaugaaaaucaguggaacucagccaaagaagccgucgaagacgaaagauuuugggauuuagugcauagagaacgagaauuacauaaacaagggaaaugugcgacaugcguuuauaacaugaugggaaaaagggaaaagaaacucggagaguucggaaaagcaaaaggaucaagagccaucugguauauguggcuaggagcacgcuuccucgaauuugaggcguuagguuuuaugaaugaagaccacugguucaguagggaaaacucacuaucagguguugaaggcgaaggucuccacaaacuaggguacaucuuaagagauauuucgaaaauuccagggggcaacauguacgcagaugauacggccggcugggacaccagaaucacugaggaugaucuucgcaaugaagcaaaaauuacagauauaauggaaccggaacaugcgcuacuagcaacaagcauauuuaaacuuacauaccaaaauaagguagucagggugcaaagaccagcuaaaaauggaacuguuauggauguaaucucaagacgggaucaaaggggcuccggccaaguagguacauacggauuaaauaccuucacuaauauggaaguacaauuaauucgacaaauggaaucagaagggaucuucuuuccuucagaacuagaaucaccgaauuuagcugagagagugcuggacugguuagaaaaacacggggcagagagacuaaaacguauggcaauaucuggcgacgacuguguaguuaaaccuauagacgacagauucgcaacggcacugauagcacuuaaugacaugggaaaaguacguaaggauauuccacaaugggaacccucaaagggauggaaugacuggcaacaagugccuuuuuguucucaucacuuccaccaauuaaucaugaaagacggccgugaaauaguuguuccaugccguaaccaggaugaacucguuggacgugcucgagugucacagggcgcgggauggagcuuacgagaaacagcuuguuuaggaaagucguaugcacaaauguggcaacucauguauuuccacagaagagaccuacguuuagcagcuaaugcaauauguucugcaguaccaguugauugggucccaacgaguagaaccacuuggaguauacaugcucaucaccaauggaugacuacggaagacauguuauccguuuggaaucgaguuuggauugaagaaaacccauggauggaagauaaaacacacguuagcucuugggaggaagugccguaucucggaaaaagagaggaucaauggugugggagucucauaggacuaacagcacgagcaacaugggcaaccaauauccagguggcaauaaaccaaguacgaagacuuauagggaaugaaaauuacuuagacuacaugacauccaugaaaagauuuaaaaacgagucugacccugagggggcacuaugg

SEQ ID NO: 22144 - RNA, 9876 nt, Artificial Sequence
  derived and/or modified CDS sequence (opt6) from DENV-1__KF672764__SS-prME
ucaguuacaaugcugcuaaugcugcuacccacagcacuugcauuccaucugacaacgagggguggagaaccucacaugauagugucaaaacaagaacgagguaaaucacuccuauuuaaaacaucugcaggaguaaauaugugcacccuuauagcaauggauuugggugaacugugugaagauacgaugaccuacaaauguccacggauaacagaagcugaaccagaugauguugauuguugguguaacgcaacagacaccuggguaacauacggaacauguucucagacaggugaacaccgaagggauaaaagaagcguggcauuagcaccacauguagggcucgguuuagagacaagaacugagacauggaugucaucagagggcgcauggaaacagauacaaaaaguagagacgugggcauuacgucacccugguuucaccguaauugcacuauuuuuggcgcacgcaauaggcaccaguauuacacagaaaggaauuauauuuauccuccucauguuaguaacaccuaguauggcaaugagaugugucgguauaggaaauagagauuuuguagaaggcuugucuggugcuacauggguagauguaguuuuagaacauggcucaugcgugacgacaauggccaaaaauaaaccaacauuagauauagaauuacuaaaaacagaaguuacaaauccagccguguuaaggaaacuguguaucgaggcgaaaauuucaaacacuacuacugauagccggugcccaacccaaggugaggcaacccuaguagaagaacaggacgccaauuucguaugccggaggacauucguugaucgcggauggggaaaugggugcggccuauuugggaaaggaucgcuauugacuugcgcgaaauuuaaaugcguuacaaaauuagaagggaaaauaguccaauaugaaaaucuaaaauauucugucauaguaacuguccauaccggagaccagcaucaaguugggaaugaaacuacugaacauggaacaauugcgaccaucacuccacaggcuccuacaagcgagauacagcugacggauuacggagcacuuacauuagauuguagcccaagaacaggauuggauuucaacgaaaugguucuacucacuaugaaagaaaaaucauggcuaguacauaaacagugguucuuagaucuaccucugccauggaccaguggggcuucaacaagucaagaaacuuggaaucgucaagauuuauuggucacauuuaaaacggcacaugccaagaaacaggaagugguaguauuggguucacaggaaggcgcgaugcacacagcgcuuaccggagcaacugaaauacagacgucuggaacaacaacaauauucgcgggccaucuaaaaugcagauugaaaauggauaaauuaaccuuaaaaggcaccucauacgugaugugcacugggucauucaaauuagaaaaagaagucgcggagacucaacaugguaccguuuuaguacaggucaaauaugaaggaacugaugcuccgugcaagauuccuuucaguacgcaagacgaaaaaggagugacgcagaauggacgucugauaacugcuaauccuauugucacugauaaagagaaacccguaaacauugaaacagaaccgcccuucggagaaucguauauuguuguuggugcuggggaaaaagcauuaaaauugucaugguucaagaaaggaucauccauaggaaaaauguucgaagcaaccgcaagaggggcacgacgaauggcuauauugggugauacggcaugggauuuuggaucgauagggggagucuuuacgaguguagguaaacugguacaucaaguguuuggaacagcauauggaguucuauucucugggguuucauggaccaugaagaucggaauaggcaucuuacuaacuugguuaggccucaauagccgaagcacaucccuaucuaugaccuguauugcggugggaaugguaacauuguaucuaggaguaaugguacaggcagacucagguuguguaauaaacuggaaagguagggaauuaaaaugugggagugguauuuuuguuacuaacgaaguccauacuuggacagagcaguacaaauuucaggcagauucaccaaaaaggcuuagugcugccauugggagagcuugggaagaaggaguaugugggauccguagugcaacacgauuagaaaauauuauguggaagcaaauaaguaaugaacuaaaucacauuuuauuagaaaaugacaucaaguuuaccguuguuguagguaaugccaauggaauacucacacaaggaaagaaaaugauacggccacaaccuauggaacacaaauauagcuggaaaucauggggcaaagcuaaaauaauaggagcagacauucagaauaccacguuuauaauagauggacccgauacuccagagugcccggaugagcaaagagcguggaauauuugggagguagaagacuauggauucggaauauucaccacuaauauauggcucaaacuucgggacaguuacacacaaaugugugaucaucgauuaauguccgcugcaauaaaagauagcaaagccguucaugcagacaugggauacuggaucgagagugagaaaaaugaaacauggaaguuagcgagggcgucauucauugaagugaaaaccuguauuuggcccaaaucacacacacuauggaguaaugggguauuagaaagcgaaaugauaaucccaaaaauguacggaggaccuauaucccagcacaauuaucggccuggcuauuuuacccagaccgcuggacccuggcaccuagggaaauuagaacuggauuuugaucuaugcgagggaacaaccguaguuguugaugaacacuguggaucgcgugguccauccuuacgaacuacaacaguaaccggaaaaauaauccaugaguggugcugucguucguguacauuaccuccucuuagguuuaggggagaggacggaugcugguaugguauggaaauucgacccgucaaagaaaaagaggaaaaccuagugaaaucaauggugucugcuggaucaggagaaguggacucguucucccuagggauacucugcgugucgauaaugauugaagaaguuaugagaaguagauggagucgaaaaaugcugaugacggggacacuagcgguuuuucuacuuuuaaucaugggucaacuaacguggaaugaccugauucgacugugcauaauggucggcgcaaaugccagcgauaagaugggaaugggaacuacauacuuagcauuaauggcuacauuuaagaugcgacccauguucgcuguaggccuguuguuuagaagguuaaccucgagggaaguacugcuacucacaauugguuuaucauuaguggcaucggucgaauuaccuaauagccuugaagaacuuggggauggacuggccaugggcauuaugauguugaaacuccuuacugaauuucaaccucaucaauuguggacaacauuauugucacuaacauuuauaaaaacaacacuuagcuuagauuacgcuuggaagacgacagcaaugguacuuagcaucgucagcuuauuuccucuuuguuuaaguaccacgucacaaaagaccacuugguuaccagucuuauuagguucauuuggauguaaaccauuaacgauguuucugauaacagaaaauaagauauggggaagaaaaucauggccucuuaaugaagguauuauggcaaucggaauagugagcauauuauuaagcucuuuacuaaagaaugauguaccucuagcuggccccuugauagcaggcggaaugcugauagcgugcuacgucauuucuggauccucggcugaucucagcuuagagaaagccgcagaaguaucuugggaagaagaagccgaacacucgggcacgucacauaacaucuuaguagaaguccaagaugacgguacuaugaagauuaaagaugaagagagagaugacacacuaacuauacuucuuaaagcaacucuacuggcagugagugggguauacccaaugagcauaccagcgacuuuauucguaugguauuuuuggcagaagaagaaacagaggucaggcguccuaugggauacaccuucgccuccagaaguugaacgagcuguacucgaugacggaauauaccgaauccuacaaagaggcuuauuaggacggagccaaguuggcguugguguuuuucaagauggaguauuccacacgauguggcacguaacuaggggugcgguccuaauguaucaagguaaacgcuuagagccaaguugggccagcguuaagaaagauuuaauuucauauggagguggcuggagguuucagggaucauggaacacuggagaagagguucaaguuauagcuguagagccuggcaaaaauccgaaaaacguucagacuacgcccggaacguucaaaacaccagaaggcgaagucggagcaauugcacuugauuuuaaaccggggacaaguggauccccuaucguaaaucgagaaggcaaaauaguagguuuauacgggaacggagugguaacaaccaguggcaccuacgucagugccauugcucaggcaaaggcuucucaagaggggccauuaccagagauagaagaugaaguuuucaagaaaagaaaucugacuauaauggaccuucauccaggaucugggaaaacaagacguuaucuuccagccauaguuagagaagcaauaaaaagaaaacuucgaaccuuaauucucgcacccacaagagucguggcaucugaaauggcagaagccuugaaagggaugccuaucagauaucaaacaacggcugugaaaucagaacauacuggacgcgagauagucgacuuaaugugccacgcaacauucacaaugagacuauuaucaccgguuagggugccaaacuauaauaugauuauaauggacgaggcgcauuuuacagaccccgcuagcauugcugcaagaggcuauauaucaacucgaguuggaaugggugaagcugcugcgauauuuaugacggcaacaccaccaggaaguguagaggccuucccgcaguccaacgcaguuauucaagaugaagagagagauauacccgaacgcuccuggaacucuggauaugacuggauaacugauuuuccugggaagaccguaugguuuguaccuagcauaaaaagcggaaaugacauugcaaacugcuuaaggaaaaaugggaagagaguuauacaauuaucacgaaaaaccuucgacacagaauaccagaaaacuaagaacaacgacugggauuauguagucacaacggauauuucugaaaugggggcaaauuuucgugcagacagaguuauagauccaagaagaugccucaaaccgguaauauugaaagaugguccugaaagaguaauacucgcugguccaaugccgguuaccguagcaucagcggcccagcggcgagggcggaucggcagaaaucaaaauaaagaaggcgaucaauacguguacaugggacaacccuugaacaaugaugaagaucacgcgcauuggacagaggcaaaaauguuauuagacaacauaaacacccccgaagggauaauucccgcauuauucgaaccugagcgagagaaaagugcugcuauagacggggaauaucgucuaagaggagaggccagaaagacuuucguugaauuaaugcggcguggugaucuacccguaugguuaucguauaaaguugccagugaagguuuucaauauucagauagaagguggugcuuugacggagaaagaaacaaccaaguuuuggaagaaaacauggauguugagauauggacgaaggagggugaaagaaagaaacuacgcccaagauggcuugaugcccguacauauucugacccacucgcucuaagagaauuuaaggaguuugccgccggacguagauccguuagcggagaucuuauucucgaaauuggaaaacugccacagcaccucacauuaagagcacaaaacgccuuagacaaucuaguaauguugcacaauucugaacagggcggaaaggccuaucgacaugcaauggaagaacugccagauacaauagaaaccuuaauguuacuagcccuaauagcaguuuuaacuggaggagugacauuauucuuuuuauccggaaaagguuuaggaaagaccucuauuggacucuuguguguaacagcuaguucagcacuuuuauggauggcuucaguagaaccccauuggauugcugcuuccauaauauuagaauuuuuccucauggucuuacucauuccugaaccagauagacagcgcacaccccaagacaaccaacuugcauacgucgugauaggacuauuauuuaugauauuaacuguugccgccaacgagaugggacugcuugagacaacuaagaaagaccucggaauuggucauguggcagccgagaaucaucagcaugcgacaauguuagacguggauuuacauccggcuucagcauggacucucuaugcuguugcuacgacaguuauaacacccaugaugagacauacaaucgagaauacaacggcaaauauuucacuuaccgcuauugcaaaccaagccgcaauucugaugggccuagauaaaggauggccgauaucaaaaauggaccuaggggugccccuacuagcucuaggguguuacagucaagugaauccauuaaccuuaacugcugcuguauuaauguuggucgcccauuacgcaauuauagguccuggauugcaagcaaaagcaacacgagaagcucaaaaacgaacugccgcaggaauuaugaaaaacccaacaguggaugguauaguggcaauugaucuugauccaguaguauaugacgcgaaguuugaaaaacaauuaggacaaauaaugcuccuaauacuuuguaccucacaaauacuucuaaugcggacaacaugggcauuaugugaaucuauuacauuggcuacaggaccacuuacgacauugugggaaggaagccccggaaaauucuggaacacaacaauugcaguuucaauggcaaauauauuccgagguagcuaucuagcaggagccgguuuggcguuuucacuaaugaaaagccuuggaggcgggcgaagaggaacaggggcacaaggagagacauugggagaaaaguggaaacgacaacuaaaucaacugucuaaaagugaguucaacacauacaaaagaaguggcaucauggaggucgaucguacugaagccaaagaaggacuaaaaagaggggagacaaccaaacaugcaguuaguaggggaacugcuaaacuuaggugguuugucgaacguaauuuagugaagccagaaggcaaaguuauugaucuuggaugugggaggggagguuggaguuacuauugcgcgggucuuaaaaagguaacagaaguaaaagguuacacuaagggaggucccggacaugaagaacccauaccuauggcuacauaugguuggaaccucguaaaauuacacucagggaaagauguauucuuuaugccuccugaaaagugugauacacuauugugugauauuggggaaucaucuccaaaucccacuauugaggaaggacgcacauuaaggguacuaaagauggucgaaccaugguuacgaggaaaucaauuuuguauaaaaauacugaauccauauaugcccaguguagucgaaacccucgaacagaugcaacgcaaacacggcggaaugcuugucaggaacccucuaucacgcaauuccacucacgaaauguacugggucucauguggcaccgggaacauaguaucagcaguaaacaugacgucccguauguugcuaaaucgcuuuacuauggcacaccgaaaaccaacguacgagagagacguggacuuaggggcggggacacgccauguagcaguagagccggaaguggccaauuuggacauaauaggacagagaauugaaaauaucaaaaacgaacacaagucaaccuggcacuaugacgaagacaacccuuauaagacaugggcauaucacggauccuacgaaguuaagccaucggggagugcaucuucgaugguuaaugggguaguucgguuauuaacgaaaccgugggauguuauuccgauggucacgcaaauagcaaugacagauacaacaccauuuggacaacaacgagucuucaaagagaaaguagauacuagaacccccagagcuaaaagagggacugcacaaaucauggaaguaacggcgaaaugguuaugggguuucuuaucucggaauaaaaagccacguauaugcacaagagaagaauuuacaaggaaagucaggucaaacgccgcaaucggcgccguuuuuguagaugagaaucaauggaacagcgcuaaagaggcuguagaggacgagcgcuucugggaucugguacauagggaaagggaacuucauaaacaggggaaaugugcaacuuguguuuauaacaugaugggaaaaagagagaagaaacucggcgaguucgguaaagcaaaagguucuagagccauaugguauaugugguugggggcacgguuucuugaguucgaagcacuggguuucaugaaugaggaucacugguuuuccagggaaaacucgcucaguggaguggaaggugagggauuacacaaauuaggauacauccuacgagacauauccaagauucccggagggaauauguaugcggacgacacagcgggaugggauacucggauaaccgaggacgaucuucaaaacgaagcgaaaauaacagauaucauggagccugaacaugcccuacucgccacaaguauauuuaaacuuaccuaucaaaauaaaguuguuagaguucagaggccagccaagaacggaaccguaauggauguuauuucgaggagagaccaaagggguaguggacagguaggaaccuacggacuuaauacguucaccaauauggaaguacaauugauaaggcaaauggaaucagagggaaucuucuuuccguccgagcuugaaaguccuaaccuagcagaaagaguuuuggauuggcuagaaaaacacggugcugagcgacuaaaaagaauggcaauuucaggcgacgacuguguaguaaaaccaaucgaugaucgguuugcaacugcacugauugccuuaaaugauaugggaaagguaagaaaagauauaccgcaaugggaaccaucuaaaggcuggaacgauuggcaacaagugccguucugcucacaucauuuccaccaacucauuaugaaagaugguagggaaauagucguuccuugccggaaccaagacgaauuagucgggagagcgcggguaucucagggugcagguuggucuuuaagggaaacggcuugccuggggaaaagcuacgcacagauguggcaacuuauguacuuucauaggagagaucuuagauuggccgcaaaugcgauauguucagcggugccaguagauugggucccaacuucacgcacaacguggucuauacacgcucaucaucaauggaugacuacagaggacaugcuaagcguauggaauagagucuggauugaggagaacccguggauggaagacaaaacacacgucucgagcugggaggaaguuccguauuuaggcaaaagggaagaccagugguguggaagucugauuggccuaacggcuagagcgacaugggcgacgaacauacaaguggcaauaaaucaaguaagacgccucaucggcaacgaaaauuacuuagacuauaugacaucaaugaaaagauuuaaaaaugagagcgaccccgaaggcgcucuuugg

SEQ ID NO: 22145 - RNA, 9879 nt, Artificial Sequence
  derived and/or modified CDS sequence (opt6) from DENV-1__EU863650__SS-prME
ucaguaaccauguuauuaauguuauugccaacugucuuaaccuuucauuuaaccacucgagggggagaaccgcauaugaucguauccaaacaagaacgggguaaaagucugcuguucaaaacaucugcaggaguaaacaugugcaccuugauagcaauggauuuaggagaauuaugugaugacacaaugacuuacaaaugcccgagaauaacagaaacagaaccugaugacguggauuguugguguaacgcuacugaaacgugggugaccuacggaacuuguucacaaacgggggaacaucgacgugacaaacgauccguugcacuggcuccacauguagguuuaggguuagaaacucgaacggagacauggaugucuagugaaggugcuuggcgucaaauucagaaaguagaaacuugggcgcucagacacccaggauuuacgguaauugccuuauuucuggcgcaugcuaucggcaccagcauaacucaaaaaggaauaauuuucauuuuauuaaugcuuguaacaccuucaauggccaugcgauguguuggcaucggaaacagagauuuuguggaaggguugagcggggcaacauggguagacguaguucucgaacaugggucuuguguaacuaccauggccaaagacaaaccuacacuugauauagaauuauuaaaaacagaaguuacaaauccagcaguacugagaaaacuguguauagaagcuaaaauaaguaauacaacgacagacucgcguugcccgacgcaaggcgaagcaacauuagucgaagaacaagacacaaauuucgugugcagacgaacuuuuguugauagggguuggggaaaugggugcggauuauucggcaaagguucccucaucacuugugccaaauucaaauguguaaccaaacuagaagguaaaauaguacaauaugaaaaccucaaauacagcguaauagucacaguacauaccggggaccaacaucaggucggcaaugaaacaacugaacauggaacaauagcaacuauuacaccacaagcgccuacgagugaaauacaguuaacagacuauggggcauuaacucuugauugcucuccaaggacagggcuagacuuuaaugaaauggugcuauuaacgaugaaagagaaaucaugguuaguccacaaacaaugguuucuggacuugccuuuaccguggacaaguggagcaaguacaagucaagaaacauggaacaggcaagaucuuuugguaacauucaaaaccgcgcacgcgaagaaacaggaagugguaguccucgggagucaagaaggggcaaugcauaccgcacugaccggagcuacggaaauccaaaccucaggaacaacaacgauauuugcaggucaucugaaaugccgccuuaaaauggauaaauuaacgcuuaaaggcauaagcuacguaaugugcaccggacuguuuaaacuagagaaagagguugcugaaacucagcauggcacaguauuaguccaaguaaaauacgaagguacagaugcgccauguaaaauuccuuuuagcucucaagacgaaaaaggugcaacacaaaacgggagacuuguaacggcaaauccaauaguaaccgacaaggaaaaaccugugaauaucgaagcagaaccgccauuuggagagucauacaucguagucggugcaggggaaaaagcgcuuaaauuaucgugguucaagaaagggagcucuauuggaaagauguucgaggcaaccgcaagaggagcuagacgcauggcaauacucggugauacagcaugggacuuuggauccauuggagggguuuuuacuucaguuggaaaacugguacaucaaaucuuugguacugcguauggcguucuauucucagguguaucuuggacaaugaaaaucggcauagggauccuuuugacuuggcuaggacuuaauaguagauccacaucguuaaguaugacaugcauagcaguaggaauggugacacuauauuuaggcguuaugguacaagcagacaguggaugugucauaaacuggaagggccgagaauugaagugcggaucugguauauuuguaacaaacgaaguacacacguggacagaacaauauaaauuucaagccgauucaccuaaacgauuaucagcggcaauuggaaaggcuugggaggaaggcguaugcgguauaagaagcgcaacaagauuggaaaauauaauguggaaacaaauaucuaaugaguuaaaccauauuuuguuggaaaaugauaugaaauuuaccgucguaguuggcgacguuucagggauacuugcgcaaggcaagaaaacaauacgcccacaaccgauggaacacaaauauucauggaaaaguugggguaaagccaagaucauaggagcagauguacagaauaccacauuuauaauagacggacccaacacuccugaaugcccagaugaccagagagccuggaauauuugggaaguagaggacuacgguuuugggauuuuuacaacaaauauuuggcugaaguuacgcgauaguuauacucaaguuugugaucacaggcugaugucagcagccauaaaggacucaaaagcuguacaugcagauaugggauacuggaucgaaucggagaaaaacgaaacguggaaauuagccagggcgucauucaucgaggugaaaaccuguguuuggccuaaaagucauacacuauggucccauggaguguuagaaucggaaaugauuauaccaaaaauauauggcggcccgaucucacaacauaauuaccggccugguuauuuuacucaaacagcuggaccuuggcaccucggaaaacucgaauuagauuuugacuugugcgaaggaacuacuguuguuguugacgaacauuguggaaaucgaggcccaucguuacgaacuacuacggucacggguaaaauuauucacgaaugguguugucggagcuguacauuaccaccacuccgauuuaagggagaagacggaugcugguaugguauggaaauacgaccaguuaaagagaaggaggaaaaccucgucaagaguauggugucagccggauccggcgaagucgauaguuucucacuaggacuauugugcauaaguauuaugauugaagaagucaugcggucucgaugguccaggaaaauguuaaugacgggaacucuuguaguauuucuucuccuuacauuaggucagcuuacauggaacgauuuaauucgacuaugcauaauggugggugccaaugcgucggauaacauggguaugggaaccacauauuuagcucuuauggcaacauuccgaaugagaccaauguuugcaguaggacuacucuucaggagacuaacaagcagagaaguucuccugcugacaguaggacuaagucuaguugcuagugucgaauugccaaauucauuggacgagcuaggagacggacuagccaugggaaucaugauuuuaaaauuguuaacggauuuccagucccaccaacuaugggcaacccuccuaucucugacauuugugaaaaccacgcugucuuuacacuacgccuggaaaacaauggcuaugauacuaaguaucgucagcuuauuaccacuaugcuuaucaacaaccucucagaaaacaacguggcuuccagugcucuuaggaucuuuggguugcaaaccacugacaauguuuuugauaacagagaauaagauauggggaagaaaauccuggccacuuaaugaaggaauuauggcggucggaauagugucuauacuauugagcaguuuacugaaaaacgauguaccacuagcugguccguugauugcaggggguauguuaauugcuugcuauguuauuucagggagcuccgcagaccucucauuggaaaaggcagccaaagucucgugggaggaagaggcggaacauucaggcgcuucacauaacaucuuaguagagauacaggaugacgguaccaugaaaauaaaggaugaagaacgagacgauacuauaaccauauuauuaaaagcaacauuacuagcaauuaguggaguauauccuaugucaauaccugcaacuuuauuuguguggcacuucuggcagaagaagaaacaaagauccggugugcucugggacacgccaagcccuccagagguagaaaaagccguuuuagaugaugguaucuauaggaucuugcaaagaggacuuuuaggaagaucucagguagggguuggagucuuccaagaaggaguguuucauacaauguggcacguuacaagaggagcuguuuugauguaucagggaaaaaggcuugaaccuuccugggccucuguuaagaaagaucuaauaucauacggaggaggguggcgauuucaagguucauggaauacuggugaagaaguacaaguaauagcgguugaaccgggcaaaaacccaaagaauguucagaccgcccccgguacauuuaaaacgagcgaaggugaagucggcgcuauugcacuggauuucaaaccaggaaccucaggaaguccaauuguaaauagggaagguaaaauaguuggacuauaugggaacgguguuguaacuacaucaggcaccuacgugagcgcaauugcucaagcgaaagcaucacaagaagguccuuuaccagaaauagaagacgaaguauuccgaaaacguaaucuuacaauuauggauuugcauccugguucugguaaaacucgacguuauuuaccagcaaucguuagagaggcuauaaaacgaaaguuaagaacuuuaguauuggcaccaacgagagucguugccagugaaauggcagaagccuuaaaggguaugccaauaagauaucagacaacggcuguaaaaucagaacacacgggcaaagaaauuguagaccugaugugucaugcuaccuuuacaaugcgguuauugagcccuguaaggguaccuaauuauaauaugauuauuauggacgaagcucauuuuacggacccagcgucaaucgcagcaagaggcuauaucucuacuagaguuggaaugggugaagcagcggcaauauucaugacagcaaccccaccaggaucuguugaggccuucccccaaaguaaugcugucauucaagaugaagaaaaagauauaccagaacgaagcuggaacucaggcuaugacuggauuacagacuuuccaggaaaaacugucugguuuguuccaucuaucaaaaguggaaacgacauagcgaacuguuuaagaaagaacgggaaacgugugauacaguuaucucggaaaaccuucgacaccgaauaccaaaagacaaagaauaaugacugggacuauguggugaccacugauauuagugaaaugggugcgaacuuccgugcagaccgugugauagauccacggagaugccuuaaaccugugauacuaaaagacggcccagaacgggugauucuggccggucccaugccuguaacaguggcgucggcagcucaaagaagaggacguauuggucguaaucaaaacaaagaaggagaccaauauauauacauggggcaaccgcuaaacaaugaugaagaucacgcucauuggaccgaagcaaaaaugcuucuagauaacaucaacacuccugagggaauuauaccggcacuauucgaaccggaacgcgagaaaagugcagcuauagacggagaauauagauuaagaggagaagcacgaaagaccuucguagaauuaaugagacggggugaucucccuguaugguuaucauacaaaguagcaagugagggauuucaauacucagaucgccgaugguguuucgauggggagaggaacaaccagguacuagaagagaauauggacguggaaauauggacuaaagaaggagaaagaaagaaauugagaccuaggugguuagacgccaggaccuauuccgauccacuagcacuaagggaauuuaaggaauuugcagccggacgaagaucaguaucaggagaucuuauacuugaaaucgggaaacuaccucagcauuuaacacaacgagcucaaaaagcacuagacaaucuuguaaugcuacauaacucagaacaagguggaaaggccuaucgucacgcaauggaggaauuacccgauacaauagagacaauaaugcuuuuggcgcuaaucgccguuuugaccggaggaguaacacuguuuuuccuaucgggaagaggacugggaaagacauccauaggucugcugugcguuacgucaagcucagcuuuauuguggauggccagcguugaaccacacuggaucgcagcaucuauaauccuagaauuuuuccuaauggucuugcuuaucccggaaccggaccgccaacgaacaccucaagauaaucaauuagcuuaugucguaauaggauugcucuuuaugauauuaacuguugcugcgacugagaugggauuacuugagacaacuaagaaagaucuugggauuggucaugcagcugcagaaaaucaucaucaugcagcuaugcuagaugucgaccuacauccagccagugccuggacauuauaugccguagcaacaacuauaauuacaccaaugaugagacauacgauugaaaauacuacggcgaauauuucauuaacagcaauagcaaaccaagcugcuauucugaugggccuugacaaagguuggccaauuuccaaaauggauauuggggugccuuuacuagcucugggaugcuauucgcaaguaaauccucucacuuugacugcagcugucuuaaugcuuguagcucacuaugcaauaauagguccgggucuacaagcuaaagcaacuagggaggcucaaaaacgaaccgcggcagggauaaugaaaaauccuacuguagauggaauugucgccauugaucuugauccugugguuuacgaugccaaauuugaaaaacaguugggacagauaauguuguuaaucuuguguacaucgcagauuuuacugaugagaacaacaugggcacucugugaaagcauuacuuuagcuacgggacccuugaccacacuuugggaaggcucccccgguaaguuuuggaacaccaccaucgcagucaguauggcuaauauuuucagaggaucguacuuagcuggcgcaggucuagcauuuaguuuaaugaaaagucucggaggcggaaggcgcgggacuggagcccaaggugaaacacugggagaaaaauggaagaggcaacuaaaucaacucaguaagucggaauuuaaaacuuauaaaaggucggggauaauagaaguagauagauccgaagcaaaggagggucuaaagaggggugagacgacaaaacacgccguaucacgagguaccgcaaaacuaagaugguuuguagagcgaaauuugguuaagccagagggcaaaguuauugaucuaggguguggacguggcggguggucuuauuacugcgcaggacucaagaaaguaacggaaguaaaagggaguacaaaaggaggcccuggucaugaagaaccuauuccuauggcaacauacggauggaaucuaguuaaauuacacagcggaaaagacguauucuuuauaccacccgagaaaugcgauacuuuguuaugcgauauaggcgaaagcucaccaaacccgacgaucgaagaaggaaggacacuaagagugcucaaaaugguggaaccuuggcucagagggaaccaguucugcauaaaaauuuugaacccauauaugccuagcguaguugaaacacuagaacaaaugcaaagaaaacaugguggaaugcucguaagaaauccucuuagucgaaauuccacucacgaaauguacuggguaagcugcgguacagggaacauaguuagcgcaguaaauaugacaucucgaaugcuccuuaacagauuuacaauggcgcaccggaaaccaacguacgaaagagaugucgaccucggggcaggaacaaggcacguugcagucgaaccagagguagcaaauuuggauauaauuggacaaagaauagaaaauauaaagaacgagcauaaaaguacguggcauuaugaugaagacaauccauacaaaacuugggccuaucauggcucauacgaaguaaagccuucaggcucagcgagcagcaugguaaauggaguagucagacuucugacaaaaccaugggacgugaucccaaugguaacacaaauagcgaugacagauacuacaccauuuggccaacagagagucuucaaagaaaaaguagauacuagaacgccaaaagccaaaagagggacugcacagauaauggagguuacagcuaaaugguuauggggauuucuaagucguaacaagaagccccgaaucugcacucgagaagaguuuacgcguaaagugcgaaguaaugcugcgaucggcgcaguauucguagacgagaaccaguggaacucaccaaaagaagccguagaagacgagagguucugggauuuaguacauagggaaagggagcuacauaaacaaggcaaaugcgcaacauguguauauaacaugaugggaaagagagagaagaaauugggagaauuugguaaagcgaaggguagccgugcaauuugguacaugugguuaggcgcgcgguuccuggaguuugaagcccugggauucaugaacgaagaucauugguucagucgugaaaauagcuugucggggguagaaggagagggucuacacaaauuagguuauauauuaagagacauuucgaaaauaccugguggaaauauguacgccgacgauacagcagguugggauaccagaauaacugaggacgaucuccaaaaugaagcaaaaauaaccgacauaauggagccagagcaugcucuauuagcuaccaguauauuuaaguugacuuaucagaauaaaguugugcguguacaaagaccagccaaaaacgggaccguuauggacgucauuaguagaagggaucaacggggcaguggucaagucggaacuuacggacugaauacauucacaaauauggaagcucaacuaauccggcaaauggaauccgaaggaaucuuuuuaccuucagaacuagaaccacccaauuuggcaggacgaguuccagauugguuggaaaagcaugguacagaacggcucaggcgcauggcuauuucaggagaugauugugucguaaaaccgaucgaugaucgauuugccaccgcacuuaccgccuuaaaugauaugggaaaaguacgcaaggacauuccucaaugggaacccaguaaagguuggaaugauuggcaacaagugccauucugcagucaccacuuccaucaacuuauaaugaaagauggcagagaaaucguugugcccugucgaaaucaggaugaacugguugguagagcuagggucagccagggagcagguugguccuuacgcgaaacugcuugucuagggaagucauaugcacaaauguggcaauuaauguacuuucacagaagggacuugaggcuugcagcaaaugccauuuguuccgcggugccgguugauuggguuccgacgucgagaacaacauggagcauacaugcgcaccaucaguggaugacuacagaggacaugcucucaguauggaaucggguauggauagaggaaaauccguggauggaagacaaaacacaugucucaaguugggaagacguuccauauuuaggcaaaagggaagaccaguggugcgguagcuugauuggcuugacagcuagagcaacaugggcuaccaacauacaaguugcuauuaaucaagucagaagauugauaggcaaugagaacuaucuagauuauaugaccaguaugaagagguuuaaaaaugagucugaccccgaaggugcauuaugguaa

SEQ ID NO: 22146 - RNA, 9879 nt, Artificial Sequence
  derived and/or modified CDS sequence (opt6) from DENV-1__KU365900__SS-prME
agcgugacaaugcucuuaaugcuaaugccuacagcacuugcuuuucaucuaacuaccaggggaggagaaccacauaugauaguaucaaaacaagaaaggggaaaaucacucuuguucaaaaccucagcagggguuaauauguguacgcuaauagcaauggacuuaggggaauuaugugaagauacuaugacuuauaaaugcccaagaauaacggaagcagaaccugaugauguggacugcugguguaacgccaccgauacuuggguuacuuacgguacgugcucccaaaccggagaacauagaagagacaaaaggagcguagcauuagcgccgcacguagguuuaggacucgaaacaagaacggaaacauggaugucaucagaaggagccuggaaacaaauucaaagaguugaaacaugggcauuaagacauccuggguuuacggugauagcacuauuuuuagcucacgcaauagguaccucuauuacccaaaaaggaauaauauuuauauugcuaaugcucgugacgcccaguauggcuaugcguuguguagguauuggaaguagagauuucguugagggacuauccggagcaaccuggguagauguuguucucgagcacggaagcugcguaacaacgauggcuaaagacaaaccuacgcucgacauagaauuauugaaaacagaaguaaccaauccugcgguacuacggaaauuauguauugaagcaaaaaucaguaacacuacgacggauagccggugcccgacacaaggugaagcuacucuagucgaagaacaagaugcaaauuuugugugccgaagaacuuuuguugacagggguuggggaaauggauguggacucuuugguaaaggaucauuaauuacaugcgcaaaauuuaaaugcguaacaaaacuugaaggaaaaauaguccaguaugagaaccuaaaauauaguguuaucgucacgguacauacaggagaccaacaccaaguagguaaugaaucuacagagcacggaacuacggcaacaauuacgccacaagcaccaacaacagaaauacaacugacagauuacggagcucuuacucuggauuguaguccuagaacgggacuugauuuuaaugaaaugguucuacuaacaaugaaagagaaaagcugguuaguucacaaacaaugguuuuuagauuuaccacuaccuuggacgucaggagcaaguaccucgcaagaaacauggaacagacaagaccuauuagugacguuuaaaacagcucacgcaaagaaacaagaaguaguaguacugggaagucaagagggcgcaaugcacaccgcucuaacuggugcuacugaaauccaaacaucaggaaccacaacgauuuuugcaggacauuuaaaauguagauuaaaaauggacaaacugacucuaaaagggaugucauacgucauguguacagguucauuuaaacuagaaaaggaggucgcggaaacccaacauggaacggucuuaguucaaauaaaauacgaaggaacggacgcacccuguaaaaucccauuuucaacacaggaugagaaggguguuacccagaauggaagacugauuacugcaaaucccauagugacagauaaagaaaagccuguaaauauugaggcagagccuccguuuggagaaucguacaucgucauaggcgcgggcgaaaaagcacugaaacuuaguugguuuaagaaaggaagcucaauuggcaaaauguucgaagcuacagcgagaggggcacgaagaauggcaauucuaggcgauacugccugggacuuuggcagcauaggaggcgucuucacaagcguugguaaacuugugcaucaaauuuuuggaaccgcauaugggguauuauucaguggugucucguggacgaugaagauaggaauaggugucuuguuaaccuggcuaggauugaauagccgaucaacgagcuuguccaugacuuguaucgcggugggauugguuacccuauacuuagguguaaugguccaagcagauaguggcugcguaauaaacuggaagggaagggaacuaaaaugcgggaguggaauauucgucaccaaugaggugcauaccuggacggagcaauauaaauuucaagcugacuccccuaaacgccuuagugcagcuauugggaaagccugggaagaaggcguaugcgguauccgaucugcaacccgauuggagaacaucauguggaagcaaauuucgaaugagcugaaccauauauuacuugagaacgauaugaaauuuacugucgucgucggagaugucgcagguauccuagcucaggguaagaaaaugauaagaccccaaccaauggaacauaaauauucauggaaauccuggggaaaagcgaaaaucauaggugcagauguacaaaauacaacauucauuauagauggcccaaacacuccagaaugcccggacgaccagcgagcauggaacauuugggaaguugaggacuacggcuucgggauuuuuacuacuaacauauggcugaaacuaagagacagcuauacacaaguaugcgaucacagguuaaugagcgcagcuauaaaagacucaaaagcuguacaugccgacauggguuauuggauagagucugagaaaaacgaaaccuggaaacuagcucgagcgucuuucauagaaguuaagacaugcauuuggccuaaaucacauacauuguggaguaacggaguccuugaaucagaaaugauuauuccuaagauuuaugguggaccgauaucacaacacaacuauagaccuggguauuucacacagacagcaggcccuuggcauuuagggaaguuagaauuggacuuugaucucugcgagggaacaaccgugguaguugacgaacacugugguaauagaggcccaucguuaagaacuaccacugugacaggaaagauuauccaugaauggugcuguagaagcuguacucuacccccuuuaagauuucgaggagaggacggaugcugguacgggauggagaucagaccagugaaggaaaaagaggaaaaucucguaaaaaguauggugagcgccgggccgggagaaguagauucuuucucguuaggacuacuaugcauauccauuaugaucgaagaaguaaugcgcucuagauggucuaggaaaaugcuaaugacaggaacgcucgcuguauucuuuuuauuaaucaugggacagcugacauggaaugauuuaauaagacuaugcaucaugguuggcgcaaaugccuccgauaggauggggauggggaccacguaccuagcuuuaauggcaacauucaaaaugaggccuauguucgcaguggguuuacuccugagaagacuuacuucaagggaaguucucuuauuaacaauaggccuuagucuuguugcguccguugaacugccaaauagcuuggaagaacuaggcgaugggcuugcaaugggaauuaugauacugaaauuguuaacggauuuccaaucacaccaacuuugggcaacgcuuuuaucauuaacauucauuaaaacuacauucucguuacacuacgcuuggaaaacuauggcuaugguguuaucgauugugucuuuauucccucuauguuuaaguacaacaucucaaaagacuacauggcuuccggugcuuuugggaagucugggaugcaaaccguuaaccauguuucuuauagccgaaaacaaaauauggggaaggaaaaguuggccguuaaacgaagguauaauggccguaggaaucguuucaauacuucuaagcucauuauugaaaaaugacguaccacuagcaggcccacuaauagccggaggcaugcugaucgccuguuaugucaucagugggaguagugcagauuuaucucuggagaaagccgcggaagucuccugggaggaggaagcagaacacucaggcgcuucccacaauauauugguugaaguacaagacgaugggacgaugaaaauaaaggaugaagaacgugacgacacccugaccauacucuugaaagcaacauuauuggcagucagcgggguuuacccauuaucaauaccagcgacuuuauucguuugguacuucuggcagaagaagaaacaacgaagcggaguauugugggauacaccuagucccccggaaguugaaagagcaguauuagaugaugggauauaccgcauaaugcagcgcggucuacucggaagaagccagguuggaguaggcguuuuucaagaaaauguauuucacaccauguggcauguuacccgcggagcaguccuuauguaucaggguaaaagacucgaaccaucaugggcuagugucaagaaagaucuuauaucauacggagggggcuggagacuacaaggaucuuggaauaccggagaagaaguccaaguaauagcaguagaaccuggcaaaaauccgaaaaacgugcaaaccgcgccugguacauuuaaaacuccagagggcgaagucggugcaauugcuuuagacuuuaagccggggacaagugggucuccuauugucaaucgagaaggcaaaauuguaggauuauaugggaacggagucguuacgacuuccgggaccuacguaucugcuauagcacaggcaaaagcuagccaagaaggaccauugccugaaauagaagaugagguuuucaggaagcggaauuugacaauuauggacuuacacccgggaucaggcaaaaccagacgauaucugccagccauaguacgagaagcaauuaagcgaaaauuacguacacuaauccuggcgccgacacgcguaguagcgucagaaauggcagaggcuuuaaagggaaugccuaucagauaucaaacaacugcgguaaagagcgaacauaccggaaaagagauaguggaccugaugugccaugcaacuuucacgaugaggcugcugucucccguacguguaccuaacuacaauaugauaauuauggaugaagcacauuuuacggauccaagcaguaucgcggcucggggauauauuucaacaaggguaggcaugggggaggcugcggcaauauucaugaccgcuacuccgccugguucaguugaagcauucccacaaucaaaugcaguaauacaggaugaggaaagagauauuccugaaaggucauggaauagcggcuacgaauggauuacugauuuuccugguaaaacagucugguucgugcccucgauuaagaguggaaacgauauugcuaacugccugcguaaaaauggaaagagaguaauacaguuaucaagaaaaacauuugacacggaguaccagaagacuaaaaauaaugacugggacuacguagugacuaccgauauuucagagaugggagcgaauuucagagccgauagaguaauugaccccagaagaugcuuaaagccaguuauauuaaaggacggacccgaacguguaauacuagcggggccuaugccggucacuguggcuagcgcugcacaaaggaggggaagaauaggacgaaaucauaauaaagaaggugaccaguauauauauaugggucaaccacucaauaaugaugaagaccaugcccacuggacugaggcuaaaauguuguuggauaacaucaauacaccugaggguauuauaccugcguuguuugagccagagagagagaaaucagcugcaauagacggggaauacagauuaagaggcgaggcacgcaaaacguucguggaacugaugcgacguggcgauuuaccuguauggcuuagcuacaaaguagcaucagagggauuucaauacagugacaggaaauggugcuuugacggagagaggaauaaccagguauuagaggaaaauauggacguugagaucuggacuaaagagggagaaagaaagaaauuaagacccagauggcuagaugcaagaaccuacucagauccauuagcguuaagggaauuuaaggaauuugcggcaggucggcgcucuguuaguggugacuugauuuuagagauagguaaacuaccacaacacuugacucagcgagcacaaaaugcacuagacaaucuaguaauguuacacaauagugaacaagggggacgagcauauagacacgccauggaggaacucccugacacuauagaaacacuaaugcuguuggcacucauugcaguacuuaccggaggugugacauuguuuuuccuaucaggcaggggacuaggaaaaacaucaaucgguuuacuuuguguaauggcaaguaguguacugcuauggauggccucgguugagccacacuggaucgccgcaucaauuauauuagaguucuuucuaauggugcuuuuaauuccggaaccagaucgacagagaaccccgcaagauaaucaguuggcauacguaguuauaggguuguuauucaugauacuaacaguugcagcaaaugaaauggggcuacuggaaacaacuaaaaaggacuugggaaucggucauguagcugucgaaaaccaucaccaugcuacaauguuagaugucgauuugcacccugcaucagcauggacuuuauacgccguagcuaccacaauaauuacgccgaugaugagacacaccauagagaacacaaccgcuaauauaucgcuaacagcaauugccaaucaagcagcaauucuuaugggcuuagauaaaggcuggcccauuagcaaaauggauauuggugucccacucuuagcucucgggugcuauagucaggugaacccacuaacacuuacagcagcggugcugaugcuaguagcacacuaugcgauuauagguccaggucuccaagcaaaagccacaagagaagcacagaaaagaacugcagcuggaaucaugaagaauccuacaguugaugguauuguagcuauagaucuugacccuguuguguaugacgcgaaauuugagaagcaauuaggacaaauaauguuacucauauuauguacgucccaaauauuauuaaugagaaccaccugggcauuaugugagaguauuacacuagcaacaggaccgcuuacaacacuaugggaagguucaccagguaaauuuuggaauacgacaauagcaguaucaauggccaauauauuuagagguaguuaccuagccggugcuggauuagcauuuucauuaaugaaaucucucggcggaggaagaagggggacuggagcucagggugaaacacuuggagaaaaguggaagcgucaacuaaaucaacuuuccaaaucagaguucaacacauauaagagaucggguauuauggaaguagauagaucugaagcaaaagaagggcuaaaaaggggcgaaaccacaaaacaugcagugagcagaggaacggcaaagcuacgaugguucguggaacguaauuuaguaaagccugagggcaagguaauagacuugggaugcggaagaggaggaugguccuauuauugugcagggcuuaagaaagugacggagguuaaaggguacaccaaaggaggacccggucaugaagaaccuauaccuauggcaacuuauggcuggaauuuaguaaaacuauauucaggaaaagacguauucuucauaccgccggagaaaugcgauacuuugcuaugcgauauaggcgaaucaucucccaacccgacaauagaagaaggaaggacuuugcgaguauuaaaaaugguagaaccaugguugcgcggaaaccaauuuugcauuaaaauauugaauccuuauaugccaaguguaguagagacucuggagcaaaugcagaggaagcauggagggaugcuagugcguaauccacuuagucguaauagcacgcacgaaauguauugggucucaugcggaacuggaaacauuguuuccgcaguaaauaugaccagccguauguuauugaaccgauuuacuauggcacaccguaagccuaccuacgagaaggacguagacuuaggagccgggacucgacauguugcgguagagccugaaguggcgaaucuggauauaauagggcagagaauagagaauauaaaacaugaacauaaaagcaccuggcauuaugaugaagauaauccuuauaaaacaugggcauaucauggaaguuaugaaguaaagccuagcggaagugcuaguucgaugguaaacggagugguaaaauugcuaacuaaaccuugggaugucaucccaauggugacccaaaucgcaaugacggauacaacaccauuuggacaacaaaggguauuuaaagagaaaguggauaccaggacaccuaaagcaaagagagguacugcucaaauuauggaaguaacagcuaggugguuauggggguuccuaagcagaaacaagaaaccaaggauuuguacccgcgaagaauuuacuagaaaggugcgauccaaugcggcuauaggcgcaguauuuaucgaugaaaaccaauggaauagcgcgaaagaagcaguugaggacgaaagauuuugggaccuuguccaucgagaaagggaauuacacaaacaaggaaaaugugccacgugcguguauaauaugaugggaaagagggagaagaaacucggggaguuugguaaagcaaaaggaucgcgagccauuugguauaugugguuaggggcuagguucuuagaguuugaggcucuaggcuuuaugaacgaggaucauugguuuagcagagaaaauucuuugucaggcguagagggagaaggccuacauaaauugggauauaucuuaagagauauuaguaagauaaguggagggaauauguaugcggaugacaccgcagggugggacacaagaauaacagaagaugaccugcaaaaugaagcuaaaauuacugauaucauggaaccagaacaugcacuuuuggcuaaagcaaucuuuaaacugaccuaccaaaauaaaguggucagaguacaacguccggcgaagaaugggacagucauggaugucauuagcagaagggaucaacgugguaguggacaaguugggacuuauggccuaaauacauuuacaaauauggaggcgcaacugauuagacagauggaguccgaaggaauuuucagcccuucagaacucgaaacucccaacuuagcugaaaggguacucgauugguuaggaaaauauggcguagaaagguugaaacguauggcgaucaguggugaugauuguguaguaaaaccaauugacgaccgauucgcuacggcauugaccgcuuugaacgauaugggaaaaguuagaaaagauauuccgcaaugggagccaagcaaaggauggaacgauuggcagcaaguuccuuuuuguucacaucauuuccaccaauuaauuaugaaggauggacgagagauuguuguaccauguagaaaucaggaugaacuuguugguagagcaagagucucacagggagcaggauggagccuaagagagacagcaugucuaggaaaaaguuaugcccaaauguggcaauuaauguauuuucaccgaagagaucugcgccuagccgcaaaugcgauuuguucagcgguuccaguugauugggucccgacaaguagaacaacauggucaauucaugcucaucaccaauggaugacaacagaagacaugcuuagcguuuggaaucgaguauggauugaagagaacccauggauggaagacaagacucauaucucaucaugggaggaugucccauauuuaggaaaaagggaagaucaaugguguggaucacuuaucggacuuacagcacgagcaacaugggcaaccaacauacaaguagcuauaaaucagguccgcagguuaauaggaaaugagaauuauuuggauuauaugacuucaaugaaaagauuuaaaaaugaaagcgacccugaaggagcuuuaugguaa

SEQ ID NO: 22147 - RNA, 9879 nt, Artificial Sequence
  derived and/or modified CDS sequence (opt6) from DENV-1__FJ176779__SS-prME
ucugugacuauguuacuuaugcugaugcccacugcacuugcuuuucacuugacaacuaggggaggagaaccacacaugauuguaagcaaacaagaacggggcaaauccuuacuguuuaaaacgagcgccggagucaauaugugcaccuuaguugcaauggaccugggugaauuaugcgaagacacuaugacuuacaaaugucccagaauaacugaagcggaacccgacgauguagauuguugguguaacgcaacugacacauggguaacguacgguacgugcagccaaacaggggaacauagacgugauaaaagaaguguugcacuagcaccccacguggguuuaggauuagaaacccgaacggaaacauggaugucaucagaaggggccuggaaacaaauccagagaguggaaaccugggcacuuagacauccaggauucacgguaauagcuuuauuccuugcacaugcaauaggaacaucaauaacacagaaaggaauaauauuuauacugcuuaugcuugucacuccuucaauggccaugagauguguaggaauaggaagccgugacuucguagagggguuaucaggcgccaccuggguggauguuguucuggaacaugguagcugcgucacaacgauggcgaaagauaaacccacacuagauauagaguuauugaaaacagaagugacuaauccugcgguauuaagaaaacuauguauagaagcaaaaauauccaacacaacuacugacaguagaugcccuacgcaaggugaggcuacuuuggucgaagaacaggacgcuaauuucguaugcagacguacauucguagauagaggcuggggaaauggguguggacuuuucggaaaagguucauuacugaccugugcuaaauuuaaauguguaaccaaacuagaagguaaaaucguacaauacgagaacuuaaaauacucagucauagugacuguucauaccggagaccagcaucaggugggcaacgaaagcaccgagcauggaacaacugcgacuauuacuccccaggcuccaaccacagaaauucagcuaaccgacuauggagcguuaacauuagauugcagcccucguaccgguuuagacuuuaacgagaugguauuauuaacaaugaaagaaaaauccugguugguacauaaacaaugguucuuagacuuaccacuaccauggacaucuggggccagcacaagccaagaaacauggaaucgucaagaucuucucguuacuuucaaaacugcacaugcgaagaaacaagagguaguaguauuggguucacaagaaggugcaaugcacacagcguugacaggcgcaaccgagauccaaacuucagggacaacuacaauauucgcaggucaucuuaaaugccgccuaaaaauggauaaacuaacccuaaaagggaugucguauguuaugugcacagguaguuucaaauuggaaaaagaagucgcugaaacccagcaugggacaguguuggugcagauaaaauaugagggcacugaugcucccuguaaaauuccauuuaguacccaagaugagaagggaguaacgcaaaaugggagacuaauaacagcaaaccccauagugacggauaaagaaaaacccgugaauauagaggcugagccuccauuuggggaaagcuauauaguuauagguguuggagaaaaggcuuugaaacuaaguugguuuaagaaaggaucuucaauugguaaaauguuugaggcgacggcaagaggggccaggagaauggcaauacuaggagauacugcaugggacuuugggucuaucggugguguauucaccaguguaggaaagcuaguacaucagauuuuugggacagcuuaugguguacuguucuccgggguaaguuggacaaugaaaauagguauugggguccuacucacauggcuagguuuaaauucgagauccacaagucugucaaugacauguaucgcaguuggauuaguaacacuguaucuuggaguaaugguucaagcagauucaggaugcguuauaaauuggaaaggcagagaauuaaaaugcggaucugguauauucguuacaaacgaaguccacacuuggacagaacaguauaaauuccaagcagacucaccgaagaggcuaucggcugccauugggaaggcuugggaagaaggggucuguggaauaagaucagcuacucgauuagagaauaucauguggaagcaaauaucaaaugaacuaaaucacauauuauuggaaaacgauaugaaauucaccguaguaguaggagaugucgcagggauacuagcacagggcaagaaaaugauuagaccccaaccaauggagcacaaauacucauggaaaaauugggggaaagcaaaaaucauuggcgcggauguacagaacagcacguucauuauugacggacccaacacaccagaauguagugaugaucagagagccuggaauauaugggagguagaagacuaugguuuuggaauauuuaccacaaauauuuggcucaaacuucgggauucauauacucaaguuugcgaccaucggcucaugucugcagcuauaaaagauucuaaggcaguucaugcugacaugggguauuggauugaaucugagaaaaaugaaaccuggaaguuagcgagagcaucuuuuaucgagguaaaaaccuguauauggccaaagucucauacacucuggagcaauggcguccucgagucagagaugauaauacccaagauauaugggggaccuauaagccagcacaacuaucgaccaggauauuuuacacagacagcgggaccauggcauuuaggaaaacuugaacucgacuucgauuugugugaagggaccacagugguaguagacgaacauuguggcaauagggggccaucauuacgcacuacaacaguuaccgggaaaauaauacaugaauggugcugccgguccugcacuuuaccgccucuaagauuuagaggagaagacggauguugguaugguauggaaaucaggcccguuaaagaaaaagaggaaaaccuugugaaaaguaugguuagcgcugguaguggagaaguugauucguuuucccucgguuugcuuuguauaagcauuaugauagaagaaguuaugcgaaguagaugguccaggaaaaugcuaaugaccgguacguuagcgguauucuuucuacuaauuaugggucaacuuacauggaacgaucugaucagauuguguauuauggucggggcaaaugcaucagacaggauggguaugggaacuacuuacuuggcguuaauggcaaccuucaaaaugcgacccauguuugcggugggacugcuguuucgucgauuaacuucaagagaagugcuacuauuaacaauuggacugucacuuguagcaucugucgaacugcccaacagucuugaagaacuuggagacgguuuagcuaugggaauaaugauacuuaaacuacucaccgauuuucaaagccaucaauuaugggccacacuucuuaguaugacguuuaucaaaacuacauucucacuacauuaugcauggaaaacgauggcaaugguauuauccaucguaaguuuauuccccuuauguuuaaguacuaccagucagaagaccacaugguugccgguacuucuaggaucauugggaugcaaaccacuaacgauguucuuaaucgcagagaauaaaaucuggggcaggaaaucauggccuuugaacgaaggcauuauggcagugggaauugucucuauacuucucucgagucuucucaaaaaugaugugcccuuagccggcccauuaauagcgggcgguaugcuaauugcguguuacguuauaaguggaucaagcgcggaucuauccuuggaaaaagcugcagagguuucaugggaggaggaggcagagcacagcggugcgagccacaauauucugguagaaguacaagaugauggaaccaugaagaucaaagaugaggaacgggacgacacacuuacuauucuacugaaagcaacucugcucgcagugucggguguauauccauugucuauaccggcaacacuguucgucugguauuucuggcagaagaagaaacaaaggagcggcguacuaugggauacaccaucgcccccaaagguagaaagagcgguccuugaugacgggauauaucguauaaugcaacgaggacuuuuaggucgcucacaggucgggguugguguauuucaagaaaauguuuuucacaccauguggcauguuacucgaggugcagugcugauguaccaagggaaacggcuugaaccgucgugggcuucggucaaaaaggauuuaauaaguuacggcggaggguggcgacuacaagggaguuggaacacgggagaggaaguucaagugauugcgguagaaccuggaaagaauccgaaaaacguccagaccgcaccugguacauuuaaaacuccugagggugaagugggagcuauagcuuuagacuucaaaccagggacaaguggcucgccaauaguuaaccgagagggaaaaauugucggguuauacggaaacgguguaguaacuacuagcggaacauacguuagugccauugcgcaagcaaaagccucucaagagggaccacuacccgaaauugaagaugaagucuucaggaaacgaaacuugacgauaauggaucuacauccuggaucuggaaagacaaggcguuacuuaccagcgauaguacgagaagcaaucaaaaggaaaaugaggacacuuauacuugccccaaccaggguaguugcaucagagauggccgaggcgcuuaaaggaaugccaaucagauaucaaacuacagcugugaaaucugagcauacuggaaaagaaaucgucgaccuaaugugccacgcaacuuuuacgaugagacucuuaaguccggugagaguuccaaacuauaauaugauaauuauggacgaagcucauuuuacugacccaaguuccauagcagcgagaggcuacauaaguacccggguugggaugggggaggcagcagcaauuuuuaugacggcaacgccuccugguucuguagaggcauucccccagaguaaugcggucauacaagacgaagaaagagacaucccagaaagaucauggaauagcggcuacgaauggaucaccgaauuuccaggaaaaaccguaugguuuguaccaucaauaaaagccggaaacgauauagccaacugccuuaggaaaaacggaaaacgagucauucaacucucuagaaaaacauuugauacugaauaucagaaaacuaagaauaacgauugggauuacgucguaacgacagauauuagcgaaaugggagcaaauuuucgugcagaccguguaauugauccuaggcguuguuuaaagccaguaauucuaaaggacggaccugaacguguaauauuagcuggaccaaugcccguuacggucgccagugcagcacaaagaagagguagaauaggucggaaccauaauaaggaaggcgaucaauauauauauaugggccaaccguuaaacaacgaugaagaucaugcacauuggacggaagcaaaaaugcuccuugacaauaucaauacucccgaggguauaauaccggcguuguuugaaccggagagggagaaaucugcagcaauagauggugaauauagguuacguggagaagcgcgcaaaacauuugucgagcucaugagacgaggagaccuaccaguaugguuaucuuacaaaguggcgagugagggauuucaauauagugauagacgaugguguuucgauggagaaaggaacaaucaagucuuggaagaaaauauggauguagaaauuuggacaaaagaaggcgagcggaagaaacugagacccagguggcuagaugcgagaacuuauucagauccguuagcccuaagagaguucaaagaauuugcugcaggccgacguucgguauccggggaccuuauauuagaaauaggaaaauuaccacaacaucuaacacaacgggcucagaaugccuuggacaaucuaguuaugcuacacaauucagagcaaggcgguagagcuuaucgccacgcaauggaggaauuaccagacaccauagaaacauuaauguuauuggcccuaauagcaguacuaacuggcggaguaacacuauucuuucuuucagggaaaggccuaggaaaaacaaguauaggacuacucugugucauggcauccagcguauugcuauggauggcuaguguagagccucauuggaucgcagcgaguauuauauuagaguucuuucucaugguccuuuuaauaccugagccugacagacagcguacaccucaggacaaccaauuagcauacgucguaauuggucuacuuuuuaugauacuaacgguagcagcuaaugagaugggcuuauuggaaacuaccaagaaagaucuuggaaucggacacgucgcaguugagaaucaucaucaugccgcaaugcucgacgucgauuuacaccccgcuucagcauggacguuauacgcgguagcaaccaccauaauuacccccaugaugcggcauaccauugaaaauacuacagcaaacauaucucugacagccaucgccaaucaggcugcaauacuuaugggacuggauaaaggguggccgauaucaaagauggauauuggcgucccacuauuggccuugggcuguuauagucagguaaauccccuaacacuuacagcagccgugcuaauguuaguagcgcauuaugcaauuauaggacccggcuuacaagcuaaggcuacacgagaagcgcaaaaacggacagcugccgguauuaugaagaauccaacaauagaugguauuguagcgauugaucuggauccuguagucuaugaugcaaaguuugagaagcaguuagggcaaauaauguuacuuauacuaugcacaucccaaauacucuugaugaggacuacgugggcguugugugaaucaauaacacuagcuacaggacccuuaacaacauugugggaaggaagucccgggaaauuuuggaauacaaccauugcagucaguauggcuaauauauucagaggaucauaucucgccggagcggguuuggcauucagcuuaaugaaaucacuaggaggcggaagaagaggaacaggggcccaaggugaaacucuaggggagaaauggaagagacaauuaaaccaacucucuaagagcgaguuuaauacauacaaacguaguggaauuauggaagucgauagaagugaagcaaaagagggucugaaaagaggcgaaacgacaaagcacgcugugucgagagguacagcaaaguugcgaugguucgucgaaaggaauuuagugaaaccagaaggaaaagucaucgaucuagguuguggacgaggcgguuggagcuacuacugugcaggacuaaagaaaguaacugaagucaaaggauauacaaaaggaggaccaggucaugaggaaccgauaccaauggcaacguaugguuggaaucuugucaaguuacacagugggaaggauguuuucuuuauaccaccagagaaaugugacacuuuacuaugugauauaggugaaagcagcccaaacccuacgaucgaagaagggaggacacuaaggguccucaaaaugguagagccauggcugagggggaaucaauuuugcauuaaaauauuaaacccuuacaugccuucgguaguagaaacucuugaacaaaugcaaagaaaacauggaggaaugcuuguccgaaauccccucucacguaauucaacucaugagauguauuggguaaguugcgguacaggaaacauaguuagugcuguaaacaugacuucuagaaugcuucuuaaccgauuuacaauggcucaucgaaaaccaacguacgagcgugauguagauuuaggugccgguacucggcauguggcaguugaaccugaggucacaaacuuagauauaaucggccaaagaauugaaaacaucaaauaugaacauaagagcacauggcacuacgacgaagauaacccuuacaagaccugggccuaccacggguccuaugaagugaaaccaucagguagugccucaucaauggugaacggcguaguuaaacuccuaacuaaaccaugggacgucaucccaaugguaacacaaauugcaaugacagauacaacucccuuuggucaacaaagaguuuucaaggaaaaaguugauacgcgcacaccuaaagcgaaaagagguacggcucaaauuauggaagucacugcuagauggcuuuggucauuccuuagcaggaacaagaaaccaagaaucuguacgagagaagaguucacacgaaagguaaggagcaacgcugcgauuggagccguguuuguagaugagaaccaauggaacagugcuaaagaagcgguggaggacgauagauucugggaucuaguacacagagagcgagaauuacauaagcaagguaaaugugcuacaugcgucuauaacaugaugggaaaaagggagaagaaacuaggugaauuuggaaaagcaaaagggucacgcgccaucugguauauguggcuaggagcuagauucuuagaguuugaagcacuagguuucaugaaugaagaucauugguuuagcagagagaacucacuuucaggaguagaaggugaaggacuucauaaauuaggauauauacuccgugacauaaguaaaauaccaggaggcaacauguacgccgacgacacagccgguugggauacacgaauaacagaagaugaucuacagaaugaagcuaaaauaaccgacauaauggagccggaacaugccuuacuagcaaaaagcauauucaagcuaacauaccaaaauaaaguaguucggguacaaaggccugccaaaaauggaacugugauggacguaauaagcagacgagaucaacgugguucaggucaagugggaacauacggauugaacaccuucacuaauauggaagcccaguuaauacgacaaauggaaucagaaggaauuuucucgccaaacgaacuggaaaccccgaaccucgcugagcguguuuuagacuggcucgagaaauacgggguagagagacuuaaacgaauggcgauuagcggugaugauugcguuguuaaaccuauagaugaucguuuugccacggcgcuaaccgcacuaaaugauaugggaaaaguacgaaaagacaucccucaaugggagcccagcaaagguuggaaugacuggcaacaggugccauuuugcucacaccacuuucaccaacuuauaaugaaggauggcagagaaauagucguaccuugcagaaaucaagaugaguuaguaggccgggcucgaguaagccaaggagccggauggucuuuacgcgaaacugcgugccuaggaaaaagcuacgcacaaauguggcaauugauguauuuucaccgaagagauuuaagguuggcggcuaaugcaauuugcagugcaguaccgguugacuggguuccaaccucucgaacaacguggucuauacaugcacaucaucaguggaugaccaccgaggacauguuaagcguauggaaccgcgucuggauagaagagaaucccuggauggaagacaaaacgaggauaucuaguugggaagauguaccauaccugggaaaaagagaagaucaaugguguggaaguuuaauaggcuuaacagcgagggcaacuugggcaacaaauauucaaguugcaauuaaccaaguucguaggcucauugguaacgaaaacuauucagacuauaugacaucaaugaaacgauuuaagaacgagucagaacccgagggcgcuuuaugguag

SEQ ID NO: 22148 - RNA, 9879 nt, Artificial Sequence
  derived and/or modified CDS sequence (opt6) from DENV-1__FJ176780__SS-prME
aguguaacgaugcuacuuaugcuuaugcccacagcgcuagcuuuucaucucacaacaaggggaggagaaccacauaugaucgucuccaaacaagaacguggaaaaucucuccuuuuuaaaacgagcgcaggagugaauauguguacccuaaucgcuauggaucucggugaauuaugugaagauaccaugaccuacaaaugcccuaggauuacugaggcggaaccggacgacguggauuguugguguaacgcaacugauacaugggugacauauggaacuugcucgcaaacuggugagcaucgaagagacaaaagaagcguugcucuagcaccccacguaggccuggguuuggaaaccaggacugaaacauggaugaguuccgaaggagcauggaaacagauacaaagaguagaaacuugggcucuacggcacccaggcuuuacaguuauagcacucuuucuagcucaugcaauaggcacuucgauaacacaaaaaggaauaauauucauccuauuaaugcuaguaacaccauccauggcaaugcgauguguugguauagguucccgagauuuuguggaaggauuauccggggcaaccuggguagauguaguauuagaacacggcucuuguguaacuacaauggcaaaagauaaaccgaccuuagacauagaacuucugaaaacugaaguaaccaauccagcaguauuaagaaaacugugcaucgaagcgaaaauaagcaauacaacgaccgauuccaggugcccuacgcaaggugaagcgacucuagucgaagaacaagacgcaaacuuugugugccggcgcacuuuuguagaucgcggaugggggaauggaugcggccuguuuggcaaaggaaguuuaauuacaugugccaaauuuaaauguguaacaaaauuagaagguaaaauuguccaauacgagaaccuaaaauauucagucauuguuacaguacacacgggcgaucaacaucaaguggguaacgagucaacugaacacggaaccacagcgaccauaacaccucaagcaccaacaacggagauucaacuaacugacuauggugcacuaacucuggacuguucaccgcgaacaggacuagacuuuaaugagauggugcuccuaacgaugaaagaaaaaucuugguuaguucauaaacaaugguucuuagaccucccuuuaccauggacaaguggagcuaguacuucgcaggaaaccuggaaccgacaagacuuguuagucaccuucaaaaccgcccaugccaagaaacaagagguuguggucuuaggcucucaggaaggcgccaugcacacagcgcuaacuggagcaacagaaauacaaacuagcgguacaacaacaauauuugccgggcaccuaaaaugcagauuaaaaauggauaaacuaacgcuuaaaggcaugaguuacguuaugugcacugguucguucaaauuagaaaaagaaguagcggaaacucaacauggaacgguguuaguacaaauuaaauaugagggaacggaugcaccauguaaaauaccuuuuaguacgcaggacgaaaaagguguuacucaaaaugguagacuuauuaccgcgaacccgaucguaacagauaaagaaaaaccaguaaacaucgaggccgaaccaccauuuggcgaaucuuauauuguuauaggagcgggagaaaaagccuuaaaacugaguugguuuaagaaaggaagcaguauaggaaaaauguucgaagcuacagcgcgaggugcuagacgcauggcuaucuugggagauacagcaugggauuuuggaucuauagguggaguuuucacuagcguagggaaauugguacaucagauuuucgggacagcauacggaguauuauuuucuggagugucauggacgaugaaaauagggauaggaguuuuauugacuugguuaggucuaaauucucgaaguacgucacuaagcaugacgugcauagcugugggcuugguuacgcuauaucuugguguaaugguacaagcagacagcgguugcgucauaaauuggaaaggaagagagcugaaaugcgguucaggaauauuuguaacaaaugaaguacacacguggacugaacaauauaaauuccaagcagacuccccaaagagacugagugcagcaauugguaaggcuugggaggagggugucugcggcaucagaucagcgacgcgauuagagaacauaauguggaaacagauuucaaaugaguuaaaucacauucugcuugagaaugacaugaaauuuacaguggugguaggagauguggcagggauccuggcacaagggaaaaagaugauaagaccgcaacccauggaauauaaauacaguuggaaaagcugggggaaggcuaaaauaaucggagcugauguacaaaauacaacguucauuauugaugguccuaauacgccagaaugucccgacgaucaaagggcauggaacauuugggaaguagaggauuauggauuuggcauauucacaacuaauaucugguugaaacuacgugacagcuacacccagguaugugaucacagauugaugucagcagcaauaaaagauucaaaagcuguccaugccgauaugggauauuggauugaaagugagaaaaaugaaacguggaaacucgcuagggcgaguuucauagaaguaaaaaccuguauuuggcccaaaucgcauacacuauggaguaacggaguuuuggaaucugaaaugauuauucccaaaauauacggaggucccauaagucagcauaacuauagaccugguuacuuuacacaaacggcggguccuuggcaucuagggaaacucgaauuggacuucgacuugugugaaggaacuacuguuguuguagaugaacauugugguaacagagggccauccuuaaggacaacuacaguaacggguaaaauaauccacgaaugguguugcagaagcuguacacuacccccgcugcguuucagaggagaagacggguguugguauggaauggaaauucgcccgguuaaagaaaaagaagagaauuuagucaaauccauggucagcgccggaucgggugaaguugacaguuuuucacuaggacuccuaugcauaaguauuaugauagaggagguaaugcguucacgauggucucguaaaaugcuaaugaccgggacuuuggcaguauuuuucuuauuaauaaugggucaauuaacuuggaacgaucugauucguuuauguauuaugguuggagccaaugcgagugauagaauggguaugggaacuacuuauuuagcacuuauggcgacuuuuaaaaugcgucccauguuugccgucggucugcuuuuuagaagacuaacaucgagggagguauugcuccuaacgauaggucuauccuuaguugcuucaguugagcugcccaccucauuggaagaauuaggcgauggacuggcgaugggaauaaugauauugaaacuauuaacugacuuucaaucgcaucaacuaugggcaacacugcuuucccucaccuuugugaaaacaacauuuucauuacacuacgccuggaaaacaauggcaauggugcuaucaauugucucacuauuuccacuaugccucaguacaacaucacaaaagacuacaugguuacccguauuauuaggcagcuuaggauguaaaccgcuaacuauguuccugauugcagaaaacaaaaucugggguaggcguucguggccucuaaaugaaggaauaauggcugucggaauaguuucuauacuauuaaguagccuucuaaagaacgauguuccauuggccgguccacucauugcugguggaauguugauagccugcuaugugauaucaggaucaucagcagauuugaguuuagagaaagcugcagaaguaucuugggaagaggaagcggaacauaguggagcuagccacaauauccucgucgaaguacaggacgacgggacaaugaaaaucaaagaugaagagagagacgacacgcuuacuauauuauugaaagcaacauuacuggccgucucaggagucuacccucuaaguauuccagcgacucuauucgucugguacuuuuggcagaagaagaaacaacguucagguguauuaugggauacaccuucgccaccagagguagaaagggccguauuggaugauggaauauauagaauaaugcagcgcggauuacuagguagaucccaaguagggguagggguauuccaagaaaauguuuuucauacuauguggcacgugacaaggggugccgucuuaauguaucagggaaagagacucgaacccucaugggcuagugugaaaaaggauuuaauaucauauggugguggauggcgguuacaagggagcuggaauacuggcgaagaaguacaaguuauagcaguugaaccuggcaaaaauccaaagaauguucaaacagccccagguacauuuaagacaccugagggugaaguuggagcaaucgcccuagauuuuaaaccagguacuucugguuccccaauaguaaaucgugagggaaaaauuguaggucuuuacggcaacgguguuguaacgacaaguggaacuuacguuucagcaauugcgcaagcgaaagcaagccaagaaggaccauuaccagaaauagaagacgaaguuuucagaaaacgaaaucuaaccauaauggaccuucacccugggucaggaaagaccagaagauaccuacccgcgauaguuagagaagcaauuaaaaggaaacuaagaacucuuauccucgcaccaacaagggucguggcgucagaaauggcagaggcauugaaaggcaugccaauacgguaucaaacaaccgcggucaagucggagcauaccggaaaagagauaguagauuugaugugccaugcgacauuuacaaugcgcuuacuaucaccagugagggucccaaacuauaauaugauaaucauggaugaagcacauuucacugacccuucgaguauugcagcaaggggcuacauuucaacaagaguaggaaugggggaagccgcagcgaucuuuaugacagcgacuccuccuggaaguguagaggcuuuuccccaaucuaaugcuguuauacaagacgaagaacgugauauaccagaaagaucauggaauaguggauaugaguggauaacugacuucccgggcaagacaguuugguucguacccagcauaaaaaguggcaacgauaucgcgaauugucuccgcaaaaacggcaaaagggucauucaacugaguagaaaaacauucgacacagaauaccagaaaacuaaaaacaaugauugggauuauguuguaaccacagacauaagcgaaaugggggcaaauuucagagcagaucgaguaauagacccacggcguugucuuaagccaguaauacuaaaggacggaccagagagaguuauucuugcaggcccgaugccaguuacuguggccagugcugcucaacgaagaggacguauuggcaggaaccauaacaaagaaggggaucaauacauauauaugggccagcccuuaaauaaugaugaggaccaugcucauuggacggaagccaaaaugcuuuuagauaauaucaacacaccagaaggcauuaucccggcauuauucgaacccgaacgagagaagucugcagccauugauggugaauaucgucuuaggggagaagcccgcaaaacauucguagaacucaugaggcggggugacuuacccguauggcuaucuuauaaaguagccucugaaggguaccaauacucugauagacgauggugcuucgauggggaacguaauaaccaaguauuagaagaaaauauggacgucgagauauggacaaaagaaggugaaagaaagaaauuacgaccaaggugguuagaugcacgaaccuauucagauccccucgcacugcgagaguucaaagaauuugcagcgggaaggaggucugugucaggcgauuuaauauuggagauuggaaaguuaccacaacauuuaacgcaacgggcacagaacgcacuagacaaucuaguaaugcuacacaacagcgaacaagggggcagagcuuauaggcaugccauggaagaacuacccgacacgauagaaacucucaugcuacucgcgcuuauugcaguuuuaacaggagguguuaccuuauucuuuuuaucugggcgagguuuagggaagacaucaauaggauugcucugcgucauggccucuaguguccucuuauggauggcuucaguagaaccacacuggauugcggcaagcauaauacucgaguucuuucucaugguacucuuaauacccgaaccggacagacagagaacaccacaggauaaucaguuagcguacguugugaucggacuauuauucaugauuuugacagucgcagcuaacgaaaugggcuuauuagaaacaacuaagaaagacuuagguaucggacauguugcaguagaaaaccaucaccaugcugcgaugcuggaugucgaccuacauccagcaagcgccuggacuuuauaugcugucgcuacgacaaucauaacgccaaugaugagacauacgauugaaaauacaacagccaauauaucgcuuacagcgauagcuaaucaagcagccauuuuaaugggcuuggacaaggguuggccuauaucaaaaauggacaucggcgugccacugcuagcucucggaugcuacucgcagguaaauccucucacuuuaacagcggccguucucaugcuaguagcacauuaugcuauuauagggccuggacugcaagcuaaagcaacuagagaagcacagaaacgaacugcugcgggaaucaugaaaaauccaacugucgacgggauuguugccauagauuuagacccgguaguuuaugaugcaaaauuugagaaacaauuaggccaaauaaugcugcuuauacuuuguaccucacaaauucuacucaugaggacuacaugggcacuaugcgaaucgauuacccuagcuacagguccuuuaacgacacuuugggaaggaagcccugguaaauuuuggaacacuacaauagccgugucuauggcaaacaucuucagggggucauaucuugcaggcgcuggccucgccuucucacuaaugaaaucuuuagggggaggucgaagagggacaggagcucaaggggaaacauugggagaaaaauggaagcgacagcugaaucaacugaguaagagugaauuuaacacguacaaaaggaguggcauaauggaagucgauagauccgaggcaaaagagggacuuaaaagaggugaaacuacaaaacaugcagucucccgaggcacggcuaaauuaagaugguuuguggaaaggaaucuaguaaaaccagaaggcaagguaaucgacuuggggugcggcaggggcgguuggucauauuacugugcaggacuaaagaaaguuacggaaguaaaagguuauacaaaagggggaccaggacacgaagaaccuauccccauggcgaccuauggauggaauuuagugaaacuacacucggguaaagacguauucuuuauaccacccgaaaagugugacacccuucugugcgauauaggugaaucuagcccaaaucccacaauugaggaaggucgcacucuuagaguacuuaaaaugguagagccaugguugagaggaaaucaguuuugcauaaaaauauuaaauccguauaugccaucagucguagaaacauuagagcagaugcaaagaaaacacggagguaugcuugucagaaauccacuaucgagaaacagcacucacgagauguauuggguaucuugugggacggguaauauuguaucagcagugaacaugacuagcagaaugcuacugaaucgauuuacuauggcacacagaaaaccaacguacgaacgugaugucgaucuaggggcaggaacaagacauguugcaguagagccagaaguaacuaaccuagacauaauaggccaaagaaucgaaaauauaaaacaugaacauaaaagcacauggcauuaugaugaggauaacccauacaagacuugggcuuaucacggaucuuacgaggucaaaccaagcgguucagcgagcagcaugguaaacgggguugugaaauuacuuacaaagcccugggauguuauuccuaugguaacacaaauugcgaugacagauacaacacccuucggccaacagagaguauucaaagaaaaaguugauacaagaacucccaaagcaaaacgcggaacagcgcaaaucauggaagugacugccaaguggcuuugggguuuucucucaagaaauaagaaaccacgaauaugcacuagagaagaauuuacaagaaaaguacguucaaaugcugcgauaggggcgguauucguggaugaaaaucaauggaacucggcaaaggaagcaguugaagacgagcgauuuugggaucuaguucauagagagagagaacuacacaaacaagggaaaugcgcaacuugcguauauaacaugauggggaaaagagaaaagaaacugggggaauuugguaaagccaaggggaguagggcgauuugguauauguggcucggggcuagauuccuagaauuugaagcacuagguuuuaugaaugaggaccauugguuuaguagagaaaauaguuuaucuggaguugaaggugaagggcuucacaaacuaggauauauacuaagggauauaagcaaaauuccuggugguaauauguaugccgaugauacugcagguugggauacgcgaauaacggaagaugaucugcaaaaugaagcaagaauaaccgauauaauggaaccagagcacgcuuuauuggcaaaauccauuuuuaagcuaacauaucaaaauaaggugguacgaguacaacguccagccaaaaaugggacugucauggacguuauaagucgacgggaucaaagggggucgggacaaguagguaccuauggacucaacacauuuaccaauauggaagcacaacucauucgucaaauggaaucugagggaaucuucagcccaagugaguuggaaacaccgaacuuagcagagcgagugcuagacuggcuugagaaauacgggguugaaagguugaagagaauggcuauuucaggagaugacuguguaguaaaaccaaucgacgaucguuucgcgaccgcuuugacugcguuaaacgauauggggaaagucagaaaagauauuccacaaugggagcccagcaaaggcuggaaugacuggcaacaagugcccuuuuguucacaccauuuccaucaauuaauaaugaaagacgggcgugaaauuguaguaccaugucgaaaucaagaugaacucguaggccgugcccgaguaucacagggagcugguuggagucuaagagaaacagcaugcuuggggaaaagcuacgcucaaauguggcaacucauguacuuucauagacgggaccuacgauuggccgccaacgcuauuuguagugcuguaccaguagauuggauaccaacgucucgcacuacguggagcauccacgcacaucaccaguggaugacuacagaagacaugcucagugucuggaaccgagucuggauagaggaaaauccauggauggaggacaaaacacauauaaguagcuggggagacgucccuuaccucggcaaacgcgaagaccaauggugugguagucuaauaggucucacagcuagagcgacuugggcuacaaauauacaagucgcgauuuaucagguccggcguuuaauaggcaaugaaaacuauuuggauuauaugacaucaaugaaaagguuuaaaaacgagagugacccagagggagcuuuaugguag

SEQ ID NO: 22149 - RNA, 9879 nt, Artificial Sequence
  derived and/or modified CDS sequence (opt6) from DENV-1__JN205310__SS-prME
agcguaacuguccuauuuaugcuccuaccgacugcauuagcauuccaccuuacuaccuugggaggagagccacauaugauuguaagcaaacaagaacgagguaaaaguuuacucuuuaaaaccucagcggggguuaacauguguacguugauagcuauggacuuaggcgaacuaugugaagauaccaugacuuacaaauguccuagaauaacagaaaccgaaccagaugacgucgauuguuggugcaacgcaaccgaaacauggguuacuuaugguaccugcucucaaacaggagaacacagacgggauaaacggaguguugcacucgcaccacauguuggucugggacuugaaacuaggaccgaaacguggaugucgucagaaggugcauggaaacaaauacaaaaaguagaaacaugggcacuacgucauccuggcuuuacaguuauagcacucuuuuuggcucacgcuauaggcacuucuauaacccaaaaaggaauuauauucauacuucuuauguuaguaacaccuucgauggcaaugcgcuguguugguauaggcaaucgagauuuuguggaaggcccuuccggcgcaacauggguagacguuguuuuagaacaugggagcugcguuacaaccauggcgaaaaacaaaccgacuuuagauauugaacuauuaaaaacagaagugacaaauccagcaauacuccgaaaacuauguaucgaagcuaaaauuucgaacacgacaaccgacaguagaugcccuacacaaggcgaagcgacgcuaguggaagaacaagauacgaacuuuguauguagacguacauuuguagacagaggguggggaaacggaugcggguuguuugguaaaggauccuuaauuacaugugcaaaauuuaaauguguuacaaaacuagaaggaaaaaucguccaauaugaaaacuugaaauauucaguaaucguaacaguccauacgggcgaucagcaucaaguagguaaugaaacgaccgagcauggaacaaccgcaaucauaacaccacaagcuccuacaucugaaauucaacugaccgauuauggugcucuaacucccgacuguucaccuaggacaggccucgacuuuaaugaaaugguauugcugacgaugaaagaaaaaucuugguuaguucauaaacaaugguuccuugaucuaccauuacccuggacaucaggggccucgacuucccaagaaacauggaaccgacaagaucuccucguuacauuuaaaaccgcgcaugccaagaaacaagaaguagucguauuaggcucacaagaaggggcuaugcacacugcguugacgggagcaacagaaauacaaacuuccgguacuacgacaauauuugcuggucauuuaaaaugcagauugaaaauggacaaacuaacguuaaaagguguuucguaugugaugugcacugggagcuuuaaguuagaaaaagaaguagcugaaacccaacauggcaccgucuuaguucaaguaaaguacgaaggcacggaugcucccugcaaaauacccucaagcagccaagaugaaaaaggagugauacagaaugggcguuuaauuacagccaauccuauaguaacggacaaagaaaaaccagugaauauagaagcagagccaccauuuggugaaagcuauauugugguuggugccggugaaaaagccuuaaaacuauccugguuuaagaaagggagcaguauuggcaagauguucgaagcgacggccaggggugcaaggaggauggcuauuuuaggagauacagcuugggauuuuggaagcaucggagguguauuuacaucuguaggaaaauuaguacaucaaauauuugguacagcauauggaguacuauuuucgggugucucauggacaaugaaaauuggaauaggaauuuuacuuacgugguuaggccuaaauagcagaucuacaucucucuccaugaccuguauugcuguaggaaugguaacucuauacuuaggggucaugguccaggcggacagcggauguguuauaaauuggaaagggagagaauuaaaaugugguucagguauauuugucacuaacgagguacauaccuggaccgaacaauacaaauuccaggcggacucaccaaaaagauuaagugcagccauaggaaaggcuugggaagagggugucugcggcauuagaagugcuacccgauuagaaaacauaauguggaagcagauuucuaaugaacuaaaccauaucuuauuggaaaacgauaugaaauuuacggugguuguuggagauguaucuggaauauuggcgcaaggaaagaaaaugauucggccucagcccauggagcauaaauauagcuggaaaagcuggggcaaagcaaagaucauaggcgcugauguccaaaacacaacauucaucauagauggcccuaauaccccagaaugucccgacaaccaacgagcauggaauauuugggagguggaagauuauggauucgguauauuuacaacuaacauauggcuaaaauuaagagauucuuucacacagguaugcgaucauagauuaaugucagccgccauaaaagauagcaaagcagugcaugcggacauggguuauuggaucgagagcgagaagaaagaaaccuggaaauuggcacgggcgucauucauagaaguaaaaacauguauauggccaaaaucgcauacucuguggaguaacggaguauuggagucugaaaugaucaucccaaaaaucuacggaggccccgucagucaacauaauuacagaccggguuauuuuacgcaaaccgcuggcccuuggcaucuaggcaaacuagaauuggauuuugacuugugcgaaggaacaacugucguaguagaugaaaacugcggcaacagaggaccgaguuuaagaacuacgacugucacaggaaaaacaacgcaugagagguguuguagaaguuguacauuaccgccauuacgauucaaacgcgaggaugguuguugguacggaauggaaauuagaccugugaaggaaaaagaagaaaacuuagugaagucuauggucuccgcaggcuccggagaaguagauaguuuuucauuaggacuuuuguguauaucaaucaugauugaagaggugaugagaagcagauggagucgaaagaugcugaugacagguacucuggcuguauuuuuauuacugacaauggggcaaaguacauggaaugauuugauaagacuauguacuaugguuggcgcuaacgcauccgacaugauggggaugggaacuaccuaucuagcauuaauggcuacauucagaaugaggcccauguuugcugucgguuugcuguuccgaagacugacuucaagggagauucuacugcuuacugugggccuaagucugguagcaucaguagaauugcccaauagucuagaagaacuuggagacggucuagcuauggguauaaugauguugaaacucuugacggacuuucaaccacaucaacuuugggcgaccuuguuaagucuuacauuuguuaaaacuacacuaucccuacacuacgcauggaaaacgauggcgaugauucucaguaucgucucauuacuuccacuuugcuuaucuaccacaucacagaaaacuacuugguuacccguccuauuagguagucuaggaugcaaaccucuaacgauguuccuaauuacugaaaauaaaauuuggggcagacguagcuggccacugaacgaaggcauaauggcaauaggcauaguuucuauauuauuauccucacccuugaaaaaugacguaccacuagcugguccacucauagcaggagggaugcucaucgcuuguuacgucauaagcggaucaucagcggacuuaucuuuagagaaggcagcagaggucucaugggaggacgaggcagaacacaguggugcaagucacaacauuuuagucgagguucaagaugauggaacuaugaaaauaaaagaugaagaaagagaugauacguuaacuaucuuguuaaaagcaacgcuauuagucauaagugguguauauccuauguccauaccugccacuuuauuugugugguacuuuuggcagaagaagaaacaacgcucagguguauuaugggauacgccuaguccuccugaaguugaacgagcgguauuagauaaugguauauacagaauacuacagcguggcuuacucggcagaagccaggucgguguaggcguauuucaagagggaguguuccauacaauguggcauguaacgagaggugccguauuaauguaucaaggcaaaagacuagaaccaucuugggcaucaguuaaaaaggaucugauaaguuauggaggugguuggagguuucaggggucuuggaauacaggcgaggaaguacagguaauagcaguggaaccugguaaaaaccccaaaaaugugcagacaacgcccgguacauucaaaacgccagaaggggaaguaggagcuauagcacuggauuuuaaaccaggcacauccgggucaacuauuguuaacagggaaggaaagauagugggacuguaugguaaugguguuguaacgacaaguggaacguacguuagugcgauugcacaggcaaaggcgagccaggagggcccucuaccugaaauugaggacgaaguauuucguaaacgaaacuuaaccaucauggaccugcacccuggaucggggaagacuaggagauaucuaccggcuaucgugagagaagcuaucaagagaaaauuaaggacuuuaguacuggcuccaacuagagucguagcgucggaaauggcggaagcccuuaagggaaugccuauuagauaccagacuacagcaguaaaaucugaacacacaggaaaagaaauuguagauuuaaugugccacgcuacauuuacgaugagacuccuaucaccgguaagggucccaaacuacaacaugauuauuauggaugaagcucauuuuacagauccugcgucaauagccgcgagggguuauaucagcacgagaguugguaugggggaggcugcugcgauauuuaugaccgcaacgccuccaggaaguguagaagccuucccccaaucaaaugccgucauucaggaugaagaaagggacauaccugaaaggucauggaauagugguuacgaauggauuacugauuuuccgggcaaaaccguuugguuuguccccucaauuaaaucaggcaaugauaucgcgaacugccuucguaaaaauggaaaaagaguuguucaauuaucaagaaaaaccuuugauacugaguaucagaaaaccaaaaacaacgauugggauuaugugguaaccacagauauaagcgaaaugggggcuaauuuucgagcagauagaguaauagauccaaggcgcugccugaaaccagucauauuaaaagauggcccagaacgugucauacuggcuggucccaugccuguaacagucgccagugcggcucaacguagaggaaggaucggaaggaaucccaauaaggaaggcgaucaguaugucuacauggggcaaccccuaaauaacgaugaagaccaugcacacuggacugaagcgaaaauguuacuagacaauauaaacacaccugagggaauaauuccagcacuauuugaaccagagagagagaagucugccgcaauagauggcgaauacagauuaaggggugaggcgagaaaaaccuuuguugagcuaaugagaaggggugauuuaccgguauggcuauccuacaaaguagcaagugaaggcuuucaauauucggacagacggugguguuuugauggggagcgaaacaaccaaguccucgaagaaaacauggacgucgaaaucuggacgaaagaaggagaaaggaagaaacuacguccaagauggcuugaugcgagaaccuauagugacccccuagcacuacgagaguucaaagaauuugcagcagguagacgaucaguauccggcgaccuaauauuggaaaucgguaaacuaccacaacauuuaacuuuaaaagcucaaaacgcauuagauaacuuagucaugcugcauaauagugagcagggcggcaaggcuuacaggcacgcgauggaagaauuacccgauacaauugaaaccuuaauguuauuagcgcuaaucgcuguacugacaggcgguguaacacuauuuuuccucagcgguaggggauuaggaaaaaccucaauaggacuacuguguguaauggcuagcagugugcucuuauggauggcaucagucgagccucacuggauagcugcauccauaauccuagaguucuuuuuaaugguccuacuuauuccagaacccgauagacaaagaaccccacaagauaaccaacuugcauacguuguaauagggcuucuauuuaugauacuaacaguagcggcaaaugagaugggccuauuagaaacgacgaaaaaggaucuagggauuggucaugcagccgcagaaaaucaccaccaugccgcgauguuggauguagaucugcauccggccucagcuuggacacucuaugcgguagcaacaacaauaauaacgccaaugaugcgacauacgaucgaaaauacgacggcgaacauuucauuaacugcuauagccaaucacgccgcuauuuuaaugggccuggacaaagguuggccuauuucaaaaauggauauagguguaccauuacucgccuuaggauguuacucacagguaaacccauuaacucugacagcagcgguuuuaauguugguagcacauuacgcuauaauuggccccggauuacaggcgaaagcaaccagggaagcgcaaaaacguacggcugccggaauaaugaaaaauccuacgguugauggaauuguggcaauagacuuggauccaguuguauaugacgcuaagauugaaaagcaacuagggcaaauuaugcuauuaauucuauguaccucacaaauacugcuuaugcggacuaccugggcauuaugcgaaagcauuacauuagccacggguccuuuaaccacacuuugggaagguaguccuggaaaauuuuggaauacgacgauugcuguuuccauggcuaauaucuuccgaggaucguacuuagcuggggcuggccuugcauuuucguuaaugaagaguuugggaggagguaggagaggaacuggggcacagggcgaaacucuaggcgaaaaauggaaaagacaacucaaucaauuaagcaaaucagaauuuaacauauauaaaaggagcgggauaauugaaguagauagaagcgaagcaaaggaaggguuaaaacgcggcgaaacuacuaaacacgcaguauccagggggacggcgaagcucaggugguucgucgagcgaaaucuugucaaaccagagggaaagguuauagaccucggauguggacgagguggaugguccuacuauugcgcaggccugaagaaagugaccgaaguuaaaggguacacaaaaggaggcccgggucacgaagaaccaauaccuauggcaacuuacggguggaauuuaguuaaacuucauucagggaaggacguauucuuuacuccacccgagaaaugugauacucuucuaugcgacauuggggaaucaucaccgaauccgacuauagaagaaggacggacacuaaggguacugaaaaugguagaaccauggcuaaggggaaaccaauucugcauaaaaaucuugaaucccuacaugcccaguguagucgaaacgcuagagcagaugcaaagaaaacauggagguaugcuugucagaaacccauuauccagaaauaguacccaugagauguacuggguuaguuguggaacaggaaauauagucagugccgucaauaugacaagccggauguuacucaauagauuuacgauggcccaucgaaaaccaacguaugaaagagauguugacuuaggagcaggcacaagacacguagcuguggagccagagguagcaaacuuagacauuauaggacaacgaauagaaaacauuaaaaacgaacauaaauccacauggcauuaugacgaagacaacccauauaagacuugggcuuaccacggaucuuaugaaguaaaaccaagcgguuccgcaagcaguaugguaaaugguguaguaagacuucuaacgaaaccaugggauguuauaccgauggucacgcaaaucgcaaugaccgauaccacacccuucggccaacagcgaguauuuaaggagaaaguagauacuagaacgcccaaagcaaaacguggaacugcgcaaauaauggagguuacagccagauggcuauggggguuuuuauccaggaacaagaaaccaagaaucugcacgcgagaagaauuuacacgaaaaguuaggucaaacgcagcuauuggugcaguauucgucgacgaaaaccaguggaauagugcuaaagaagcuguugaagaugaacguuucugggaucuaguucaucgagaacgcgaacugcacaagcagggaaaaugcgccacuugugucuacaacaugaugggacguagggagaagaaacugggugaauuuggaaaagccaaaggcuccagagcaauuugguacaugugguuaggugccagauuucuggaauuugaagcccuaggauuuaugaaugaggaucacugguucaguagggaaaacagucuuagcggaguugaaggggagggacaucauaaacucgguuauaucuugcgggauauaaguaaaauaccuggaggaaauauguaugcagaugacacggcaggcugggauacaaggauaacagaggacgaucuacagaacgaagcaaaaauuacugacaucauggagccagaacaugcauuauuagcaacgaguaucuuuaaauugacauaccagaauaaggugguacguguacagagacccgcuaaaaaugguacugugauggauguaauaaguagacgagaccaaagaggaucaggacaaguggguacauacggcuugaauacuuucacuaacauggaagcucaauuaauaagacaaauggaaucugaagggauauuuaguccaagcgaauuagaaacuccaaaccuagcggaaagaguuuucgauuggcucgaaaaacauggcauagaacgauuaaagaggauggcaauaucaggagaugauuguguaguaaagcccauagaugauagauucgcaacagcgcuaaccgcucuuaacgauauggguaagguaaggaaagauauaccgcaaugggaaccaccuaaaggguggaacgacuggcaacaaguaccauuuugcagucaucacuuucaccaguugauaaugaaagauggcagagaaauaguuguacccugcagaaaucaagacgaguuaguugggcgagcucgggucucacagggugcagguuggucacuacgugaaacugcgugcuugggaaaaucuuacgcacagauguggcagcuaauguacuuccacagaagagacuuaagacucgcugcaaacgcuauuuguucggcugucccaguugauuggguucccacaaguaggacgacguggaguauucacgcgcaccaucaauggaugacgaccgaagauauguuaucagucuggaacaggguauggauagaagaaaacccauggauggaagauaaaacucacguaagcucaugggaagaugucccuuaucuagggaagcgagaggaccaguggugcggcagcuugaucggauuaacagcaagagcaacgugggcaaccaauauucaaguugccauaaaccaaguaagaagguuaauagguaacgagaacuauuuagacuauaugacaaguaugaaaagauucaagaacgaauccgaccccgagggagcuuugugguga

SEQ ID NO: 22150 - RNA, 9879 nt, Artificial Sequence
  derived and/or modified CDS sequence (opt6) from DENV-1__HQ332182__SS-prME
agcgugacaauguuacuaaugcuucugccgacagcgcuagcauuucaucuaacaacacgaggcggggaaccgcauaugauaguuagcaaacaagaacgagggaaaucauuacucuucaaaacaagcgcagggguuaauauguguacuuuaauagcaauggaccuaggggaacuaugcgaagauacaaugacauacaaauguccacgaauaacggaagcagaaccugaugacguugauuguugguguaaugcuacagauacauggguaacauaugguacaugcagccaaacuggagaacauagaagagauaaacguucugucgcuuuagcaccccauguggguuugggucuugaaacgcgaaccgaaacguggaugaguagcgaaggagcauggaaacagauacagaggguagagacaugggcacuccgccauccuggauuuacaguaauagcuuuguuucuugcacaugcaauuggcaccucgauuacgcaaaaaggaauuauauucauacuauuaaugcuaguaacaccaucuauggcgaugcguugugucggaauuggaaauagagacuuuguagaaggacuuaguggggcaaccugggucgaugucguauuggaacaugguaguugugucacgacuauggccaaaaauaaaccaacauuagauauagaauuguuaaaaacggagguuacaaauccagcaguucuuaggaaacuaugcauugaagcuaaaauuucuaauacaacuacagacagccggugccccacucaaggagaggcgaccuuaguugaagaacaagaugcaaacuucguaugcagaaggacauuuguagauagagguugggguaaugguugugguuuauuuggaaaaggcucauugcuuacuugcgcuaaauuuaaaugugucacaaaacuggaggguaaaauaguccaauacgaaaacuuaaaauauucgguaauaguaaccguucacacgggagaucagcaccaggucgguaacgaaacgacagaacacgguacaauugcuacuauaacaccucaagcccccacgagcgaaauacaacuaaccgacuacggcgcuuuaaccuuagauugcucuccccgaacgggucucgauuucaaugagaugguacuauuaacaaugaaagaaaaaucgugguuaguccauaagcagugguuccuugauuuacccuugccauggacaagcggagcgaguacaagccaagagaccuggaauagacaagacuuauuaguuacguucaaaacagcacaugcaaagaaacaagagguagugguauuaggaucacaggagggugcgaugcacaccgcauugacaggugcuacagaaauucaaaccucugggacaacgacuauauuugcuggccaccuaaaaugcagacugaaaauggauaaauugacauuaaagggcacaagcuacguaauguguacaggaaguuucaagcuagaaaaagaaguagcugaaacucaacaugguacaguauugguccagguuaaguacgaaggcaccgacgccccuuguaaaauaccauucucaacacaagaugagaaaggagugacgcaaaaugguaggcuaauaaccgccaacccaauuguaacugacaaagaaaaaccggucaauauugagacugaaccaccuuucggagaauccuacauaguaguaggggcgggugagaaagcauuaaaacuguccugguucaaaaaggguucuucaauaggaaaaauguucgaagcaaccgcgagaggagcuaggagaauggcgauucucggggacacagccugggauuuuggaaguauugggggaguauucacaagcguuggaaagcuaguacaccaaguguuuggaaccgcauauggggugcuguuuucaggcgucucguggacaaugaaaauagguauagguauacuacuuaccuggcuaggauuaaacagccgcaguacaucauuguccaugacauguaucgcggugggaauggugacccuauacuugggagucaugguacaggcugauucaggguguguaauaaacuggaaagggcgagaacucaagugcgggaguggaauuuuuguaacaaacgaaguccacacauggacagaacaauauaaauuucaagcugauucaccuaaaagguuaucagcggcgaucgguaaggcuugggaggaaggugugugcgggauucgaagugcuacccgacuggaaaauauaauguggaagcaaauaaguaaugaguuaaaccauauccuacuagaaaaugauaugaaguucacaguagugguuggcgacgccaacggcauauuagcccaaggaaagaaaaugaucagaccucaaccuauggagcacaaauacucguggaaaaguugggggaaagccaaaauaauaggagccgacauucagaauacuacuuuuauaauagauggaccugacacuccagaaugcccagaugaucagcgcgcguggaauaucugggaaguggaagauuauggauucggaaucuucacuacuaauauuuggcugaaauugagagauagcuauacucaaaugugcgaucacagacugaugagugcggcuauuaaagauucuaaagcuguucacgccgauaugggguacuggauagagucugagaagaaugaaaccuggaaauuagccagagcaucauucauugaaguaaaaacauguaccuggccaaaaucucauaccuuauggucgaacggcgugcucgagagugagaugauaauaccaaaaaucuacggaggucccaucagucaacacaacuauaggccuggcuauuuuacacaaacagcuggaccauggcaucuugggaaauuagaauuagauuuugaucuuugcgaggguaccacaguuguuguagaugaacauugcgggaacaggggaccaagucuacgaacgacaacagugacaggaaagauuauccaugagugguguugcagaucauguacgcuuccaccacuacgauuuagaggggaggaugguuguugguaugguauggagauacgaccugugaaagaaaaagaagaaaaccuaguucgaucgaugguuuccgcuggaucaggcgaaguugauucauuuucuuuagguauacuuuguguuaguauaaugauagaagaggucaugagaagucguuggaguagaaaaauguugaugaccgguacauuagcgguuuucuuauuacuaauuaugggucaauuaacuuggaacgaucuaauucgacuauguaucauggugggcgcgaacgcaucagacaggauggggauggguacuacguaccuagccuuaauggcuacauuuaaaaugcgaccaauguucgccguuggauuauuguuucgaagacuuacaucccgagaaguucuucuucuaacuauaggccuaagccuaguagcauccguagaguuaccuaauagccucgaagaacucggcgacgguuuagcaaugggcauaaugauguuaaaguuacuaacagaauuucaaccacaccaacuauggaccacgcuuuuaagccuuacauuuauuaagacaacauuaagccuagacuacgcauggaaaaccacagcaauggcguuaucaauaguaucauuauucccucuaugucuaucuacaacaucccagaaaacaaccugguuaccuguuuuauuaggaucguucggcuguaaaccguuaacaauguuccuuaucacggagaauaagauuuggggacguaaaaguuggccgaucaacgaaggcauaauggcuauagguauaguaagcauucuacuuucaagccuucucaaaaacgaugugccuuuagcagggccucugauagcgggugguauguugauugcaugcuacgucaucucuggcaguagugcugacuuauccuuggaaaaggcggccgaaguuaguugggaacaagaagcagaacacagcgguacgucccacaauauacugguugagguacaagaugauggcacaaugagaaucaaagaugaagagaaggacgauacauuaacaauucuauuaaaggcuacauugcucgcagugaguggagucuacccaaugucaauccccgcaacacuguucgugugguauuucuggcagaaaaagaaacagagaucgggaguauugugggacaccccaaguccucccgaaguagaaagggccguacuggaugaugggauuuauagaauauuacagcgggguuuacuagguaggucucaaguggguguuggaguuuuucaagacggcgucuuucauacuauguggcacguuacuagaggggcuguccucauguaucaaggcaaaaggcuugaaccuagcugggcgaguguuaagaaagacuugaucaguuauggcggaggauggagauuucaaggaucauggaauacuggagaagaaguccagguaauagcaguagagccaggaaagaacccuaaaaacgugcagacaacuccuggaacuuuuaaaacaccagaaggggaaguaggagcgauugcguuagauuuuaagccuggaacaucuggcucacccaucguaaaucgugaaggaaaaauuguaggucucuauggaaauggaguugugacaacaucggguacauauguaucugcuauagcgcaagcgaaggcuucacaagagggcccucuuccggaaaucgaggaugaaguguuuaagaaaagaaauuuaacuauaauggauuuacacccugguaguggaaaaacgaggagauaccugccggcaauuguacgagaagccaucaagaggaaauugagaacuuuaauucuagcacccacaagaguaguagcauccgaaauggcugaagcacuuaaaggaaugccuauuagauaucaaacgacugcugucaaaucugagcacaccggcagagagauuguagacuuaaugugccaugcaacuuuuacgaugagacucuugagccccguuagaguucccaacuauaacaugauuaucauggaugaagcacauuuuaccgacccugcaucuauugccgcaagagguuauaucaguacucguguagguaugggugaggccgcagcaauauuuaugacagcgacgccaccagguucagucgaagccuuuccacaaucaaacgcaguuauacaggaugaagaacgugauauaccugaacgcucuuggaacucgggauaugacuggauaacugauuucccggggaaaaccgugugguuugugccuagcauuaaaucggggaaugauaucgcaaauugccuccgaaagaauggaaaacggguaauucaacuaaguagaaagacauuugacacagaauaccagaaaaccaaaaacaaugauugggauuacguaguuacuacagauauaagugagaugggugcaaauuuuagggcagauagagugauagacccccggagaugccuaaagcccguaauucuaaaagauggaccugagagagucauucuggccgggccgaugccaguaacuguggcuucggcugcucaaaggagaggccggauaggccgaaaccaaaauaaagaaggagaucaguacguguauaugggacaaccacugaacaacgacgaagaucaugcccauuggacugaagcuaaaaugcucuuagauaacauuaauacuccagaagguauaauuccagcgcuauucgaaccagaaagagagaaaagugccgccauugacggagaauaucgacuuagaggugaagcaagaaaaacguuuguagaacucaugagacgaggggaucuacccguuuggcuuucauacaagguagcaagcgaaggcuuucaauauagugaccgacguugguguuuugauggagagagaaacaaucagguguuagaagagaacauggauguggaaauauggacuaaggaaggcgagagaaagaaacuccgcccccgaugguuagaugcgcgaacuuauagugauccgcuggcccuaagagaguuuaaagaauuugcggcaggaagaagaaguguaucuggcgaucuaaucuuagaaauaggaaaacugccgcagcacuuaacuuuacgcgcgcaaaaugcgcucgacaaccuugucaugcuacauaacagcgaacaagggggaaaggcuuauagacacgcuauggaagaacuaccagacacuauagagaccuugaugcuccuggcgcucaucgcaguuuuaacaggaggagucacucuguucuuucuuagcggaaaaggacuaggcaagacuucaauagguuugcucugcgucaccgcaucgucgguauuauuauggauggcuucaguagaaccccauuggauugccgcuucaauaauacuagaguucuuucuaauggucuuguuaauaccagaaccggauagacaacgcacaccccaagacaaucaacucgcguaugucgucaucgguuuauuauuuaugauccucacaguagcagcgaaugaaaugggccuacuggaaacaacgaaaagggacuuaggaauaggacacguagcugcugaaaaccaccaacacgcgacaaugcucgacguagaucuaagacccgcaucagcguggacgcucuaugcggucgcgacgacagugauaaccccuaugaugagacauaccauagaaaauacgaccgcaaacaucagucuaacugcuauugccaaccaagcagcuaucuuaauggggcuugauaaaggauggcccauuaguaagauggauaucgggguuccacuacuagcuuuaggaugcuauagccaagugaauccguuaacacuuacggcagcaguauugaugcuagucgcucacuaugcgauaauaggaccgggauuacaagccaaggcaaccagagaagcucaaaagagaacugcagcuggcauuaugaaaaaucccaccguggauggcaucgucgcuaucgaccuagauccgguaguauaugaugcaaaauucgaaaaacagcuuggucaaauaauguuacuaauccuuugcgcuucacaaguacucuuaaugcggacaaccugggcacuaugcgaaucuauuacccucgcaacagggcccuuaacaacccuaugggaggguucaccagguaaguucuggaauaccacaaucgcaguaucaauggccaauauauucagaggcucguaucucgccggugcagguuuggccuuuucacuuaugaaaaguuuaggcggaggacgaagggguacaggagcccaaggcgaaaccuugggugaaaaauggaaaagacaacuaaaucaacuaagcaaaagugaguucaauaccuauaagcguucaggaauaauggaaguagacagauccgaagcaaaagaaggauuaaagagaggcgaaacuacuaagcaugccgucucaagagguacggcaaaauuaagaugguuugucgaaagaaaccugguaaaaccugaaggaaaaguaauagauuuaggauguggucgcgguggauggagcuauuacugcgcaggauuaaagaaaguaaccgaaguuaaagguuacaccaaaggagguccgggccaugaagaaccgauaccaauggcaacauaugguuggaaccuaguaaagcuacacagcggaaaagauguauucuuuaugccuccagaaaaaugugacacacuacucugugauauuggugaaucuucgcccaacccgacaauagaagaggguagaacccuacgaguucuuaaaaugguugaaccauggcuacgcgguaaccaguucugcauuaagauccugaacccauauaugccaucuguagucgagacauuagaacaaaugcagaggaaacauggagguauguuaguucgcaacccgcuaagcagaaacucuacacaugagauguacuggguuagcugcggaacuggcaauauaguaagugcuguuaauaugacuucucggauguuacuuaaucguuuuacaauggcccaucgaaaaccgacauaugaacgagacguagaccuaggagcaggaacaagacacguggcaguagaaccggaaguugcaaacuuagacauuauaggucaaaggauugagaacaucaaaaaugaacacaaaucaaccuggcauuaugacgaggauaauccuuacaaaacuugggcauaccaugguagcuacgaaguaaaacccucgggcagugcaucgucgauggugaauggaguaguacgacugcugaccaaacccugggaugugauaccgaugguaacucaaaucgccaugaccgauacuacgccauucggacaacaacgaguguucaaagagaaaguagauacacgaacuccaagagcuaaacgugguacgacucaaaucauggaaguaacagcuaaaugguuaugggguuuucuaagucgcaacaagaaaccgcggauauguacgagggaggaauuuacgagaaaagugaggucuaaugccgcuguuggagcuguauuugucgacgaaaaccaguggaacagugcuaaagaggcgguagaggacgaacgauuuugggauuuaguucauagagaaagagaacuucauaaacagggaaaaugugccaccuguguguauaauaugaugggcaagagggaaaagaaauuaggcgaguuugguaaggcuaaagggucacgugcaauuugguauauguggcucggagcaagauuucuagaguucgaggcacucgguuuuaugaaugaagaucauugguuuaguagagaaaacagccuuucaggagucgaaggagaaggacuccacaaauuaggcuauaucuuacgggauauaaguaagauaccaggagggaauauguacgccgacgacacagcagggugggauacacgaaucacggaagacgauuugcaaaacgaggccaagauaacagauauaauggaaccagagcacgcccuacuggcaacaucaauauuuaaauuaacauaucaaaauaaagugguacgcguacaaagaccugccaaaaaugguacaguaauggacgucauuagucgacgugaucaacgaggaucuggucaggugggaacauauggcuuaaauacuuucacaaauauggaaguucaacuuaucaggcaaauggaaucagaagggauauuuuuaccgucggaguuagaaacccccaauuuggcugaaagaguauuagauuggcuggagaaacauggagcagaaaggcugaaacgaauggcaauaucuggagaugacuguguaguaaagcccauagaugacagauucgcaaccgcccucacugcuuuaaacgauauggggaaggucaggaaggacaucccucaaugggagccuucuaaaggguggaaugacuggcaacaaguuccauucugcucacaccauuuucaucagcugauaaugaaggacggacgugagauagucguacccugucguaaccaagaugaacuuguuggacgugcuagaguuagucaaggagcuggauggagccuuagagaaaccgcaugccuagguaaguccuaugcucaaauguggcagcugauguacuuccauaggagggaccuucgucuggcugcuaacgcaauauguucagcuguaccaguagauuggguaccuacaagucgcacgaccuggucgauucacgcccaccaucaauggaugacuaccgaagauauguuaucagucuggaaucgaguuuggaucgaagaaaacccauggauggaagauaaaacacauguaaguaguugggaagaagugccauauuuaggaaagagagaagaucaauggugcgggaguuuaaucggcuuaacagcuagggcaaccugggcgaccaauauacaagucgcaauaaaucaagugaggcgauuaaucggaaacgagaauuaucuagacuacaugacuucaaugaaacgcuuuaaaaaugaaucagauccagaaggagccuuaugguag

SEQ ID NO: 22151 - RNA, 9879 nt, Artificial Sequence
  derived and/or modified CDS sequence (opt6) from DENV-1__HQ332181__SS-prME
aguguaacuauguuacuaauguuauugccuacggcucuagcuuuucaucuaacuacacgaggaggggaaccacacaugauagugaguaaacaagaacgcggcaaaucuuuguuauucaaaaccucagcaggaguuaauaugugcacacucaucgcaauggaccuaggagaacuuugugaagauacaaugacuuacaaauguccuagaaucaccgaagcagaaccagaugauguagauuguuggugcaaugcgacagacacaugggucacguacggaaccuguagccaaaccggagaacaccggagagagaaaagguccguagcgcucgccccacauguuggacuaggucucgaaacacgcaccgaaacauggaugaguucugaaggggcguggaagcaaauacaacggguagaaacaugggcgcuaagacauccagguuucacaguaaucgcauucuuucuggcucacgcaauagguacaaguauuacucaaaaggggauuaucuuuauuuuguuaauguugguaacuccaucaauggcgaugcguuguguuggaauaggaaauagagauuuuguagaagguuugagcggggcuacguggguagacgucguuuuagaacauggaucauguguaacaacaauggccaaaaauaaaccaacauuagacauagaauugcugaaaacggaaguaacaaauccugccgucuugagaaaacugugcauugaagcuaaaaucucaaacacaacgacagauucacguuguccaacacaaggggaggcaacgcuaguagaagaacaagacgcgaauuucguauguagaagaacguucguagacaggggauggggaaauggauguggacuauuuggaaaaggaucccucuuaacuugcgcaaaauuuaaaugcguuacaaaacuagagggaaaaaucguacaauaugaaaauuuaaaguacagugucauaguuacagugcauacgggugaucaacaucaagugggcaacgaaacaacugaacauggaacaaucgccacaauuaccccacaagcaccaacaagugaaauacaauuaacugacuacggagcacuaacucuugauuguucaccccgaacaggauuagacuuuaaugagaugguucugcucacuaugaaagagaagucuuggcuugugcacaagcaaugguuuuuagauuugccauugccauggacaagcggagcuucaaccucacaagaaacauggaaucgucaagaucugcugguaacauucaagacagcucacgcuaaaaagcaagaaguagucguauugggcucucaagaaggagcgaugcauacagcacucaccggagcaacugaaauccaaaccucagguacaacgacaauauucgcuggccauuuaaaauguaggcuaaagauggauaaacuaaccuugaaagguaugucuuacgucauguguacaggcagcuuuaaacuggaaaaagaaguggcagagacacaacacggaacgguguuaguacaggucaaauacgaaggaacugaugcgccaugcaaaaucccuuucagcacucaagacgaaaaaggaguaacgcaaaacgguagauuaauaacagcuaauccaaucguaacagauaaagaaaaaccaguaaacauugaaacagaaccgccuuucggugagucauauauagugguuggagccggugaaaaagcacuaaaguuaaguugguuuaagagggguagcucaauagguaaaauguucgaagcuacagcacguggcgcaagaaggauggcgauccugggagauaccgcuugggacuuuggaucgauugggggaguauuuacaagcguaggcaaauuaguucaucaagucuuugguacggcuuacggggugcuauuuucagguguaagcuggacaaugaaaauuggaauuggaauacucuugacuugguuagggcuuaacaguagaaguacaucuuuaaguaugacuuguauugcaguugguauggucacuuuauauuuggggguaauggugcaagcggauucaggaugcguuauaaauuggaaaggaagggaauuaaaauguggaucaggcauuuucgucacaaaugaaguacauacuuggacggaacaguacaaguuccaggcagacucaccaaagcgauuauccgccgcgaucgggaaggcuugggaagaaggaguauguggaauaaggucugcgacaagacuagaaaacauaauguggaagcaaaucucaaaugaauugaaucacauuuugcuggagaaugauaugaaauucaccguugucguuggugaugcgaauggaauccuaguacaaggcaagaaaaugaucagaccacaaccgauggagcauaaguauucuuggaaauccuggggaaaggccaaaauuauaggagcagauauacagaacacuacauucauaaucgacggaccggauacuccugaauguccggauggacaacgcgcauggaauauuugggaagucgaggacuacgguuuugguguuuuuacuacuaauauaugguuaaaguuaagagacucauauacacaaaugugcgaccacagacuaauguccgcagcuauuaaagauucaaaagccguacaugcggauaugggauauuggauagaaagugagaaaaaugaaaccuggaaacuggcgcgcgcgucguucauagaaguaaagacauguacguggccaaagucacacacucucuggaguaauggcguacuugagucggaaaugaucaucccuaaaauauauggagguccaaucagucaacacaauuaucgaccgggauacuucacgcagacagcggguccauggcauuuggguaaacucgaguuagauuuugacuuaugcgaggguacgacggugguaguggaugaacacugugguaacagagggccaucuuuaaggacuaccacaguaacagggaaaauuauacaugaguggugcugccgaucauguacuuuaccgccgcuuagauuccgaggcgaagauggcuguugguauggaauggaaauccgcccaguaaaagaaaaagaggagaaucuaguaagauccauggugagugccgggacuggugaaguugauucauucucauuaggaauacugugcguaaguauaaugauagaagaaguuaugagaucgagguggagcaggaaaauguugaugaccgggacccucgcaguauuuuuacuucuaauaaugggacagcuaacuuggaacgauuuaauacggcuaugcauaaugguaggagcaaaugcgagcgauagaaugggcauggggacaacauaccuugcacuuauggcuacauuuaagaugagacccauguucgcaguaggucucuuauuuagacggcuaacaagcagagaaguccucuuacuaacaaucggacuaagucuaguagcgucagucgaauuaccaaacagccuagaggaacucggagacggucuagcgaugggaauaaugaugcucaaauuacuuacggaauuucagccacaucaacuguggaccacuuugcuuaguuuaacauucguaaaaacagcuuuaaguuuagauuacgcauggaaaacaacagccaugguucuaucgauaguaucuuuauuuccauuaugcuuaaguaccacuucacagaaaacaacauggcuaccuguccuauugggcucuuuugguuguaaaccuuugacaauguuucuaauaacugagaauaagauuuggggccgaaaauccuggccacuaaacgaggguauaauggcaauuggaauagugaguauuuugcucaguucguuauuaaagaacgauguuccucuagcaggaccgcuaauagcuggagggaugcucaucgcuuguuacguuauaucuggaucuucggcggaucuaagucuagagaaggcagcagagguuagcugggaacaagaagcagaacauagcggagccucacacaauauucuagucgaagugcaagacgauggcacaaugaaaaucaaggaugaggagagagaugauacacugaccauccuuuuaaaagccacauuguuagcaguuuccggggucuauccuaugucuaucccagcgacacuguuuguaugguauuuuuggcagaagaagaaacaaagaagcggcgugcuaugggacacaccuucaccgccagaaguugaacgagccguacucgacaacggaauauauagaauauugcagaggggacuguuagggcguucacaaguaggugucggaguauuucaggaugggguauuucauaccauguggcaugucacacgaggagcuguauuaauguaccagggaaaacgacuggaaccaagcugggcaucagucaagaaagauuugauauccuaugguggaggguggcgguuucagggcaguuggaacaccggcgaagaaguacaaguaauagcuguagaaccgggcaaaaaccccaaaaauguucaaacaacaccugggacuuucaaaaccccagaaggcgaagucggugcgauagcguuagacuuuaaaccuggcaccucuggcucccccaucguuaauagagaaggcaaaauuguugguuuauacggcaauggaguaguuaccacaucagggacuuacguauccgcuauagcacaggcaaaagcaucacaagaaggcccccuaccugagauagaggacgagguuuuuaagaaacgaaacuuaacaaucauggaucuucacccgggcaguggaaagacuaggcgauaucuuccugcaauaguuagagaagcaauaaagcggaaauuacgaacauugauauuagcaccaacaagaguaguggcaagcgagauggcagaggcguuaaaaggaaugccaauaagauaucaaacaacagcaguuaaaucagaacacacgggucgagagaucguugauuuaaugugucaugcaacuuuuacaaugcgauuguuaucucccguccgaguaccgaauuauaauaugauaauaauggacgaagcacauuuuacagauccagcgaguaucgccgcaagaggauauauaucaacgagaguagguaugggugaagcagcagcgauauucaugaccgcaacaccgccaggaaguguagaagcauuuccccaaaguaacgcaguaauacaagacgaagaacgagauauaccagaaaggucuuggaacucaggauaugauuggauaacagacuuuccugguaaaacaguaugguuugugccuuccauuaaaagugggaacgacaucgcgaacugucuaaggaagaaugguaagaggguuauccaacuuucaagaaaaacauuugacaccgaauaucagaaaacuaaaaacaaugacugggacuacguugucacaacagacauuagugaaaugggcgcaaauuuucgggccgaccgaguaauugacccacgcagaugccucaaaccagugauauugaaagacggaccugaacguguuauauuagcaggccccaugccgguaacaguagcaucagcggcucaaagaaggggucgaauaggaagaaaucagaauaaagagggagaccaauacguuuacaugggccaaccacuaaauaaugaugaggaccacgcacauuggacugaagccaaaauguuauuagacaauauaaauacuccagaggguauuauccccgcacuuuucgagccggaacgagagaaaagcgcagcaauagacggcgaauacagacuucguggggaagcaagaaaaacauuugucgaacuaaugagaagaggagauuugccaguguggcuaaguuauaaagucgcauccgaaggauuucaauacucugauagaagauggugcuuugauggcgaaagaaauaaccaaguucucgaggagaauauggacguagaaauauggacgaaggagggugaacgaaagaaauuaaggccaagguggcucgaugcacgaacauacucugauccgcuagcguuacgagaguuuaaagaguuugccgcuggcaggcguucgguaucaggagaucucaucuuagaaaucggaaaacuuccucaacauuuaacgcuucgagcacagaaugcauuagacaacuuagucaugcugcauaauagugaacaaggcgguaaagcauacaggcaugcaauggaagaguuaccugacacuauagagacauuaauguuauuagcccuuauagcggugcuaacaggaggaguaacuuuauucuuucugucaggcaaaggauuaggaaaaaccuccauaggauuguugugugugacagccucgucggcauuacuguggauggcuaguguugaaccgcauuggauagcggcauccauaauucuugaguucuuucugaugguucuuuugauuccggaaccugauagacaacgaacuccccaggacaaccaacuagccuacgucgugauaggauuacuauucaugauucuaacagucgcugcuaaugaaaugggccuuuuagaaacaacuaagaaagaucuggguauuggauauguugcagcagagaaccaucaacacgcaaccauguuagauguagaucuacauccagccucugcuuggaccuuauaugcaguagcuacaacuguuauaacaccaaugaugagacauacaauugagaauaccacagcgaacauuucucuuacagcaauagccaaccaagcggccauccuuaugggacuagacaaaggauggccuauaucgaaaauggacauuggaguaccccuacuugcgcucggcugcuacucacagguuaauccuuuaacauugaccgcugcaguucuaaugcuagucgcccacuaugcaauaauaggaccagggcuucaggccaaagcgacgagagaagcgcaaaagcgaaccgccgcggguauaaugaaaaauccgaccgucgauggcauaguagcaauagaucuagauccaguaguauaugacgcaaaauuugaaaagcaauuagggcaaauaauguuguugauuuuguguacaucucagauuuuguuaaugcgcacgacaugggcucuuugugagaguauaacauuagcuacagggccguuaacuacacuaugggaggggucuccaggcaaguuuuggaacacgaccauugccguaucgauggcuaauauauuccgcggaucauaucuagcuggggcaggguuggccuuuuccuuaaugaaauccuuagggggaggacgucguggcacaggagcucaaggcgagacacuaggugaaaaguggaagagacaacuaaaccaauugagcaaaucugaguucaauacguauaaacguagcgggauaauggaaguggaccggagcgaggcaaaagaggggcuuaaaagaggugaaacuacaaagcacgcgguaucuagaggaacagcgaaguugcgaugguucguggaaagaaaccuagugaaaccagaagggaaagugauagauuuaggaugcggcaggggaggaugguccuacuacugugcuggguuaaagaaaguaaccgaagucaaggguuauacuaaaggugguccaggucaugaagaaccaauaccaauggcaacauacggcuggaauuuaguuaagcuccauagcgggaaagacguguucuuuaugccuccagagaaaugcgauacacuguugugugauauuggugaaucuuccccaaaccccacaauugaagagggaagaacgcuucguguuuugaaaaugguagagccuuggcuucgaggaaaccaauucuguauaaaaauccuuaacccauauaugccaagcguuguugaaacacucgaacaaaugcaaagaaagcauggcgggaugcuaguucgaaauccacucaguagaaauaguacacaugaaauguacugggugucauguggcacaggaaauaucgucucggccgugaauaugaccagccgaaugcuauuaaauagauucacgauggcucacagaaaaccaacauaugaaagagauguugauuuaggugcuggaacacgacacguugcaguggaaccagaaguugcuaaucuugauauuauuggacaaagaauugaaaacaucaaaaaugaacauaaaucaacauggcauuacgaugaagacaauccauauaaaacaugggcguaccacgguucauaugaaguaaaaccaucuggaucagccaguuccauggugaaugguguaguuagacuauuaacaaaacccugggacguaauaccaaugguaacucaaauagcaaugacugauacaacacccuuuggacagcaaagaguauucaaagaaaaaguggacacaagaacgcccagggcgaagagagguacaacacaaauaauggagguaacagcaaaaugguuaugggguuuucugucaagaaauaaaaagccacgaauaugcacucgugaagaguucaccagaaaaguaaggucuaaugcagcaauuggcgcaguguuuguugacgagaaucaauggaacagugccaaagaagcugucgaagaugaaagauucugggauuugguucaucgagagagagaacuucauaagcaagguaaaugugcuacuugcguauacaauaugauggggaaaagggagaaaaagcugggcgaauuuggaaaagcaaaagguucucgggcaaucugguacauguggcuuggugcgcgcuuccuagaguucgaggcauugggguuuaugaacgaagaucacugguucagcagagagaacagccuuagcggaguugaaggagagggucuacauaaauugggauacauucuacgggacauaucaaaaauacccggugguaauauguaugcagaugacacagcaggaugggacacgcggauuacugaagaugaucuccaaaacgaagccaaaauuacagauauuauggaaccugaacaugcauuauuggcuacgagcauuuuuaaauugaccuaucaaaauaagguaguuagaguacaacgaccagcuaaaaauggaacagugauggauguaauaagcagaagggaucagcgaggaucuggucaaguagggacauacgguuuaaauacuuuuacaaauauggagguacaacuaauaagacaaauggagucugaaggaauauuccuaccgucggaacuggagacgccuaauuuagcugaacgggcacuggauugguuagaaaaacacggagcugagcgacugaaaagaauggcaauuucuggcgaugacugcguaguuaagccaauagacgauagauucgcaacugcgcuaacagcuuugaacgauauggggaagguccgaaaagauauaccgcagugggaaccaucaaaaggauggaacgauuggcaacaaguaccuuucuguucucaccauuuucaucaacugauuaugaaagaugggcgggaaaucguaguuccauguagaaaucaagacgaauuagugggacgggcaagagucagccaaggagcgggauggucacuacgcgaaacggcuugccuaggcaaaaguuacgcacaaauguggcagcuaauguacuuucauagaagggacuuaagauuggcggcgaacgcaauauguucagccguaccuguagauugggucccaacaaguaggacaaccuggucaauccaugcucaucaucaauggaugacaaccgaagauaugcugaguguauggaaccgaguuuggauagaagaaaauccuuggauggaagauaaaacgcacgucaguaguugggaggaaguucccuaucuuggcaaaagagaagaucaauggugugguuccuuaauuggauugacagccagagcuacaugggcaacaaauauccaaguagcuauaaaucagguaaggcguuuaauagggaacgagaacuaccuggacuacaugaccaguaugaagagauuuaaaaacgagagugauucugaaggggcguugugguaa

SEQ ID NO: 22152 - RNA, 9879 nt, Artificial Sequence
  derived and/or modified CDS sequence (opt6) from DENV-1__HQ332180__SS-prME
aguguaacaauguuacuuauguugcucccaacggcauuggcauuucaucuaacgacgagaggaggggaaccucacaugauuauaagcaaacaagaacgagggaaaucauuacuuuuuaaaacaagcgcgggugugaacauguguacauuaauugcaauggaucuuggagaacuaugcgaagacacaaugacguacaaauguccuagaauaacagaagccgaaccagaugauguagauuguugguguaaugcuacugauacuuggguuaccuauggaaccuguucccaaacaggugaacaucgcagagauaaaagaucuguagcucuggcuccacacguggguuuagguuuagaaacacguacagaaacauggaugucaucggaaggagcguggaaacaaauacaaaggguagaaacgugggcacuacgacacccaggauucacuguuauagcauuguuuuuagcacaugcaaucggaacaucaauaacccaaaaaggaauaaucuuuauucuguugauguugguuacgccgaguauggcgaugcgcugcguagggauaggcaaccgugauuucgucgaagggcuaagcggagcaacauggguagacgucgugcucgaacacgguuccugcguaacuacuauggcgaaaaacaaaccaacacucgacauugaacuacuuaaaacugaagucacuaacccugcgguacuucguaaauugugcauugaagccaaaauaaguaauaccaccaccgacucacgaugccccacacaaggugaagcgacccucguugaagaacaagaugcuaauuucgucugccgaagaaccuuuguugaucgagguuggggcaaugggugcggcuuguuugggaaaggaagucuccuaacuugcgcaaaauuuaaaugcgucaccaaacucgaaggaaaaauaguccaauaugaaaauuugaaauacuccgugauugucacaguacauacuggugaucaacaccaagucggaaaugaaaccacugaacacgggacuauagcaacgauuacuccucaggcuccaacaagcgaaauacaacuaacggauuacggugccuuaacucuagauuguuccccgcguaccggccuagauuucaaugaaaugguucuacuuacaaugaaagaaaaauccuggcuuguucacaaacaaugguuuuuggaccucccauuaccauggacuucaggcgcuagcacuagccaagagacguggaauagacaagauuuguuagucacauucaaaacugcccaugccaagaaacaagaaguagucguauuagggagccaagagggugcaaugcauaccgccuugacaggagccacggaaauacaaacauccggaacgacaacuauuuuugcaggucacuugaaauguagacuuaaaauggauaaacuaacauuaaaaggaaugaguuacguuaugugcacuggaucguuuaaauuagaaaaggaaguugcagaaacucaacauggaacuguacuuguacaaguuaaguacgaaggcacggacgcaccauguaaaaucccauuuucuacacaggaugaaaaaggggucacacaaaacgggagacuuauaacagcuaacccaaucguaacggauaaggaaaagccuguaaauauagaaacagagccucccuuuggugaaucguauaucgucguaggagccggagaaaaagcgcuaaaacuaagcugguucaagaaagguaguucaauaggaaaaauguuugaagcaacugcucgaggugcgaggagaauggcaauauuaggagauacggcuugggauuuugguucgauagggggaguauuuacgagcgucggaaaacuuguucaccaaguauucggaaccgccuacggugugcuauuuucuggaguuaguuggacgaugaaaauuggaauaggaauccuacuaacuuggcuaggucuaaauucaagaucaacgucacuuucaaugacguguauagccguugggaugguaacucuguaccuaggugcuauggugcaagcggauagcggauguguuauuaacuggaaaggacgggaacugaaaugcggcucuggaauuuuuguaacaaaugaaguacacacuuggaccgaacaauauaaauuccaagcagacucuccuaaaagacuaucagcugccauagguaaggcaugggaggaagggguguguggaauuaggucagcgacuaggcuugaaaacauaauguggaaacagauaagcaaugaacuaaaucacauauuacuggaaaaugacaugaaauucacgguagucguaggagaugccaaugggauucuggcucaagguaagaaaaugaucaggccgcaaccuauggagcauaaauauucauggaagucauggggcaaagccaaaaucaucggagcugauauacagaacacaacauucauuauagauggcccggauacuccagaauguccagauggacagagagccuggaacauuugggaaguagaggauuaugguuuuggaaucuuuacuacgaacauaugguuaaaguugcgcgacucguacacccagaugugcgaucaucgucuaaugagugccgccauaaaagacagcaaagcuguacaugccgacaugggauauuggaucgaaagugagaaaaacgaaacauggaaauuagcacgggcaucauuuauugaaguuaaaacaugcacauggcccaaaucacacacgcucuggagcaacggcguacuugaaucagagaugauaauuccaaaaauauacggaggacccaucucgcagcauaauuauagacccgguuauuucacacaaacagcuggaccuuggcaucuaggaaaacuagaauuagauuuugauuugugugaagggacaacgguaguuguagaugaacacugugguaaucguggucccucacuacgaaccacuacuguaaccgguaagauuauacacgaauggugcuguagaucaugcacgcugccgccucuaagauuccguggagaagaugguugcugguacggaauggaaauccguccaguuaaggaaaaagaagaaaaucugguaagaaguauggucucagcuggaucaggagagguugauucguuuagcuuaggcauucuuugcguaaguauuaugauagaagaaguaaugagguccagaugguccagaaagaugcuaaugacaggaacccuugcgguauuucuacuacuaauuaugggacaguuaacuuggaaugauuuaauacgguugugcauaauggugggagcaaaugcuucggaccggaugggaaugggaaccacacacuuagcauuaauggccacguuuaagaugcguccuauguucgcugugggauuauuauucagacguuuaaccucgagggaaguguuacuguuaacgauuggacuuagucuaauggcgucuauggagcuaccuaacuccuuggaagaauuaggagacggcuuagcgaugggcauuaugauguugaaacuccuuacugaguuccaaccacaucaacuuuggaccacgcuuuuaaguuuaacguucguuaaaacaacacuaaguuuggacuaugcguggaaaacgacugcgaugauacuauccaucgucucacuauucccauuauguuuaaguacaacaagccagaaaacuacaugguuacccguccugcuagguucguuugggugcaaaccauuaacaauguuucugauaacagaaaacaagaucugggggagaaagucauggccacuuaaugaggguauaauggcaauuggaauagucucuauacuguuaucaucccuacuaaagaaugauguacccuuagcuggaccacuuauagcgggcggcauguuaauagcguguuacguaauuucaggaagcucugcagaucucucgcuggaaaaagcugcggaagugucuugggagcaggaggcugaacauaguggagcgagucauaauauucuugucgaaguucaagaugacggaacgaugaaaauuaaagacgaagaaagggacgauacacucacuauuuuacugaaagcaacguuacuagcuguaaguggcgucuauccgaugagcaucccagcuacacuauuuguuugguauuucuggcagaaaaagaaacagaggagcggcgucuugugggacacaccuaguccucccgaaguggagagagccguuuuagacgaugguauauaucggauauuacaacggggauuacuagggagaucacaaguuggaguaggcgucuuucaagacggaguauuucacacaauguggcacgucacucgcggcgcgguucucauguaucaaggaaaacgucuagaacccucaugggccucugucaagaaagauuuaauuagcuacggaggcggguggcguuuccagggaucuuggaauacaggagaagaaguacaagugauugccguggaaccaggcaaaaauccgaaaaauguccaaacaaccccugguacuuuuaaaaccccagaaggugaaguaggggccauagccuuagauuuuaagccuggaacauccggcagccccauugucaauagagaagggaaaauaguugguuuauacggaaacgggguaguuacaacaagugguacuuacguaagugcuauagcucaggcaaaagcaucacaggaaggaccacuaccggaaauagaagaugaaguauuuaagaagcgaaaucuaacgauaauggaucuccaucccggguccgguaaaacuagaagauaucugccugcgauaguacgcgaagcaauuaagcguaaauuacggacccucauucuggccccgacgcgaguagucgcuucugaaauggcagaggcucuuaaagggaugcccauucguuaucaaacgacagcaguaaagucagagcacacuggccgugaaauagucgaucuuaugugccaugcgaccuucacgaugagguuauuaucgccuguaagaguucccaacuauaauaugauuauaauggacgaggcccauuucaccgaccccgccucaauagcagcaagaggauacauaucaacuagaguagguaugggugaggcugcagcaaucuuuaugacagccacuccuccgggguccgucgaagcguuuccucaaucaaacgcgguuauacaagacgaggaaagagauauaccggaaagaagcuggaacucaggauacgauuggauaacagauuuuccagggaagacgguaugguuuguaccuucuauaaaaaguggaaaugacauagcaaauuguuuaaggaaaaacggaaaaagaguaauccaguuaaguagaaaaacguuugauacagaguaccagaaaacuaaaaauaaugauugggauuacguugugacaacagauauuucggaaaugggggcuaacuucagagcggacagaguaauugacccaagacgauguuugaagccagucauauuaaaagaugguccagaaagggucauccuugcagggccaaugccagucacugucgcgucagccgcucaacguaggggacgaauuggacgaaaccagaacaaggagggcgaccaauauguauauaugggacaaccgcuuaauaacgaugaagaccaugcgcacuggacugaggcuaagaugcucuuagauaauaucaauaccccggaagguauuauaccggcacuauucgaaccggaacgcgaaaaaucagccgcgauagauggcgaauauagguuaagaggggaagcucgaaaaacauuugucgaacugaugcgaagaggugaccuaccuguauggcugucauacaaagucgcaucagaagguuuucaauauagugacagaagauggugcuuugauggugaaagaaacaaucaagucuuagaagaaaacauggacguugaaauauggacaaaagagggagaaaggaagaaacuccguccccgaugguuagaugcucgaaccuauagcgacccgcuugcgcuaagagaguucaaggaguucgcggcaggaaggcgaucuguaucuggugaccugaucuuggagauaggaaaauuaccacaacauuuaacccuacgcgcacaaaaugcccuagauaaccuagugauguuacacaacagugaacagggcggaaaggcuuaucgucacgcuauggaggaauuaccugacacuauagaaacccuuauguuguuagcacuaauugcugucuuaaccggugggguuacuuuguuuuucuuaagcggaaagggauuaggaaaaacaagcaucgggcuguuaugcguuaccgcuagcucggcauuacuauggauggcaagcgucgaaccccauuggauugcagcaagcaucauucuugaguucuuccuuaugguccuacuaaucccggaaccagaucggcaaaggacaccccaagauaaucagcuagccuauguaguuauaggguuguuauuuaugauacuaacagucgcugcaaacgaaaugggacuccuugaaacuaccaagaaagaucuggguauaggcuaugucgcagcagaaaaucaucaacaugccacuauguuggauguugaccugagaccugcaagugcauggacacuauacgcaguugccacgacagugauaaccccaaugaugagacauaccaucgagaacacaacagcaaacauaagucuaacagcaaucgcaaaucaagcagcaauauuaaugggccucgacaaaggauggccgauuaguaaaauggacauugggguaccauuacuggcauuagguugcuauucacaagucaacccauuaacacucacugcagcgguauugauguuaguugcacauuaugccauaauaggaccgggucuucaggcaaaagccacgcgugaagcacagaaaagaacugcggcaggaauaaugaaaaaucccaccguagacgguauaguggcaauagaucuugauccgguuguauacgacgcaaaguucgaaaaacaauuaggccaaauaauguuauuaaucuuauguaccagccaaauauugcucaugcgaacgacaugggcccuuugcgaaucaauuaccuuagcaacggggccuuuaaccacacuaugggaaggaaguccagggaaauuuuggaacacuacaauugcaguaaguauggcaaauauuuuccgagggucauaucuugcuggagccggguuagcauuuaguuuaaugaaaaguuuaggcggcgguagaagaggcacaggugcacaaggagaaacauuaggggaaaaauggaaacgacaacuuaaucagcucucgaaaagugaauuuaacacuuacaaaagaucagggauuauggaaguugacagaucggaggcuaaagaagguuuaaaaagaggcgagacuacaaagcacgcggugucucgaggaacagcaaaacugaggugguuugucgaaaggaauuuaguuaaacccgaagggaaagugauagaccuuggauguggacgaggcggcuggaguuauuacugugcagguuugaagaaaguaacugaaguuaaaggauauaccaagggcgggcccggucacgaagaacccauuccuauggcaacguauggcuggaaucuaguuaaacuucauagugguaaggacguguucuuuaugccaccugagaagugugacacacuccuaugugacauaggugaaucaucuccaaauccaacgauagaagaaggaaggaccuuacgcgugcuaaagaugguagaacccuggcuaaaaggaaaccaauucuguauaaaaauccuaaacccauacaugccgucuguuguagagaccuuagaacaaaugcagcguaaacauggcggaaugcuaguuagaaacccccuaucaagaaauaguacucacgaaauguacuggguaaguugugguacgggcaacauagugucggcagugaacaugacuagcagaauguuacugaauagauuuacuauggcacacaggaaaccuacauaugaacgcgauguugauuugggagcggggacgcgccacguggccguugaaccugaaguggcaaaccuugauaucauaggucagagaaucgagaauaucaaaaaugaacacaagucuacauggcacuaugacgaagauaacccauauaagacuugggcauaccacgguucauaugaggugaagccuucggguucagccucaaguaugguaaacgguguaguccguuuauuaacaaaacccugggauguaauuccaaugguaacacagauagcuaugacugauacuacaccuuucgggcaacaacggguguucaaagaaaagguagauacgagaacuccgagagcuaagcgagguacaacccaaaucauggaagugacugccaaauggcugugggguuuucuaucacguaacaagaaaccgagaauuugcacuagagaagaguucacacgaaaggucagaucaaaugcagcuauaggagcaguauucguagaugaaaaucaauggaauagugcgaaggaagcgguagaggaugagagauuuugggaucuggugcacagagaaagagagcuacauaaacaaggaaaaugugcaacauguguauauaacaugaugggcaaacgcgagaagaaauugggggaauuuggaaaagcaaaaggaucccgggcaauaugguacauguggcuaggagccagauuccuagaguucgaagcccuaggauuuaugaacgaggaccauugguuuagucgugaaaauucgcucucaggggucgaaggcgaaggauugcauaaauuaggcuacauauuaagagauauaagcaagauacccgggggaaauauguacgcugaugauacugcgggaugggacacaagaauuacagaagaugaccuacaaaaugaagcuaagaucacggauauaauggaaccagagcacgcccuauuagcgaccucuauuuuuaaguuaacauaucaaaacaaaguaguacgaguacaaagaccagccaaaaacggcaccguaauggauguaauaucucgucgagaucaaagaggaucuggacaaguggguacauauggcuuaaauacguuuacaaauauggaaguucaauugauacgucaaauggagucagaaggaauauuucuaccgagugaacuugaaacaccaaaucuagcggaacgagucuuagauuggcuugaaaaacacggggcagaaagauugaaaaggauggcuaucuccggagaugacugcguugugaagccuauagacgauagauucgcuacagcacugacugcuuuaaaugacaugggcaaaguacguaaagauauaccacaaugggaaccaucaaaaggcuggaaugauuggcaacaggucccauuuuguagucaccacuuccaucaauugaucaugaaagaugguagagaaauuguaguucccugccgaaaucaagaugaguuaguaggucgagcaagaguaucacaaggagcaggauggucguuaagagagacggcuugccuaggaaaaucuuacgcccaaauguggcaacuaauguacuuccaucgucgggacuuacgccuugcagcuaaugccaucuguucagcaguaccaguagauugggucccaacuucuaggacuacuuggucaauacaugcacaccaucaguggaugacuacagaagacaugcucaguguauggaauagggucuggauagaagaaaaucccuggauggaagauaagacccauguuucuucuugggaggaagucccguauuuaggaaagcgagaagaucaauggugugguucuuuaauaggauuaacagcacgcgcaacuugggccacuaauauucagguagcgauaaaccaagugagaagauuaauagguaacgaaaauuauuuagauuacaugacuucaaugaagcguuucaaaaacgaaucggacccagaaggggccuugugguaa

SEQ ID NO: 22153 - RNA, 9879 nt, Artificial Sequence
  derived and/or modified CDS sequence (opt6) from DENV-1__HQ332179__SS-prME
ucuguaacaauguuauuaauguugcuucccacugcguuagcuuuucauuuaaccacgcguggaggcgaaccacauaugauuguaucaaaacaagaacgcggcaaaucacuucuguuuaaaacaagugcaggagugaauauguguacuuuaauugcuauggauuugggcgaacuaugcgaagauacgaugacauauaaauguccgcguauuaccgaagcagaaccggaugacguagauuguuggugcaaugcaacagauacguggguaacuuauggaacuugcucgcaaacuggagagcaucguagagauaaaagaagcguugcuuuggcgccgcacgugggauuagggcuggagacucgaacugaaacuuggaugaguucugaaggggcguggaaacaaauucaaagaguagagaccugggcauuacggcacccaggauucacagucaucgcucuuuucuuggcgcacgccauagguaccaguauuacacaaaaaggcauaaucuuuauacuuuuaauguuaguaacgccaucgauggccaugagaugcgucgggauagggaauagagacuucguugagggcuuaagcggcgcgacauggguagacgucguauuggaacauggcucaugugucacaacaauggccaaaaauaaaccaacauuagauauagaacuauuaaaaaccgagguaacgaacccggcaguguugaggaaacuauguauagaagcuaaaaucucgaacaccacuacagauucacgaugcccuacucagggcgaggcuacacugguagaagaacaagaugccaacuuugucugcagaagaacauucguggaccgaggauggggcaauggauguggacuuuuuggaaaaggaagccuauugaccugcgcaaaauucaaaugcgucacgaaauuagaaggcaaaauagugcaauaugaaaacuuaaaauacuccgugauuguaacgguacacaccggugaccagcaccaaguaggcaaugaaacaacugaacacgguacuaucgccacuauaacaccgcaagcucccacuucagaaauacaauuaacagauuacggcgcacuaacauuagauuguuccccgcgcaccggguuggauuucaaugaaaugguuuuauuaacuaugaaagaaaagucauggcugguacauaaacagugguucuuggaccucccauuaccuuggacgucgggggcuucaacaucacaagaaacauggaauaggcaagacuuauuaguuacauuuaagacagcacacgccaagaaacaagagguugugguguugggaagccaagaaggggccaugcauacagcauugacaggagcaacagaaauccaaaccucagguacuacaacaauauuugcaggacauuugaagugucgucuuaaaauggacaaacuuacucuaaagggaaugaguuauguuauguguacugguucguuuaaacuugaaaaagaaguugcagaaacccagcacggcaccguccuaguucaaguaaaguacgaaggaacugaugcgccaugcaaaauaccguucucaacucaagacgagaagggaguaacucaaaauggcagauuaauaacagccaaucccaucguuacggacaaggaaaaacccguaaacaucgaaacugagccgcccuuuggagaaagcuauauuguagugggugcuggagaaaaagcauuaaaauugaguugguuuaagaaaggauccucaauagggaaaauguuugaagcuacagcccguggagcaaggagaauggcuaucuugggcgacacagccugggacuuuggaaguauagguggaguauuuacaucaguuggaaaauugguucaccaaguuuuugggacagcguaugggguauuauuuagcgguguaucauggaccaugaaaauagguauugguauauuauugacauggcuuggacucaauaguagaaguaccagccuguccaugaccuguauagcuguuggaaugguaacauuauaucuagguguaauggugcaagcagauucaggguguguaauaaauuggaaaggacgagaauuaaaaugcggaucagggauauuuguuaccaaugaaguacauaccuggacagaacaauauaaguuucaagccgauagcccaaaacgacuuucagcggcaauaggaaaggcgugggaagaaggagucugugguauuagauccgcuacuagguuagagaauauuauguggaagcaaauaucaaaugaauugaaccauauauuacuagaaaaugauaugaaauuuacuguuguagugggggaugccaaugggauuuuagcgcaaggaaagaagaugauacgaccacaaccaauggaacacaaauauucuuggaaaagcuggggaaaagccaagauuauuggagcagauauacaaaauacuacuuucauuauugauggucccgacacucccgaaugccccgacggacaacgagcuuggaauauaugggaaguagaggacuacgguuucgguauuuuuacaacgaauauuugguuaaaacugcgagauucuuacacucaaaugugcgaccauagauuaaugucagcagcuauaaaagauucgaaggcaguacaugccgauauggguuacuggauagaaucagagaagaaugaaacuuggaaacuggcucgagcuaguuucaucgaagucaaaacauguacauggcccaaaagucacacacuauggaguaacggcguacuggaguccgaaaugauuauaccaaaaauauaugguggacccauaucgcaacauaauuaucgacccggcuauuuuacccaaacagcaggaccuuggcacuuagggaaacuugaauuggauuuugaucuuugugaaggaacuacgguagucgucgacgaacauugcggaaaucgcggcccaucacucaggacuacgacuguaacuggaaagauaauacacgaauggugcugccguucgugcacgcucccaccuuugagauucagaggagaggacgguuguugguauggaauggagauaagaccaguaaaagaaaaagaggagaaccuuguaaggucaaugguaucugcaggaucuggggaaguugacucauucucccugggaauuuugugcgcaaguauaaugauagaggagguuaugaggagcagauggagucgcaagauguuaaugaccggcacccuagccgucuuuuugcuuuuaauaaugggacaauuaaccuggaacgaucugauaagacuaugcauaaugguaggugcuaaugcaucggacagaaugggaaugggaacuacguacuuagcgcucauggcuacuuuuaaaaugcgaccaauguuugcuguaggacuauuauuccguagguuaacaucaagagaaguacucuuacuaacgauuggucucucgcuaguagcauccgucgaacuaccuaacaguuuagaagaacuuggagauggacuagccaugggaauaaugaugcuaaaacuuuuaacagaauuucagccacaucaacuauggacaacacuauuaagccuaacguucgugaaaaccacguuaagucuagauuacgcauggaaaacuacagcuaugguucuuucaauuguuagucuuuuuccucuuugccuaaguacuacaagucagaaaacuacaugguugccaguauuacuuggaucguucggauguaaaccucuaacaauguuccuaaucaccgaaaacaaaaucuggggucguaaaucauggccucuuaaugaaggaauaauggcgauuggaaucgugucaauuuuacuuaguagucucuugaaaaaugauguaccacuagcagguccacuaaucgcaggaggaaugcuuauagccuguuacgugauaucugguaguagcgccgaucuacuacuugaaaaggcggcagaggucucuugggaacaagaggcagaacacucaggcgcuucacauaauauauuaguugaaguacaggaugaugguacgaugaagauaaaggacgaggaaagagaugacacucuuacaauacuccucaaagcuacauuauuggcgguuucuggaguguacccuauguccauucccgcaacgcuuuuuguaugguauuuuuggcagaagaagaaacaacgcaguggcguacuaugggauacaccauccccuccagagguugagcgcgcaguuuuagaugauggaauauaucgaauacuccaacgugguuuacucgggagaucccaaguaggggucggaguguuccaagacggggucuuccacacuauguggcauguuacgcgaggugcaguccuaauguaucagggaaaacgcuuagaaccauccugggccagcgucaagaaagaucuaauuuccuauggcggugguuggcgcuuucagggaaguuggaacaccggugaagaagugcaaguuauagcgguagaaccaggcaaaaaccccaaaaacguucaaaccaccccuggaaccuucaaaacaccagaaggggaaguuggugcgauagcacuagacuuuaaacccggaaccuccgggucgccuauaguaaacagagaggggaaaauuguuggccuauacgguaauggaguaguuacuacaaguggaaccuacguaucagcgaucgcucaggcaaaagcaucgcaagagggaccccucccggagauugaagacgaaguauucaaaaagaggaaucucacaauaauggaccugcacccgggaucuggaaagacaaggagauaccuuccugcaaucgugagagaagcuauaaaaagaaaacuucguacuuuaauacuagcuccaacaaggguuguggcaagugaaauggcagaagcacucaaagguaugccaauaagguaccagacgacugcugugaagucggaacauacaggacgggaaauaguggaucuuaugugucacgcuacguuuacaaugagauuacuaucaccaguccgagucccgaauuacaacaugauuauaauggaugaggcccacuuuacugaucccgcaagcauagcugcaaggggguauaucaguacacgaguuggcaugggugaggcagcugcaauuuuuaugacggcaacaccaccaggaucagucgaggcauuuccucaaucgaacgcagucauccaggaugaagaaagggacauaccugaaagaaguuggaacaguggcuacgauuggauaacggauuuuccaggaaaaacggugugguucguaccaaguauaaaaucaggaaaugacauugcaaauugccugcguaagaaugguaaacgagucauacaacuaagucggaaaaccuuugauacugaauaccagaaaaccaaaaauaacgacugggauuacgugguuaccacagauauaagcgaaaugggcgcaaacuucagagcagaccguguuauagaccccagaagaugucugaagccuguaauucuaaaggacgguccagaaagaguaauucuagccggcccaaugccggugacuguugcaagcgcagcacaacgcagaggacguaucgggaggaaucaaaauaaagaaggagaucaauauguauacaugggacaaccacuaaacaacgaugaagaccacgcucacuggacagaagcaaaaauguuguuagacaacauuaauacgccagaagggauuauaccugcguuguuugagcccgaacgagaaaagucagcggcgauugacggagaauauagauuaagaggggaagcacgaaaaaccuucgucgagcuaaugagacgaggugauuugccugucugguugucuuauaaaguagcuagcgaaggguuucaauacucagaccgaagaugguguuucgacggagaacggaauaaucaaguucuagaagaaaauauggacguugagaucuggacaaaagaaggagaaaggaagaaacucaggccaagguggcuggaugcgcgcacguacagugacccgcuggcauuacgagaauuuaaagaauuugcagcagggagaaggaguguuaguggugaccuaauauuggagauugguaaauugccucaacauuuaacuuuaagggcacaaaaugcccuugauaaccugguaaugcugcacaacucagaacaagggggcaaagcauauaggcaugcgauggaggaacuaccugauacaauagagacucugaugcuacuagcuuugauugcgguacuuacaggagguguuacacuauucuuuuuaagugguaaagggcuaggcaaaacaucgauagguuuauugugcguaaccgcaucaucugcgcuacucuggauggcgugugucgagccccauuggauagcugcuaguauuaucuuggaauuuuuccugaugguuuugcuaauaccagaaccagacagacagcgaaccccgcaagacaaucaacuagccuacguagucauaggacuucuuuucaugauuuugacuguagcugcaaacgaaaugggacuuuuagagacaaccaagaaagacuuaggaaucgguuauguagcugcagagaaccaccagcaugcaacgauguuggaugucgauuuacggcccgcaucagcauggacucuuuaugcgguagcuaccacgguaaucacaccaaugaugcgucacacaaucgaaaacacuacagcaaacauuucuuuaacggcaauugcaaaucaagcugccauccuaaugggauuggauaaaggguggccaauaagcaagauggauauugguguccccuuguuagcauuagggugcuauagccagguaaacccauugacgcuuacugcugcuguccuaauguuaguagcgcauuaugccauaauaggaccaggacuacaagcgaaagcuacucgagaagcacagaaaaggacagcagcagguauuaugaaaaauccaacaguugaugguauaguagcgauagaccucgauccaguaguauacgaugcuaaguucgaaaaacaauuaggucaaauuauguuauuaauucuaugcacgagucaaauuuuauuaaugagaaccacaugggcacucugcgaaucuauuacacuagcuacuggaccucucacuacuuugugggaaggaagucccgguaaauucuggaauacuacuauagcuguaucuauggcuaauauauuucgaggauccuaccuagccggugcagguuuggcauuuucacuaaugaaaucauuaggagggggccggagggguacaggugcccagggagagacucucggugaaaaauggaaaagacaacuuaaccaacuaagcaaaagcgaauuuaacacuuauaaaagaaguggaauuauggaaguggaucgauccgaagcaaaggaagguuuaaaaaggggcgaaacaaccaaacacgccguaucaagaggaaccgcuaaacuaagaugguuuguagaaagaaauuuaguaaaaccagaaggaaaaguaaucgaucucggguguggaagaggaggguggucauauuauugcgcgggacucaagaaggucaccgaaguuaagggauacacuaaaggcggacccggacaugaagaacccauuccaauggcaaccuacggcuggaaccuagucaaauuacauucaggaaaggauguauucuuuaugccaccagagaaaugugauaccuugcuuugugacauuggagagucuagucccaacccaacgauagaagagggaagaacccuuagaguuuugaaaaugguagaacccuggcugaaagguaaucaauuuugcaucaaaauauugaauccuuauaugccgagcgugguagaaacucuggaacaaaugcaacgaaaacauggcggaauguuaguacgaaauccccuuaguagaaacaguacccaugagauguacuggguaaguugugguacuggcaacauagugucagccguaaauaugaccaguaggauguuguuaaaccguuucaccauggcucauagaaagccuaccuaugaacgcgauguagauuuaggagcaggaacacgucacgucgcggucgaaccagagguggcaaaucucgacaucauaggccaaagaauagaaaacaucaaaaaugagcacaaaucaacuuggcacuacgacgaagauaacccauauaagacaugggcauaucacgggucauaugaaguaaaaccuucaggaucagcaucauccauggucaacggaguaguucguuuguuaacaaaaccaugggaugugauuccaaugguuacacagauugcaaugacggacacaacucccuuuggucagcaaagaguauuuaaagaaaaaguagacacacgcacuccuagggccaaacgaggaacgacacaaauaauggagguaacggcaaaaugguugugggguuucuuguccaggaacaagaaaccacgaaucuguacaagagaagaauuuacccgaaagguaagaaguaacgcagcaauaggugcaguauuuguggaugaaaaucaguggaauagugccaaagaagcaguugaggaugaacgauuuugggacuuaguucaucgagaacgagagcugcacaagcaaggcaagugcgcuacuuguguuuauaacaugaugggcaagagggagaagaaacuaggagaauuugggaaagcaaaagggucaagagcaauaugguauaugugguuaggugcgagauuccuagaguucgaggcuuugggauuuaugaaugaggaccauugguuuucucgagaaaauagccuuucaggaguagaaggagaagguuuacacaaauuaggguacauauuacgcgauauuaguaaaauccccggcgggaauauguaugccgacgacacugcagguugggacacuagaauaacagaggacgauuugcaaaacgaagcaaaaauaacagacauaauggaaccagagcacgcacuauuagcaacuucgaucuuuaaacuuaccuaucaaaacaaaguuguaagagugcaacguccugcaaagaaugguacgguuauggacguaauaagucgaagggaucagaggggauccgggcaagucgguaccuacggauugaauacauucacgaauauggaaguucaauuaauccgacaaauggagucagaggguaucuuccugccaucugaacuagaaacgccaaaucuagcagagagaguccucgacuggcuagaaaaacauggagcagaaagauuaaaaaggauggcaauauccggggaugacuguguagugaagccaauagacgaccgauuugcaacagcucugaccgcuuuaaaugacauggguaagguccgaaaagauauuccccaaugggaaccaagcaaaggauggaaugauuggcagcagguuccauuuuguucgcaucacuuccaccaacugauaaugaaagauggacgagaaauuguggugccauguagaaaucaggacgaguuaguagggcgugccagagucagccaaggcgcaggauggaguuugcgagaaacugcaugucuuggaaaaaguuaugcucaaauguggcaacuaauguauuuucacagacgggaucugcgcuuagcagcuaaugcaauaugcagugccguacccguugacuggguuccgacaagcaggacgaccugguccauucaugcgcaucaucaauggaugaccacugaagacauguuaucgguuuggaauagaguguggauugaagaaaacccguggauggaagauaagacgcacgugagcucaugggaagaaguaccguacuugggaaagagagaagaucaauggugcggaucauugauaggucugacugcgagggcgacuugggccaccaacauucagguagcaauuaaucaaguaagacgccuaauaggaaaugaaaacuacuuggacuacaugacuucgaugaagcgguucaaaaaugaaucagaucccgaaggagcacuuugguaa

SEQ ID NO: 22154 - RNA, 9879 nt, Artificial Sequence
  derived and/or modified CDS sequence (opt6) from DENV-1__KR919820__SS-prME
acuguaguggcauugcuaaugcuauuaccaauggucuucucauuucacuuaacuacacgaggaggggaaccacauaugaucguuaacaaacaagaacgcggaaaaagccucuuauucaaaacauccggugggaucaacauguguacacucauagcaauggauuugggagauuuaugugaagacacuaugacguauaaaugcccucggauaacagaagcagaacccgaugacguugauuguugguguaacgcuaccgauacauggguuacauaugguaucuguaguccuacgggugaacaucguagagaaaaacguucagucgcgcuugcaccacacgugggucuaggguuagaaacuagagcugaaacuuggaugucuuccgaaggagcuuggaaacaaauccaaaggguagaaaccugggcacugcgccauccugguuucaccguaauagcuuuauuuuuagcucacauaauaggaacaagcauuacacaaaaaggcguuaucuuuauauuauuaaugcucguaacaccgaguauggcuaugcgaugugucggagucggaaaucgcgacuuuguagaagggcuuaguggcgcuaccuggguugacgugguucuagagcacggaagcugcguaacgacuauggccaaaaauaaaccuacucuagauauugaauuauuaaaaacagaaguaaguaaucccgccguguugaggaaacuuugcauagaggcgagaauaucaaauacaacgacugauucacgaugccccacacaaggcgaggcuucucugucagaggagcaagauacaaacuucgugugccggagaacucuaguggacaggggauggggcaacggcuguggucucuuugggaaaggaucgcugauaacgugugcgaaauucgaauguuugacuaaaauggaagguaaaauaguucaguacgaaaauuugaaauacucaguaauaguaaccguacauacuggggaucaacaccaaguagguaaugaaacuacgggacauggcacuaccgcaacuauaacaccacaagcgccaacuucagaaauacaacuuacugacuauggggcccugacauuagacugcaguccacgaaccggauuagauuucaaugaaaugguucuguuaacuaugaaagagaaaagcuggcuaguccacaaacagugguucuuggaccugccccucccgugggccagcggagcaaguagcccucaggaaacguggaaucgacaggaccugcucguaacguuuaaaacagcucaugcaaagaaacaagaggugguaguacuggggagccaagaaggagcaaugcacacggcccucacuggggcaacagaaauucaaacuucagguacaacaacgauauucgcaggacaucucaaauguagacucaaaauggacaaauugacucuaaaaggaauguccuauguaaugugcacaggguccuuuaaacuaaagaaagaaguagcagaaacccaacacggaacuguuuuaguucaaguagaguacgaaggaacugaugccccauguaaaauaccguuuacuacacaagacgaaaaagggguaauucaaaacgguagauuaauaacggcgaauccuauuguaacggauaaagaaaaacccguaaauauagaggcugaaccaccauuuggagaaucuuauaugguuauaggcguaggggacaaagcacucaaacuauccugguucaaaaagggcucgucucuuggaaagauguucgaagcaacagcacgcggggcucgacggauggcaauuuuaggcgauaccgcuugggauuuuggcucaguuggugguguuuuuacaucgaugggaaagcuaguacaucaaaucuucggaacagcuuacgggguguuauuuucugggguaucauggaccaugaaaaucgggauaggucuuuuauuaacuugguuaggucugaacucucggucaaccagcuugucuaugacaugcauugcagucggaaucaucacguuauauuuagguguaaugguacaagccgauacagguugcgugguuaauuggaaagggagagaacucaaaugcgguucagguauauuuguuacaaaugaaguccacacuuggacagaacaauacaaauuccaagcggauucaccaaaacgccuaucagcugcuauaggcaaagcgugggaagaugguguuugcggaauuagaucagcaacuaggcuagaaaauauaauguggaaacaaauagcuaacgagcuaaacuauauucuuuuagaaaaugauaugaaauucacgguugucguuggagauguuaaagggauacucacacaagguaagaaagguauacgaccucagccgauggagcauaaauacuccuggaaaucuugggguaaagcgaagauaaucggagcagacguacagaauacgacauuuauaauagacggcccugauacacccgaauguccggacucucaacgagcguggaacauuugggaaguagaagauuauggauuugggauuuuuacaacaaacauauggcuuaaacuacgggauagcuacacacaaguaugugaucaccgauuaaugucagcagcaauaaaggauucgagagccguacacgcagauaugggauacuggauagagucggagaaaaaugagacguggaaguugagcagggcuucauuuauugaaguaaaaacuuguacguggccuaagagucacacauuauggucaaauggcguccuugagucagagaugauaauuccaaaaauuuauggagggcccauaagccaacauaauuauagaccaggauauuuuacccaaacugcugguccuuggcaccuuggaaaacuugagcuagauuuugaucugugugaagggacgaccgucguaguugacgagcaguguggaaauagagguccaaguuugagaacaacaacaguaacaggcaaaauuauacacgaauggugcugucgaagcuguacccucccgccauuaagauuuaaaggagaagauggauguugguauggaauggaaauacgcccuguaaaagaaaaagaagaaaaucucguaaagucuaugguaucagcaggaucaggaaagguagauaacuuuucccucggguuauuauguauuagcauaaugguggaagaagugaugcgaucaagauggagcggcaagauguuaaugaccgguacaauggccguguucuugcuauuaguuaugggacaauuaaccuggaaugauuugauacgaguuugcauuaugguuggagcacaugcuuuggacucaaugggcaugggaacaaccuaucuagcacuaauggcgacuuuuaaaauuagaccaauguuagcgguuggauuacuauucagaaaacugacuagcagggaaauucuguugcugacaaucggucuaucuuugauaaccccuguagaacuaccuaacuccauugaagaacucggugauggauuagcaaugggaauaaugauguuaaaacuucuuacagauuuccaaccauaucaacuaugggcaacuuuacuaagccugaccuucguaaaaacuacacuaagccuucacuacgcauggaagacugcagcgaugguacucucgaucgucagcuuguugccgcucuguuuaucaacaacaucacagaaaacaacauggcuacccauauuacucggguccuuaggcugcaagccauuaacaauguuccuaaucagcgaaaauaagauauggggcagaagaucuuggccaauaaaugaaggcauaauggcugucggaauaguuaguauacuaaugucaucacuguugaaaaacgacgucccacuagcggguccuuuaaucgcagggggaauguuaguagcauguuaugucauuucaggaucaagugcugaucuuacacuugagaaaaccgcggaaguaaguugggaagaagaggcggaacacaguggaacggcgcauaauauauuagucgaagugcaagaugacgguacgaugaaaauaaaagacgaagaacgcgaggacacacuuacaauauuauuaaaagcagcacuauuagcauuaucaggaguauauccuaugucuauuccggccacucuguucguaugguacuuuuggcaaaagaaaaagcaaagaucuggcgugcugugggauauaccaagcccgccugaaguagaaaaagccguacuagacgacggaauauacagaauuuuacaaagaggaguuuuuggcagaucucaggucggaguggggguauuucaagagggcguauuccacacaauguggcaugugacaagaggggcagucuuaacauaucagggaaaaagacucgaaccuucaugggcuucugugaagaaagauuuaauuagcuacggaggcggcuggcgauugcaaggaagcuggaacgucggugaagaaguccaaguaauagcuguugagccaggcaaaaauccuaaaaacguucaaacugucccaggcaccuuuaaaacacaugaaggcgaaguaggagcgauagccuuggacuucaagcccggaaccucaggaaguccaauaguaaauagagauggcaagguagugggauuauacggaaauggcguagucacaaccagcgguacauauguauccgcaauagcucagucuaaaguuucucaagaggguccauugccggagaucgaggaugaaguuuucaagaagaaaaauuugacuauaauggacuuacacccagguagcggaaaaacacgccgauaccuaccagcaauuguccgagaaucaauaaaacgaagauugcgaacauuaauacuggcgccgacgagagugguagccucagaaauggccgaggcacucaaagguuugccuauccgauaccagacgacagccgugagaaaugaacacacggggcgcgaaauaguagacuuaaugugucaugcaacuuucaccaugagauuauuaucaccgguucgaguaccgaacuacaauaugauaaucauggaugaggcacacuuuaccgacccagcaucuauagcagcccgaggauacauuagcacgagagucggaaugggggaagcagcggcaauuuuuaugacagcuacacccccuggaagcgcggaggcauucccacaaaguaacucugucauuuaugaugaagaaaaagauaucccagagaggagcuggaacucaggauacgauuggauuacagacuuccaaggaaaaaccgucugguuuguaccaucaauaaagacggguaaugauauagcuaauuguuuacguaaaaacggcaaaagaguaauacaguugaguagaaaaacauuugacacugaguaccagaaaacgaaaaacuccgauugggauuuuguggucacgacagauauaagcgaaaugggcgcgaacuuuagagcugauaggguuauagacccgaggcgcugccuaaaaccaguuauacuuagagauggaccagaacgagucauccuagcugguccaaugccagugacaguggcaagcgcagcucaaaggcgcggaagaaucgguagaaaccaguccaaagaaggcgaccaauauaucuauauggggcaaccgcucaauaaugacgaagaucaugcgcacuggaccgaagcaaaaaugcuauuggauaauaucaacacaccagaaggaaucauaccagcucuauucgagccggaacgcgagaaaucagccgcgauagacggcgaguaccgauuacgcggggaggcuagaaagacauuuguagagcuaaugagacgaggcgaccuuccaguauggcuauccuacaaaguugccucagaagggauacaguaugcugaccgaaaguggugcuuugauggagaacgaaauaaucaaauauuagaagaaaauauggauguggaaauauggaccaaagaaggagaaaggaagaaacuucgaccgcgaugguuagacgcaagaacauauagcgauccucuagcgcuaagagaguucaaggaguucgcugcugguaggcguucaguaucaggagacuuaauucuagaaauaggcaaauugccacaucauuuaacccaaagagcacaaaacgcccuagauaauuuagugauguuacacaauuccgaacaaggaggacgagcauacagacaugcgauggaagaauugccggauacgauagaaacauuaauguuguuagccaugauugcaacgcugacugggggaguugcucuuuucuuccuauccgguaagggacugggaaaaacuucuauugggcuauuauguguaauggccuccaguaccuuguuauggauggcgagcguugagccccacuggauagcagcgaguauagugcuagaguucuucuuaaugguccuacuuauuccagaaccagacagacaacggaccccacaagauaaucaacuggcauauguagugauuggucuccuaguacugauccuuacuguagccgcuaaugagaugggcuuguuagaaacaacgaagaaagauuuaggcauaggaagcgcugcagcugaaauacaacaccauaccacaauccuagauguugaucuacaccccgcaagugcguggacgcuuuacgcggucgccacuacuguuauuacaccgauguuaagacacacgauagaaaacacuacugcaaacaugucauuaacagccaucgcaaaccaagcugccauauugauggguuuagacaaaggauggccaauaucaaaaauggacauaggaguaccguuacuugcacuaggcugcuauagucaaguaaauccaaugacgcuaacagcugccguuuuaauguuagucgcccacuacgcaauaauuggcccaggauugcaggcuaaagcaacccgagacgcgcaaaaacgaacugcugcgggaauaaugaagaacccuacgguugacgguaucguugcgauugaucuugacccaguuguauacgauacuaaguucgaaaagcagcuggggcaaauaaugcuacuuauucuaugcacaagccagauacuauuaaugcguacaacgugggcauuuugugaaagcauaacgcuggccacugguccauuaacaacauuaugggaagggucuccugggaaguuuuggaacacuacuauugccguaaguauggcuaauauuuuucgagggagcuauuuagccggugcugggcucgcguucaguuuaaugaagucucuuggaggaaauagaagagggacaggcgcccaaggugagacacuaggagaaaaauggaagcgucagcucaaccagcugaguaaacuagaguucaacacguauaaacgcaguggcauaauggaagucgauagaacagaggccaaagaaggauuaaagagaggagagacgacaagacaugccguaagucgagggacagccaagcuaaggugguucgucgaacgcaauuuaguaaaaccugaaggaaaagugauagaccuagggugcggaagagguggauggucuuacuauugugcaggccucaagaaagucacggagguaaaagguuauacuaaaggcgggcccggacaugaagaaccgauacccauggcaacauacggcuggaaccuaguaaaauuacacaguggaaaagacguauuuuucauacccccugaaaaaugugacacuuuauuaugugauaucggagagucuucgccuaacccaaccauugaagagggacgaacacuaagaguauuaaagauggucgaaccuugguuacgaggaaaucaguuuugcauaaaaguauugaauccuuacaugccaucugugguagagacucuagaaagaaugcaacguaaacauggaggcaugcucgugagaaacccacucucuagaaacaguacucacgagauguauuggguauccuguggaacugggaauauagugagcgcugucaauaugacuagcagaauguuauuaaauagguucacaaugacucauagaaaaccaacuuaugagaaagauguagacuuaggagcaggcacaaggcauguagcugucgaaccagaggucgcgaaccuagacauuauuggucaaagaaucgagaauauuaaaaaugaacauaaaaguacuuggcauuacgacgaagacaacccauauaaaacaugggcauaucacgggaguuacgaagucaaaccaagugguucugccagcucgaugguuaaugguguaguucgacuguuaacuaaaccaugggaugugauacccaugguaacacaaauagcaaugacagauacaacuccauucgggcagcaaagaguguuuaaagagaagguggauacuagaacaccaaaggcuaaacguggaacugcacagguuauggaaauuacagcagguugguuauggaaauuucucucucgaaagaagaaacccaggaucugcaccagagaagaguuuacaaggaaagucaggucaaaugcagcaauaggugccgucuucguugaugagaaccaauggaacucggccaaggaggcuguagaugaugagcgcuucugggaccuagugaauagagaaagagaacuacacaaacagggcaaaugcgcaacuugcguuuauaacaugaugggaaagagggagaagaaauugggugaguucgguaaagcgaaggggaguagagcaauuugguauaugugguuaggagcacgguucuuggaauuugaagcgcuaggauuuaugaacgaagaucauugguuuuccagagauaacaguuugagcggaguagaaggugagggucuacacaaauuaggcuacauuuuacgagacaucgcaagaauaccaggaggcaauauguacgcagaugacacggccggcugggauacacgaauaaccgaagaagauuuacagaaugaagcucgugucaccgaacugauggaaccagaucacgcucaauuggcaacaucaauuuuuagguuaacauaccaaaauaaaguaguaaggguccaaagaccuggcaaaaauggcaccguaauggauguaaucucacguagagaucaacgaggaaguggccaaguagggacauacggcuuaaauacauuuacgaacauggaagcacaauuaauucgacaaauggaauccgaagggguauuuucgccguccgaauuagaaacgcccaaccuggcuaaucgcguacuugauuggcuagaaaaauacgguguugaacgacucaagagaauggcuauuagcggugaugauugcguuguuaagccaauugaugaucguuuugcuaccgcauugacugcacuuaacgauauggguaaaguucgaaaagauauaccgcaaugggaaccauccagggguuggaaugacuggcaacaaguuccguucugcagucaucauuuccaucaacuuauuaugaaggacgguagagaaauaguuguaccauguagaaaccaagacgaguuaguuggacgagcuagagucagucaaggagcgggauggagccuaagggagacagcaugccuugggaagucauacgcccaaauguggcaauuaauguacuuccaucguagggacuuacgacuggcagccaaugcaauaugcucugcugugccuguagauugggugccaacgagucgaacuacuuggagcauacaugcucaucaucaauggaugacaacagaagacauguuaucaguauggaauagaguauggauugaagagaauccuuggauggaagauaaaacucacguaaccuccugggaagacguacccuacuuaggaaaacgugaagaucaauggugcgguagcuuaauaggacuuucagcgcgcgcaacuugggcaauaaauauacaaguagcaauuaaccaaguacggaaauuaauugguaaugaacauuaccaagauuacaugacauccaugcgacgcuuuaaaaaugaaagugagccugaaggagcacuaugguga

SEQ ID NO: 22155 - RNA, 9879 nt, Artificial Sequence
  derived and/or modified CDS sequence (opt6) from DENV-1__DQ285561__SS-prME
agcguaacuaugcuucucaugcuucuaccaacugcauuaacauuucaucuaaccacucggggaggugaaccucauaugauaguuggaaaacaagaaagagguaaaucuuugcuguuuaaaacgagugccgguguaaauauguguacauugauugcuauggaccucggugaacugugugacgacacgaugacauauaaauguccaagaauuacagagaccgagccagacgacguugauugcugguguaaugcaacugaaaccuggguuacguacgguacgugcagccaaaccggagaacacagaagagacaaaagauccguggcacuagcaccccacguuggacuaggauuggaaacgcgcacagaaacuuggaugaguuccgaaggcgcuuggcgucaaauacagaaaguggaaacuugggcacugaggcauccaggauuuacuguaauagcuuuauuccuggcacaugcgauagguacuagcauuacacaaaaaggaauaauauucauacuacuaaugcuaguaacuccaucuauggcaaugaggugcguagggauaggcaauagagauuuuguagaagguuugucaggagcuaccuggguugacguaguuuuagaacaugguucaugcguuacuacuauggcgaaagauaaaccuacacuggauauugaacuguugaaaacggaaguaacuaaucccgcagugcuacguaaauuauguauagaagcuaaaauaucuaauacaacaacagacagccgaugcccuacucaaggagaagcaacccuuguagaggaacaagauacgaauuucguguguagacguacauuuguugauagaggcugggguaacggauguggcuuauuuggaaaagggagucugauaacaugugcaaaauucaagugugucaccaaacuugagggaaagauuguccaauaugagaaucuuaaauacagcguaauaguaaccguccacacuggugaccaacaucaagucggaaaugaaacaaccgaacauggaacaauagcgaccauaacuccucaagcuccaacaucugaaauacaauugacugauuacggcgcauugacacuggacugcuccccacgaacaggauuagauuuuaaugaaaugguacuacuuacaaugaaagaaaaauccugguuaguacauaaacaaugguucuuagaccuuccauuaccuuggacgucaggugcgucaacgucccaagagaucuggaaccgacaagauuuacuugucacauuuaaaacugcacaugccaagaaacaggaagucguuguacuaggaucccaggaaggggcaaugcauacugcucucacuggggcuacugagauccagacaucgggaacaacaaccauauuugcgggccaucucaaauguagauuaaaaauggacaaauugacauugaaagggauaaguuacguaaugugcacgggaucuuuuaaguuagaaaaggagguggcagagacacagcacgguacuguauuaguacaaguuaaguaugaggguacagacgcaccaugcaaaaucccauucuccucucaagacgaaaaaggugucacucaaaacggacgucuuguuacagcaaauccaauagucacugauaaagaaaaaccaguaaacauugaagcugagccgccuuucggagaaucuuauauuguugugggagccggugaaaaagcgcuaaaauuaaguugguuuaagaaaggauccaguauuggaaagauguucgaagccacagcuaggggagcuagaagaauggcuauauuaggcgacacagcaugggauuuuggaagcauagggggaguauuuacgucuguagguaaacuuguucaucaaauauucggaacagccuauggaguauuauuuagcggaguaagcuggacgaugaaaauaggcauugguauacuacugacuuggcuuggcuuaaauagcagauccacaagucucucaaugacaugcauugccguaggaaugauaacucuuuaucugggaguaaugguccaagcagauagugguugcguaaucaacuggaaaggccgagaacuaaaguguggaagcggcauauuugucacaaacgaaguacauacauggacugaacaauauaaauuucaagcagauuccccuaagagacuaagugccgcaauaggaaaggcaugggaggaaggagugugcggaauaaggagugcuacccggcucgagaauauaauguggaaacaaaucucaaaugaauuaaaccacauacuauuagagaaugacaugaaauuuacaguaguuguuggagaugugucugguauccuugcgcaagguaagaaaucgauaaggccgcagccuauggaacauaaauacucauggaaaagcuggggaaaagcuaagauuauaggagcggacguacaaaacacaacauuuauaauugaugguccaaauacgcccgaguguccagacgaucaacgagccuggaauauuugggagguggaagauuacggauucgguaucuuuacaacaaauauuuggcucaaacugagggacucauauacacagguaugugaucauagauuaaugagugcagccauuaaagauaguaaggcagugcaugcagacaugggcuacuggauagagucggagaagaaugaaacguggaagcuagcuagagcgaguuuuauugaaguuaaaacuuguauauggccuaaaucacacacacuuugguccaaugguguucuagaaucggaaaugauuauaccuaagauauauggaggaccuauuagucagcauaacuaccgaccuggauacuucacucaaacggcgggacccuggcaucuaggaaaacuagaacucgacuuugaucuuugugaaggcacaaccguagucgucgaugaacacugcggcaacaggggaccuagcuuacgcaccacaacaguaaccggcaaaauaauacaugaaugguguugcagaagcugcacccuuccuccucuccgauucaaaggcgaagacgguuguugguacgggauggaaauucgaccaguuaaagaaaaagaagaaaacuugguaaaaagcaugguaagugcagguucuggcgaaguagauucauucucacuaggcuuacucuguauuucaauaaugauugaagaaguuaugcgcucccgguggucucgaaaaaugcuuaugacugguacauuagcaguauuccuccuguugacgaugggacaauuaacuuggaacgaccuaauaagauugugcauaaugguuggagccaaugcgagugauaauauggggauggggacuaccuaucuugcauuaauggcuaccuuuagaaugcguccaauguucgccgugggguuacuauuuaggcgucuaaccucacgagaaguacuauugcuaacuguggggcuaucacugguagcuucggucgaacucccuaauucccuagaagaacuaggagauggguuagcgauggguauuaugaucuuaaaacuacuaacagauuuccaaucucaucaacuaugggcaacauuauuaucacuuacauuugucaaaacuacguucucacuacacuacgcauggaagaccauggccaugauacugaguauagucucauuguucccauuaugccuaagcacaacaucacagaaaaccacgugguuaccuguucuccugggaaguuuagggugcaagccacuaacgauguuucugauuacugaaaauaaaauauggggaagaaaaucauggccucucaaugaaggcauaauggcaguugggauaguuagcauauuguuaucaagucuacugaaaaaugacgucccuuuggcaggaccucuaauagcaggagguaugcuaauagccugcuacguuauuagcggaucauccgcagauuuaucacuagagaaagcugccgaaguuaguugggaagaagaagcagaacacucgggugcgagucauaacauauuaguugaaauacaagacgauggaaccaugaaaauuaaagaugaagaacgcgaugauacaaucacaauauugcuuaaggcaacauuauuagcaauaucaggaguauauccuaugaguauaccggcgacacucuucguuugguacuuuuggcagaagaagaaacaaaggucuggaguauugugggacacaccaucuccacccgagguggagcgagcugucuuagaugacggaauauauagaauuuuacagcggggauuacuagguagaucccaagucgguguagguguguuccaagaaggcguguuucauacgauguggcacguuacuaggggugcaguucuaauguaucaagguaaaaggcuugaaccuagcugggcgagcgucaagaaagauuuaauaucauacgggggugguuggcgauuucaaggcucguggaauacaggugaagagguccaaguaauagcuguagaaccgggcaaaaaucccaaaaaugugcaaacagcaccggguaccuuuaaaacgagcgaaggugaaguaggugcgaucgcauuagacuuuaaaccagggacaucaggcaguccgauuguaaaccgagaagggaaaaucgucggacuuuauggaaauggaguugugacuacuucgggcaccuauguaagcgcgauagcacaagccaaagcgagucaggaaggaccacuacccgaaauagaagaugagguuuuuagaaaaagaaaucugaccauaauggaucugcacccugguucagggaaaacacgcagauaucugccggccauugugcgcgaagcaauaaaaagaaaauuaagaacauuaguucuugcgccuacuagaguaguugcaagugaaauggcggaggcuuugaaagguaugccgauaagauaucaaaccacugcugugaagucagagcauacaggaagagagauugucgauuuaaugugucaugcaacauuuaccaugagguugcuuucuccaguaagaguuccaaacuauaacaugauuauaauggacgaagcacacuuuaccgauccagcuucuauagcagcaagggguuacauauccacaagggugggaaugggcgaagcagcagcuauuuuuaugacagcgacaccucccggauccguagaagcguucccccaguccaacgccgucauacaggacgaggagaaagauauaccugagagaagcuggaacuccggauacgauuggauuaccggauuuccugguaaaacaguuugguucguaccuucaaucaaaucuggcaacgauauugcuaauugccuuaggaaaaaugguaagcgcgugauucaauugagucguaaaacauuugauacagaguaccaaaagacuaaaaacaaugauugggauuacgucgugacuacagacauuucggagaugggcgcuaauuuucgggcagaccgugugauugauccucgucgcuguuugaaaccagugauauuaaaagacggaccagagcgcgucauucuugcuggaccuaugccgguaacgguggcaagugcagcucaaaggagaggacgcauuggucgaaaccagaauaaggagggagaucaguacauuuauauggggcagccauuaaauaacgacgaagaucacgcccacuggacagaggcaaaaauguuacuugacaacaucaauacgccugaagggauuauucccgcauuauuugagccugaaagggaaaaaucggcggccauugacggagaguaucguuuacgaggagaggcucgaaaaacauuuguagaacuaaugcguagaggugauuugccggugugguuaagcuauaaaguggcguccgaaggauuucaguacagugauagaagaugguguuucgauggggaacggaacaaccaagucuuagaggaaaacauggauguagaaauuuggacgaaagaaggugaaaggaagaaauuacguccgagauggcuagaugcaagaacguauucagauccacuggcacugagagaauuuaaagaauuugcugcaggcagacgauccguaagcggagauuuaaucuuagagauagggaaauuaccccaacaccuaacucaacgugcacagaacgcauuagauaaucuaguuauguuacauaacucagagcagggaggaaaggcguaucgacaugcuauggaagaacuaccagauacaauagagacauuaaugcucuuagcgcugauugcagucuuaaccggggguguaacacucuuuuuccuaaguggucgugguuugggcaaaacaaguauuggacuucuuugugugaugagcucgagugcucuacuuuggauggccucaguagagccucauuggauagcugcgaguauuauauuagaguucuuuuugaugguucuacuuauucccgaaccagauagacaacgaacaccucaggacaaucaacuugcguauguaguaauaggauuauuauuuaugauauuaaccguagcagccaacgaaaugggccuucucgaaacuaccaagaaagaccucgguauaggacacgcugcugcagagaaucaccaucaugcagcaaugcuagauguagacuuacaccccgcaagugcauggacucucuacgcaguagcgaccacaaucaucacgcccaugaugagacauacuauagaaaacacaacggcaaauauuucauuaacagcaauagcaaaucaggccgccauauuaaugggucuagauaaaggguggccgauuucuaagauggacaucggagugccucucuuggcguuaggcuguuauucccagguaaaucccuuaacucuaacggcagcuguauugaugcuugucgcacacuaugccauuaucggacccggucuccaggcaaaagcaacucgugaagcgcagaaaagaacagcagcaggcauaaugaaaaauccaaccguagacggaauaguagcgauagaucucgacccgguuguuuaugaugcaaaauuugaaaagcaacuaggacaaauaaugcuucuaaucuuguguaccagucaaauucuuuuaaugagaacuacaugggcgcugugcgaauccauaacuuuagcaaccggaccgcuuacuacacucugggaaggaucgccuggaaaauuuuggaauacgacuauugcugugagcauggcaaacauauuuagaggaagcuaccuagcaggagcaggauuagccuuuucucucaugaaaagccuaggcggaggaagacgagguacgggugcacaaggagaaacacuuggggaaaaauggaagagacaacugaaucaguuaaguaaaagugaauuuaauaucuacaagcgaucaggcauaguggaaguugaccguuccgaagcaaaggagggacuaaaaaggggugagacaauaaaacaugcuguaucucguggcacugcaaaacuaaggugguuuguagaacgaaaucuuguaaaaccagaagguaaaguaauagaccuaggaugugguagaggagguugguccuauuacugugcaggacuuaagaaaguaaccgaaguaaaaggauauacaaaagggggucccggacacgaggagccaauuccaauggcaacauacggcuggaauuuggucaaacuauacaguggaaaagauguauuuuucauuccaccagagaaaugugauacacuacuuugugauauuggcgaaucaagucccaauccgacaaucgaagaaggacguacauuaagaguguuaaaaaugguugaaccaugguuaaggggaaaucaauuuuguaucaaaauauuaaauccauacaugccaucaguuguagaaacgcuggaacaaaugcaacgaaaacacggaggaaugcuuguacguaacccauuaagcagaaacagcacucacgaaauguauuggguaucuugugggacuggcaauauaguauccgcgguaaauaugacuuccagaauguuacuaaaccgauuuacaauggcccaccgaaaaccaaccuaugaaagagaugucgauuuaggcgccgguacucgacacgucgccguugaaccggaggucgccaauuuagacauuaucggacaacggauugagaauaucaaaaaugaacacaaaagcacauggcauuacgaugaagauaauccuuauaaaacaugggcuuaccacggaucuuaugaagucaaaccuuccggaucggcaaguaguaugguaaauggaguugugagauuacucacaaagccgugggauguaauacccaugguaacucaaauugcuaugacagacacaacaccguucggacaacaacgaguauuuaaagagaaaguggauacuaggaccccgaaagcaaagagggggaccgcucaaauaauggaaguaacagcaaaauggcuauggggauuuuugucacgcaauaaaaagccuaggauauguaccagagaggaauuuacuagaaaaguccgcucuaacgcagcuauaggagcaguguuugucgaugaaaaucaguggaauagcgcaaaagaggcugucgaagaugaaagguuuugggacuuagugcgucgagagagagaauugcauaaacaggggaaaugcgcuacuuguguauauaacaugaugggaaagagagagaaaaagcuaggugaauuuggcaaagcaaagggcagccgugcaauuugguauaugugguugggagcaagauuccuagaauuugaggcacuagguuucaugaacgaagaucacugguucucuagagaaaacaguuugucaggcgucgaaggcgaaggacuacauaagcuaggauacauacuuagagacauuagcaaaauuccaggcggcaacauguaugcagacgauacggcggggugggacacuaggauuacagaggaugaucuccaaaaugaagccaaaauaacagacaucauggaaccggagcacgcacuauuggcgacgucuauauucaaacuuacguaucaaaauaagguaguuagaguccaaagaccugcuaaaaaugguacugugauggaugugauuucacgaagagaucaacgaggaucaggacaagugggaacuuaugguuugaacacauuuacaaauaugggcgcgcaacuaauaagacaaauggaaucagaggguaucuucagcccgagugaacuugagacuccaaaccuagccggcagagucuuagacugguuagaaaaacacggcaucgaaagguugcguagaauggcaauuucgggcgaugauugugucguaaaaccaauugacgauagguuugcgacagcgcuaacugcacuaaacgacauggggaagguaagaaaagauauaccucaaugggagcccaguaaaggauggaacgacuggcaacaagugccauuuugcagccaccauuuccaucaauuaaucaugaaggacggucgagagauuguaguuccuugucggaaucaagaugaacuugucggacgagcaagaguaucacagggagcaggauggucguuaagagaaacggccugucuaggaaaaagcuaugcgcagauguggcaauugauguauuuccauagacgagaccuucgucuugccgccaaugcgauuugcucggcgguaccagucgauuggguaccaacuucacgaacuacauggucuauucacgcacaucaccaauggaugacaacugaagauaugcucaguguauggaacagaguauggauugaagagaauccauggauggaagacaaaacccauguuaguaguugggaagacgugccguaucuuggaaagagggaagaccaauggugcgguagccuaauuggucugacugcaagagcuacgugggccaccaauauucaaguagcaauuaaucagguuagacgccugauagguaaugaaaauuacuuagauuauaugacaucgaugaaaagauucaaaaacgagucggauccugagggcgcuuuaugguga

SEQ ID NO: 22156 - RNA, 9879 nt, Artificial Sequence
  derived and/or modified CDS sequence (opt6) from DENV-1__DQ285562__SS-prME
aguguuacgaugcuauuaaugcuucugccgacggcauuagccuuucaucucacuacgcgaggaggugaaccucauaugauuguaucaaaacaagagcgaggaaaaucuuuguuauuuaaaacaucugcggggguaaauaugugcaccuuaauagcaauggaucuaggagagcuaugcgaagauaccaugacauacaaaugcccaaggauaacggaagcagaacccgacgauguagauuguuggugcaacgcgacagauacauggguuaccuaugguacaugcucucaaacaggugaacaucgcagggacaaaaggucaguagcauuagcaccccacgugggauuagguuuggaaacgagaacagagacuuggaugagcucggaaggagccuggagacaaauacaaaaaguagaaacuugggcuuuacggcauccagguuucacggucauagcgcuauuccuggcacacacuaucggaacaucaauuacacaaaaagguauaauuuuuauacuuuuaauguuagugaccccauccauggcuaugagaugcgucggaauaggaaacagggauuuuguagaagggcuaucaggugcgaccugggucgacguaguacuagagcaugguucauguguuaccacuauggccaaaaauaaaccuacacuggauauugaacuucucaaaacggaaguaacaaacccggcaguuuuaagaaaauuauguauagaagcaaaaauaaguaacacaacaacggauucaagguguccaacucaaggugaagcgacucuuguagaagaacaagacgcaaauuuuguuugcagaagaacauucguggaucgagguuggggaaaugguuguggccuauuuggaaaaggaucgcuguuaacgugugccaaauucaaauguguaacaaaacucgaaggaaaaaucguacaauacgaaaacuuaaaauauucgguaaucguaacaguccacacuggagaccaacaccaaguugggaacgaaacaacagaacacgguacaauugccacuauuacgccacaagcaccaacgucugagauacaauuaacagauuauggagcccuaacucuggacuguaguccgcguaccggcuuggacuuuaacgaaaugguacuucugacaaugaaagaaaaaucaugguuaguacauaaacaaugguuucuugaucuaccucuucccuggacaucgggugcgucaacuagccaagagaccuggaacagacaagacuuauuaguuacauucaaaaccgcucaugccaagaaacaagagguaguaguauuggguucgcaagagggcgcuaugcauaccgcacucacgggagcaacagaaauacagaccucuggaacuacuacgauauuugcuggacaucucaaauguagauuaaaaauggacaaacuuacacuaaaagguguaagcuacgucauguguacaggaucauuuaaacuagaaaaagaagucgcagaaacacaacauggaacuguuuuaguacaaguaaaguaugagggcacagaugcuccguguaaaauacccuucucaacgcaagacgaaaaggguguaacacaaaaugggagacucauaaccgccaacccuauaguuacugacaaggaaaaaccagucaacauugaaaccgagccucccuuuggagaaucuuacauaguuauaggagcgggcgagaaggcccuaaaacuaaguugguucaaaaagggaucaucaauaggaaaaauguuugaggcaacagcacguggugcaaggcgaauggcaauacuaggcgauacugcaugggauuuuggcagcauaggcggcguauuuaccagcgugggaaaauugguucaccaaguauucggcaccgcauacggcguacuauucucuggaguuagcuggacaaugaagauugggauaggaaucuugcuaaccuggcucggacuaaauucacgaaguaccucacuaagcaugaccuguaucgugguagguauggugacccuguaucuugggguaaugguacaagccgacucuggcugcgugaucaauuggaaaggacgagagcuuaaaugugguaguggaauauucgucacaaaugaaguucacacauggacugaacaauauaaauuccaggcagacucgcccaaacgucuaucggcagcgauaggcaaggcaugggaggaaggagugugcggcauuagauccgcuacucgucuagaaaacauaauguggaaacaaauuagcaaugaguuaaaccauauauuacuagagaaugauaugaaauuuacuguagucgugggcgacgcaaacggaauacuaacucaaggcaagaaaaugauaaggccacaaccuauggagcauaaauauaguuggaaaaguuggggaaaagcaaaaaucauaggggcugauauucaaaacacuacuuuuauaauugauggaccggacacaccagaaugccccgaugaccagcgagcauggaacaucugggagguugaggacuacggcuuugggauauuuacuacaaauauauggcuaaaauuaagagauucuuauacgcaaaugugugaucacagauugauguccgcugcaaucaaagauuccaaagcuguccaugcugauaugggguacuggauagaaucugagaaaaacgaaacauggaaacuugccagagccagcuucauagaggucaagacguguauauggccaagaagccacacccuauggagcaacggaguccucgagucagagaugauaaucccuaagaucuauggaggacccauaucgcaacacaauuaucgcccgggguacuucacgcaaacggcaggucccuggcauuuaggaaaauuagaguuagacuuugauuugugugaagggacuacuguggucguugaugaacauuguggaaaccgaggaccuagccuucgaacuacgacagugacaggaaaaaucauucacgagugguguugcagaaguuguacuuugccgccgcuccgcuucaaaggagaggacgguugcugguaugguauggaaauccgaccggugaaagaaaaagaggagaaucucguccgaaguaugguuagugcagguucaggugagguagacucguucucucuaggucucuuauguguuaguaucaugguugaagaaguaaugcguucuagauggucaagaaaaauguugaugacaggcaccuuagcuguuuucuucuuguuaauuaugggccaauugacuuggaaugaccuaauaaggcuaugcauaauggugggggccaauguaucagacagaauggguaugggcacaacauauuuagcucuaauggcaaccuucaaaaugaggccaauguucgcaguugggcuuuuauuucgucgacuuacgaguagagaaguucuacuucucacuauaggguuaucauuagucgcaucugucgaauuaccaaacucucuggaggaacuaggagacggguuagcuaugggaaucaugauguuaaaacuucucacagauuuucaaagccaucaacuauggacaacucuauuaucucuaaccuuuaucaaaacgacacugucuuuggacuaugcuuggaaaacaauugccauggugcuuucgauuguaucucuauuuccccuguguuuauccacaacaagucagaaaacgacaugguugccaguguuauugggaaguuucggauguaaaccacuuaccauguuuuuaauaacagaaaacaagaucuggggaagaaaaucguggccccuuaaugaaggcauaauggcggucgguauaguaucgauccuauuguccucgcuauugaaaaacgaugucccucuagcuggaccacucauagcugguggaaugcucauaacuugcuacguuauaagcgggucuucugcggaccuuaguuuagaaaaagcagcggaaguuucuugggaggaggaagcugagcauucuggagcaucacauaauaucuuggucgaggugcaggaugaugguacuaugaaaauuaaggaugaagaaagggaugacacucuaacgauucugcuaaaagcaacacuccuagcuguaagcggaguauauccaaugagcauaccagcuacuuuauuuguaugguauuuuuggcagaagaagaaacagagaucggggguauugugggacacgccauccccuccagaaguggaaagagcaguucuagacgauggcauauauagaauauugcagcguggacuacuaggaagaagccaaguuggagucgggguauuccaagauggggucuuccauacuauguggcacgucaccagaggagcgguacucauguaucaaggaaaaagauuagaaccaaguugggcaagcgugaaaaaggaucuaauaaguuaugguggaggauggcgguuccaaggaucuuggaacacaggagaagaaguucaaguaaucgcuguagaaccaggcaaaaauccgaagaauguccaaacgacucccgggacuuucaaaacuccggaaggcgaaguuggagcaauagcacuugacuuuaaacccggaacaagcggaucccccauaguaaauagagaaggaaaaauuguaggacuguauggaaacgguguuguuacgacguccggaacguauguuagcgcgauagcacaggcgaaggcuucgcaggagggaccauuaccugaaaucgaggaugaaguguuuaagaaacgaaaucuuacaauaauggaucuacauccgggaucaggaaaaaccagacgguacuuaccugcuauuguccgagaagcuauaaaaaggaaacuaagaaccuuaauauuagcacccacacgggugguugcaucggaaauggcugaagcccuuaaagguaugccaauaagguaucaaacuacugcuguuaaaucagaacauacaggucgugaaauaguggacuugaugugccaugcgaccuucacuaugagacuuuuaucaccuguccgugucccaaauuacaauaugauaauuauggacgaagcgcacuuuaccgaccccgcuucaauagcagcccgagguuauauaucgacaagaguuggaaugggcgaagcagccgcuauauuuaugacagcaacacccccagguucagucgaagcauucccacaaaguaacgcugugauacaggaugaagagagagauaucccagaacguuccuggaacucuggguaugauuggauaacagauuucccaggaaaaacggucugguuuguaccaucaaucaagucaggaaacgacaucgcgaacugccucagaaagaaugguaaaagaguaauucagcuaucacguaagacauuugacacagaauaucaaaagacuaaaaauaacgauugggauuauguuguaacuaccgauaucucagaaaugggagcaaacuuuagagccgaucguguaauugauccaagaagaugcuuaaagcccguuauacugaaagauggacccgaaagaguaauucuagcugggccgaugccgguaaccguagcaagugcggcucaacguaggggaaggaucgggcguaaccaaaauaaagaaggugaccaguacauauacauggggcaaccacuaaauaacgaugaggaucacgcucauuggacugaagcuaaaaugcuccuagacaacauaaauacaccagaaggaaucauuccagcucuauuugaaccugaaagggagaaauccgcagccaucgauggggaauaucgacuacguggcgaagcgagaaaaacauuuguggaauuaaugaggagaggagauuugcccguguggcucucuuauaagguggcgagcgaaggcuuccaauacucagauagacgaugguguuucgauggugaaaggaacaaccagguauuggaagaaaauauggacguagagauauggacaaaagaaggagagagaaagaaauugcgaccacgcugguuagaugcucgcaccuauagugacccccuagcgcuaagagaauuuaaagaguuugcagccggucgucguagcguaucuggcgaucuaauacucgaaauagggaaauuaccucaacaucuuacacucagagcucagaaugccuuagauaaccuuguaaugcuacauaauagugagcaagggggaaaagccuacagacaugccauggaggaacucccggauacgauagaaacccuaaugcuacuggcauuaauagcagucuuaaccggaggugugacauuauucuuuuuaucuggaaaaggauuagggaaaacgucaaucggcuuauuaugcgucauggcaucuaguguucuguuauggauggcuucaguugaaccacauuggauagcagccaguauaauccuugaguucuuucugaugguacuucucauucccgaaccagaucgacaaagaacaccacaggauaaccaguuagcguauguggucauaggccuauuauucaugauuuuaacagucgcagcaaaugaaauggguuuguuagaaaccacgaagaaagaccuuggaauaggucacgcagucgcugaaaaccaccaucacgcaacaaugcuagauaucgaccuucaccccgccucagcguggacauuauaugcuguugcaacuacaaucauaacucccaugaugaggcauacuauagaaaauacgacagcgaauauaaguuuaacagcaaucgcuaaucaagcggcaauauuaaugggccuagauaaaggauggcccauaaguaaaauggacauagggguaccucuacuugcuuuaggauguuacucccaaguuaacccguuaacccuaacggcagccguccuuauguuaguggcccauuaugcaauaauagguccgggacuacaggcgaaggcgacgagagaagcacaaaagcgcaccgcagcagguauaaugaagaauccaaccguugauggaauaguugcuauagaucuagacccugugguauaugaugcuaaguuugaaaaacaacuaggucaaaucaugcuauugauauuaugcacgagucaaauuuuauugaugcguacuacuugggcguugugugaaucuaucacauuagcuacuggcccuuuaacaacucuuugggagggaagcccagguaaauuuuggaacacaacaauagcaguuaguauggcuaauauauuucgaggcucauaucuugccggagcaggacucgcguuuucacuaaugaaaucauuagggggcgggcggcggggaacaggagcgcaaggcgagacacuuggcgaaaaauggaaacgccaacuuaaccaacugucaaaaucugaguucaauaccuauaaaagaagcggcaucauggaaguugaccgcucggaggcaaaggaaggguuaaaaagaggagaaacaacuaaacacgccgugagucgaggaaccgcaaagcugaggugguucguagaacgaaauuuagugaaaccagaaggaaaagugauagauuuaggcuguggaagaggaggauggucauacuauugugccggacucaagaaaguuacggagguaaaagguuacacaaaaggggguccaggucaugaagaaccaauuccuauggcuacauacgguuggaaucuagugaaauuacauagcgguaaagauguauucuucacuccacccgaaaagugugauacacuauuaugcgacauuggagaaucaucaccgaauccaacaaucgaagaagggaggacacuacgugucuuaaaaauggucgagccuuggcuacgaggcaaccaauuuuguauuaagauacucaaucccuauaugccaucuguuguagaaacucuugagcaaaugcaaagaaaacauggugggauguuaguaagaaacccauugucgagaaauucuacucaugagauguacuggguaaguugcgggacagggaacauuguaucagcaguuaacaugacaucucgcaugcuuuuaaacagauucacaauggcucauaggaaaccgaccuaugaaagggauguugauuuaggggcuggaacacggcacguugcaguagaaccagaaaucgcgaauuuagauauuauaggccaaagaauugaaaauauuaaaaaugagcacaaaucaacguggcauuacgaugaagacaauccguacaagaccugggcauaucacgguaguuacgaaguaaaaccaagcgggagcgcaucuucgaugguuaacgguguuguaagguuauugacaaaacccugggauguaauucccauggucacccaaaucgccaugacugauacaacaccuuuuggacaacaacgaguauuuaaagaaaaaguugauacucguacuccgcguccgaaaagaggaaccgcacaaauuauggaaguuacagcaaaguggcuguggggguuucuauccaggaacaagaaaccuagaauauguacuagagaagaauuuacccgaaaagucaggucaaaugccgcaaucggggcuguuuuuguagacgaaaaccaauggaacucagcaaaagaagccguagaagacgaacguuucugggaucucguucaccgagagcgugagcuucauaaacaggggaaaugcgccacuuguguuuauaacaugauggguaaacgugagaagaaacuuggagaguucggaaaagcuaaaggguccagagcuauaugguacaugugguuaggagcucguuuccucgaauuugaagcgcuaggcuuuaugaaugaggaccauugguuuucgagagaaaauucuuuauccggaguagaaggugaagggcuucacaaauuaggauacauauuaagagacauaucuaaaauucccggaggaaauguauaugcagacgauaccgccggaugggauacccgaauaaccgaggaugauuuacaaaacgaagccaaaauaacugacaucauggagccagagcaugcauuacuagccacuucuauauucaaacuuacauaccaaaacaaagugguuaggguccaaagaccagcaaagagugguacaguaauggauauuauuucacguagagaccaaagaggaucuggucaaguagguacuuacggauuaaacacguuuaccaacauggaaguccagcuuaucagacaaauggaguccgaagguauauuuagucccagugaauuagaaaauucaaaucucgcggaaagaguucuugauugguuagagaaacaugggguugagcgauuaaaacgcauggcaauaaguggugaugacugcgucguuaagcccacugacgaccgauuugccacggcguugacagcacuaaacgacaugggaaaaguaagaaaagauaucccacagugggagccaucgaaaggauggaaugauuggcaacaagugccauuuuguucucaucauuuucaucaacuuauaaugaaagacggacgagagauugucguuccaugcagaaaucaagacgaacucgucgguagagcccgugucucacaaggagcugguuggucgcugcgugaaacagcuuguuuagggaaaagcuaugcacaaauguggcaacuaauguacuuccaccgacgugaucuacgauuagcugcuaaugcaaucugcucagcagugccaguugauugggugccaaccagcagaacaacguggagcauacacgcacaccaucaauggaugacgacagaggacaugcucucaguauggaacagggucuggauagaggaaaacccguggauggaagauaaaacucacguuucuagcugggaagauguaccauaucuugggaagagggaggaccaauggugugguucacuaauagggcuaacggcgcgagccacgugggcaacaaauauccaagucgcaauaaagcaaguaagaagacuaauaggaaaugaaaauuacuuggauuauaugacgagcaugaaacguuuuaaaaaugaaucugacccagaaggggcucuaugguaa

SEQ ID NO: 22157 - RNA, 9879 nt, Artificial Sequence
  derived and/or modified CDS sequence (opt6) from DENV-1__DQ285558__SS-prME
uccguuacuaugcuguuaauguuacucccaacugcauuaacuuuucaccucacgacgcgcggaggggaaccucacaugauugugggaaaacaagaacgagguaaauccuuauuguuuaaaacgucugcaggaguaaacauguguacucucaucgcuauggaucugggagaauuaugcgaugauacuaugacuuacaaaugcccaagaaucacggaaacagaaccugaugauguggauuguugguguaaugcgacagaaacauggguuacauacggaacaugcucgcaaacgggugaacauagaagagacaaacgaagcguagcauuagccccacacguagggcugggccuggaaacgcguacagaaacuuggaugagcagugagggugccuggagacaaauucaaaaaguagagacaugggcccuuagacaucccggauuuacaguuauagcacuauucuuagcacacgccauagguacuucaauaacucaaaaagggauaauuuucauauuacuaaugcuaguaacuccgucaauggcaaugcgaugcguaggaauaggcaauagggacuucgucgaagguuugagcggagcaacuuggguugauguaguucuggagcauggaucuuguguaacgacuauggcaaaagauaaaccuacacuggacauagaacuguuaaaaacagaaguuacgaacccagcgguucuuagaaaauuauguaucgaggccaaaauaucaaauacaacaacagauagccguugucccacgcaaggugaagcuacccuaguagaagaacaagauacaaauuuuguauguagacguacauuuguagaucgaggcugggggaauggauguggucuauuugguaaagguucguuaauaacaugugcgaaguuuaaauguguaacuaaacuugaggguaaaauaguucaguacgagaauuuaaaauacuccguaauuguuacgguacauaccggagaucaacaccaaguaggaaaugaaacaaccgaacacggaacgauagcaacaaucacaccacaagcuccaacuucugaaauucaacuuacagauuauggugcauugacacuggacuguagucccagaacaggacuugacuuuaaugagaugguccuuuuaacaaugaaggaaaagaguuggcuaguucacaaacaaugguucuuggaccugccccuaccauggacauccggggcgucaacgagucaagaaacuuggaaucggcaagaucuucuaguuacuuucaagacggcacacgcgaagaagcaagaaguaguaguguuaggaagccaagaaggagcuaugcauacagcacucaccggugcaacagaaauacaaacaagcgguaccacgacaauauuugcuggacauuuaaaaugcaggcuuaaaauggacaaauuaacauuaaaaggaauaaguuauguuauguguacuggaucauuuaagcuagaaaaagaaguagccgagacacaacaugggacgguuuuaguacaggugaaguaugaagguacugaugcuccguguaagauaccuuuuucaagucaagacgagaaaggugugacgcaaaacggccgauuagucacggcuaacccaauaguuacugauaaagaaaagccuguaaauauugaagccgagccaccuuuuggcgagucguacauaguagucggagccggcgagaaggcacucaaguugagcugguuuaagaaagguucaucgauaggaaaaauguuugaagcaacagccagaggggcacggcgaauggcgauacuaggcgacacugccugggauuuuggaagcauaggcgguguauuuacaucagucggcaaguuaguacaucagauauucgguacagcauauggcguguuguuuucaggugugucuuggaccaugaaaauagggauugguauacuauuaacguggcuagguuuaaacucaagaucaacaaguuugaguaugacaugcaucgcaguuggccuaauaacacuauacuuaggggucaugguucaggcagauuccgguuguguaaucaacuggaaagggagggaguuaaaaugugggucagguauauuugucacuaacgagguacacacuuggaccgaacaauacaaauuccaagcugauucaccgaagagacuuucugcugcaauagguaaggcaugggaagagggaguaugcggcauacgaagugcgacacgucuagagaacauuauguggaaacaaauaucgaaugaacuuaaucauauacugcucgaaaacgauaugaaauuuaccguaguaguaggugaugucagugguauucuagcgcaggguaagaaaaguauacgaccucaaccuauggaacauaaauauuccuggaaaaguugggggaaggcaaaaauaauaggagcugacguacagaacaccacuuuuauuauugauggaccgaauaccccagaaugcccagacgaucaaagagcuuggaacauuugggaaguagaagauuauggcuuuggcaucuucacaacaaauauaugguugaaauuaagagacucuuauacacaggugugcgaucaucggcuuaugagcgcagcgaucaaagauagcaaagccguucacgcggauaugggcuacuggauagaaagcgagaaaaacgaaacauggaaacuugcuagagcuagcuuuauugaagucaaaaccuguauauggccaaaaucucacacacuguggucaaacgguguccuagaaagcgagaugaucauuccgaagauauacgguggaccaauaucacaacacaacuaucgcccgggauauuuuacgcaaaccgcaggaccauggcaucuaggaaaacuggaauuagauuucgacuugugugaagguacuacuguagugguagaugaacacugcgggaaucgugguccaucucugcgaacaacuacuguuaccggcaaaauaauucaugaguggugcugucggucgugcacuuuaccgccacucagauuuaaaggagaagaugguuguugguacggcauggagauucgaccuguaaaagagaaagaagaaaauuuaguaaaaagcaugguaagcgccgggaguggugaaguggauagcuuuucuuuaggauuauuaugcauuagcauuaugaucgaagaagugaugagaucgagauggucaagaaaaaugcugaugacaggaacgcuagcaguauuuuuacuccuaaccaugggccagcuuaccuggaacgaccuaauccgauuaugcauaauggugggagcaaaugcgucggauaauaugggcaugggaacgacguauuuagcauuaauggcgaccuuuagaaugcgaccaauguucgcaguuggccuguuguucaggcguuuaacgucuagggagguuuuacucuuaacgguagguuuaucacugguggcaaguguugaauugccaaacucauuagaagaauuaggugauggacuagcuauggggaucaugauacuuaaacuucuaacggacuuucaaucgcaccaauuaugggccacucuucuuucacuaacuuuuguaaagacaacauucagucuccacuacgcauggaaaacaauggcaaugauucuaaguauugugagucuuuucccauuaugcuuaucaacgacgucacagaagacaacguggcugccuguacuacuugguucguuagguuguaaaccuuuaacgauguuccuaauaacagaaaacaaaaucuggggaagaaaguccuggccauuaaaugaaggaauaauggcaguuggaaucguaagcauuuuacuaaguucccuucucaaaaacgacgugccacuagcuggaccgcuaauugccggggguauguuaaucgcauguuauguuauuucgggaucaucagccgaucuaaguuuagaaaaagccgccgaaguaagcugggaagaggaagcagaacauucgggagcaucacauaauauauuaguggagauucaggaugaugguaccaugaaaauuaaagaugaagaaagagaugacacaauuacaauucuacuaaaggcgacauuacuugcaauaucggguguauauccgaugagcauaccugcaacuuuauucguuugguacuuuuggcaaaagaaaaagcaacggucaggagucuuaugggauacgccaucaccgccugagguugagagagcaguccucgaugauggaauauaccguauacugcaaagaggcuuauuaggacguucucagguagggguagguguguuucaggaggggguauuucacacuauguggcaugugaccagaggagcgguucugauguaccaaggaaagagguuagagccaucuugggcaaguguuaagaaggauuugauuucuuauggaggaggauggagauuucaggggaguuggaacacgggcgaggagguacaaguaaucgcagucgaaccgggaaagaaucccaaaaauguucaaacugccccgggaacuuuuaaaacaucugaaggugaaguaggagcaauugcacuagauuuuaagccugguacaucuggaucaccuaucguuaaucgcgaagguaaaauaguaggccuauacggaaacggagucgucacaacaucaggaacauacguuuccgcuauagcucaagcuaaagccagucaggaggguccucuaccagaaauagaagacgaagucuuuagaaaacggaacuuaacgauaauggaccuccauccugguucggggaagacgagaagauauuuaccagcuaucguucgagaagcuauaaaacggaaguuaaggaccuuaguuuuagcuccaacacgagucguagcuuccgaaauggcugaggcacucaaagguaugccuauacgauaucaaaccacggcuguaaaaucagagcauaccggaagagagauuguagauuuaaugugucacgccacauuuacuaugcgguuacuuucuccagugcgagugccuaacuauaauaugauaauaauggaugaggcgcauuucacugacccggcaucaauugcugcaagagguuacauaucaacuagaguaggaaugggcgaagcugccgcgauauuuaugacugccacuccaccagguuccguggaagcauucccgcaauccaacgccguaauacaagaugaagaaaaggacauuccagagcgaaguuggaacaguggauacgacuggauaacugauuuuccuggaaaaacugucugguucguaccgagcaucaagucuggcaacgauauagcaaauugccuuaggaaaaacgguaaaagaguuauccaacucucaagaaagacuuuugauacagaguaucagaaaacuaaaaauaacgacugggauuacgugguaaccacggauaucagcgaaaugggcgcuaacuucagggccgauaggguaaucgauccgcggagaugccuuaaacccguaauccucaaggaugggccagaaagaguuauucuugcggggcccaugccagucaccguugcuucggccgcucaaaggagaggacgcauaggcagaaaucagaauaaggaaggagaucaauacauauacauggggcaaccucucaauaaugaugaagaucaugcucauuggacugaagcaaagauguuacuggauaacauuaacacucccgaaggaauaauuccagcccuauucgaaccggaacgagaaaaaucagcggcuauugacggugaguacagauuaagaggggaagcucgaaaaacuuucguagagcuaaugagacggggugacuugccuguguggcuaucguacaaaguggccagcgaaggguuucaauacucagauagaagaugguguuuugacggugaacggaauaaucagguauuagaggaaaauauggacguugagauuuggacaaaggagggagaaagaaagaaguugagaccacgcuggcuagaugcgagaaccuauagugacccacuugcccuacgggaguucaaagaauuugcggcuggucgaagaucaguuucaggagaucuuaucuuagaaauaggaaaauuaccucagcaccuuacacaaagggcacaaaacgcucuggacaaucuagugauguuacauaacucugagcaagguggaaaagcauacaggcaugcuauggaagaacuaccggauacaauugaaacccucauguugcucgcauugaucgcuguuuuaacgggaggugugacauuauucuuuuuaucuggcagaggguugggcaaaacaaguaucgguuugcuaugcgugaugucaucuuccgcccucuuauggauggccagcguggaaccacacuggauugcggcauccauaauccuugaguucuuccuaaugguacuucuuaucccagaaccggaucgacaaagaacuccccaagauaaccaacuagcguacgucguaauaggccuauuauuuaugauucuaacgguugcagccaacgaaauggguuuauuggagacaacgaagaaagaccuugguauaggacacgcggcagcugaaaaccaucaucacgcagcaaugcuugauguugauuugcacccugcaucagcauggacacuauaugcaguugcgacaacaauaauuacaccgaugaugcgacacacgauagagaacacgacagcaaauaucucauugacggcaauugccaaucaagcggcuauccugaugggguuggauaaagguuggccaauuucaaagauggacaucgggguuccccuuuuagcuuuaggauguuauagucaagugaacccgcucacucucacggcugcuguucugaugcuaguugcccacuaugcuaucauagguccaggucuacaagcgaaagcaaccagagaagcucaaaaacgaacagccgccgguauaaugaaaaauccgaccguggauggaauugucgcgauugauuuagacccaguaguguaugaugcaaaauuugagaagcaguugggucaaauaauguuacuuauacuuugcacaucccaaauauugcuuaugagaacgacgugggcgcuaugugaaagcauuacccuugcaacagguccacuaacuacacugugggaaggaagcccagguaaauuuuggaacacgacaauugcuguaaguauggcuaauauauuuagggguucauaucuagcuggcgcaggcuuagcauucucauuaaugaaaaguuuagggggcggcagaaggggaacaggugcucaaggagagacauuaggugaaaaauggaaacgacaauuaaaucaguugucgaaaagcgaauuuaauauuuacaagagaagcgguauuguggaaguagaccgcagugaagcaaaggaaggauugaaacgcggcgaaacaauaaagcacgcaguaucgagagggacggcaaaauugagaugguuuguagaacguaacuuagugaaaccugaaggaaaggucauugauuugggcuguggucgaggaggcuggucauauuauugugcaggacucaagaaagugacagaagucaaagguuauacuaagggcggaccagggcacgaagaaccaauuccuauggcuaccuaugguuggaauuuaguaaaauuauauagcgggaaagauguauucuuuauaccaccggagaaaugugauaccuugcuuugugauaucggugaaagcuccccaaauccuacaauagaagagggucgaacgcuuagaguccuuaagaugguagagcccugguuaagggguaaccaauuuugcauuaagauauugaacccguauaugccaaguguaguugaaaccuuagaacaaaugcaaagaaaacauggagguaugcuagugcgaaacccucuaaguagaaauaguacgcacgaaauguauuggguaaguugugggacaggaaauauagugucugcgguuaauaugaccucaagaaugcuuuuaaauagauucacgauggcccaucgaaaaccaacauacgaacgggacguagacuugggggcugggacaaggcauguugcaguggagccagaaguagcaaaccuagacaucauaggacaaagaauagagaauauuaagaaugaacacaagagcaccuggcauuacgaugaagacaacccuuauaaaacaugggccuaucauggcucguaugaagugaaaccauccggaagugcaaguaguauggucaauggaguagucagacuuuuaacgaagccuugggauguaauaccaaugguaacacagaucgcgaugacagauacaacuccauuuggucaacaacgaguauuuaaagaaaaagucgauacuaggacacccaaagcuaaacgcgggacggcccaaauaauggaaguaacagcaaaauggcucugggguuuucuaagccgaaacaaaaagccuagaauauguacuagagaagaguucacaagaaaaguaagaaguaacgcagcgauaggugcaguauuuguugacgaaaaucaguggaacagcgccaaggaagccgucgaagaugaaagguucugggaucuaguucgacgugaaagagaacuucacaaacaaggaaaaugcgcgacaugcguuuacaauaugaugggcaaaagggagaagaaacucggugaauuuggaaaggcaaaagggaguagagcuauuugguauaugugguugggcgcacgauucuuagaguucgaggcucuaggauuuaugaacgaagaccacugguucagucgcgagaacucacuuucagguguagaaggcgaaggucuacauaaauuagguuauauacuuagagauaucucaaaaaucccgggcggaaauauguacgcagacgauacggcagggugggauacaaggauaacagaggacgaccuccaaaacgaagcaaaaaucacugacauuauggaacccgaacacgcacuucuagcgacaucuauauuuaaauuaaccuaucaaaacaaaguuguucgaguucaacgcccagccaaaaacggcaccguaauggacgucauuagccgaagagaccagcgcggcucuggacaaguuggaacuuacggacuaaauaccuucaccaauaugggugcacaauugauuagacaaauggagucugaagguauauuuucuccuagugaacuagaaacgccaaauuuagcaggcagaguuuuagauuggcuggagaaacauggcauagagagacuacgcagaauggccauuagcggagaugauugugucgucaaacccauagaugauagauuugcaacggcucugacugcguuaaaugauaugggaaaaguacgaaaggauauuccucagugggaaccgagcaaaggauggaaugauuggcaacaaguaccauuuuguucacaucauuuccaucaacucauaaugaaggaugggagagaaauaguuguuccaugccgaaaucaagacgaauuaguagggcgggcaagaguaagccaaggcgccggauggucacuccgcgaaaccgcgugcuuggguaaaucguaugcacaaauguggcaacuaauguacuuucaucguagggaccuacgccuugcugcuaacgcuaucugcucagcaguccccguagacuggguaccuacaaguaggacuacauggucuauacacgcucaccaucaauggaugaccaccgaggacauguugagcguauggaauagaguuuggauagaagagaauccuuggauggaagacaaaacccaugugucaagcugggaagauguuccuuaucuugguaaacgagaggaucaaugguguggaucacuaaucgguuugaccgcacgagcaacuugggcgacuaacauacaaguugccauaaaccaagugagaagacuuaucggaaaugaaaauuacuuagauuauaugacaagcaugaagcgguucaagaacgaaagcgauccagaaggcgcauuaugguaa

SEQ ID NO: 22158 - RNA, 9879 nt, Artificial Sequence
  derived and/or modified CDS sequence (opt6) from DENV-1__DQ285559__SS-prME
ucagucacuaugcuucugaugcuucucccuacugcguugacauuucacuuaaccacuagagguggagaaccucauaugaucgucucgaaacaagaaagagguaaaucccugcuauuuaaaacaaguguugggguaaauaugugcacauuaauagcuauggaucuaggugaacuaugcgaagauacuaugaccuacaaaugucccagaauuaccgaagcagagccggacgauguagauugcuggugcaaugccacggacacauggguuacauacgguaccugcucacaaaccggugaacaccgaagagauaaaagaucuguagcauuggcaccccacguagggcucggcuuagagacaaggacggaaaccuggaugagcagugaaggagcauggaaacagauacaaaaagucgaaacaugggcuuugcgccacccuggguuuaccguaaucgcuuuauuccucgcccacgcaauagguaccucaauaacgcaaaaaggaaucauauucauacuacuaauguugguaacaccgucuauggccaugagaugugucgguaucggcaaccgggauuuuguagaagguuuaucaggagcuacaugggucgacguuguuuuagaacacggaaguugcguaaccaccauggccaaaaauaaacccacacuagacauagaauugcuuaaaacggaaguuacaaauccagcaguguuacgcaaacuuugcauagaggcuaagauauccaauacaacaacagacucuagauguccuacucaaggagaggcaacccuaguggaagaacaagaugccaacuuugucuguaggcgcacuuuuguugauagaggguggggcaauggaugugggcucuuugguaagggaucacuguuaaccugugcuaaauuuaaauguguuacuaaauuagaaggaaagauuguccaauaugagaaucucaaauacucaguuauaguaacgguccacacuggggaccaacaucaggucgguaaugaaacuacagaacaugggacaaucgccacuaucacuccgcaagcaccuacuuccgagauccagcuaauagacuacggagcauuaacacuggacuguaguccaaggacagggcuggauuuuaaugaaaugguacuacuaacuaugaaaggcaaaagcuggcucguucacaaacagugguucuuagaccuaccucuuccuuggacaucaggugcgagcaccucacaagaaacguggaacagacaagaucuucucguaacauuuaaaacagcucaugcgaagaaacaggaaguagugguauuggguucacaggaaggagcaaugcauacagcauuaacgggagcaacagaaauacagacauccggaaccacaacaaucuucgcaggucacuugaagugcagacuaaagauggauaaacucacauugaaggggaugucauacguuaugugcacaggaaguuucaaauuagaaaaagaaguagcggaaacgcaacacgguaccguccuaguacaagugaaguaugagggaacggaugcaccuugcaaaauuccauuuuccacacaggaugagaaagguguuacucagaacggucgauuaauuaccgcaaacccuauagucacugacaaggaaaaaccggugaacauugaaaccgagccaccuuuuggagagaguuauaucguaguaggagcgggagaaaaagcauuaaaacuaaguugguuuaagaaaggcucgucaaucggaaaaauguucgaagcaacagcacguggugccaggcguauggcaauccuuggagacacagccugggauuuugguagcaucggcggaguuuucacaagugugggaaaacuaacgcaucaaguauucggaacugcauauggagucuuguucucuggaguuaguuggacaaugaaaauagguauugguauacuuuuaacuugguuaggcuuaaacucccgcucuacuagcuuaaguaugaccuguauugcgguugguaugguaacacuguacuuaggaguaaugguacaggcagauucaggcuguguaauaaauuggaaagggagagaguuaaaauguggaucaggaaucuuugugacaaaugagguacauacauggacugaacaguauaaauuccaagcggacaguccuaagaaguuaucagcagccauaggaaaagcaugggaagagggcguguguggcauacgaagcgcgaccagacuagagaacauaauguggaaacaaaucaguaaugagcuaaauuauauauuguuagaaaaugauaugaaauucacugucgugguaggugaugcaaauggcauucucgcacaagguaaaaagaugauucguccucaaccuauggagcacaaauacucguggaagucauggggaaaagcaaagaucauuggugcagauauucaaaauacaacuuuuaucaucgacggucccgacaccccagaaugcccggacgaccaacgagcauggaauauaugggagguugaagauuauggcuuugggauauuuacuacaaacauuuggcuaaaauuaagagacucauauacacaaaugugugaccauaggcuaaugagugcagcuauaaaagauagcaaagcgguacaugcagauaugggauauuggauagagucagagaagaaugaaacuuggaaguuggcucgugcauccuuuaucgaggucaaaacauguaucuggccgaaaucgcauaccuuauggucaaacggaguauuagagucagaaaugauaauaccaaagauauacgggggucccauuucccaacauaacuauagaccaggauauuuuacucaaacugcuggacccuggcacuuaggcaaauuagaguuagacuuugaucuaugcgaaggcacuacagucgugguugacgagcauuguggaaauagagguccauccuuaagaacuacaacuguaacugguaaaauuauacaugaauggugcugccguucuuguacccuuccaccauugcgcuuucgcggcgaagauggauguugguauggcauggaaauacgacccguaaaagaaaaagaagaaaacuuagucagaucaaugguaagugcuggaucgggugaaguggauucuuucaguuuagguauacucuguguaucaauucuaauagaagaagugaugcgaaguaaguggucaagaaaaauguugaugacaggaacguuagcaguguuucugcuuuugauuaugggccaacuaacuuggaaugaucugaccaggcucugcaucaugguaggagcgaacgcuagugacaggauggggauggguacaacuuacuuagccuuaauggcgaccuuuaagaugagaccaauguucgcaguaggacuacucuuucgccgucuaacaucccgugaaguacuguuauuaaccauaggauuaagccuaguagcgucaguagaacugccuaauucucucgaagaauuaggugauggguuagcaaugggaauaaugaucuuaaaauuauuaacggacuuucaaccacaccaacucuggacgacuuuacuuuccuugaccuuuauuaaaaccacacuaagccuagauuacgcauggaaaacuauggcgaugacuuuaucaauuguaucccucuucccgcugugucucucgaccaccagucagaaaacaacuugguuaccaguucuacuaggaaguuuuggcuguaaaccuuugaccauguuuuuaauaacagaaaauaagaucuggggaagaaaaucuuggccaauaaacgaagguauaauggcuguaggcauaguaaguaucuuacucucaucacuguuaaagaaugacguaccucucgccgguccauugauagccggcggcauguuaaucgcauguuauguuaucagcggaucuucagcagaccuuagucuagaaaaagcagcagaaguuaguugggaggaggaagcggaacauucgggcacaucgcacaacauauuaguggagguacaggaugaugguacuaugaagaucaaggacgaggaaagagaugacaccuugacuauacuacucaaggcuacucuuuuagcugugucagguguguacccgaugagcauuccggccacauuauuuguuugguauuuuuggcagaagaagaaacaacguuccgguguucugugggacaccccgagcccucccgaaguugaaagggcagucuuggaugacggcauauaccguauacugcaaaggggguuguuagguagaagucagguuggagucggcguguuucaagaugguguuuuucacacaauguggcacguaacacgcggagcaguccuaauguaucaggguaaaagguuagaaccgucuugggccucugucaaaaaggaucuaauaagcuauggagguggauggcgauuccaagguagcuggaauacaggagaagaaguacaaguaaucgcgguugaaccaggaaagaaucccaagaacguucaaaccacaccagguacauuuaagacaccagagggugaagucggggcaaucgcccuugauuucaaaccaggcacaucgggaucaccaauagucaauagagaaggaaaaauaguaggucuauacgguaauggaguagucacaacaaguggaacauauguuagcgcaauugcacaagcaaaggccagccaagaggguccauuaccagaaauugaagaugagguauucaagaaacguaauuugaccauuauggaccuacacccagggagcggcaaaacaaggcgauaccugccagccauuguaagagaagcgauaaaaagaaaauugcguacccuaauuuuagcgccuacgagaguaguugcgucugaaauggcagaagcauuaaaaggaaugccaauuagauaucagacaacagcaguaaagagcgaacacacaggucgagagaucguagacuuaaugugccacgcgacauucaccaugagacucuuaucaccuguccgugugccaaauuauaacaugauaauaauggacgaagcacauuucacugaucccgcuaguauagcagcccguggauauauuucaacaagaguaggaaugggggaagcugcggcgauuuuuaugacugcuaccccaccagguucgguagaagcauucccucagucaaaugcggucauacaggacgaagaaaaagacauuccugaacgaucauggaacaguggauaugauuggauuacagauuuuccaggaaaaacuguaugguuuguaccaaguauaaaaucuggaaacgauaucgcuaacugucuucgaaagaacggcaaaagagucauacaacugaguagaaaaacauucgacacagaauaccagaaaacaaagaacaacgauugggacuaugugguuacaacagacauauccgaaaugggggcuaauuuucgugcagaccgaguuauagauccacggcguuguuuaaaacccguaauccuaaaagacggaccagaacgaguuauacuagccgguccaaugccuguuaccgucgcgucggcagcucaaagacgcggccgaauugggagaaaucaaaacaaagaaggcgaucaauauguguauaugggacaaccucugaacaacgaugaagaucacgcucacuggacugaggcuaaaauguuguuagacaauauaaacacacccgaagggaucauaccugccuuauucgagccagaacgagaaaaaucagcggccauagauggcgaguauagacucaggggagaggcuaggaaaacauucguggaacuuaugcgccguggagaucuaccagucuggcuaucauacaaaguugccucugaggguuuucaguauucugaucgaagguggugcuuugauggagagagaaauaaccagguauuagaggaaaauauggauguugaaaucuggacaaaagaaggagagaggaagaaguuacgcccucgauggcuagaugcgagaacauauucagaucccuuggcauuacgagaauuuaaagaauuugcugcgggccgucgcaguguuucaggcgaccuuauccuggagauugguaaauugccccaacaucuaacuuuacgagcccagaaugcauuagauaacuuaguaauguuacauaauagcgaacagggaggaaaagcguauagacacgccauggaggaacuuccggauacaauugaaacguuaaugcuucuagcacuaauugccguuuuaaccggaggcgucacacuauucuuuuuaucugguaagggacucggaaaaacuucuauaggacuacuuuguguuauggcuucgucggcauuacucuggauggcaucagucgaaccgcauuggauugcagcaagcauaauuuuagaguucuuucuaaugguacugcuuauaccugagccagaucgucaacgcacuccacaagauaaccaacucgcuuauguagugauugguuuacucuuuaugaucuuaaccguugcagccaaugagauggggcugcuagaaacuacaaagaaagacuuggggauagggcaugucgcugcggaaaaucaccaucaugcgaccauguuagacguugacuugcgucccgcgucagcuuggacacuauacgcaguggcaacaacgguaauaacaccaaugaugcgucauacgauagaaaauaccacagcaaacauuagccuaacagcuauagcaaaccaagcggcaauucugaugggucuagauaaaggauggccuauauccaaaauggauauagggguaccuuuauuagcccuuggauguuacucacagguaaacccauuaacccuaacagcagccgucuuaaugcuaguugcucauuaugcuauuauagggccuggucuucaggcaaaagccacaagggaggcacaaaaacgaacagcagccggaauaaugaaaaauccaacuguugacgguauaguagcaauagaccuagauccaguaguuuaugacgcaaaauuugaaaaacaguugggacagauaaugcuauuaauacucugcaccucacagauauuauugaugcgaaccacgugggcgcucugcgaauccauuacauuagccacagguccucuaacaacucucugggagggauccccaggaaaguuuuggaacacuacuauagcgguaucuauggcaaacauuuucagagguucauaccuugcaggagcagguuuagcauuuucauuaaugaaauccuugggaggcggaaggcgcggaacaggagcgcagggcgaaacgcucggugaaaaguggaaacgacaacuuaaucaauuaaguaagucagaauuuaacacuuauaaaagaucaggaauaauggaaguagaucgaagcgaagcaaaagaaggccucaaaagaggcgaaacaacaaagcacgcuguuucaagggggacagcaaaguugagaugguuuguagaaagaaacuugguuaagccugaaggaaaaguuauagaucuuggcugugggagaggaggaugguccuacuacugcgcaggauuaaagaaagucacggaaguaaaagguuauacaaaaggcgggccgggucaugaagaaccuauuccuauggcuacguauggguggaaucucguuaaacuacacucuggaaaagacguauucuuuauaccuccagaaaaaugugacaccuuauuaugugacauuggagaaucaucgcccaauccuacaauugaagagggccgaacacuaagagugcugaaaaugguggaacccugguuaaaaggaaaucaauuuuguaucaaaauauugaacccauauaugccaucgguagucgaaacucucgaacagaugcagaggaaacacggcgguauguuagucaggaauccgcucucacguaauaguacacacgaaauguauugggucucguguggcacgggaaauauagugagcgcuguaaacaugacuagcagaaugcuucucaauagguuuacaauggcccauaggaaaccaacguacgaaagagauguugaucuuggcgcuggaacccgucacguagccguagaaccagaaguggcaaaucuggauaucauaggucagagaauugagaauaucaaaaacgaacacaaauccacguggcauuacgacgaggacaaccccuacaaaaccugggcauaucauggaaguuaugaaguuaagccgaguggaucagcauccagcaugguaaacggaguagugaggcuacuaaccaagccaugggauguuauaccgauggugacucagauagcuaugacggacaccacaccauucggucagcaaaggguauuuaaagaaaaaguugauacacgcaccccaagggcaaaacgggguacugcacaaauuauggaggucaccgcuaaauggcuguggggauuccucagucgaaauaaaaagccacggaucugcacaagagaggaauuuacacgcaaaguaagaagcaacgcggcgauaggugcuguguuuguagaugaaaaccaauggaacucagcuaaagaagcgguugaggacgaacgauucugggauuuaguccaccgagagagagaguugcacaaacaagguaagugcgcaacauguguauauaauaugaugggcaaaagagagaagaaacucggagaauuugggaaagcaaaaggaucaagagccauaugguacauguggcugggcgcacgauuuuuagaguucgaagcccuagguuuuaugaacgaggaccauugguucucccgagaaaauagucugucuggcguugaaggagagggcuuacacaaauuagguuauauacuacgagauauaaguaagauaccaggagguaauauguaugcagaugauaccgcagggugggacacccgaauuacagaagaugacuuacagaaugaggcaaaaaucacggauauaauggaaccagaacacgcuuuguuggcuacagcuauuuuuaaauuaacuuaccaaaacaagguggucagaguccagcgaccggcuaaaucugguacugugauggauguuauaucucguagagaccaacgaggcucgggacaagugggaacuuacggccuaaauacauuuacaaacauggaagcccaacuaauuaggcaaauggaaucggaaggaauauuccuaccauccgaguuagaaacaccgaaucuggcaaaacgcguucuugauugguuagaaaaauauggcgcagaacgauuaaaacgaauggccauuagcggagacgauuguguaguaaagccuauagaugaucgauuugccaaagcauuaaccgcgcuaaacgacaugggaaaaguacgaaaagacauuccccagugggaaccuucuaaagguuggaacgacuggcaacagguaccuuucuguucucaucauuuucaucaguugaucaugaaagaugggcgagaaaucguaguacccugccgcaaccaggaugaacucgucggaagggcacguguuagucaaggagcaggguggucucucagagaaacugcaugucucgggaaaucauacgcccaaauguggcaauugauguauuuucauagaagggaucuacgacuugccgcuaaugcaauuuguagugcaguuccugucgauuggguuccgacgagcagaacaacauggucuauacaugcacaucaucaauggaugacaacugaagauaugcuaucagucuggaacagaguauggauagaagaaaauccauggauggaagauaaaacacacguuuccuccugggaagaaguaccuuaucuugguaaacgcgaagaucaaugguguggaucacuuauuggacugacagcaagggcaacaugggcuaccaauauccaggucgcaauaaaucaaguuagaagacuaauaggaaacgaaaacuaucuagauuauauggcaaguaugaagagauuuaaaaacgaaagcgacccugaaggugcuuugugguaa

SEQ ID NO: 22159 - RNA, 9879 nt, Artificial Sequence
  derived and/or modified CDS sequence (opt6) from DENV-1__AF311956__SS-prME
ucagugacgauguuacuuaugcuacuucccacagcucuagcuuuucauuuaacuacacgaggaggggagccacacaugauaguuucuaaacaagaaagagggaaaucauuacuauuuaaaacaagcgcaggagugaauaugugcacuuugauagcaauggacuugggugaacuaugugaagauaccaugacuuauaaaugccccagaauaaccgaagcugaaccagacgacguugauuguuggugcaaugcuacggauacauggguaacuuacgguaccuguucucaaaccggagagcauagaagagauaaaagaucagucgcauuagcuccccauguuggauuaggauuagagacaagaacugagacauggaugucaucagaaggagcguggaaacaaauacaaaaaguugagacuugggcauuacgacauccggguuuuacuguuauagcucuuuuucuagcccaugcgauuggaacaucaaucacacaaaaaggcauaauuuuuauacuucuuauguuagugacuccauccauggcuaugagauguguugguauaggaaaccgagauuucguagaagguuuaaguggggccaccuggguagacguuguauuagagcacggaagcuguguaaccacaauggcuaaaaacaaaccaacauuagacauugaacucuuaaaaacagaaguaaccaauccagcgguacuacgcaaacuauguauagaggcuaaaauaucgaauacgacaacagacucgagaugucccacacaaggagaagcgacuuugguagaagaacaagacgccaacuuuguaugcaggaggaccuucguggacagaggguggggaaaugggugugggcucuuugguaaagggaguuuacuuaccugugcaaaauucaaauguguaaccaaacucgaagguaaaauuguucaauacgaaaauuugaaauauaguguuauaguuacgguacauacgggcgaucaacaccaaguaggaaaugaaacaacugagcauggaacaauugccaccauaaccccacaagcgccaacgagugaaauacaacuaaccgacuauggagcucuaacccuagauuguaguccuaggacuggacuugauuuuaacgaaauggucuuacugacaaugaaagaaaaaucauggcuagugcacaaacaaugguuucuagacuuaccccuaccguggacuucuggagccucaacgucacaggaaacguggaaccgacaggauuuacucguuacuuuuaaaacugcacaugcuaagaaacaagaagugguuguauuagggucacaggaaggagccaugcauacagcacuaaccggagccaccgaaauacagacaucuggcacuacgacuauauuugcaggccacuuaaaauguaggcuaaaaauggauaaauuaaccuugaaagguacgucuuaugugauguguacugggaguuuuaaacuugagaaagagguggccgagacacaacauggaacaguuuuaguucaagugaaauaugagggaacugaugcgcccuguaaaauacccuuuaguacacaggacgagaagggaguuacacagaauggaagacugauaacagcgaaccccauugucacagauaaagaaaaacccgugaacauagaaacggaaccgccguuuggugagaguuacauuguuguuggggcaggcgaaaaggcuuuaaaacugagcugguucaaaaaggggucaucaauuggcaaaauguucgaagcuacagcaagaggcgccaggcggauggcaauacuaggagauacggcaugggauuuugggaguauaggagggguauuuacaagugugggaaaacucguacaucaaguuuuuggaacagcuuacgggguucuauuuucaggagucucauggacaaugaaaauaggcauuggaaucuugcuaacaugguuaggauuaaacucacggucaacaagccuaaguaugaccuguaucgcggugggaauggucacccuuuaucuuggagucaugguccaagcugacucagguuguguuaucaauuggaagggacgcgaauugaaaugugguucuggaauauuuguaacaaaugagguacacacauggaccgagcaauauaaguuccaggccgacagucccaaacgauugagugcagcaaucgguagagcuugggaagaaggagucugcggcauaagaucugcaacgcgacuagaaaacauuauguggaaacagauuucaaaugaacuuaaucauauacuucuagaaaacgacauaaaauuuacgguaguaguaggaaaugcaaaugguauacuugcccaaggcaagaaaaugauaagaccacaaccgauggaacauaaauacucguggaaaucuuggggaaaagcgaaaauaauaggggccgauauccagaauacaaccuuuauaauugacggaccagacacacccgagugucccgaugaacagagagcauggaacaucugggaaguagaagauuaugguuucggaauauuuacgacgaacauuuggcugaaauuaagagauuccuacacccagaugugcgaccaucggcuuaugagugccgcaauuaaagauagcaaagcuguccacgccgacauggguuauuggauugaaagcgagaagaaugaaaccuggaaauuagcacgugcauccuucauagaaguaaaaacauguauuuggccaaaaagccacacuuuauggucaaauggcguuuuggaaucugagaugauaauuccaaaaauguauggagggccaauaagucagcacaauuauagaccuggauacuuuacucaaacugcaggaccauggcaucuggggaagcuagaauuggauuuugaccuaugcgaggggacaacaguaguaguugacgaacacuguggcaguagggguccaagccugcgaacgaccacuguuacaggaaaaauaauucacgaaugguguugccgaucaugcacauugccaccacuccgcuuucgcggcgaagaugguugcugguacggcauggaaauacggcccguaaaagaaaaagaggaaaaccugguucgcucgauggucucagcggguucuggagaaguagauaguuuuagccuaggaauuuuaugcguauccauuaugauagaagaggucaugagaagcagauggagucgaaaaauguuaaugacggguacgcucgccgucuuccuucuucuaauaaugggacaacuuacguggaaugacuuaauucggcuaugcauuaugguaggggcaaaugccagugauaaaaugggcaugggcaccacauaccuggcacuaauggccacauucaagaugaggccuauguuugcaguaggucuauuauuccgaagacucacaagcagagaaguauuacucuugacuauaggucuuucccucguugcuaguguggaacuaccuaacucgcuugaagaacuaggagauggauuagcaauggggauuaugauguuaaaacugcuaacggaauuucagccucaucaacuauggacaacgcuucucaguuuaacauucauuaaaacaacauugucauuagauuacgccuggaagacaacugccaugguucuaagcaucguaagucuguuuccauuaugcuugucaacaacaucacagaaaacaacuuggcucccgguacuuuuaggcagcuucggcuguaaacccuugacuauguuucugaucacagaaaaugaaauuuggggacgaaaaagcuggccacuuaacgaggggauaauggcgauagggauaguuaguauauuguuaucuucguuacuuaaaaaugauguacccuuagccgggccccugauagccggcggaaugcuaaucgccugcuauguuauaucaggcucaucugcagaucuuagcuuggagaaagcagcggaaguaucaugggaagaggaagcagaacauucagguacaagucacaauauauuagucgaaguucaagaugauggaacaaugaaaauaaaggaugaagaacgggaugacacuuugacaauucuacuuaaagcaacauuacuggcgguaucuggcguauauccaaugucuauucccgccacacucuuuguaugguauuuuuggcagaagaagaaacaacgaucuggaguucuaugggacacgccgucuccuccugaaguggaacgagcuguuuuggacgauggaauuuaucguauccuucaaaggggauuauuagguagaagccaaguaggaguuggcgucuuucaagacggcgucuuucacacaauguggcacguuacuagaggugcaguuuuaauguaucaaggaaaaagacuugaaccgucaugggccucugucaagaaagauuuaauauccuaugggggagguuggcgcuuccaaggaagcuggaauacaggcgaagaagugcaaguaauagcaguagaaccaggaaagaaucccaaaaauguacagacuacgccuggcacuuucaaaacaccagaaggggaaguuggagcgauugcucuggauuuuaagccaggcacauccggauccccuauaguuaaucgagaagguaagauaguaggauuauacgguaauggaguaguaacaacuucaggcaccuaugucucagcaauagcucaagcaaaggccagucaagaagggccucuuccagaaauagaagacgaaguuuucaaaaagagaaaucucacaauaauggaccuacacccggguuccgggaaaacaagacgauaccuaccugcuaucguaagagaggcaauuaagcgaaaauuaaggacccuaauccuugccccuaccagaguugucgccagugaaauggccgaagcgcucaaagguaugcccauuagguaccaaacaacagccgucaaaucagagcauacuggccgagagauaguugacuuaaugugucacgcaacauucacgaugaggcugcuaucuccaguaagggugccaaacuacaacaugauaaucauggaugaagcgcauuucacugauccugcaagcaucgcagcgagaggguauauaucgacacgcguugguaugggggaagcggcagccaucuuuaugacugcaacgcccccugguucaguagaggcuuucccgcaaucuaacgcuguaauacaagaugaagaacgugauauaccggaacgaucguggaacagcggauaugauuggauaaccgauuucccaggaaaaaccguuugguuuguuccgucaauuaaaucaggaaaugauauagcgaacugccuaaggaaaaacgggaagagaguuauacaacuuagccgaaaaacguucgacacagaauaccaaaagaccaaaaacaaugauugggauuaugucguaacuaccgauauuagugaaaugggagcuaacuuuagagccgacagagugauagauccacggagaugucuuaaaccugucauccuaaaagacggcccagaacgaguuauucuugccggaccaaugccagucacgguugcauccgcagcacagagacgugggagaauuggacgcaaccaaaacaaagaaggugaucaauauguauauaugggucagccucuuaacaacgaugaagaucacgcucauuggacagaagccaagaugcuacuagacaacauuaauacaccugaaggaauaaucccggcacuguuugagccggaaagagaaaaaucagcagcuaucgauggcgaguacagacugaggggugaagcaaggaagacauuuguggaacuaaugcguaggggcgacuuaccggucuggcuaucuuacaaggucgccuccgagggauuccaauacucagacagacgcuggugcuucgauggugaacguaacaaucaggugcuugaggaaaauauggacguagaaauauggacuaaagaaggagaaaggaagaaauuaagaccccgaugguuggaugcccguaccuauucggauccuuuggccuuacgggaauuuaaagaauuugcggcaggcaggagaucaguaucaggugacuuaauccuggaaauuggcaaacucccucagcauuuaacguugcgagcgcaaaaugccuuggauaaucugguaauguugcauaauagugaacagggcgggaaagcauacagacacgcgauggaggaacuacccgauacaauagagacccuaauguuauuagcucuaauagcuguacugacagguggagugacacuauucuuucugucaggaaaaggccuagggaagacaucuaucggacuacuuugcgugacagcgagcagugcacuucuuuggauggccagugucgagccucauuggauagcagcaucuauaauucuagaauuuuuccucaugguauuacuuauaccagaaccugauagacaaagaacaccgcaggacaaucaauuagccuacguaguuauaggccugcuguucaugauacuuacggucgcggcgaacgaaaugggauuauuagagacuaccaagaaagacuuaggaauagggcauguggcagcagaaaaucaucaacaugcaacgaucuuggaugucgaccuucaccccgcaagugccuggacacuuuacgcaguagcuaccaccguaaucacaccuaugaugagacacacaaucgaaaauacuaccgcgaacaucagcuuaaccgccauagcgaaccaagcagccauuuuaaugggacuagauaagggguggccuaucucaaaaauggaccuuggugucccucuacuagcgcuuggcuguuauagucaagucaaccccuuaaccuuaacugcggcaguuuuaauguuggucgcccacuaugcaauuauagguccuggguuacaagcaaaagcuacccgugaagcucaaaagcgaaccgcagcuggaauaaugaaaaauccaacuguagacggcauugucgcgauagaucuggauccaguugucuaugaugcaaaauuugaaaaacaacuggggcagauaaugcucuuaauucuauguacaucucagauauuacuuaugaggacuacaugggcacuuugcgagucuauuacacuggcuacaggccccuuaacaacacuuugggaaggcagcccugggaaauucuggaacacuacaauagcgguaucaauggccaacauauuuagaggcucguacuuagccggugcuggacuugccuuuagucuaaugaagaguuuagguggaggcaggagagggacaggagcacaaggagagacucucggcgaaaaauggaaaagacaguuaaaccaauuaaguaaaagcgaauuuaacacuuacaaacguucugguauaauggaaguagaucgcuccgaagcaaaagaaggguuaaaaagaggggaaacuaccaaacacgcgguaucccgaggaaccgcuaaacuuagaugguuuguagagagaaauuuaguaaaaccugaaggaaagguuauagaccuagguuguggucgcggaggauggagcuacuauugcgcagggcuuaagaaagucacagaaguaaagggcuauacaaaaggugguccuggacaugaggaaccgauucccauggcaaccuauggcuggaaucugguaaaacuucauagugguaaagauguauucuuuaugccacccgagaaaugcgacacacuacuuugugauauuggugaaaguucaccaaacccaacuauagaagaagggagaacacucagaguauuaaaaaugguggaaccauggcuuaggggaaaucaauuuuguauaaaaauacuuaaucccuauaugccaucaguaguagaaacccuagaacaaaugcaaagaaaacacggggguaugcucguucgaaauccauuaagucguaauagcacucaugagauguacugggucucauguggaaccggcaacauugugagcgcuguuaacaugacaucgcguauguugcuuaaccguuuuacaauggcgcaccggaaaccuacauaugaaagagacguugaucuuggggcagggacuagacauguugcagucgaaccugagguagcuaacuuagauauaauuggacagcgaaucgagaacaucaaaaacgagcauaaaucuacauggcauuaugaugaagauaauccauauaaaacgugggcauaucacggaucuuacgaaguuaagcccaguggaucagcaucauccauggucaauggaguaguaagguuacuaacgaaaccaugggauguaaucccaaugguaacacaaaucgcaaugaccgacacuacacccuucggucaacaaagagucuuuaaagaaaaaguggacacaagaacaccccgggcgaaacgaggcacagcucaaauaauggaaguaacugccaaauggcuuuggggauuuuuaucaagaaacaagaagccucguauauguacacgagaagaauuuaccagaaaaguaagaaguaaugcugcuauuggagcuguuuuuguugaugagaaucaauggaacagugcaaaagaggcaguugaggaugaacguuucugggaccuaguacaccgcgaacgagaacuccauaaacaagguaaaugugccaccuguguguauaauaugaugggaaaacgugagaagaaauugggugaauuuggaaaagccaagggauccagggcuauuugguacaugugguuaggggccagauuucuggaguucgaagcgcuaggauuuaugaaugaagaccacugguuuucaagagaaaauucgcugagcggagucgaaggugaagggcuacauaaguuagguuauaucuuaagggauauauccaaaauaccaggagggaauauguaugcugaugacacugcgggaugggacacacgaauuacugaagaugaccuacagaacgaagcaaaaauuacagauaucauggaaccagaacaugcacuucuggcuaccucuauauuuaaauuaacguaucagaauaagguagucagaguucaaaggcccgcgaaaaacgggacugucauggauguaauuagucggagggaucaacguggaucaggacaaguagguacauauggauuaaauacguuuacgaauauggaaguucaacucaucagacaaauggaaagugaggguaucuucuuuccgagugaacuggaaaguccaaaccucgccgaaagaguauuggauuggcuagaaaaacauggagccgaaagacuuaaacgaauggcaauuucuggggaugauugcguugucaagccaauugacgaucgauucgccacagcacuuauugcuuuaaacgauaugggaaaaguaagaaaagauauuccucaaugggagccaaguaagggauggaaugacuggcaacaaguaccauucuguucacaccauuuccaccaauuaauuaugaaggauggccgagaaaucguaguccccugccgaaaucaagacgaauuaguaggccgggcacgagugucacaaggagcuggguggagccuaagagaaacagcauguuuaggaaaaucuuaugcacaaauguggcaacuuauguauuuucauaggagagaccuuagacuggcggcgaaugccauauguucugcugucccaguggacuggguaccuacaagcagaacaaccuggagcauucaugcgcaccaccaauggaugacuacagaagauauguugucuguguggaacagagucuggauagaagaaaauccauggauggaagacaaaacucaugucagcuccugggaagaaguuccguaccuaggaaagagagaagaucaauggugugguagucuuauagguuuaacagcccgcgccacuugggcuacaaacauacaagucgcuaucaaucaaguuaggcgguuaauugggaaugaaaauuauuuggacuacaugacaaguaugaagagguuuaagaaugaaagugaucccgaaggagcauugugguga

SEQ ID NO: 22160 - RNA, 9879 nt, Artificial Sequence
  derived and/or modified CDS sequence (opt6) from DENV-1__AF311958__SS-prME
aguguuacuaugcucuuaaugcuacuacccacggcgcuugcauuucaucuaacuacacgagguggugaaccccauaugauaguaaguaaacaagaacgagguaaaucauuguuauuuaaaaccagcgcuggcguaaauauguguacguuaauagcuauggauuugggugaauuaugcgaggacacgaugacguacaaaugcccgcgaauuacggaagcagaaccagaugauguugauugcugguguaaugcuacggauacuuggguaacuuacggaacuuguucccaaacgggagaacauagaagagauaaaagaaguguagccuuagcaccacauguuggucuaggucuugaaacaaggacugaaacauggaugucuucagaaggagcuuggaaacaaauucaaaaaguagaaacuugggcauugcgccacccuggcuuuaccguuauagcucucuuucuagcacaugccauaggaacaaguauuacucaaaaagggauaaucuuuauccuacuaauguuaguaacgccgagcauggcaaugcgguguguaggaauugguaauagagauuuugucgaaggucugucaggcgcaaccuggguggauguaguacuagaacacggaaguugcguuacuacaauggccaaaaauaaaccgacccuugacauagaguuguuaaaaaccgaaguuacuaacccggcuguauuaaggaaauuaugcauagaagcuaaaauaucaaauacgacgaccgacucaagauguccgacccaaggcgaagcaaccuuaguagaagaacaagaugcuaauuucguaugccgucgcacauuuguagaucgagggugggguaacgguugcggauuauuuggaaaagguucauuacucacaugugccaaauuuaaguguguaacgaagcuagaaggaaaaauagugcaguacgaaaauuuaaaauauucggugauuguaacaguucauacgggagaucaacaucaaguaggaaacgagacgacugaacaugggacaauagcuacgauuacaccucaagccccaacuagcgaaauccaauuaacugacuacggcacgcuaacauuagauugcucacccagaacuggcuuagacuuuaacgagaugguacucuuaaccaugaaggagaaauccugguugguccauaagcaaugguuuuuagauuuaccuuuaccauggacuucuggagcaucaacgucgcaagaaaccuggaauagacaggaucuucuaguaacguucaaaacagcccacgcaaagaaacaagaaguugucguacuagggucucaggaaggagcgaugcauacagcauuaacaggcgcaaccgagauucagacaaguggaacuacaacgauuuucgccggacaccuaaaaugcagauuaaagauggacaaacucacauugaaagguacaucguauguuaugugcaccggcucauucaaacuugaaaaggaaguugcugaaacacagcacggaaccguucucguucaagugaaauacgaaggcacagaugcgccguguaaaauaccauuuuccacccaggacgaaaaaggaguuacacaaaauggacguuuaauaaccgccaacccaauuguaacugacaaagaaaaaccaguuaauauugagaccgaaccgccauucggagaaucauauauugucguaggggccggagaaaaggcgcugaaacuaagcugguuuaagaaaggaagcucaauuggaaaaauguucgaggcgacagcaaggggcgcucgacgaauggcuauauuaggcgauacagccugggacuucggcuccauaggagggguauucacaagcguaggcaagcuaguacaucagguguucgguaccgcguaugggguacucuucagcggaguuuccuggaccaugaaaauaggaaucggcauuuuauuaacauggcuuggcuugaacagccguucaacaagccucaguaugacuugcauugcagugggcauggugacacuauacuuagguguaauggugcaagcagauaguggaugcguuaucaacuggaagggacgugaacuaaaaugcgguagcgguauauucguaacaaacgaagugcacacauggacugaacaauauaaauuccaggcagacaguccaaaaagacuuucagcggcaauagggagagcgugggaagagggaguuugcggaauccguucagcgacaagacuagagaacauaauguggaagcaaauaaguaaugagcucaaucauauauugcuagaaaacgacauaaaauuuacaguuguaguuggcaacgcaaacgggauacuggcacaggguaagaaaaugauacgcccucaacccauggagcauaaauacaguuggaaaucauggggaaaagcuaaaauaauaggagcugauauccaaaauacaaccuucauaaucgacggacccgauaccccagagugccccgaugaacaacgcgcuuggaauauaugggaaguggaggauuauggcuucgggauauuuacgaccaacauaugguuaaagcugagggacucguacacgcaaaugugugaucaucggcucaugucugcugccauaaaggauuccaaagcaguacaugccgauaugggauacuggauugaaagugagaaaaacgagaccuggaagcuggcccgugcgucuuucauagaaguaaagacuugcaucuggccaaaaagccacacauuauggagcaauggcgugcuagaaagcgaaaugaucauuccaaagauguaugguggaccaauuagccaacauaauuaucggccuggguacuuuacucaaacugcuggcccuuggcaccuuggaaaacuugaacuagauuuugauuugugcgaaggcacaaccguuguagucgacgaacauugugguagucgaggacccuccuuaagaacuacuaccgugacggguaagaucauacacgaguggugcugucggucaugcacacugcccccacuaagguuccgcggagaagacggcuguugguauggaauggagauaaggcccguaaaagaaaaagaagaaaaccuggugcgcucaaugguuucggcaggauccggugagguggauucguuuucacuagggauccuaugugucagcauaaugauugaggaaguuaugaggucuagguggucgagaaaaauguuaaugacuggaacauuggccguauuccuacucuuaauaaugggacaacugacuuggaaugaccucauacgucuauguauuauggucggagcgaacgcuagugacaaaauggguauggguacaacauaccuggccuuaauggccacuuucaagaugcgucccauguuugcagucggcuuacuguuuagaagacuaacuucucgagagguuuuauuacucacaauaggccuuagcuuaguugcaaguguggaacugcccaacucgcuagaagaacuuggagauggauuagcaauggguauuaugauguuaaaguuauuaaccgaauuucaaccacaccaacucuggacaacccucuuaagccuaacuuuuauuaaaacaacauugagucuugauuaugcauggaagacuaccgcaaugguacucaguauagugagucuauuuccguugugucuuaguacaacuucacagaagacaacaugguuacccguacuacuaggaucauucggaugcaaaccuuuaacaauguuccuaauuacagaguacgaaauauggggucguaaaagcuggccacuuaacgaagggauaauggcaaucggaauagucaguauuuuacuaagcucacuucuuaaaaacgacguuccgcuagccgguccacuaaucgcuggcgguaugcuuauagcaugcuaugucaucagcggcucgucggcugauuuaagccuagagaaagcagcagaaguaagcugggaagaagaagcagagcacuccgguacaagucacaacauacucguagaaguccaagaugauggaacaaugaagauaaaggaugaagaacgcgacgauacucucaccauacuauuaaaagccaccuuauuagcuguaucaggaguauauccuaugucaaucccagcaacuuuguucguaugguauuuuuggcaaaagaagaaacaaagaaguggaguauugugggauacccccagcccuccugagguggaaagagcaguacuagacgauggaauuuacaggauacuucagagaggccuccuagguagaucacaaguggggguagguguauuucaggauggagucuuccacaccauguggcacguaacaagaggcgccguguugauguaucaagguaaacgucuugaaccaucgugggcgagugucaagaaagaucuaauaucuuaugggggaggcuggagauuucagggguccuggaauacaggggaggaaguacaagugauugccguggaaccugggaaaaaucccaaaaauguccaaacaacccccggaacguuuaaaacgccugagggcgaaguuggagccauagcuuuagauuucaagccaggaacauccgggaguccaauuguuaaucgugaagguaagauuguagggcuuuauggaaauggcguggucacuacuucagguacuuacgugucugcaauugcccaagcaaaggcaagucaagaggaaccauuaccugaaaucgaggacgaaguuuuuaagaaaagaaaccuuaccauaauggaucuccacccaggaagcggaaaaacucgucgguaccuccccgcuauuguucgugaggcuauuaaaaggaaauuacggacuuuaaucuuagcaccaacucgagucgucgcaucagaaauggcugaagcucucaagggcaugcccauuagauaucaaacuaccgcagugaaaagcgagcauacugggcgagagauuguugauuuaaugugucaugcaacauucacgaugcguuuguuaucaccagucaggguucccaacuauaauaugauuauaauggacgaagcacauuucacugacccagcaucuauagcugcaagaggauacaucaguacacgcguuggaaugggggaagccgcggcaauauucaugacugcuaccccgccugguucuguugaagccuucccccaguccaaugcuguuauacaagaugaagaacgagauauuccugaaaggucuuggaacucaggauacgacuggauaacugacuucccgggcaaaacgguuugguucguacccucaaucaaguccgggaaugauauagcgaauugcuuacggaaaaacggcaaaagagucauacaauuaagucggaaaacguuugacacagaauaccagaaaacuaagaacaacgacugggauuaugucgugacaaccgacaucagcgaaaugggagcaaauuuuagagcugauagagucauagacccccgacguugccuaaaacccguuauccugaaagacggacccgaaagagugauccuagccggccccaugccuguaacuguagcaagugcggcgcaacgaagaggacgaauuggaaggaaccagaauaaagagggagaucaauacguguacaugggacagccguuaaauaaugacgaagaucaugcucauuggacggaagcaaaaaugcuguuagauaauauuaauacacccgaaggaauaauaccugcguuauucgagccagaaagggagaagucugcagcuauagauggugaauaucgauugcguggagaagcgcgaaaaacauuuguagaauuaaugcguagaggcgaucuuccgguauggcuaagcuacaaaguugcauccgaaggauuccaauauucggacaggaggugguguuuugauggggaaagaaacaaucaaguccuugaggagaacauggauguagaaaucuggacaaaagaaggagaaaggaagaagcuacgcccuagauggcuugaugcaagaaccuacagugauccauuagcacuaagggaauuuaaagaauuugccgcgggccgcagaagugucuccggagacuuaauacuugaaaucggcaaauugccacagcaucugacauugagggcucagaaugcucuugacaauuuaguuauguugcauaacucagaacaaggagguaaggcuuaccgacacgccauggaagaacucccggauaccaucgagacuuuaauguuauuggcauuaauagcggugcuaacaggcgguguaacuuuauucuuuuugucugggaagggccuggggaagacaucaauagguuuacucugugucacggcaucauccgcacuauuauggauggcuagugucgaaccucacuggaucgcugcgucuauaauauuggaguucuuucuaauggucuuauuaauuccagaaccagacagacagagaaccccucaagauaaccaacuagcuuaugucgucaucggacuacuauuuaugauucuaacggucgcagcaaaugaaaugggcuuacuagaaacgacaaagaaagaucuugguauagggcacguugcagccgaaaaucaucaacacgccacaaugcuugacguugaccugcacccagcgagcgccuggacuuuauaugcaguggcuaccaccguaauuacacccaugaugaggcacacgauugaaaauacuacagcaaacauuagucugacugcaauagccaaucaggcagcaauucucauggguuuagacaaggguuggccuauauccaagauggaucuagguguucccuuauuagcacuagguugcuauagucaaguaaauccacuuacacuaacagcagcugugcuuaugcuaguagcgcacuaugcaauaauaggccccggauuacaagcuaaagcaacaagagaagcgcagaaaagaacggccgcuggaauaaugaaaaacccaacaguugauggcauaguugcaauugaucucgauccaguaguauacgaugcuaaauuugaaaaacaauuaggacaaauuauguuacuaauauuauguacaagucaaauacugcugaugcguaccacuugggcauuaugcgaaucuauuacccuagcuacaggcccacucacaacucuaugggaaggaucacccggaaaguucuggaauacuacaauugccguauccauggcaaauauuuucagaggaucauaucuagcaggcgcuggauuagcuuucaguuuaaugaagucacuagggggaggaagacgcgguacaggcgcucaaggagaaacauuaggugaaaaauggaagcgacaguuaaaccagcugucuaaauccgaauuuaauaccuauaagagaucugguaucauggaaguagaccguucggaagcgaaagaaggccuuaaacgcggagaaacuacuaaacaugcgguaucacgaggcgcggcuaaauugagaugguucguggaacggaaucuugugaagccagaggguaaaguuaucgaccuagguuguggcaggggagguuggucauauuauugcgccggacucaagaaaguaacugaaguaaagggguauacaaaagggggaccaggccaugaagaaccaauaccaauggcaacuuacggguggaaccuugugaaguugcacucagguaaagauguauucuuuaugccaccagaaaaaugcgauacuuugcuuugcgacaucggagaaucaagucccaacccuacuauagaagagggaagaacguuacgaguguuaaagaugguugaaccuugguuaagaggaaaucaauuuuguauuaaaauauuaaaucccuauaugccaagcguaguagaaacucuggaacagaugcagcgcaaacacggagguauguuaguccggaauccgcuaucgcggaauaguacacaugaaauguauugggucagcuguggaacuggaaacauaguuucggcuguuaauaugacaucaagaauguugcuaaaccgguucacuauggcccauagaaagccaacguaugaacgcgaugucgauuugggugcagguacaagacauguggccgucgaaccagagguugcaaacuuagacauaauaggacaaagaauugaaaauaucaaaaaugaacauaaaucaaccuggcacuaugaugaagauaauccuuacaaaacuugggcauaccauggaucuuaugaaguaaaaccuucugguucagcaaguucaaugguaaauggagucguaagauuauuaaccaaaccaugggacgugauucccauggucacacaaauugcaaugacugauacuacacccuuuggacaacaaagaguauucaaggaaaaaguagacaccagaacgccaagggccaaaagggguacagcacaaaucauggagguuacagcaaaaugguuauggggcuuuuuaucacguaacaagaagccgagaauuuguacaagagaagaauuuacgaggaaaguuagaagcaacgcagccauuggggcaguauuuguagaugaaaaucaauggaacucagccaaagaggcaguagaagacgaaagauuuugggaucuaguacauagagaaagagaguugcacaaacaaggaaagugcgccacaugugucuauaauaugaugggaaagagagagaagaaacuaggagaauuuggcaaagccaagggaucuagagcaauuugguacauguggcuaggggcacguuuucuagaguucgaggcuuuagguuucaugaaugaagaucacugguucucacgggaaaauucccugucugguguagaaggggaaggauuacauaaacuagguuauauacuaagggacaucaguaaaauacccggcggcaacauguacgcagaugauaccgcggguugggauacuaggaucacugaagaugaucuacagaaugaggccaaaauaacggacauaauggaaccagaacaugcucuccuggcuacguccauauuuaagcuaacuuaccaaaacaagguaguucgaguucaacgcccagcgaagaacggaacagucauggauguaaucucaagaagagaccaacgugggucuggucagguagguacauauggccucaacaccuuuacaaacauggaggugcaauuaauacgucaaauggaaucugaaggaauauucuuuccuucagaauuagaaucgccaaaccucgcugagcgaguacuggauugguuagagaaacacggagcugaacgauuaaaaagaauggcuauuucaggugaugauugugucgugaagccuaucgaugauagguuugcaacagcacuuaucgcccuaaaugauauggguaaggucagaaaagauauuccccaaugggaaccauccaaaggguggaaugauuggcaacaaguucccuuuugcucucaccauuuccaccaguugauuaugaaagauggucgggaaauagugguacccugucguaaccaagacgaauuagugggaagggcgagagugagucaaggagccggauggucccuaagagaaaccgcgugucucgguaaaaguuacgcccaaauguggcaacuuauguauuuccacagacgggauuuaagacuagcagcaaacgcuaucuguagugccgugccuguagauuggguucccacgucgcgaacaacuuggucuauacaugcgcaucaucaguggaugaccacugaagacaugcuaucgguauggaauaggguuuggauugaagaaaaucccuggauggaagauaaaacucacguaucuuccugggaagaaguuccauaucuaggaaaacgcgaagaucaguggugcggaucacuaaucgggcuaacagcuagagccaccugggcaaccaacauccaagucgcgauaaaccaggucagaagacuaauaggaaacgaaaauuacuuagauuacaugacaaguaugaaaagauuuaaaaacgaauccgacccagagggggcacuaugguaa

SEQ ID NO: 22161 - RNA, 9879 nt, Artificial Sequence
  derived and/or modified CDS sequence (opt6) from DENV-1__AF311957__SS-prME
uccgucacgauguuacuaaugcuacuucccacugcauuagcuuuccaccugacgacacgaggaggugaaccgcauaugauagugucuaaacaagaacgcggcaaaagucuacuauucaaaaccucugccggugugaacaugugcacguuaauagcaauggacuuaggcgaauuaugugaagauacaaugacauauaaauguccacgaaucacugaagcagaacccgaugauguagauugcugguguaacgcgacagauaccugggugaccuacgggacauguagccaaacaggagaacaucgacgggacaaacgaucaguggcacuugcgccccacguagggcuagggcuagaaacaagaacggaaacauggaugucaucagagggagcauggaaacaaauucaaaaaguugaaacaugggcacuccgacauccaggguuuacugugauagccuuauuccuagcgcaugcgaucggaacuucaaucacgcaaaaagggauaauauuuauucuccuaaugcuuguuacuccaaguauggcaaugagaugcguaggaauagguaacagagacuucgucgaaggacuuucuggagccacauggguagaugucguguuagaacauggcucgugcgugacaacaauggccaaaaauaagccaacccucgacauugaacuuuuaaaaacagaaguaaccaauccugcaguuuuaaggaaacuuugcaucgaagccaaaaucagcaauacaacgacagacucacgguguccaacacaaggugaagcaacucuugucgaagaacaagaugcuaauuuuguauguagaagaacguuuguagauaggggaugggggaacggcugcggacuauucgguaaggggagucugcuaacgugugcuaaguuuaaaugugucacgaaacuagaaggcaagauaguacaauaugaaaaucucaaauauagcguaauuguuaccguccauacaggagaccaacaucaaguuggaaaugaaaccacggaacacgguacaauagccacuauaacaccgcaagcaccgacaagugaaauacaacuaacggauuauggagcauugacuuuggacugcucuccucgaacggguuuagacuucaacgaaaugguacuacuaacgaugaaagaaaaaucuugguuggugcacaaacaaugguuucuagaccuacccuuaccguggacaagcggugcaucaacuagccaagaaacuuggaauagacaagaccuauuagucacauuuaaaacagcucaugcaaagaagcaggaaguaguaguauugggcucucaagaaggcgccaugcacaccgcucuaacgggggcaacugaaauacaaacuagcgguaccacaacaauauucgcagggcaucugaagugucgguuaaaaauggacaaacuuacgcuuaaggguaccucauauguaauguguacaggcagcuuuaaauuggaaaaagaaguugcagaaacucaacauggaacuguccugguacagguaaaauaugaggguacagacgcuccguguaaaauaccauuuuccacacaggacgagaaaggaguaacacaaaaugguagguuaauaacugccaacccgauaguuaccgacaaagaaaaaccagucaacaucgagacggaaccaccuuuuggagagagcuacauaguugugggagcgggugagaaagcgcugaagcuaucgugguucaaaaaggggucgagcauugguaagauguucgaagcgacagcucgaggcgccaggaggauggcaauacuuggcgacaccgcuugggacuuugguucaaucggagguguguucacaagcguuggaaaacuuguccaccaaguuuuuggaaccgccuauggaguacuguucucuggugucucuuggacaaugaaaauagggauugguauucugcuaacauggcuaggauuaaacagcaggagcacaucccuuucaaugacguguauugcaguuggaaugguuacacuguauuugggagugauggugcaagcagacagcgguugcguaauaaacuggaagggccgagaauuaaaaugcgguaguggaauuuuuguaacgaaugaaguacacacuuggacagagcaauauaaauuucaagcugauaguccaaaacgucugucagcugcaauaggaagggcgugggaggaggguguuuguggcauacgaucagcaacaagauuggaaaauauaauguggaagcaaauaaguaaugaauugaaccacauccuccuggaaaaugauauaaaauuuacaguugucguugguaacgcaaauggcaucuuagcacaagguaaaaagaugauaagaccucaaccgauggagcauaaauacaguuggaaaaguuggggcaaagcaaaaauuauaggagcugacauccagaacacgacauucaucaucgacggaccugacacacccgaaugucccgacgaacaacgugcguggaauauaugggaaguugaagacuauggauucgggauauuuacuacgaauauaugguuaaaguuacgggauucauauacucaaaugugcgaccacagacuaaugagcgcagcgauaaaagacucuaaagcuguacacgcugacaugggauauuggaucgaaagcgagaaaaacgaaacuuggaaacuagcuagggccucuuucauagaaguaaaaacauguauauggccaaagucucacacauuguggucuaauggugugcuagaaagugaaaugaucauaccaaaaauguacggagguccgauuagccaacauaauuauagaccaggauacuucacccaaacagcgggaccauggcaccuggggaaauuagaacucgauuuugaucucugugaagguacaacuguugucguugacgagcauuguggcuccaggggaccgaguuuacgaacaaccacgguaacgggaaaaaucauucaugaaugguguuguaggaguuguacucuaccaccgcuaagguuuagaggagaggaugguugcugguacgggauggaaauuagaccagugaaagaaaaagaggaaaaccucguuagaucuauggugucagccgggaguggagaaguagauucuuuuucgcuaggaauacuguguguuaguaucaugauagaagaaguaaugagaucaagauggucacggaagaugcucaugacuggaacacuagcgguguuuuugcuacuaauuaugggacaacucacauggaaugaccuaauuagauuauguauaauggugggcgcaaacgcaagugauaagauggguauggguacaacuuaccuagcguugauggcaacauucaaaaugagacccauguucgcuguuggccuuuuguuuagaaggcuaacaagccgcgaaguuuuguuacugacaauuggucuaucuuuaguagcaucaguagaauuaccaaauucuuuagaagaguuaggagacgguuuggccaugggaauuaugaugcuaaaacuacuuacugaauuucaaccccaucagcuuuggacgacguugcuaucuuugacuuuuauuaaaacgacuuuaagucuagauuacgcauggaaaacuacugccacaguauugagcauaguuagucuauuccccuuaugucucaguaccacaucacagaaaaccacauggcucccuguacuucuaggcaguuuuggaugcaaaccucuaaccauguuucucauuacagaaaaugaaauauggggacggaaaucauggccucugaaugaggguauuauggcuaucgggauuguaucaauauuguuaaguagccuacucaaaaacgaugucccauuagcugguccuuugauagcaggaggaauguuaauagcaugcuacguuauaucaggcucuagugcugauuugagccuagaaaaagccgccgaggugucaugggaagaggaggcugaacauuccggaacgucucauaauauucuggucgaaguacaagaugauggaacaaugaaaauaaaggacgaggaacgcgaugacaccuuaacaauucuuuugaaggcaacgcuacucgcaguaaguggaguguauccuaugagcauaccggcaacacuauucgucugguacuuuuggcagaagaagaaacaaagaagcgggguucuaugggacacaccaagcccaccugagguggaacgagcgguacuagaugacggcauuuauaggauucuacagcggggacuacuugguagaucccaagugggugucgggguguuucaagacgggguauuucacacgauguggcacguuacgagaggagccguauuaauguaccaaggaaaaagauuggaaccaagcugggcaagcguuaagaaagaucuaauuucuuaugguggaggguggagguuccaaggcaguuggaacacaggugaagagguacaaguaauugcaguugagccagguaaaaauccuaaaaacguacaaaccacaccagguacauuuaaaacaccagaaggagaaguuggcgcgauugcgcuugauuuuaaaccuggaacuucagggucaccaauaguaaauagggaaggaaaaauaguaggucuuuauggaaauggaguaguuaccacgucaggaacauacguuuccgcuauugcacaagcgaaagcgucacaagaaggcccguuaccugaaauugaagacgaaguguucaagaaaagaaacuugacaauaauggaucuacauccagguaguggcaaaacucgaagauauuuaccugcuauuguaagagaagcuauaaaaagaaagcuccguacauuaauuuuagcuccaacacguguuguagcauccgaaauggcugaggcacuaaaaggaaugccgauacgauaucaaacuacagcgguaaaaagugagcauacaggcagagaaauaguagaccuuaugugucaugcgaccuucacaaugcgacuuuugagcccaguacgggugccaaacuacaacaugauaaucauggaugaagcacauuuuacagacccggcauccaucgcugcaagaggcuacaucagcacaagaguggguaugggagaggcugcagcaauauuuaugaccgcaacaccgccggguucaguagaggcuuucccgcaauccaacgcuguaauacaagaugaggaaagagauauaccagaaaggagcuggaacucggguuaugauuggauuacagauuuuccgggaaaaaccguuugguucgugccaaguaucaagucuggaaacgauauagcuaauuguuuacggaaaaacggcaaaagaguuauacaacucucacgaaagacauucgauacugaguaucagaaaacuaaaaacaaugacugggauuaugugguaacaaccgauauaagugagaugggugcaaauuuuagggcggauagaguuauagauccacgacggugucucaaaccaguaauacuuaaagauggcccagaaagaguuauacucgcaggcccaaugccaguuacaguagcgucggcagcacaacgacgcggcagaauugguagaaaucaaaauaaagaaggagaucaauacguguacaugggccaaccgcuaaauaaugacgaagaccacgcacacuggacagaagcaaagaugcuauuagauaacauaaauaccccagaaggaaucauaccagcgcuauuugaaccagaaagagaaaaaucagcugcaauagacggugaauauagacuccgcggggaagcgcguaagacuuuugucgaauuaaugcgucgaggagauuuaccaguguggcuuaguuauaaaguagccagcgaagguuuucaauauucugaucgacgguggugcuucgauggagagcgaaacaaucagguccuagaggagaacauggauguugagauauggaccaaagaaggugaacgaaagaaauugagaccacgaugguuggaugcuaggaccuauucagacccucuagcacuacgggaguucaaagaguucgcagcugggcgaagaaguguaucuuccgaucuaauauuagaaauaggaaaauugccccaacacuugacacugcgcgcucaaaaugcgcuugacaaccuaguuaugcuacauaauucagaacaaggggguaaagccuauagacaugcgauggaggagcucccagacacaauugagacuuuaauguuacuugcacuuauagccguacucacaggagguguaacgcuuuucuucuuauccgguaaaggcuuaggaaaaacuuccauaggucuucuauguguaacugcaucaucggccuuacuauggauggcauccguagagccucauuggauagcugcgucaauaauacuagaguuuuucuuaaugguacuucuuauaccugaaccagauagacaaagaacgccacaggauaaucaauuagcguauguagugauaggauuauuauuuaugauacugacaguugcagcaaaugagaugggcuuacuggagacaacuaagaaagaccuggguauaggccauguagcagcagaaaaccaucagcaugcuacaauguuagauguggaucuacacccugcaagugcauggacauuauacgcaguugcaacuacaguaauaacuccaaugaugaggcauacuauagaaaacaccacagcuaauauaucacuaacagcaauagcaaaucaggcagcaauauuaauggggcuagauaagggauggccuauaucaaagauggacuuagguguaccguuacucgcauuggggugcuacucucaaguaaauccguugacccuuacagcggcaguauuaaugcucguugcgcauuacgcuauuauuggaccuggucuacaggcgaaggcaacgcgggaagcgcagaaaagaacagcagcgggaauaaugaaaaauccgaccguagauggaaucguagcgauagaccuagacccaguggucuacgaugcgaaguuugaaaaacaacuaggucaaaucaugcucuuaauacucuguacaagccaaauauuacuuaugcggacaacaugggcuuuaugugaaagcaucacauuagccacaggaccacuaacaacacucugggagggaucaccgggaaaauucuggaacacgacaauagcgguaucaauggcaaauauauucagaggcuccuaucuagcaggcgcuggguuggccuuuaguuugaugaaaaguuuaggcggaggucggcgcgguaccggagcgcaaggggaaacauuaggagaaaaguggaagcgacaacuaaaccagcuuaguaaaucagaguuuaauacauacaaaagaucugguauaauggaaguagaccggucugaggcaaaagaaggccuuaaacguggagagacuacuaagcaugcugugucaagaggaacagcaaaguugaggugguucguugagagaaauuuaguaaaaccagaaggaaaaguuauagauuuagguuguggucgagguggauggaguuauuacugugcagguuuaaagaaaguaacggaggugaaaggauauacaaaaggcgguccugggcaugaagaaccgauccccauggccacauacggcuggaaucuaguaaaguuacauucaggaaaagauguauucuuuauacccccugaaaaaugugauacacuucuaugugacaucggcgagucaucaccaaauccaacaauagaagaagguagaacccuacggguacucaaaauggucgaaccauggcuccguggcaaucaguuuuguauaaaaauacucaauccguacaugccaucuguaguugagacauuggagcaaaugcagagaaaacauggagguaugcucguacguaauccucucucccggaauaguacccaugaaauguauugggugucuugugguacaggaaauauagucucagcuguuaauaugacuucaagaauguuauuaaauagauuuacaauggcucauagaaagccaacauaugaacgagauguugaucucggagcuggaacgagacauguugcaguagagccagaaguagcuaaucuagacauaauuggucagcgaauagagaacauaaagaaugaacacaaaucuacuuggcacuacgaugaagauaauccauauaaaacuugggcuuaucauggcucauaugaaguaaaaccaagcgggagcgcaucuucuaugguaaacggaguuguaagguuguugacuaaaccuugggauguaauccccaugguaacccaaauugccaugacagacacaacucccuuuggucaacaaagaguauuuaaggaaaaaguagacacacgcacgccuagggcuaagagggguacugcacaaaucauggagguuacggccaaaugguuguggggguucuugucaaggaauaaaaagccacgaauauguacuagagaggaauuuacuagaaagguuagaucgaaugcagcaauaggggcaguauuuguugaugaaaaucaguggaacagugcgaaagaagccgucgaagacgaaagauuuugggacuuaguacaucgcgaacgugagcugcacaaacaaggcaagugcgcgacaugcgucuauaacaugaugggaaaaagggagaagaaauuaggcgaauuuggaaaggcaaaagguucaagagcaauuugguauauguggcuuggagcaagauuccuugaguucgaagcacuggguuucaugaacgaagaccacugguuuucacgugagaauagucuuaguggaguagagggugaaggguuacauaaacuaggauauauccuuagagauauaagcaaaauaccaggaggcaauauguaugcggaugacacagcagguugggauacuaggauaacggaagaugaucuucaaaacgaagcaaaaauaacggauauaauggaaccugaacacgcuuuacuagcaacaaguaucuuuaaacuaacauaucaaaauaagguugucagaguacaaaggccugcaaagaauggaacagugauggacguaaucucaagaagggaccagcggggaagcggacaaguaggcacuuaugggcugaacacguucaccaauauggaaguacagcucauaaggcagauggagagugaagggauauuuuuccccucagaguuggaauccccaaauuuggcagaacgaguauuagacuggcuugaaaaacauggcgcggagagauugaagagaauggcgauuaguggcgaugauugcgugguuaaacccauugacgauagguuugcaacagcuuugauagcacuaaacgacauggggaaagucagaaaagauaucccccaaugggaaccgaguaaaggcuggaaugacuggcaacaaguaccguucugcagucaucauuuccaucagcugauuaugaaagauggaagagaaauuguuguuccauguaggaaccaagacgaacucguaggcagagcaagagugucacagggagcugguuggagccuuagagaaacugcuugucuaggaaaaucauacgcccaaauguggcaacuuauguauuuucacagacgagacuuaagguuagcagcaaaugcaauauguuccgccgugcccguggacugggugcccacaagcagaacaacuuggaguauucaugcacaucaccaguggaugacuacagaggauaugcuuuccguguggaaccgcguuuggauagaggaaaacccauggauggaagauaaaacacauguaaguuccugggaggaaguuccauaccuggguaagcgagaagaucaauggugcggaagucuuauugguuuaacagcgagagcuacuugggcuacuaacauucaagucgcaauuaaucagguuagaagacuaauuggaaacgagaauuaccuagacuauaugacaaguaugaaaagguuuaaaaaugaaagugacccggaaggggcguuaugguag

SEQ ID NO: 22162 - RNA, 9879 nt, Artificial Sequence
  derived and/or modified CDS sequence (opt6) from DENV-1__EU280167__SS-prME
uccguaacaaugcuacuuacauuaaugccgacagcgcuagcuuuccaccuaacaacacgaggaggagaaccacauaugauuguaucaaaacaagaacgaggaaaaucuuuauuguuuaaaacaagugcuggcguuaauaugugcacauugauagcaauggauuuaggagaauuaugugaggauacagucacguauaaaugcccacgaauaacagaggcugagccagacgacgucgacuguuggugcaaugcaacagauacaugggucacauacgguacauguucgcaaacuggagaacacaggcgugacauccgaucaguugcacucgcaccgcacguagguuugggacuagaaacacguacggaaacuuggaugagcuccgagggagcauggaaacaaauucaaaggguagauacuugcguacucagacauccaggauuuacuguuauagcacuguuuuuggcacaugcaauagguacuucuauuagccaaaaaggaauaaucuucauucugcucauguuaguaacaccaucgaugacuaugcgaugugugggcauagggucgagagauuuugucgagggccuuaguggggcaacaugggucgacguagugcuagagcacgggucgugugucacaaguauggcgaaagauaaaccaacauuagacauugaacuauuaaaaacggaggugccuaauccagcaguucugaggaaauuauguauagaagccaaaauauccaauacaacaacagauagccgaugcccuacgcaaggugaagcaacgcuuguagaagaacaagaugcaaacuucguuuguaggagaacuuucguagauagaggauggggaaacggaugcggccuguuuggaaaagggucccuacuaacaugcgauaaauucaaaugcgucaccaaauuggaaggaaaaauuauucaauacgaaaauuuuaaauauaguguuauuguuacagugcauaccggcgaccaacaucaaguggguaaugaaucuacagaacacggaacaaccgcaacaauaacgccacaagcuccaacuacggaaauucaacuuacagauuauggcgcacuaacgcuugauuguucaccacgaacaggccuugacuucaacgagauggugcuucugaccaugaaagaaaaaucauggcuuguucauaaacaaugguuucuagaucuaccucuaccuuggacaaguggugcgagcaccaguagggaaaccuggaacagacaagaccuauuagugacuuuuaaaacagcacaugccaagaaacaagaggucguagugcuggggucacaagaaggagccaugcauaccgcacugacaggugccacggaaauucaaacaucagguacuacuacgauauucgcugggcaccuaaaaugccgacuaaaaauggacaaacugacacuaaaagguaugagcuauguaaugugcacugggucauuuaaacuugagaaagaaguggcugaaacccaacauggaacuguacucgugcaaauuaaauacgaaggaaccgaugcacccuguaaaauuccauucaguacucaagaugaaaaaggcguuacacagaauggaagauuaauaacagcuaaccccauugucacugacaaagaaaaaccuguaaauaucgaagcggaacccccuuuuggcgagaguuacaucguaauugguguaggcgaaaaagcucucaaacuuagcugguucaagaaaggcucaucgauaggcaaaauguucgaagcaacggcacgaggugcucguagaauggcaaucuuaggagacacagcgugggacuucgggucaauuggcggcguguucaccaguguugguaaauuaguacaccaaauauuuggaacagcguacggaguacuuuucagugguguuuccuggacuaugaaaauaggaaucggaguguuauuaacauggcuaggccuuaauagucguucaacgagucuuuccaugaccugcauagcuguaggacuuguaacucuauacuuagguguuaugguucaagcagauagcggauguguuauaaacuggaaagggagaggacuaaaauguggaagugguauuuucgucaccaacgaaguacacacuuggacaggacaauacaaauuucaagcagauucuccgaaaggucuaucagcugcgauuggaaaggcuugggaagaagguguaugugguauucggucugcuacacggcuugaaaauaucauguggaaacaaauaucgaacgaacugaaucauauuuugcucgagaaugauaugaaauucacugugguagucggugauguagcugggauacuggcacagggcaagaaaaugauccgaccccaaccaauggaacauaaauacucguggaagaauuggggcaaagcaaaaauaauaggagcugauguacaaaacucaacuuuuauuauagacggcccaaacacgccagaaugcucagaugaccagcgagccuggaacaucugggaagucgaagauuaugguuucggaauauucacuacuaacauauggcucaaacuccgggauucguauacacagguaugugaccauagguuaauguccgcugcaauuaaagacucuaaagcaguacaugcggauaugggauacuggauagagagcgagaaaaaugaaacauggaaacuagccagggcaaguuucauagagguuaaaacguguaucuggcccaaaagccacacacuauggaguaacggcguguuagaguccgagaugaucauaccuaaaauuuacggagguccuaucucccaacauaacuacaggccaggguacuucacgcaaacagccgguccauggcaucuggguaaauuagaguuggauuucgacuuaugugaaggaacaacugugguuguugaugaacauugcggaaacagggguccuagucuuggcacaacgacagugacugggaagauaauccaugaguggugcugcaggucaugcacacugccuccacugcgauucaggggugaagauggauguugguauggcauggaaauaagaccuguuaaagaaaaggaagaaaaccuuguaaaaaguaugguuagcgcugggagcggugagguagauaguuuuuccuuagguuuacugugcauaaguauuaugauagaggagguaaugcguagcagauggaguagaaaaaugcucaugacagggacacuagcuguauuuuucuuguuaauaaugggacaacuaaccuggaacgaucuaauucgacuuuguauuaugguaggagcaaaugcaucugauagaaugggaaugggaacaaccuauuuggcuuuaauggcuacauuuaaaaugcguccgauguuugcuguaggauuacuauuucguagauuaacaaguagagaaguucuauuauuaacaauaggucuuucacuuguggccucuguugaacuacccaacucccuagaggaauuaggugacggcuuagcuaugggaauuaugauacuaaaauuguuaacugacuucaggucccaccaauugugggcuacccuacuuuccaugacuuuuauaaaaacagcauuuuccuuacacuacgcauggaaaaccauggcgauggugcugaguauagucucucuauucccauuaugccuguacacaacgagucagaaaacaaccugguuaccaguauugcuaggaagucuaggcugcaaaccacucacuauguuuuuaauugccgagaauaagauuuggggcagaaagucuuggccguugaaugaaggcauuauggcaguugguauaguuucaaucuuacuuucaagucuauuaaagaaugacguucccuuagcagggccacuaauugcggguggaaugcuaaucgcauguuauguuauaaguggcucaucggcugaucuaaguuuagaaaaagcugcagaagugaguugggaagaggaagcggaacauucaggugcuucgcacaauauauuaguagaaguacaagacgauggaacaaugaagauuaaagaugaagagagggacgacacgcuaacaauccugcucaaggcaacauuacuagcagucucaggaguauacccguugucgauaccugccacccuguuugugugguguuuuuggcagaagaagaaacagagaagugguguauuaugggacacuccaucuccaccaaagguggaaagagcuguuuuagaugacggaauauacaggauaaugcaaagaggcuuauuaggcagaagucaaguuggugugggcguauuucaagagaauguauuucauacaauguggcacguaacaagaggagcugugcuaauguaucaaggcaaaaggcuugagccaucaugggcuuccguuaagaaagaucuuauuucuuaugguggaggguggcgacuucaaggcaguuggaacacaggugaagagguccagguaaucgcaguagaaccagguaaaaauccuaagaauguacaaacagccccugguacuuucaagacgccagaaggagaagugggggcuauagcauuggacuuuaaaccuggaacguccggaucgccaauagugaauagagaaggaaaaauaguuggguuauauggcaacgggguaguuacgacgucuggaacuuacguuagugcuauugcacaagcuaaggccagucaggaaggaccguugcccgaaauagaagaugaaguauucagaaagagaaaucugacgauuauggaucuccauccagguaguggaaaaaccagaagauaucuuccagcgauugugagagaggcaauaaaacguaaaaugcgaacacuaauauuggcuccgacaagagucguggccagugaaauggccgaggcauuaaaagguaugccaaucagauaucaaacaacugccguaaaaucagaacauaccgggaaagagauuguugaucuaaugugucaugcuacguuuacaaugcgucuacucaguccuguaagggugccaaacuacaacaugauaauuauggaugaagcacacuuuaccgauccuucaucuauagccgcgcguggauauaucucuacucguguaggaaugggcgaagcugcagcgauuuucaugacugcaacaccgccuggaucgguggaggcauuuccccaauccaaugcaguaauacaagaugaagaaagagacaucccugaaagaucuuggaauaguggguacgaguggauuacggauuuuccaggaaaaacgguaugguucguuccuucaauuaaggcuggaaacgauauaaccaauugucuacggaaaaacgguaaaagaguuauucaauuaucuaggaaaacauuugacaccgaauaucagaaaaccaaaaauaaugacugggauuaugucgucaccaccgacauaagcgaaaugggagcuaauuucagagcagacagagugauggaccccaggagauguuugaaaccggugauucuaaaagacggaccugaaagaguuauucuugcuggaccaaugccuguaaccguggcaucagcagcgcaaaggagaggucggauagguagaaaccauaauaaggaaggugaucaauacauuuauaugggucagccacuuacuaaugaugaagaccacgcgcacuggaccgaagccaaaaugcuguuagauaacauaaauacuccagaagguauaauuccugcucuguucgagcccgagagagagaaaucagcagccauagauggagaauaccgauuaagaggagaagcacguaaaacauuuguugaauuaaugagacguggagaucucccagucuggcucagucauaagguugccucagaaggauuucaauacagugacagaagguggugcuucgauggagagagaaauaaucaaguauuagaagagaacauggaugucgaaauauggacuaaagaaggcgaaagaaagaaacuucgaccucgaugguuggaugcacggacuuauagugacccauuggcucucagggaauuuaaggaauuugcggcgggccgacgaucaguaagcggcgauuugauauuagaaauaggaaagcuaccacaacaucuuacgcaaagggcacaaaacgcucuugauaacuuagucaugcuacacaacuccgaacaaggcgggcgcgcauaccgacaugccauggaagaacuuccugauacaauugaaacacuaaugcuuuuagcacuaaucgcaguguuaacaggagguguaacccucuucuuucucaguggaaaaggacugggaaagacaagcauaggucuauuauguguuauggcgucuucagucuuauuguggauggcuucuguagaaccccauuggaucgccgcuagcaucauccuagaguucuuucucaugguucuucucaucccagaaccagaucgccagcguaccccacaggauaaucagcuagcauacguggucaucggauuguuauuuaugauauugaccguagccgcaaaugaaaugggguuacuagaaacuaccaagaaagaucucggaauaggacauguagccguugaaaaucaucaucacgcagcgaugcuagacgucgacuugcauccugcuucagcguggacauuguacgccguagcaacaacuaucauuacuccaaugaugcgucacacaauagaaaauacaacagcaaacaucuccuugacugccauagccaaucaagcugcaauacuaaugggguuggauaagggguggccaauuucaaaaauggacauagguguuccgcuacuugcucuaggaugcuacucucaggugaauccucuaacucuuaccgcagccguuuuaaugcuaguagcucacuaugcaauuaucggaccgggacuccaagcaaaagcuacacgugaagcacagaagcggacagccgcagguaucaugaaaaaucccaccauugauggaauagucgccauagauuuggauccaguagucuacgacgcaaaauuugaaaaacaguuaggccagauaaugcugcucauauuaugcacaucucaaauauuacucaugcgaaccacgugggcauugugcgaaucuauuaccuuagccacaggaccccuaacgacucuaugggaagggucaccagggaaguuuuggaacacaacaauagccgucucgauggcaaacauauucaggggaucuuaccuagcuggugcaggcuuagcauucucuuuaaugaaaucauuggguggagggaggagagguaccggggcucagggugaaacacucggagaaaaauggaagagacaacuaaaccagcuuucaaaaucagaguucaauacuuauaaaagaucuggaauaauggaaguagauagauccgaagcaaaagagggccuuaaacgaggcgagaccacgaaacaugcugugagucgcggaaccgcaaaauuacguugguucgucgaacgaaacuuaguaaaaccagagggaaaagucauagaucuggggugugggcgaggcggguggaguuauuacugcgcugguuuaaagaaagugaccgaagugaaaggauauacuaaaggaggaccagggcaugaggagccaauaccaauggcuaccuaugguuggaaucucgucaaauugcauaguggaaaagacguguucuucaucccaccagaaaaaugugauacuuuauuaugcgauaucggagaaucaucaccaaauccaaccauagaggaaggcagaacauuacggguauuaaagauggucgaaccauggcuucguggcaaccaauuuuguauaaaaauacuaaacccauauaugccaagcguugucgaaacucuugaacagaugcaaagaaaacacggaggaaugcuaguuagaaauccuuuaucacgcaacagcacucaugaaauguauuggguaagcugugguacaggaaauaucguaucggcgguaaacaugacgucacgaaugcuguuaaauagauucacgauggcccaucguaaaccaacauacgaaagggauguugauuuaggggcagguacaagacacguagcaguugagccagagguagcaaaucuagauauuauuggucaaagaauugagaacauaaaacaugaacauaagucaacguggcauuaugacgaagauaauccauacaaaacuugggccuaucacggaaguuacgaggucaagccgaguggauccgccaguucuauggucaacggugucguuaaacuacuuacuaagccuugggacguaaucccaaugguaacacagaucgcuaugacagauaccacacccuucggacaacaaaggguauucaaggagaaaguugauacacguacaccgaaagcuaaacgaggaacagcgcaaaucaugguagugacagccagauggcuguggaguuuucuaucgcgaaauaagaagcccaggaucuguacccgggaagaguuuacgagaaaaguaagaagcaaugccgcgauaggcgcaguauuuguggaugagaaucaguggaacuccgcuaaagaagcaguugaagaugauagauucugggaccugguacauagagaacgcgagcuccacaaacaagguaaaugcgcgacgugcguauauaacacuaugggcaagagggagaagaaauuaggugaauuuggaaaggcaaaagggucaagagccaucugguauaugugguuaggggcaagauuucuagaguucgaagcacuagguuucaugaaugaggaccauugguucucucgugaaaauagucucagcgguguagaaggcgaaggauuacauaaauuaggauacauacuaagagauauuucaaagauuccagggggaaauauguacgccgacgauaccgcagguugggacacgagaauaacagaaggagaucuacaaaacgaagcgaagauaaccgacauuauggaaccagaacaugcauugcuugcgaagaguaucuuuaaacucacauaccagaauaaaguuguaagaguccaaaggccagccaaaaaugguacgguuauggaugugauaucacgccgagaucagcgagguucaggacaaguuggaacauacggauuaaauacuuuuaccaauauggaagcacaacucauccgacaaauggaaagugaaggaauauuuucaccaaacgaacucgagacuccgaaccuggcagagcggguacuagauuggcuagaaaaguacggaguagaaagauuaaaacgcauggcaauuuccggggacgacugcgucguuaaaccaauugacgauagauucgcuacagcacucaccgcccuuaaugacauggggaagguaagaaaggauauuccucaaugggaaccaucaaaagguuggaacgacuggcaacaaguaccuuuuugcucgcaucauuuucaccaacuaaucaugaaggacgguagagaaaucguagugccaugcagaaaucaagaugaauuaguggguagagcaagagugagucaaggggccggaugguccuugcgugaaacugcaugccuugguaaaagcuaugcucagauguggcagcuaauguacuuccaucgacgcgauuugcgccuagcagcaaacgcaauauguucugcugugccuguugacuggguuccaacgagccgaacaacuuggucaauucaugcccaucaucaguggaugacaaccgaggacaugcuuucggucuggaaccguguauggauagaagaaaacccauggauggaggauaagacacguauaaguucaugggaggacgucccuuaccuaggggaacgagaagaccaguggugcgguucccuaauaggccuuacugcaagagcaacaugggcaacgaauguucaaguugcaaucaaccaaguaagaagacucauuggaaaugaaaauuauuccgauuacaugaccaguaugaaacgauucaagaacaaaucagagccagagggugcccuuugguaa

SEQ ID NO: 22163 - RNA, 9876 nt, Artificial Sequence
  derived and/or modified CDS sequence (opt6) from DENV-2__AJ968413__SS-prME
acugcugggaugauaaucaugcucauucccacuguaauggcuuuucaccuaacuacgcguaauggggaaccacacaugaucguaucuagacaagaaaaagguaaaucacuguuauucaaaacagaagacgggguaaacaugugcacauugauggcaauggaucuaggagaauuaugugaagauacaauuacauacaaauguccucuucuccgccaaaacgaaccugaagacaucgauuguugguguaauucaacgaguacuuggguuaccuaugggacaugcacaaccacaggugaacaucgucgggagaaaaggucaguagcacucguuccacauguagggaugggacuggaaacgaggacagaaacuuggauguccagcgaaggggccuggaaacacgcucaaaggauagaaacauggauacuaaggcacccaggauucacauuaauggcugccauucuagcauauacaauaggaacgacacacuuccaaagagcacuaaucuuuauacuccuaacugcaguggcgcccaguaugacaaugcguugcauagguauaucgaauagagacuuuguagaaggaguaagcggagggaguuggguagacaucguacuagagcauggaaguuguguaacaacuauggccaaaaacaaaccaacgcuggauuucgaguuaauaaaaacagaagcaaaacaacuagcuacgcuaagaaaauauuguaucgaggcaaaauuaacgaacacaaccacagaaucaaggugcccaacgcaaggagagccgucacugaacgaggaacaggauaaacgauuuguaugcaaacacaguaugguugauagggguuggggaaacgguuguggccucuuugguaaaggcgguaucguaacgugugccauguucacuuguaagaaaaauauggaagguaaaauuguacaaccagaaaacuuagaguauacaauaguaauaacaccacacucuggagaggaacaugcuguagguaaugauacagguaaacauggaaaagaaauuaaaauaacgccucaaucuagcauaacugaagcggagcuaacuggauacgggacaguaacuauggaaugcucuccccgcacaggacuugauuuuaaugaaaugguacuucuucaaauggaaaauaaagccugguugguacaccgacaaugguuuuuagaucuaccauuaccuuggcucccuggugcggauacgcaggggagcaauuggauacaaaaagaaaccuuaguaacauucaaaaauccucaugcgaagaaacaagacgucguaguacucggaucacaagaaggcgcgaugcacacagcccugacuggcgcaacggagauacaaaugaguagcgguaaccucuuauuuacagggcaccugaaauguaggcuaagaauggauaaauugcaguugaaaggaaugucuuauaguauguguacuggaaaguuuaagguaguaaaagaaauagcagagacacaacacggaacaauaguagugagaguucaauaugaaggcgacgggagucccuguaagaucccauuugaaauuauggauuuggagaagagacacguauuagggagguuaauuacugucaauccuauuguuacggagaaagauagcccaguuaacauagaagccgagccuccguucggugauucauacguaaucauagguguagaaccaggucaauuaaaacuuaauugguucaagaaagguaguagcauaggacaaauguucgaaacaaccaugcgaggggcuaaaagaauggccauacuuggcgauaccgcaugggauuucggaucauuagguggagucuuuacaucgauuggaaaggcuuuacaucagguguucggggcaauuuauggagcugcuuuuucuggggucaguuggacgaugaaaauuuuaauuggcgugauaauaacguggaucggaaugaacucacguucuacuucgcuaaguguaaguuuaguacuggucggugucguaacucucuauuugggaguuguuguacaagccgacucuggauguguaguuuccuggaaaaauaaagaauuaaagugugguucuggaauuuuuauuacagauaauguucauacauggacggaacaguauaaauuucaaccagaaucaccgagcaagcuagcuuccgccauacaaaaggcucaccaggaaggcauaugugggauucgcuccgugacuagauuagagaaccuaauguggaagcaaauaacaccagaguuaaaccacaucuuaucagaaaaugaaguaaaacuaaccauuaugacuggagauauaaagggaauaaugcacgcggggaaaagaucacuuagaccgcaaccuacugaacuacgauauaguuggaaaacauggggaaaagcaaagaucuuaaguacagaaucacacaaucaaacuuuucuaauagaugguccggagacagccgaaugccccaauacgaaucgggcauggaacucgcuagagguggaagacuauggauuuggaguuuuuacaacaaacauauggcucaaacugcgggaaaagcaagacgucuucugugauagcaaguugaugucagcagcgauaaaagauaauagggcaguacacgcagauaugggcuacuggauugaaucagcauugaacgauacuuggaaaauugaaaaagcgagcuuuauugaaguuaagagcugccauuggccaaagagucacacgcuguggagcaauggagugcucgaaagugagaugauaauacccaaaaauuucgcgggcccuguaucacagcauaacuaccgaccagguuaucauacacaaacugcagguccuuggcacuugggaaaacuagaaauggauuucgauuuuugugaaggaacaaccguuguugucacagaggacugcgguaaccgaggcccuuccuuaagaacgacaacagcgaguggaaaauugauaacagagugguguugccguucauguacacucccuccacugagauacaggggcgaagacggcugcugguaugguauggaaauccgaccuuuaaaagagaaagaagaaaaccuaguaaauagccuaguaacggcaggccacggucaaaucgauaauuuuucauuggguguucugggaauggcguuauuuuuagaagaaauguugagaacuagaguaggaacaaagcaugccaccuuacucguggccguuucuuuuguaacacuaauaacaggaaacaugagcuuucgugaccuugguaggguaauggucauggugggugccacgaugaccgaugauauuggcaugggaguuacauaccuagcucuacucgcugccuuuaaaguccguccuacuuuugcggcaggacuauuguugagaaaacuuaccucuaaagaacuuaugaugacaaccauaggugucguacuuuuaucgcaaagcacaauuccggagaccauacuagaacuuacugaugcucuugcauuggguaugaugguauuaaaaaucgucagaaagauggagagguaucagcuagcaguaacaauuacagcgauacugugcguucccaacgcagugauauuacaaaaugcauggaagguaucauguacaauauuagcaguaguuucagugucaccauuguuauugacaagcucacagcagaaagccgauuggauuccucuagcacuaacuauaaaggguuuaaaucccaccgcgauauuucuuacuacauugucaagaacguccaagaagcgcucguggccucuuaacgaagcgaucauggcuguaggaaugguaucgauuuuagcuaguagcuuauugaaaaacgacaucccaaugacagguccucuagucgcggguggauuauuaaccgucugcuauguacuaaccgguagaucagcagauuuagaacuugaaaaagcagcagaugugagaugggaggaucaagcggaaaucucgggcaguucaccaauucuguccauaacaaucucggaagauggaucaaugucaauuaaaaaugaagaggaagaacagacguuaacuauucuaauaagaaccggauugcuaguaauaagcggauuauuucccgucuccaucccaauuacagcugcagcgugguauuuaugggaagucaagaaacagcgagcuggaguguuaugggauguaccaucgcccccaccaguaggaaaggccgagcuugaagauggugcguacagaauaaaacaaaaagguauucucggauauucacaaauaggggccgguguuuauaaagaggguacauuucauacaauguggcauguaaccagaggcgcaguacucaugcauaaaggaaaacgaauugaaccuagcugggcagacgucaagaaagaucuaauaucuuauggcggcggguggaagcuggaaggagaguggaaagaaggcgaagaaguacagguuuuggcuuuggaaccagguaaaaauccuagagcaguucaaacaaaaccgggauuauuuaaaacaaauacgggaacuauaggggcagucagucuugauuuuucuccggguacuuccggcucgccuauaaucgauaaaaaggguaaagugguugguuuauauggaaacggagucgucacuagaaauggggcauauguaagcgccauagcacagacugaaaagucaauugaggacaaucccgaaauagaagaugauaucuucagaaagaaacggcugacaauaauggacuugcauccuggugcgggaaaaacgaaaagauauuuaccagcuauaguaagagaagcgaucaaaagaggacugcgaacgcuuauucuggccccaacaagaguaguagcugcagagauggaagaagcacuccguggauuaccaauaagauaccaaacccccgcaauacgggcugaacauacuggaagagagaucgucgaucuaaugugucaugcuacauuuacuaugagacuguugucgccgguaagagucccuaacuacaacuuaaucaucauggacgaagcacauuuuacagauccugcaaguauagcugccagaggguauauuaguacaagagucgaaaugggggaggcagcaggcaucuucaugacagcgacuccaccgggaagccgggacccguuuccucaaucuaaugcuccuauuauggaugaagaaagggaaauuccugagcgauccuggaacagugggcaugaauggguaacugacuucaaggguaaaaccgucugguuuguaccguccauuaaagcugggaaugacaucgcagcaugccuaagaaagaauggcaagaaagucauacaauuaucacggaagacauuugacucagaauauguuaagacacguacaaacgauugggacuucguuguaacaacugauauaagcgaaaugggugcaaauuucaaggcagaacgagugauugauccuaggcgauguaugaaaccuguaauccuaacagacggcgaagaacgaguuauuuuggcaggaccaaugccgguaacucacucuagcgcugcucaacgaagagggcgaauaggacgaaaucccaaaaaugaaaaugaccaauauauauauaugggagaaccacuagaaaaugacgaagauugcgcacacuggaaggaagcaaaaaugcuccuagauaauaucaacacaccagaagguauuaucccaagcauguuugaaccagagcgagaaaaaguagaugcuauugacggggaauauaggcuacgaggugaagccaggaaaacguuuguugaccuaaugaggagaggagaccuaccagugugguuagcauauaagguagcagcagaaggcauaaacuaugcugacagaagaugguguuuugacggaaucaggaacaaucagauauuagaagaaaauguagaagucgaaauuuggacgaaagagggagaaagaaagaaauuaaaaccaagaugguuagaugcacggauauauagugacccacuggcacuaaaagaauuuaaagaguucgcggcggguagaaaaucuuuaacguuaaauuuaauaacggaaaugggucggcucccaacuuuuaugacacagaaggcacgagaugccuuggauaaccucgcaguacuucauaccgcugaagcagggggucgugcauauaaucaugcucuaucagagcuaccggagacccuagaaaccuuauuauuacuaaccuuauuagcuacagugacgggagguauauucuuguuuuuaaugucuggucgcgguauuggaaagaugacuuugggcauguguuguauaauuacagcgaguauucugcucugguacgcccaaauacaaccacauuggauagcugccucaauaauacucgaguucuuuuuaauaguacuacucaucccugaaccagaaaagcaacgaacaccgcaggacaaucaacuaacguauguggucauugcgauucucacugucgucgccgccacaauggccaacgagaugggauucuuggagaaaacgaagaaagacuuaggauuaggauccauaacgacacaacaacccgagucaaacauucuugauauagaccuacggccagcuucagcauggacacuauaugcaguugcgacgacauuuguaacaccuauguuaagacauucaauugaaaacuccuccguaaacguaucucucacugcgauagccaaucaagcgaccguacuuaugggguuaggaaaagguuggccacucucuaaaauggacauaggaguaccucuuuuagcuauagguuguuacagucaaguaaauccaauuacucuaacagcagccuuauuauuguuaguagcacauuaugccauuauuggaccaggguuacaggcuaaagcuacgagggaagcacagaaaagagcagcugcagguauaaugaaaaaucccacaguagauggaauaacgguaauagaccucgaucccauacccuacgauccaaaguucgaaaaacagcuagggcaagugaugcuuuuaguuuuaugcguuacacaaguccuaaugaugcgaaccacaugggcucucugugaagcacucacucuagcuacugguccgaucucgacucugugggaaggaaauccaggcagguucuggaauaccacaauugcgguaagcauggcaaacauauucagaggauccuacuuagcaggagcaggcuugcuauuuucaauaaugaaaaacacgacuaacacaagaaggggaaccggaaauauuggggaaacgcuaggugaaaaauggaaaaauagauuaaaugcccuugggaaaucagaauuucaaaucuacaagaaaucaggaauccaggaaguagacagaacacuagcgaaagaagggauuaaaagaggcgaaacagaccaucaugcaguaucaagagguucugcaaaauugagaugguuuguagaaagaaauaugguaacuccggaaggcaaaguagucgaucuagguuguggccgcggagguuggucauacuacugcggcggacuaaagaacgugcgagaggucaaagguuuaacuaaaggagggccuggacacgaagaaccaauaccgaugagcacuuacgguuggaaccucguacgccuacaauccggcgucgauguauucuucacaccaccugagaaaugugauacauuacugugugauauuggugaaucaucaccaaauccgacuguagaagcuggacgaacuuuaagaguacuaaaucucguggagaauuggcuaaauaacaacauacaguucuguauaaaagucuuaaacccuuauaugccaagugugauagagaaaauggaggcuuugcaacgaaaauauggaggggcuuuagugagaaacccacucagucgcaauucaacacacgaaauguauuggguuagcaacgcuucgggcaacaucguaucaucgguaaauaugauuucucgcaugcucauaaaucguuuuacgaugaaacacaaaaaggcuacauacgagccggauguugaucuaggaagcgggacuagaaauauaggaauagaaucggaaguccccaauuuagauauuauaggaaaaagaauugagaaaauuaaacaagaacaugaaacaagcuggcauuaugaucaagaccauccuuacaaaacuugggcauaccacggcaguuaugaaacaaaacagaccgguucggcaucuagcauggucaacggugugguaagguuauuaacaaaaccuugggauguaguuccaauggucacccaaauggcuaugacggacacaacacccuuuggucagcaacggguuuucaaagaaaagguagauacacgaacacaggaaccaaaagaaggaacuaaaaagcugaugaaaaucacagccgaaugguuauggaaagaacuaggcaagaagaaaacaccacguauguguacuagagaagaauuuacaagaaaaguacgaaguaaugcagcgcuaggagcgauuuucacagacgaaaacaaauggaagucugcaagagaagcaguugaagauuccagauuuuggggucugguugacaaagaaaggaaucuacacuuagaaggcaaaugugaaacuuguguguauaauaugaugggaaaacgggagaagaaauuaggcgaguucggaaaagcaaaaggaucacgagcaauuugguacaugugguuaggcgcacgauucuuggaauuugaggcgcuagguuuccugaaugaagaucauugguuuucuagggagaacagccuuuccgguguagaaggagagggguugcacaaguuaggauauauuuugcgagacguaagcaagaaagaaggcggagcuauguacgccgaugauacagcagguugggauacuagaauuacucuugaggaucucaaaaaugaggaaaugguaacaaaucacauggagggagaacauaagaaacuagcggaggcgauauuuaaacugaccuaucagaacaagguaguaagaguucaaagaccaacuccgagaggcacgguaauggauaucaucucgcgucgugaucaaagaggcucgggacaaguugguacauauggcuuaaacacauuuacaaauauggaagcacagcugauccgacaaauggaaggagaaggaguguucaaguccauacagcaucuaacgguuacugaagaaauagcaguucagaauugguuggcgcggguuggacgcgagaggcucagucguauggcuauuagcggggaugauuguguugugaaaccgcuugaugacagguucgcaucagcucuuacagcucuaaaugauauggggaaaguccgaaaagacauacaacaaugggaaccaucaagggguuggaacgacuggacccaaguuccuuuuugcagccaucauuuccaugaauugaucaugaaagacggaagaguccuaguagucccuugcaggaaucaggaugaacugauaggacgagccaggauuagucaaggugcaggaugguccuuaagagaaacagccugucuaggaaagucuuacgcgcagauguggaguuuaauguauuuccaucguagggaccugaggcuugcagcaaaugccauuugcagcgcagucccaagccauuggguuccgacgucacgaacuacauggucaauucacgcaaaacaugaguggaugaccacggaggauaugcugaccguuuggaauaggguuuggauccaagaaaauccuuggauggaagacaaaacuccgguagaaucaugggaagaaauacccuauuuaggaaagagagaagaucaguggugugguucacugauaggcuuaacaagucgagccacaugggcuaaaaauauucaaacagcgaucaaccaaguccgaaguuugauugguaaugaggaauauacggauuauaugccaucaaugaagagauuucgaagggaagaggaggaagcaggcguguugugguaa

SEQ ID NO: 22164 - RNA, 9876 nt, Artificial Sequence
  derived and/or modified CDS sequence (opt6) from DENV-2__AB543624__SS-prME
agcgcaggaaugauaauaaugcugauaccaacuguaauggcuuuccacuuaacgacuagaaacggugaaccccacaugauuguaggaauccaagaaaaaggaaaaucauuauuauuuaaaacagaagauggaguaaacauguguacccuaauggcaauggaccucggcgaacuaugugaagacacgauaacuuauaaauguccauugcuacgacagaacgaaccugaagacauagacugcugguguaacaguaccuccaccugggugaccuacggaacguguacuacgacaggagaacauagacgagagaaaaggagcguggccuuaguaccacaugugggaaugggguuagaaacuagaacggaaacauggaugucaagugaaggagcauggaaacaugcacaacgaauagaaacguggauauuacgucaucccggauucacaaucauggcugccauuuuagcauacacgauagggacgacucauuuccaaagaguguugauauucauauuguuaacagcgguagcgccaucaaugacaaugcggugcauuggcauuucuaaucgagauuuuguugaaggugugagugguggaagcuggguagauauugugcuagaacaugguagcugcguuacaacaauggcgaaaaauaaacccacacucgacuucgaauugauuaaaacagaagcaaaacagcccgccacccuuagaaaauauugcauugaagcaaaauuaacuaauacgacgacugagaguagaugucccacucaaggcgagccgucguugaaagaagaacaagauaaacgauuugugugcaaacauagcaugguugaucgcggaugggggaaugguugcgguuuauuuggcaaaggcgguauaguaacuugcgcuauguucacaugcaagaaaaacauggaaggcaaaauuguacaacccgaaaaucuggaauauaccaucguugugacaccacacagcggcgaagaacaugcagugggaaaugauacuggaaaacaugguaaagaaauaaaggugacuccucaauccucgauuacugaggcagagcuaaucggauacggaacuguuacaauggaauguuccccuagaacgggcuuagacuuuaacgaaaugguacuacuucagauggaaaauaaggcauggcuaguacaccgccagugguuuuuggacuuaccccuaccaugguuaccaggugccgauaagcaggaaucaaacuggauacaaaaagaaacgcucgugacguuuaaaaauccacaugcaaagaaacaagaugucguaguucuagggucaccugagggagcaaugcauacggcuuuaacaggagcaacugaaauccaaaugucgagugggaaucuucuuuucacaggacaucuuaaauguagauuacgaauggauaaacuucaauuaaaggguaugucguacagcaugugcacggguaaauuuaaaguuguaaaagaaauugccgagacccaacauggaacaauaguaauaaggguacaauacgaaggugaugguaguccuuguaaaauucccuuugaaaucauggaucuugaaaaacguuaugugcuugguaggcucaucacagucaacccaauagugacagaaaaagacaauccugucaacauugaagcagaaccaccauuuggcgauaguuacauaauaauaggaguugaaccaggacaauuaaaauuaaacugguuuaagaaagguucgucgauaggacagauguuugaaaccacaaugcguggagcaaaacgaauggcgauacuaggugacacugcuugggacuucggaucguuaggaggcguguuuacuucgauaggaaaagcgcuacaucagguauuuggcgcuauauauggagcugcauucucuggaguauccuggacuaugaaaaucuugaucggggucaucauaacauggauagggaugaauagcagaucaacaucccuauccguaucucugguccuuguaggcauagucacgcucuauuuaggaguaaugguucaagcagacucagguuguguaguaaguuggaaaaauaaggaauugaaaugcggaucaggaauauucaucacagauaacguacacacuuggacggaacaguauaaguuccagccagaauccccguccaaacuggcgagugcuauacaaaaagcacaggaagaggggaucuguggaauuagauccguaacucgauuagaaaauuuaauguggaaacaaauagcaccagagcuuaaucacauacuugccgaaaaugagguaaaacuuacgaucaugacaggcgacauaaaagguaucaugcaagcuggaaagagaucgcuccgaccgcaaccaaccgaauuaaaauacuccuggaagaccuggggcaaggcaaaaauguuaucuaccgagucguauaaccaaacauuucucauagaugguccugaaacugcagaauguccgaauaccaauagagccuggaauagccuagaaguugaagacuauggauuugguguauucaccacaaacauauggcuaaaacuaaaggaacgucaagacgccuuuugugauuccaaacuuaugagugcugccauaaaagauaacagggcgguucacgcggacauggguuacuggauagaaucugcgcucaaugacacuuggaaaaucgagaaggcgucuuucauugaagucaaaaacugucauuggccaaagucgcauacccuuuggucuaaugggguauuggagagugagaugauuauacccaaaaacuuagccggaccugugagccaacauaauuaccgucccggcuaccacacacagauugccgggccauggcauuuaggaaagcuggaaauggauuucgauuucugcgauggaacaacgguuauagucaccgaagacugcggcaaucguggccccagcuuaaggacuaccacagccuccgguaaacuaaucaccgaauggugcugccgguccugcacauuaccgccacuuagguaucgaggagaagauggaugcugguauggcauggaaauaaggccauuaaaagaaaaagaagagaacuuaguaaauucuuuaguaacggccggccacggacaaguugauaauuuuucacugggaguccuuggcauggcucuguuucuggaagagaugcuccgcacaagaguagguaccaaacaugcgauauuauuaguugccguaucuuuugugacauugaucacaggcaauaugagcuuuaaagaucuagggagagucguaguaauggucggagcuacuauggcugaugauauagguaugggaguaaccuauuuagcacuacuugcagcauucaaaguucgaccaaccuucgcugcgggcuuauuacugcgaaaauuaacaucaaaggaauuaaugaugacaacuauuggaaucguucuauuaucgcaauccacuaucccagaaacaguucucgaauugaccgaugcauuggcgcuggguaugaugguuuuaaagauaguaaggaacauggaaaaguaccaacuagcugugacgaucauggcuauacuauguguaccuaacgcaguaauacugcaaaacgcauggaaaguaagcuguacuauauuagcuguaguaucaguauccccauugcuucuuacaaguagucaacaaaagaccgacuggaucccuuuagcccucacaauaaaaggucuuaacccaacagcaaucuuucugacaacgcugucccgcaccaauaagaagaggagcuggccucuaaacgaagcaauuauggcaguagggaugguaagcauacuagcguccucacuucuuaagaacgauaucccaaugaccggcccccucguugcuggaggucuccuuacgguuuguuacgugcugacaggaaggagugcagaucuagaguuagaacgugcaacagauguaaaaugggaggaccaagcagaaauuaguggaagcagcccaauucuaucuaucacuauuagugaggacggaucgaugagcaucaaaaacgaagaagaagaacaaacacucacaauacuuauccgaacaggauuacuggucaucagcggguuauuuccuauauccauaccaauaacagccgcggcuugguauuuaugggaaguaaagaagcaaagagcgggagucuuaugggacgugcccaguccaccaccuaugggcaaagcugaacucgaagauggcgccuauaggauaaaacaaaaaggcaucuuaggcuacucucaaauuggagcgggaguuuacaaagaaggaacauuucacacaauguggcacgucacccgaggagcuguguuaaugcauaaaggcaagcgaaucgaaccuucuugggcagaugucaaaaaggauuuaauuaguuacggugguggauggaaauuagagggcgaguggaaagaaggggaagaaguacaaguauuggcgcuugaaccuggaaagaacccuagagcuguacaaacaaaaccaggauuauuuaaaacaaacaaugggacaaucggugcaguuaguuuggauuucagcccggggacaagcggaucaccgauuauagacaagaaggguaaaguagucgguuuauacggcaacggaguugugacuagaucaggagcauauguuuccgcaauugcacagacugagaaaagcauagaagauaauccagaaauagaggaugauauuuuuaggaaaagaagauuaacaauuauggauuuacauccaggagccgguaagacaaaacgauaccuaccagccaucgugagagaggcaauaaaaagaggcuuaaggacauuaauucuagcaccgacacgagucgucgcggcugagauggaagaggcuuuacgugguuugccuaucagguaucaaacuccagcuauucgggcggagcauacaggaagagaaauugucgaccuuaugugccacgcuacauucacuaugaggcuccuuagcccggugagagucccaaacuauaacuuaauaauaauggaugaagcgcauuuuacagacccggccucuauugcugcaagagguuauauaucuacaagagucgaaaugggcgaggcugcaggaaucuuuaugacugcaacgccaccaggaagcagagauccuuucccacagucaaacgcaccgauaauugacgaagaacgggaaauaccggagcgcucauggaacagcggacacgaaugggucacugauuucaaagguaaaacgguaugguuuguaccuaguauaaaagcagguaaugauauugcagcuugccuuagaaagaauggcaaaaagguaauacaacuuucacguaaaacuuuugacagugaauacguaaaaacaagaacuaaugacugggauuuuguaguaaccacugauauaagcgagaugggggcaaauuuuaaagccgaacguguaauugacccucgacgaugcaugaaaccaguaauucuaacagauggagaagagagaguuauacuugcagggcccaugcccguaacgcauucaucugcagcacaaagaagagguagaauaggaagaaacccaaagaaugagaaugaucaauacauauacaugggggagccacuugaaaaugacgaggauugugcucauuggaaagaagcgaaaaugcuacuggacaauauuaacacaccugaggguauuaucccuaguauguucgaaccagaaagagaaaaaguagacgcaauagacggagaauacagauuacggggugaagcaagaaaaacauuuguggaccugaugcguagaggcgauuuaccagugugguuagcuuacaaagucgcugcagaaggaauaaauuacgccgaucgaagauggugcuuugacggcauaaagaauaaccagauacuugaagaaaauguugaaguugaaaucuggacaaaagaaggagaacgcaagaaacuuaaaccacggugguuggaugcucgcauuuauagugacccgcuagcguuaaaagaauuuaaagaguuugcagcgggaagaaagucacuaacacuuaaucucauaacagaaauggggagauuaccgacauuuaugacucagaaaacuagggaugcccuggauaauuuggccgugcuacacacagcagaagcgggaggucgagcauauaaccaugcguuaagugaacuaccagaaacucuagaaacauuacuucuacuaacuuuauuggcuacagucacugguggcaucuuuuuauuucuuaugagcggccgagguauuggaaaaaugacacucgggauguguuguauaauaacagcaucgauauugcuuugguaugcgcagauacagccgcauuggauagcagcgucgaucaucuuagaauuuuuccuaaucguucuguuaauuccggaaccagaaaagcaaaggacaccccaagauaaucaacugacauauguuguaauagcaauacuaacuguaguagcugcuacgauggcuaaugaaaugggguuucucgagaaaaccaagaaagaccuagggcuagguucuaucgcaacccagcauccugaaucaaauauucuagacauagaucuacgacccgcuucugcuuggacauuguaugccguggcgacaacauucauuacacccaugcuccgacauucgauagaaaauagcucuguaaacgugucauuaaccgcuaucgccaaccaagcuacuguucuaauggguuugggaaaaggcuggccauuaucgaaaauggauauaggggucccucugcuagcuauagggugcuauucgcaggucaaucccaucacacucaccgcugcauuguugcuacucguggcgcacuaugcuauuauuggaccaggucuucaagcgaaagcuacacgagaagcacagaagagagccgcugcaggaauuaugaaaaacccgacaguagaugggaucacuguaauugauuuagaucccauccccuacgauccaaaguuugagaaacaauuaggccaaguaaugcuacucauacugugugugacacaggugcuuaugaugagaacaacgugggcacuuugcgaggcccuaacauuggcgaccggaccaauuucuccucuuugggaggguaacccaggaagauucuggaauacuacuauugcaguaucaauggcgaacauauuccgcggaucuuaucuagcgggagcugguuuauuauucucuauaaugaaaaauacaacaaauacaagacgaggaacaggaaacaucggagaaacacucggggaaaaguggaaaucccgccuuaaugcgcuugggaaaucagaauuucaaauuuacaagaaaucgggaauccaggagguggacagaacauuggcaaaagaggguauaaaaaggggagaaacugaccaucacgcuguuaguagaggaucagcaaaauuaagaugguucguugagagaaacaugguuacuccugaaggaaaaguaguugaccucggaugcggacgaggagguuggucuuacuauuguggaggcuugaaaaauguaagagaagugaagggacuuacuaaagguggaccaggacaugaggaaccgauccccaugucuacuuacggauggaacuuaguaagacuccagagcggcguugacguuuucuucauuccgccggaaaagugugauacucuucuaugcgauauaggagagagcaguccaaacccuacugucgaagcaggcagaacacuaagggucuugaacuuaguggagaacuggcuaaauaaccacacacauuuuugcauaaagguguuaaacccguauaugccaucaguuuuagagaaaauggaagcauuacaacgaaaauacggaggggccuuggugcgaaauccauugucgagaaauucuacacaugaaauguacuggguaaguaacgcaucagguaauaucguauccucgguaaacaugauaucaagaauguugauaaauagauuuacgaugaggcacaagaaagcaacuuaugaacccgacguagauuuagggucuggaacacgaaacauagguauagaaucagaaaucccuaaccuugauauuauagggaagaggauugaaaagauaaaacaagaacacgaaaccaguuggcacuacgaccaagaccacccauauaaaacgugggcauaucacgguucguaugaaacaaaacaaaccgguagcgccucaaguauggugaacggcgucguaagacucuugacaaaaccuugggauguucuucccacggugacacaaauggcaaugacagauacuacgccuuucggucagcaacggguauuuaaagaaaaagucgauacgagaacucaagaaccuaaagagggaacuaaaaaguugaugaaaauuacugcggaguggcuauggaaggaguuaggcaagaagaaaacacccagaauguguacccgagaagaguuuacccguaaagugagaucuaacgcagcauuaggagcaauauucacagacgaaaauaaguggaagucggcgagggaggcaguagaagacucacgguuuugggaauuaguagauaaagagagaaaucugcauuuagaaggaaaaugugaaacaugcguauacaauaugauggggaaaagggagaagaaacuaggagaguucggaaaggcgaaaggaagccgcgcaauaugguauauguggcuaggcgcucgauucuuggaauuugaagcgcuaggcuuucucaacgaagaucauugguucuccagggaaaauucguuauccggagucgaaggagaaggguuacauaaauuaggauauauucuaagggaugucucaaagaaagaaggaggugcgauguaugccgacgauacggcaggcugggauacaagaauuacacucgaagaccuuaaaaaugaagaaauggugacaaaucacauggaaggagaacauaagaaacuggccgaggcuauauucaaacugacguaucagaauaaaguaguucggguucagcgaccaacaccgagaggaacgguaauggacauaauuagccgaagagaccaacgaggcaguggccaagucggaacauauggccuaaacaccuuuacgaauauggaagcacagcuuauacgacaaauggaaggagaggggguuuuuaagaacauucaaagguugacuguaaccgaagagguagccguccauaauuggcuggcacgagucggaagagagagauugucaaggauggcgauaucuggcgaugauugcguaguuaaaccacucgacgacagauuugcaaaugcguugacugcucuuaaugauauggguaaaauucggaaagauauucagcagugggaaccaagcaaagguuggaaugauuggacccaggugcccuuuuguagucaucauuuucacgaacuuauaaugaaggaugggagaguacuugucguuccguguagaaaucaggacgaacuaaucgguagagcacguaucucacagggagcaggauggucacuaagagaaacggcuugccuaggcaagucuuacgcacagauguggagcuuaauguauuuucauagaagggacuuaagacuagcugcuaacgcaauauguagcgcaguaccaucucauuggguuccuaccucaaggacuacauggagcauacaugcaaagcaugaauggaugacaacggaagacaugcuuacgguguggaaccguguguggauccgugaaaauccauggauggaagauaaaacaccaguggaaucaugggaagaaaucccauaucuaggaaaaagggaggaccaauggugugguucauuaauaggauuaacgucgagagccaccugggcaaagaacauucaagcggcaauuaaucagguacguucauuaauaggcaacgaagaauauacagauuacaugccauccaugaagcgcuucagaagagaagaggaggaagcaggcguacucugguaa

SEQ ID NO: 22165 - RNA, 9876 nt, Artificial Sequence
  derived and/or modified CDS sequence (opt6) from DENV-2__AB189122__SS-prME
accgcugguguaauaauaaugaugauaccaacuguuauggcauuucaucuuacaacacgaaauggagaaccgcauaugaucgugucacgacaagaaaaaggaaaaucgcuacuauuuaaaaccgaaaauggaguaaauaugugcacucuuauggcaauggacuuaggagaacuaugcgaagacacaauuacguauaauuguccguugcuaagacaaaacgaaccugaagacauagauuguugguguaauucgacgucaacguggguaaccuacggaaccugcacggcuacuggugaacacagacgggaaaaacggaguguggcuuuggcuccacacgugggaaugggucuugaaacaagaaccgaaacauggaugucaagugaaggagcuuggaaacaugcacaaagaauugaaacauggguauugcggcacccaggguuuacaauaauggcagcaaucuuagcguacacaauaggcacgacuuacuuccaaaggguucuuauuuuuaucuuacuaacagcaguugcaccuucaaugaccaugcguuguauaggcauaucaaacagagauuucguagaaggaguaucuggcgguucuuggguugacaucguacuagaacacggaagcuguguaacuaccauggccaaaaauaaaccaacacuugauuuugaacuaaucaaaacugaagcaaaacaccccgcaacacuuagaaaauauuguauagaagcgaaacugacaaacacuacaacggcaagucgaugcccgacucaaggggaaccaucauugaaugaagaacaagauaaaagauucguauguaaacauucgaugguggacagaggaugggggaacgggugcggcuuauucggaaaagggggaauuguuaccugcgcaauguucacaugcaagaaaaauauggaaggaaaaguaguccaaccagaaaacuuagaauacacuauaguaauaacaccucauagcggagaagaaaacgcaguagguaaugauacugguaaacacggaaaagaaauaaaaguaacaccacagaguucaauaaccgaagcagaauuaacggguuaugguacgguuacaauggaauguucuccuagaacgggcuuagauuuuaacgaaauggucuuacuacaaauggaaaauaaagcauggcuaguacauagacaaugguuuuuagaucuaccguuaccaugguuaccaggugcagacacacaaggauccaacuggauucaaaaagaaacuuugguaacauucaaaaacccacaugccaagaaacaagacgugguuguacuugggucacaagaaggcgcuaugcauacagcguuaacgggugcuacugaaauucagaugaguagcgguaaucuacuauucacugggcaccuuaaaugucgcuuacggauggacaaauuacaacuaaaaggaaugucuuacaguaugugcaccggcaaauuuaaaguaguuaaagaaauagcggaaacucaacacggaaccauaguuauacggguacaauaugaaggagauggaagcccguguaagauacccuuugaaauuauggaucuagagaaacgucauguguuaggcagauugaucacaguaaauccaauaguuacagagaaagauucuccuguuaauauugaggcagaaccaccguuuggagauucauauauuauuauaggaguggaaccuggacagcuaaaacucaauugguucaagaaaggaucaucuaucggccaaauguucgaaacaacuaugcgaggagcgaaaaggauggccauauuaggggacacugcuugggauuuugguagccuuggugguguauucacaucaauaggaaaggcucuacaccaaguauuuggagcuauauacggugcagcauuuucuggcguaagcuggacuaugaaaauacuuauaggaguaguuauuacauggauagguaugaacucaagaucuacuucucucagugucucgcuuguacuugucggagucgugacgcucuauuuaggcguuauggugcaggcugacaguggauguguaguuuccuggaaaaauaaagaauugaaguguggaagugggauauuuauuacugacaaugugcauacuuggacagaacaauauaaauuucaaccagaaagcccuagcaaacucgcuucagcaauacaaaaagcgcaugaagaagguauaugugguauaagaaguguuacccgacuagagaaucuaauguggaaacaaauaacaccagagcuaaaccacauuuuaagugaaaaugaaguuaaacuuacuauuaugacgggagacaucaaaggaauaaugcaagcugggaaaagaagucuacgaccacaaccuacagaacugaaguacucauggaaggcuugggggaaggcgaaaaugcuaucaacagaacugcauaaucauacauuucuaauugaugggcccgagacugccgaauguccaaauacuaacagagcauggaacuccuuagaaguagaagacuauggauucggcguuuuuacuaccaacauuuggcuaaaauugaaagaacgucaagauguauuuugcgauucuaagcucaugucugcagccauuaaagauaauagggcuguacacgccgauaugggcuacuggauagaauccgcacuaaacgacacuuggaaaaucgaaaaggcuucauuuaucgagguaaaaucaugccauuggccuaaaucacauacucuuugguccaacgggguguuagaaucggagaugauaauacccaaaaauuucgccgguccggugucgcaacacaauuauagaccaggauaucauacacagacagcuggacccuggcacuuggguaagcuagaaauggacuucgauuucugugaaggcaccaccgucguaguaacagaggauugugguaaucgaggcccgaguuugaggacaacaacagccucaggaaaacuaaucacugaauggugcugccgguccugcacgcugccaccucuuagauauagaggugaagauggaugcugguaugggauggagauuagaccucuaaaagaaaaagaagaaaaucuugucaauucguuaguuacagcgggucacggucaaauagauaacuuuucucugggaguauuaggaauggcacuauuucuugaagaaaugcuuagaacaagggucggaacgaaacaugcgauccuccuaguugcaguaaguuucguaacuuuaauaacgggaaacaugagcuuuagagauuuagggagaguuaugguaauggucggggccacuaugacagaugacauuggcaugggggugacauaucuggcgcuccuagcggcuuuuaaagugagaccaaccuuugcggcaggcuugcuacuuaggaaauuaaccagcaaggaauuaaugaugacgacaaucggcauaguacuccuaucacagaguaccauaccugaaacgauccuugaacugacagaugcgcuggcacuagguaugaugguauuaaaaauaguaaggaacauggagaaauaccaacuagcuguaacaaucauggcuauccucuguguaccaaacgcaguaauuuugcagaaugccuggaaagugucgugcacgaccuuagccgugguuagcgugagcccgcuguugcucacgagcucgcaacagaaagcggauuggauaccucuggcauuaacgauaaaaggccugaauccuacugcgauauucuuaacaacccuaucuagaacgagcaagaaaagaucuuggccauugaacgaagcuauaauggcuguagggaugguuaguauccuagccucaucccuucucaaaaaugauauacccaugacggggccgcuaguggccggaggucugcucacaguuugcuacgucuugacaggcaggagcgcagaucuagaauuagaaagagcggcugauguacgaugggaagaacaagcggagaucucagguagcucucccauauuaucaauaacaaucagcgaagauggaucaaugagcaucaaaaacgaggaagaagaacagacacugacaauucuuauacggacaggucuacucguaaucuccggacuauuuccgguuaguauaccuauaacagcagcugcuugguauuuaugggaggucaagaaacagagagcgggaguguugugggacguaccuucuccaccacccguuggaaaagcugaguuagaggacggugcuuaccgaauuaaacaaaaaggaauacuugguuacagucaaauaggagugggaguauauaaagaaggcacauuucauaccauguggcacguuacacguggggcaguacugaugcacaaggggaaaagaauagaaccaucgugggcagauguaaagaaagacuugauuuccuaugguggagguuggaaacuagaaggagaauggaaagaaggggaagaagugcaaguauuagcacuagagcccggcaaaaacccacgugcaguacaaacuaaacccggucucuuuaaaacuaauacagguacgauaggggcuguuucacuugauuuuucuccaggcacaaguggaaguccaaucguagauaagaaaggaaaaguagucggacuauaugguaauggaguggucacacgaagcgguaccuauguaagugcuauugcucaaacagagaaaaauauugaggacaauccugaaauagaggaugacauauucaggaagaaacgauuaacgauuauggauuuacacccuggagcggguaaaacaaagcgauacuuaccugccaucguacgagaggcuauuaaaagagggcuaagaacuuuaauacucgcgcccacacgcguggucgccgcggaaauggaggaggcuuugagaggacucccgauucgcuaccagacuccggcaauucgcgcugagcauaccggcagggaaauugucgaucuuaugugucacgcaacauuuaccaugagacuacuauccccgauacgagugcccaauuauaauuuaauaauuauggacgaggcucacuucacagauccugccucaauagccgcucgagguuauauaaguacuaggguugaaaugggugaagccgcagguaucuuuaugacugcaacaccuccuggcucaagggauccuuucccucagagcaacgccccuauaauggacgaagaacgagaaaucccugaacguaguuggaauagcgggcaugaauggguaacggauuuuaaagggaaaacgguaugguuuguaccgagcauuaaagcaggcaaugacauagcagcgugucuaaggaaaaacggcaagaaaguaauacaauuaucucgcaaaacauuugacucugaauauauuaaaacaagaacaaaugauugggacuucguugugacaacagacauaucugagaugggggcaaacuucaaagcggagagagugauugauccgagacguuguaugaaaccgguaaucuuaacagauggggaagaacgaguaauccuagcuggcccaaugcccguuacccauuccucagcagcacaaagacgaggaagaguaggucguaaucccaaaaaugaaaacgaccaauauauuuacaugggugagccucucgagaaugaugaagacugugcucauuggaaagaggccaagaugcucuuagauaauauuaacacaccugagggaaucauuccaucaauguuugaaccugaacgagaaaagguagacgcaauagauggagaguauagguugcgaggagaagccaggaagacauucguagacuugaugaggcggggagaucuucccguauggcuggcguacagaguggccgcagaaggcauuaacuaugcggauagacgcuggugcuuugauggaguuaaaaauaaucaaauacuagaagaaaacguagaagucgaaauauggacuaaagagggcgaaaggaagaaacuuaaaccgcgguggcuugaugcacguauauauucugacccguuagcgcuaaaagaguucaaagaguuugccgcaggacguaaaucguuaacucuaaacuuaauuacagaaaugggccgucuccccacguuuaugacacaaaaggcgaggaaugcacuugauaacuuggcugucuugcauacagcugaggcaggaggacgagcauacaaucacgcguuaucugaguugccagaaacucuugaaacacuauuauugcugacguuauuagcaacugucacgggugguauauuuuuauuucucaugagcggaaaagguaucggcaagaugaccuuaggaaugugcuguauuauaacugcgaguguccuccuaugguaugcacaaauacaaccacacuggauagcagcgucaauaauucuagaguucuucuuaauugugcucuugauacccgagccugaaaagcaacguacaccucaggauaaucaacuaaccuaugucguaauagcgauauuaacaguaguagcugccacaauggcaaaugaaaugggauuuuuagagaaaacuaagaaagacuucgggcucgguagcauugcuacacagcaaccagaaagcaacauucuggauauagaccucaggccagcuuccgcauggacacuuuaugccguagcuaccaccuuuauaaccccuaugcuaagacauagcaucgaaaauucuucuguaaacguaagucuuacugcaauagcaaaucaggcuacuguacuaaugggucuagggaaaggcuggccccuaucuaagauggauauagguguaccauuacuagccaucgguugcuauucacagguaaauccaauaacguuaacagcagcguuacuauuacuuguugcacauuacgcuauaauuggaccagguuuacaagcuaaggcgacgagagaagcacagaaaagagcggcugcaggaauuaugaaaaacccgacuguagaugguauuacugugauugauuuagauccaauaccguaugauccuaaauuugaaaaacaacuaggacaagucauguuauugguuuugugcguaacacaaguauuaaugaugcguacaacgugggcguuaugcgaagcucuaacacuagccaccgggccgauuucuacacucugggaaggaaauccaggacgguucuggaauacaacgauagcagugucaauggccaauauauuucgaggauccuauuuagcuggcgcggguuuauuguuuagcauaaugaaaaacacagcuaauaccagaaggggaacaggaaauacuggugaaacacuaggagaaaaauggaagaaccgauuaaaugcgcuagggaaaucagaguuccaagucuauaagaaaagcgguauacaagaaguagauaggacucuggccaaagaagggauagagaggggagaaacagaccaucacgcgguuagucgcgguagugcgaaacugcguugguucguagagcgcaauuuaguuacaccugaggggaaggucguggaucuuggaugcggacgugggggauggucauacuauugcgguggccucaaaaauguaaaagaagucaaaggcuuaacaaaaggaggaccuggacaugaagaacccaucccuaugucuacauacggcuggaauuuaguacgccuacaaaguggaguagacguauucuuuacuccacccgaaaagugcgauacucuacugugugauauaggcgaauccagucccaauccaacagucgaagcaggaagaacacuacgagucuuaaacuuaguugaaaauugguuaaacaauaauacacaauucugcauuaaaguauuaaauccauacaugccaucagugauugaaaagauggaagcacuacaaaggaaguacgggggcgccuugguaaggaauccuuuaucgagaaauucuacacaugagauguauuggguuagcaaugcuagcggcaauauugugaguagcguuaacaugauaucaagaaugcugauaaacagauuuaccaugcgccacaagaaagcaacauacgaaccugauguugauuuaggaaguggaacaagaaauaucggcauagaaucugagauaccaaacuuggauauuauaggaaaacggaucgagaaaauaaaacaagaacaugaaacaaguuggcacuacgaccaagaucauccauacaaaacuugggccuaccacggcucauacgaaacaaaacagacaggaagugccagcucaaugguuaauggaguuguuagacuacugaccaaaccaugggacgugauuccuaugguaacacaaauggcaaugacggacacgacacccuuuggucaacaacgaguuuuuaaagaaaaaguagauacucgaacucaagaaccgaaagaaggaacgaagaaacuaaugaaaauuacugcagaaugguuguggaaagaauugggcaagaagaaaaccccgagaauguguacaagagaagaguuuaccaggaaaguaaggucaaaugcggcgcuaggcgcaauuuuuacagacgaaaauaaguggaaaucagcaagggaagcgguggaagacagcggauuuugggaauuaguagacaaagaaagaaaucuacaccuugagggcaagugcgaaaccuguguauauaauaugauggguaaaagggagaagaaacuaggugaauuugggaaagcuaaagguucacgugccauuugguauauguggcuuggggccagauuucuagaauuugaggcuuuaggcuuuuuaaaugaagaccauugguuuucuagagaaaacagccuuaguggcguugaaggagaggguuugcauaaacuagguuauauuuuacgcgaugucagcaaaaaggaagguggggcuauguaugccgacgacacagcagguugggauaccagaauaacguuggaagaccucaaaaaugaggaaauggucacaaaucauauggaaggagaacacaaaaagcucgcugaagccaucuuuaaauuaacauaucaaaacaaaguaguucguguacagagaccaacgccucguggaacgguuauggacauaauaucaagaagagaucagagagggucugggcaaguaguuaccuacggccuuaauacuuucacaaauauggaagcucagcuaauuagacagauggaaggagaaggaguauucaaauccauacaacacuuaacaguuacugaagagauagcggucaaaaacuggcuggcuagaguaggucgagaaagauuaucuaggauggcuaucucaggugacgauuguguaguaaaacccuuagacgacagguuugcaucggcauuaacugcacuaaacgacauggggaaagugcgcaaagauauacaacaaugggagcccucacguggcuggaacgauuggacgcaaguuccuuuuugcagccaucacuuucacgaguuaauuaugaaggacggaaggguauuggugguucccugcagaaaucaagaugaauugaucggcagagcaagaauuucacaaggggccggauggucacuuagggaaacugcuuguuuagguaagagcuacgcucaaauguggaguuuaauguauuuucaccguagagauuuacgucuugccgccaacgcgauauguuccgcaguuccgagccacuggguucccaccucacgaacuacauggucuauccaugcuacacaugaguggaugacgacugaagauaugcuaacuguuuggaaccguguauggauacaagaaaauccauggauggaagauaaaacaccugucgaaucgugggaagaaauaccauauuuaggaaaacgcgaagaucaauggugcgguucacuuauaggucucaccucaagagcuacgugggcgaaaaauauucaaacagcuauuaaucagguuagaucacuuauugguaacgaagaguauacagauuauaugcccagcaugaagagguuuaggcgagaagaagaagaagcugggguacuaugguga

SEQ ID NO: 22166 - RNA, 9876 nt, Artificial Sequence
  derived and/or modified CDS sequence (opt6) from DENV-2__AB189123__SS-prME
acugcagggguaauaauaaugaugauuccuacaguaauggcauuccaucuuacaacgcgaaauggggaaccucacaugauagugucacgccaagaaaaaggcaaaucguuguuauucaaaacggaaaacgguguuaacaugugcacccugauggcaauggaccuuggagaacuuugugaagauacuauuacguacaauugcccacuuuuaaggcaaaaugaacccgaagacauugauuguugguguaauucaacaucgaccuggguuacauauggaacuugcacugcuacaggggagcaccgccgagaaaaacgcagcguagcuuuagcaccucauguggggaugggguuagaaaccaggacugagacguggaugagcucugagggugcauggaaacacgcacaaaggauagaaaccuggguacuucgucacccagguuucacaauuauggcugcaauccuagcuuacaccauuggcacgacauacuuccaacgaguacucauauuuauacuucuaacagccguagccccaagcaugaccaugcgcuguauaggcauuagcaaucgagauuucguagagggcguaaguggaggcaguuggguugauaucgucuuggaacauggaaguuguguaacaacgauggcuaaaaacaaaccaacuuuggauuuugaacucauuaaaacugaggccaaacaucccgcaacuuugcgaaaauacuguauagaagcaaaacucacgaauaccacaacugcuucacgaugcccaacacaaggugaaccaucauugaaugaagaacaagauaaaagauucgucugcaaacauucaaugguagacaggggauggggaaauggauguggacuauuugguaaaggagguauuguaacaugugcgauguuuaccuguaagaaaaauauggaagguaaaguuguacaaccggagaaucuagaauacacgauugucauaaccccgcacaguggagaagagaaugcuguagguaacgauacuggcaaacacggaaaagaaauaaaaguaacuccacaauccuccauaacagaggcugaauuaacuggauacggcacaguuacuauggaaugcucaccaagaacggggcuagauuuuaaugaaaugguacuuuugcaaauggagaauaaggcuuggcuuguccaucgacaaugguuccucgacuuaccucuuccuuggcuaccgggggcagacacucaagguucaaauuggauccagaaagaaacucugguaacuuuuaaaaauccacaugcaaagaaacaagauguaguaguucuagguagccaagaaggugcaaugcacacggcacuuacuggagcaaccgaaauucaaaugucuaguggaaaucuauuauuuacgggccaucuaaaaugucggcuacggauggauaaauuacaauuaaaagguaugucguauucaauguguacuggaaaauuuaaaguagugaaagagauagccgaaacccaacauggcacuauaguaauucgaguacaauaugaaggugacggaagcccaugcaaaauaccuuuugaaauaauggaccuugagaaacgacauguacuagguagauuaauuacuguaaacccgauaguaacagagaaagauaguccaguaaacauugaagccgagccgccauucggcgauuccuacauuauaauuggaguagaaccaggucaacuaaaacuaaacugguuuaaaaaggguaguaguauuggucaaauguuugaaaccacuaugaggggagcuaagaggauggccauucuaggggauaccgcaugggauuucggaucauugggcggagucuuuacuucaaucgguaaggcccuacaccaaguguuuggagccauuuacggagcagccuucagcggaguaucauggacuaugaaaaucuugaucgguguaguuauuacauggauuggcaugaacucuagaaguacaucucuaaguguaucucucguacucguugguguugugacacucuaucuaggggucaugguacaagcagacagcggcugugucgucaguuggaaaaauaaggaguuaaaaugcgguuccgggauauucaucacggauaacguacauaccuggacugaacaguacaaauuccaaccagaaagcccuucuaagcuagcuagugcaauacaaaaggcacaugaagaaggaaucugcggaauaagaaguguaacccguuuggaaaaucuaauguggaaacagaucaccccagaauuaaaucauauuuuaucagaaaacgaaguaaaacuuacuaucaugacaggagacauuaaggguaucaugcaagcugguaaaagaaguuuaagaccacagccaacugaguuaaaauacucauggaaggcuugggguaaagccaaaaugcuaucuaccgaauugcacaaucacaccuuuuugauugauggaccugaaacagcagaaugcccaaauaccaauagggccuggaacuccuuagaaguagaagacuaugguuuuggaguauuuacaacgaauauauggcugaaacuaaaagagcggcaggacguuuucugcgauucgaaguuaaugagcgcagcgauuaaggauaacagggcaguacacgcagacaugggauauuggauugaaucugcgcugaacgauacuuggaaaauugaaaaagccucauuuaucgaaguuaaaucaugucacuggccuaagucucauacguuauggagcaauggaguucucgagagugaaaugaucauaccuaaaaauuucgcagggcccgugucacaacacaauuauagaccaggauaccauacccaaaccgcugggccuuggcaucuagguaaauuagaaauggauuuugauuucugcgaaggaacaacuguaguaguuacugaagauugcgguaaucgaggaccaucauuaaggacaacuacagccagcggaaaauugauaacugaauggugcuguagaucuugcacucugcccccauuaagauauagaggugaagauggcugcugguacgguauggaaauacggccuuugaaggaaaaagaagaaaaucuaguaaauaguuuaguuacagcaggccauggacaaauagacaauuuuucucugggcguucuuggaauggcguuauuuuuagaagagaugcuccggacaaggguggggacuaaacacgcaauacuccucguggcuguaucauucguuacacucauuacaggaaacaugucuuuucgugauuuaggaagaguuaugguuaugguaggugcaacaaugacggaugauauaggaaugggggugacguauuuagcauuacuagccgccuucaagguucguccuacuuuugccgcuggccugcuuuuaaggaaacuuacaucuaaagaacuuaugaugacaacaauuggcauuguacucuuaagucaaagcaccauacccgaaacaauacuagaauuaacugacgcacuagcacuugguaugaugguucuaaaaauuguaagaaacauggaaaaauaccaacuagcaguuacaauaauggcaaucuuauguguaccaaacgcaguaauacuacaaaaugcauggaagguaagcuguacgacucuugccgugguguccguuaguccauugcugcuaaccaguagucaacagaaagcagacuggauaccacucgcguugacaauaaaaggauuaaaccccacugcaauauuucuaaccacgcugaguaggacaucaaagaaaagaucauggccacuaaacgaagccaucauggcuguuggaauggucucaauuuuagcuagcucauuguuaaagaaugauaucccaaugacuggcccauuaguugcgggcggguuguugacaguauguuauguacucacuggacguuccgccgaccuugaacuagaacgugccgccgauguuaggugggaggaacaggcugaaauaucagguucuucuccuauucucucgaucacuauuucugaagaugguucaaugagcauuaaaaaugaggaagaagaacagacacucacaauccuaauuagaacugguuuauuggucaucuccggucuauuccccgugagcaucccaauaacagcagcagcaugguacuugugggaagucaagaaacaacgagcaggagucuugugggauguaccgagcccgccacccguuggcaaagccgagcuugaggacggagcguaucgaauuaaacagaaagguauauuaggauacucacaaauuggugcuggcguauauaaagaagggaccuuucauacgauguggcacguaaccagaggagcaguacuaaugcacaaagguaaaagaauagaacccagcugggcugaugucaagaaagauuuaauuagcuaugguggagguuggaaacuagaaggugaauggaaagaaggggaagaaguacaaguauuagcacuugaaccaggcaaaaacccgcgcgcuguacagacuaagccaggcuuguucaagacuaauacggggacuauuggagcagugaguuuggauuucaguccuggcacuagcgggaguccgauuguagacaagaaaggaaaaguaguagguuuauaugggaauggaguagugacacggucugguacauacguuagugcaauugcucaaacagagaaaaacauagaagacaaccccgaaauugaagaugacauuuuccgcaagaaaaggcuuacuaucauggacuugcaucccggagcagggaaaacaaaacguuacuugccagcaauaguaagggaagccauuaaacgaggacuucgcacgcuaaucuuagccccaacacguguuguggccgcugaaauggaagaagcguuaagaggcuugccuauucgauaucaaacaccagcaauuagagccgaacacacgggcagagaaaucguagaucuaaugugccacgcaacguucacaaugagauuguuaagcccaauacgggucccaaacuacaacuuaauaauuauggacgaagcucauuucacugacccugcuaguauagcugcgagaggcuauauaucaacuagaguggaaaugggugaagcugcaggcauauucaugaccgcaacuccuccggggucuagagaucccuucccucagagcaaugcuccuauaauggacgaggaaagagagauaccugaaagaucguggaacaguggacaugaaugggugacagacuucaaagguaaaacaguaugguuuguuccaucaaucaaggcugguaacgauauagcagcaugcuuaaggaaaaauggaaagaaagucauacaacuaaguagaaaaaccuucgacucagaauacauuaagacgagaacgaacgauugggacuucgucguaacaaccgacauaagugagaugggugcaaauuuuaaagcagaacgaguaauagacccacgaagauguaugaagccgguaauucuaacagauggggaagaaagggugauuuuagcagguccuaugccgguaacacacucaauagcagcacaaaggcgagguagaguuggacgaaacccuaaaaacgagaacgaccaauacauauauaugggcgaacccuuagaaaaugaugaggauugugcucacuggaaagaggcuaagauguuacuagauaauaucaauacgccugaagguaucauaccaucuauguucgaaccggaacgggaaaaaguugaugcaauagauggcgaguaucguuuaagaggugaggcccguaagacauuuguggacuuaaugcgccgaggagaucugccaguaugguuagcauauagaguagccgcugaagguaucaauuaugcugaccguagaugguguuuugacggcgucaaaaacaaucagauacuagaagagaauguagaaguugaaaucuggacuaaagaaggagaacgaaagaaacuaaaaccacguugguuggaugccagaaucuacuccgacccccuggcccuaaaagaauuuaaggaauuugccgccggaagaaaaagccuaacucuaaacuuaauaaccgaaaugggaagauuaccuacauucaugacccaaaaagcaagaaaugcacuugauaacuuagcagucuuacauacagcugaggcaggaggucgcgcuuauaaccaugcacuaucugaguuaccagaaacuuuggaaacgcuguuauuauugacacuucucgcuacaguaacaggaggcauauuccuguucuuaaugagcggaaagggaauaggaaaaaugacguuagguauguguugcauaauaacugccaguguauuacuaugguacgcccaaauucaaccacauuggauagcugccucaauaauauuggaauuuuuccuaauaguuuugcugauaccagaaccagaaaaacaaaggacaccccaagauaaucaacuaacauauguaguaauugcgaucuuaacaguuguggcagccacuauggcuaaugaaaugggauuuuuagagaaaacgaaaaaggauuuuggauuggggucuauugcaacacaacaacccgaaucaaacauauuggauauugauuuaagaccggcgagugcuuggacucuuuaugcaguugcaacgacauuuauaacgccgaugcuucgccauucgaucgagaauaguagcguaaaugugagcuuaacggcgauagcgaaucaagcuacaguauugaugggauuaggcaagggguggccauuaagcaaaauggauauaggaguaccacuguuagccauugggugcuauucucaagugaacccgaucacccucacugcugcacuauuguuacuugucgcccauuacgcuauaaucgggccagguuuacaagcgaaagccacgagggaagcgcaaaaacgugcagcugccggaauaaugaaaaacccaacaguagauggcauaacagucauugacuuagaucccauaccauaugaucccaaauucgaaaagcagcuagggcaaguaauguuauugguacuuugcguaacacaagucuuaaugaugagaacuacuugggccuuaugugaagcucuaacauuagcuacugguccaauaagcacacuaugggaagggaauccugguagauuuuggaauacuacuaucgcggucuccauggcaaauauuuuucgggguuccuaucuagcgggugcaggacuguuauuuuccauaaugaagaacacugcaaauacuagacgagggacagguaacacaggugaaaccuugggcgaaaaguggaagaaucgauugaacgcccuugggaaaucagaauuucaaauuuauaagaaaucagguauucaggaagucgaucguacucucgcuaaggaaggaauagaacgaggagaaacagaccaucaugcugugucucgggggucagcaaaauugcggugcuuuguugaaagaaaucuaguaacaccugagggaaagguaguagauuugggaugugggcgaggugggugguccuacuauugugguggacugaaaaauguaaaagaaguuaaaggucucacaaaaggagguccaggacaugaggagccgaucccgaugagcacuuaugguuggaaccuagugagacuacagucaggugucgacguguuuuucacgccgccagagaagugugauacgcuucugugcgauauuggugaaagcaguccgaauccuaccguggaggcuggcagaacauuacguguauuaaaccuuguagaaaauuggcucaaaaauaauacacaauuuugcauaaaggugcuaaauccuuauaugcccucaguuaucgagaaaauggaagcccuacaacgcaaguacggcggugccuuaguucggaauccgcugagucgaaacaguacucaugaaauguauuggguuagcaaugccaguggaaauaucgucagcaguguaaauaugaucagcagaauguugauaaaccgcuucacgaugcgccauaagaaagcuaccuacgaaccagauguggaucuuggcucgggaacaagaaacauugggauugaaagugaaaucccgaauuuagacaucaucgggaaacgaauagagaaaauaaaacaagaacaugaaaccaguuggcacuacgaucaggaucacccauauaagacuugggccuaucauggaucguaugagacuaaacaaacaggaucggcaagcaguaugguaaaugggguuguccgacucuuaacaaaaccgugggaugugauaccgaugguaacacaaauggcgaugacggacacaacacccuuuggacaacaaagaguuuucaaagaaaaaguagauacaagaacgcaagaaccuaaggaaggaacuaagaaauuaaugaagauuacagcagaaugguuguggaaagaauuagggaagaaaaagacaccaaggauguguacuagagaggaauuuaccaggaaaguucguaguaaugcggcacuaggagcuauuuuuacugaugaaaauaaauggaaaucagcucgggaagcgguagaggacaguggcuuuugggaauuaguagauaaggaaagaaaucuacaucucgaaggaaaaugcgagacuugcguauauaauaugaugggaaaaagggagaagaaauuaggggaauuuggcaaagcaaaagguucucgggcgauaugguacauguggcucggggccagauuuuuagaguuugaggcuuugggcuucuuaaacgaagaccauugguuuagccgagaaaauucccuaaguggagucgaaggagaagggcuacauaaauuaggcuauauauuacgggauguuagcaagaaagaggguggagcaauguacgcagacgacacugcgggcugggacacacggauaacgcuagaggaucuuaaaaacgaggaaauggucacaaaucacauggaaggcgaacauaagaaacuugccgaagcaauauuuaaacuaaccuaucaaaauaaaguagugagaguacaaagaccuaccccacgagguacgguguuagauauaauaagccgccgagaccagagaggaucaggacagguggugacguauggauuaaauaccuuuacaaauauggaagcgcaauugauucgucaaauggaaggcgagggaguauucaaaagcauccagcaccuuacuguaacugaggaaaucgcaguuaaaaauugguuggcacgaguaggaagggaacgcuugagccgaauggcuaucucgggugacgacugcgucgucaaaccacuggacgaucguuucgcuucugcccuuacugcucuuaacgauaugggcaaaguucgaaaagauauucaacaaugggagccgagucggggauggaaugauuggacucagguaccauuuuguagucaucauuuccaugaauuaauaaugaaagacggacgcguauuaguaguacccugucggaaucaagacgaauuaauagguagagcuagaauuucccaaggcgccggcuggucuuuaagagaaacagcuugucuaggaaaauccuacgcacagauguggucacuuauguauuuccaucgcagagaccuaagacuggccgcaaaugcaauauguagugcaguaccuagucauuggguuccaacaucucggacaacauggagcauccacgcgacacaugaauggaugacaacggaagauauguuaacuguguggaaucguguauggauacaagagaacccguggauggaggacaaaacaccaguagagucaugggaagagauaccuuaucucggaaaacgugaagaucaauggugugggucuuugauaggcuuaacgucgcgugcgaccugggccaaaaacauccagacagcaauuaaucaggucagaucucuaauuggaaaugaagaauacacagacuacaugccuucgaugaaaagauuccgccgcgaggaagaagaagcaggagugcuuugguaa

SEQ ID NO: 22167 - RNA, 9876 nt, Artificial Sequence
  derived and/or modified CDS sequence (opt6) from DENV-2__AB189124__SS-prME
acagcuggaguaauaauuaugaugauaccuacgguaauggccuuucauuuaacgaccagaaauggagaaccacauaugaucguuucaagacaggagaaagguaaaucacuccuuuuuaaaacggaaaauggggucaauaugugcacguugauggcuauggaccuaggcgaacuuugugaagauacaauuacauauaacuguccucugcuuagacagaaugaaccagaagauauugauuguugguguaacucaacgagcacguggguaacguacgguacauguacugcaacgggagaacaucgccgugaaaaaaggucuguugcuuuggcuccccauguaggaaugggacucgaaacuagaacagaaacauggaugagcagugagggggcauggaagcaugcucagcguaucgagacauggguauugcgccacccgggguuuacaauuauggcggcuauucuugcauauacuauagguacaacauacuuucagagaguucugauuuucauccuauugaccgcaguagccccgucgaugaccaugcgcuguauaggaauaucgaaucgcgacuuuguagagggcguuaguggugguuccuggguggacauuguacuagaacacggaucuugcguaacaacuauggcuaaaaauaaacccacgcuugacuuugaacuaauaaaaaccgaagccaagcaucccgcaacacuaagaaaauauugcauagaggcaaaacuuacgaacacaacaacugccucgaggugcccaacgcaaggagagccaucauuaaacgaagaacaagacaaaagauucguaugcaaacacucuaugguugaucguggaugggguaacggauguggucuauuuggcaagggugggauaguaacuugcgcgauguuuacauguaaaaaaaacauggaggguaaaguaguucaaccugaaaauuuagaguacaccauagugauaacaccgcacuccggugaggaaaaugcuguugggaacgacacuggaaagcacgguaaggaaauaaaaguaacuccccagagcuccauaaccgaggcugaauuaacaggcuacggaacaguuacaauggaauguucgccaagaacaggcuuagauuucaacgaaaugguacuguugcaaauggaaaauaaagcgugguuaguacacagacaaugguuuuuagacuuaccacuacccuggcuccccggcgcugacacacaggguucaaauuggauucaaaaagaaaccuugguuacauuuaaaaauccacacgcgaaaaaacaagacguugugguacuugggagccaagaaggugcgaugcauacagcguuaacuggcgcaacagagauacaaaugucaucaggaaacuugcucuucacuggacaucuaaaaugccgguugagaauggacaaauuacaauuaaaagguaugucuuauagcauguguacuggaaaauuuaagguagugaaagaaaucgcugaaacacaacacgggacgauugugauuagaguccaauacgaaggcgaugguaguccuuguaagauccccuucgaaauaauggauuuggaaaaaagacacguauuaggaaggcuuauaacugucaacccaauaguaacugaaaaagacucuccuguuaauauugaagcugaaccuccguuuggugauuccuacauuaucaucgggguagaaccaggacaauuaaaacuaaacugguuuaaaaaaggaucaucuaucggacaaauguuugaaacaacaaugagaggggccaaaagaauggcuaucuuaggcgacacagccugggauuuuggaagcuugggaggcguuuucacaucgauugguaaggcacuccaucaaguauuuggagccauauauggugcugccuucucugguguguccuggacaaugaaaauacuuauaggcgucgucaucaccuggauuggcaugaacagccguagcacaagcuugucaguuagucuagucuuagucggugucguaacucuauaucugggcguuauggugcaagcugauaguggguguguaguaagcuggaagaauaaggaauuaaaaugugguagcgggaucuucauaaccgauaauguacauacguggacagaacaauacaaauuucagcccgaaucuccuagcaagcuagccucagcgauacaaaaagcacaugaagaaggaauaugugguauuaggucgguaacaagacuggaaaauuuaauguggaagcaaauuacucccgaguuaaaucacauacuaagugaaaacgaaguaaaguuaacgauaaugacgggggacaucaaaggaauaaugcaagccggaaagcguaguuugcggccucaaccaaccgaguugaaguauaguuggaaagcuugggguaaagcaaaaaugcugagcacagaacuacauaaccacacauucuuaauugacggaccagaaacagccgaaugcccaaacaccaaucgagcuuggaacaguuuagaaguagaagauuacggguucggaguauucacuacuaauaucuggcuuaaacucaaagaaagacaagauguauuuugcgauucaaagcugauguccgcggcgauuaaagacaacagagcuguccaugccgauaugggauauuggauagagucagcacuaaaugacacuuggaagauugagaaagccucauuuauugagguuaaaucaugucacuggccaaaaagucauacauuauggagcaacggugugcuagaaucugaaaugauuauaccuaagaacuucgcugggccggucucgcaacauaauuacagacccggguaucauacucagacugccgguccauggcacuuaggaaagcuagaaauggauuuugauuuuugugaaggaacaacuguggucgucacugaggauugugguaaccggggucccucacuacgaaccacgacagcgucaggaaaguuaauuaccgaguggugcugccgcucauguacucucccuccacuaagauaccgaggggaagaugguuguugguaugguauggaaaucagaccccuuaaagaaaaggaagaaaacuuagugaacagcuuggugacugccgggcauggccagaucgacaacuuuucacuuggaguuuuaggcauggcuuuauuuuuagaagagauguugcgcacuaggguugguacuaagcaugcaaucuuguuaguggcagugucauuuguuacgcugauuacuggaaauaugucuuuucgcgauuugggacgaguaauggugaugguuggagcuacaaugacagacgauaucgggaugggcgugacuuaucuagcuuuauuagcggcguuuaagguaagaccaacauucgcagcaggguuacuguugcgaaaauugaccagcaaggagcuaaugaugacaacuauagguauuguuuuauuaucucagucuacaauaccugaaacaauacuagaacuuacagaugcccuggcguuagguaugaugguacucaaaaucguaaggaauauggaaaaauaccaacuugcgguaaccauaauggcuauucuguguguaccuaacgcaguuauacuucaaaaugccuggaaaguuucaugcacaacuuuagcgguaguaaguguaaguccauugcuuuuaaccagcucccaacagaaagcugauuggauaccuuuagcucucaccauaaagggucuaaauccaaccgccauuuuccucacgacgcuuaguagaacaaguaagaaacguagcuggccacuuaacgaagcgauaauggcagucgguauggucaguauacuagcauccucacuuuuaaaaaaugauauaccaaugacuggcccuuuaguagcagggggauuacuaacuguaugcuauguacucacagguagaucagcagaccuagaacucgaacgggcugccgauguaagaugggaagaacaagcagaaauaucagguucuagucccauccugucuaucacaauaagcgaagacggguccauguccauuaaaaacgaagaggaggaacaaacucugacgauucuuauuagaaccggacucuuaguuauaucaggacuauucccaguauccauaccaauaacagcggcggcgugguaccuaugggaggugaaaaaacaacgggcaggagugcuuugggauguaccaucaccuccgccuguagguaaagcugaacuagaagacggugcauaccgaauaaaacagaaaggaauacuagguuauagucaaaucggagcaggaguauauaaagaaggaaccuuucauacaauguggcacgugacacgcggagccguauugaugcacaaaggaaaacgcauagaacccaguugggcugacgucaaaaaagauuuaauuaguuacggaggcgguuggaaguuagaaggugaauggaaagaaggagaagaagugcaaguuuuagcacuagaaccgggcaagaacccgcgagcagugcagacaaaacccgggcuauuuaaaacuaauacaggaacuauaggcgccgucucccuugauuucaguccagguacuucaggcucuccuauaguggacaaaaagggaaaaguggucgguuuguaugguaauggggugguuacgcgcaguggaacuuauguuagugccauagcacagacugaaaaaaauaucgaagauaaccccgaaaucgaagaugacauauuuagaaaaaagagguuaaccauaauggacuugcaucccggggcugguaaaacuaaaagauaccuaccagcaauagucagagaggcgauuaaacgaggacuaagaacuuuaaucuuggcaccaacgaggguagucgccgcagaaauggaagaagcccucagagguuuaccgauuagauaucaaaccccagcuauaagagcagaacauacaggacgcgaaauuguggacuuaaugugucaugcaacuuucacgaugcgauuauuaucuccaauuagaguaccuaauuacaauuuaauaauaauggacgaggcucauuucacugauccagccucgaucgcagcaagaggguauauuaguacucgaguugaaaugggugaagcagcaggcaucuucaugacagcaacgccuccagggagcagagauccguuuccacagucaaaugccccuauuauggacgaagaacgugaaauaccagaacguagcuggaauucaggacacgaauggguaacagacuuuaagggcaaaaccgucugguuuguaccaucgauuaaagcaggaaacgacauagcugcaugcuuacgaaagaaugggaaaaaaguuauacagcucagucgaaaaacuuuugacuccgaauauauaaaaacaaggacaaaugauugggauuuugugguaacaaccgacauaucggaaaugggcgcaaauuuuaaagcugaacgagugauugauccacgccgcuguaugaaaccuguaauacuaacggacggagaagaacgagucauacucgcaggaccaaugccugugacgcauagcucagcagcucaaagacguggucgugugggacguaauccuaaaaaugagaaugaccaguauaucuacaugggcgagccacuugaaaacgacgaagauugcgcucacuggaaggaggcaaaaaugcuauuagauaacauaaauacacccgagggaauuauaccaucgauguucgagccugaacgugaaaagguagaugcgauugauggggaguauagacuccguggggaagcaaggaaaacauucguggauuuaaugagaagaggagaccugccaguaugguuagccuauagaguugcagcagaagggauaaauuaugcagaucgccgcuggugcuuugauggagugaaaaacaaucaaauacuugaagaaaauguagagguagaaauauggacuaaagaaggugaaaggaaaaaauuaaaaccuagauggcuagaugcaaggauauauucagacccauuagcccuaaaagaauuuaaagaauucgcggcugggcgaaaaagucuuacuuuaaacuuaauaacugaaauggguagacuaccaacuuucaugacacaaaaagccaggaaugcgcucgauaaccuagcggugcuacauacagcugaagcuggaggacgcgccuauaaucaugcgcuaagcgaauuaccggaaacgcuagaaacacuacuucuacuaacgcuauuagcgacaguaacgggaggaauuuuuuuauuccuuaugucaggaaaaggaauagguaaaaugacacuggggaugugcugcauaauaacugcuuccguccuauuaugguacgcccaaauacagccacacuggauugcagcuucaauuauuuuagaauuuuuucucauuguacugcuuaucccagagcccgaaaaacaacgaacuccgcaggacaaucagcuaacauacguaguaauugccauauuaacgguaguugccgccacaauggcaaacgaaauggguuuccuugaaaagacgaaaaaagauuucggauuaggcagcauugcgacacaacaaccggaaaguaauauacuagacauagauuuaagaccagcgagugcauggacuuuauaugcgguugccaccacauuuauaacacccauguugagacauucuaucgagaauucaucaguaaacguaucucucaccgcaauagcaaaccaagccaccguacuuaugggauuaggaaaaggguggccacuauccaaaauggauauaggggucccacuguuggcaauuggguguuauagucaaguuaauccuauaacuuugaccgcugcuuuacuccuauuaguggcacauuacgcaauaaucgguccaggacuacaagcuaaggcgaccagagaggcgcaaaaacgcgccgccgcggggauuaugaaaaauccuacggucgacggcauuaccgucauugauuuagauccuauccccuaugaucccaaguucgaaaaacagcugggucagguaaugcuacuaguacucugugugacgcaaguacuaaugaugcgcacaacaugggcacuuugcgaagcucucacacuagcuaccggcccuauaagcacgcugugggaaggcaauccgggacguuuuuggaacacaacuauagcgguaucaauggcuaauauuuucagaggauccuaucuggccggagccgguuuguuauuuucaaucaugaaaaacaccgcaaauacgcgaagaggcacagggaacacuggagagacacuaggggagaaguggaaaaacagacugaaugcacuagggaaaucagaauuccaaauuuacaagaaaaguggaauacaagagguugacaggacccuagcaaaagaagguauagaaagaggagaaacagaccaucaugcgguaucgcguggauccgcaaaguuaagaugguuuguugaacgaaauuuaguaacuccagaagguaagguaguggaucucggauguggacgaggaggguggucguacuacuguggaggguugaagaacgucaaagaaguaaaaggcuuaacaaaagguggcccagggcacgaagaaccaauacccaugaguacauauggguggaaucuuguuagacugcaaucuggcgucgacguuuuuuucacgccacccgaaaagugugauacacuguugugcgacaucggugagagcucaccgaauccgacgguagaggcagguaggacgcuacgaguacuuaaccuagucgaaaacugguuaaaaaacaauacacaguuuugcauuaaaguuuuaaaucccuauaugcccucuguaauagaaaaaauggaggcauuacagagaaaauacgggggcgcacucguacguaacccauuaucuaggaacagcacccaugaaauguacuggguaaguaaugcaaguggcaauauagucucuucaguaaauaugauaucacgaauguugauaaaucgguuuacgaugcggcauaaaaaggcuacuuacgaaccagauguagacuuaggaucuggaacaaggaacauaggaauagaaucggaaauuccuaaucuagacauaaucggaaaaagaaucgaaaaaauuaaacaggagcaugaaacaagcuggcacuaugaccaagaucacccauacaaaaccugggcauaucacgguaguuacgagacaaaacaaacugguucggcgaguucaaugguaaacggugucguuagauuauugaccaagccaugggaugugaucccaaugguuacucagauggcaaugacagacaccacccccuuuggacaacaacggguuuuuaaagaaaagguugacaccagaacccaagaaccuaaagaaggaacuaaaaaguuaaugaaaaucaccgcugaauggcuauggaaggaauugggaaaaaagaaaacaccaagaaugugcacaagagaagaauucacuagaaagguaagaagcaaugcugccuugggagcuaucuuuaccgacgaaaacaaauggaaauccgcuagagaggcagucgaggauaguggguuuugggaacuagucgacaaagaacgaaaccuucaccuggaagguaaaugcgagacuuguguuuacaauaugauggguaaacgagaaaaaaaacuaggcgaauuuggaaaagcaaaagggucuagggcaaucugguauaugugguuaggagccagauuuuuggaauuugaagcguuagguuucuuaaacgaagaccauugguuuaguagagagaauucauugagcgguguagaaggugagggguugcauaaauugggcuauauuuuacgugacguaucuaaaaaagaggguggugcaauguacgcugaugauacagcggggugggacacccguauaacacuggaagaucuaaaaaaugaagaaauggucacgaaccacauggaaggagagcauaaaaaacuugcagaagccauuuuuaaacugacguaucaaaauaaaguuguaagagugcaaaggcccacaccaaggggcacggugauggauauuauaagucggagggaucaacgagggagcggccagguagugacuuaugggcuaaauacauuuacgaauauggaagcacaguuaauaaggcaaauggaaggagagggcguauuuaagaguauacagcacuuaacgguuacagaagagauugcggugaaaaauugguuagcuaggguuggaagagagcgguuaucaagaauggcuaucuccggagaugauuguguugucaaaccccuagaugauagauuugccuccgcacucacagcacuaaaugauaugggaaagguaagaaaagauauccaacaaugggagccaucacggggcuggaaugauuggacucaagucccauuuugcagccaucauuuccaugaauuaauaaugaaagauggucgaguuuuaguaguaccuugcagaaaucaagacgaguuaauaggacgagcacgaaucucacaaggugcuggcuggucuuuaagagaaacugcuuguuuaggaaaaucauaugcucaaauguggaguuuaauguauuuucaucgacgagaccuuagacuagccgcaaaugcuauaugcagcgcaguaccaucucauuggguccccacauccagaacaacuuggaguauucacgcaacacaugaauggaugacaaccgaggauauguugacgguauggaacagaguauggauucaagaaaauccguggauggaagauaaaacucccguagaauccugggaggaaauaccguaucuaggaaaaagagaagaucaauggugugguaguuugaucggacugacuagccgugccacgugggcaaaaaauauccaaacagcaauaaaucaaguucgcucacuaauaggaaaugaggaguauacggacuauaugccaucaaugaaacguuuuagacgugaagaggaagaggccggagugcuuugguaa

SEQ ID NO: 22168 - RNA, 9876 nt, Artificial Sequence
  derived and/or modified CDS sequence (opt6) from DENV-2__AB122020__SS-prME
acagcaggcguuauagugaugcucauaccaacagcuauggcuuuucauuugacaacuaggaauggggagccacacaugauaguuggaaggcaggaaaaaggaaaaucauuacuuuucaaaacagaagauggcgucaacauguguacauuaauggcgauagauuuaggcgaacuuugugaagauacaauuacguauaaauguccccuacuucgccagaaugaaccugaagauauagacuguugguguaauucaacuucuacaugggucaccuacggcacaugcaccacuacgggagaacauaggagggaaaaacgaucugucgcacugguuccacauguaggcaugggucuggagacacgcacggaaaccuggauguccucagaaggugcauggaagcacguacaaagaaucgagaccuggauauuaagacauccugguuuuacuaucauggcggcaauacuagcauacacaaucgggaccacucacuuucaacgagcuuugauauuuauauuauuaaccgcuguagcuccgucaaugaccaugagauguaucggaauaucuaaccgcgauuucguagaggggguaaguggagguucguggguagacauaguucuugaacaugggaguuguguaacuacgauggcaaagaauaaaccgacacuagauuucgagcugauuaaaacagaagcuaaacaaccggcaacauuaagaaaguauugcauugaagcgaaguuaaccaacacuacuacugagagucgcuguccuacacaaggagaacccucauugaacgaagaacaagacaaacgauuuauauguaagcacucaaugguagaccgagggugggggaacggaugcgguuuauucggaaagggugggauugucacaugcgcgauguucacaugcaaaaagaauauggagggaaaaauaguucaaccagaaaaucucgaauacacaauaguaaucacgccgcacagcggggaagaacaugcagugggaaaugauacugguaagcacggaaaagaaauaaaaauaacaccacaguccucgacuacugaagcagaacuaacaggauacggcaccguaaccauggaauguaguccgcguacaggccucgauuuuaacgaaaugguguuauuacagauggaagauaaagcgugguuaguucaucgccaaugguuuuuggaucuaccauuacccugguugccaggagcagauacacaagguucaaauuggauacaaaaagaaacacuaguuacauuuaaaaacccucacgcuaaaaaacaagauguaguugugcuaggcagucaagaaggagccaugcauacagcacugacaggagcgacagaaauucaaauguccucagguaaucuguuauucacagggcacuuaaaaugccgauugcguauggauaaguugcaacuaaaaggaaugagcuauucaaugugcacuggcaaauuuaaaauuguaaaagaaaucgcagagacucagcauggcacuauagucaucagaguucaauacgaaggggauggcagcccuugcaaaauaccauuugaaauuacugaccucgaaaaaagacaugugcuaggaagacuaauaacagucaacccaauuguaacagaaaaggacaguccuguuaauauagaagcugaaccgccuuucggugauagcuacauaaucguggguguagaacccggucaauuaaagcuuaacugguucaaaaagggaagcucuauagggcaaauguucgagacuacaaugaggggugcuaagcgaauggcaauccugggagacaccgccugggauuuuggauccuuggguggaguuuucacgaguauaggaaaggcauuacaccaagucuuuggugcgauuuauggggcugcguucucaggaguaagcuggacuaugaagauauuaauaggugucaucauaacauggaucggaaugaauagucgaaguacgucuuuaagcguuagcuugguucugguaggagucgucacacuuuaucuaggagcaauggugcaggcagauucagggugcaucguuucauggaaaaauaaagagcuaaaauguggaaguggcauauuuaucacagauaacguacauaccuggacagaacaauauaaauuucaacccgagagcccuucuaaauuagccagcgcaauacagaaagcacaugaagaaggaauauguggcauacgaagugugaccagacucgaaaaccuaauguggaaacagauaacaccggaacuuaaucauauacugucggaaaaugaagucaaacucacuauuaugacaggugacauuaaagguauuaugcaagccgggaaaagaucccuccguccacaaccaacggaauuaaaguauagcuggaaaacuugggggaaagccaaaaugcuuucaacugagagucauaaccaaacuuuucuaaucgacgggcccgaaaccgcugaauguccaaauacaaaccgagccuggaauagucuugagguugaagacuauggauucggggucuucacuacuaacauuuggcuuaaauugcgagaaaagcaagacguuuuuugugacucaaaacucaugucugcugccauuaaagacaaccgagcagugcaugcagacaugggauauuggauugagagcgcucuuaaugauacuuggaaaauggaaaaagcaucauuuauagagguaaagucaugucacuggccaaagucucauacauuauggagcaauggugugcuagaaucagaaaugauaauaccgaagaauuucgccgggccgguaucgcagcauaauuauaggccuggauaccauacacagacagccgggcccuggcaucuugguaaacuagaaauggauuucgacuucugcgaaggaacaaccguuguaguaaccgaggauugcgguaacagagguccgaguuuacgcaccaccaccgcuucuggaaaacuuauaacugaauggugcugcagaaguuguacuuugcccccucuacgguauagaggagaagauggauguugguauggaauggaaauucgcccgcuuaaggaaaaagaagaaaaucuugugaacucgcugguuaccgcaggucauggccagauugauaauuucucacuagguguacuaggaauggcauuauuuuuagaagagaugcuuagaacgcguguaggaacuaagcaugccauauuguuaguugccuuaucuuucgucacacuaauaacaggaaacaugagcuucagagaccuugggagggugaugguaauggucggagccacuaugacagacgauauagguaugggaguaacauaccuagcacuacuagcugccuuuaaagugaggccaaccuucgcagcuggccuacuauuacgcaaguuaacuucgaaagaacuaaugauggcaacuaucggcauugcguuacuuagucaaucuacucuuccagaaacaauucucgaacuaacagaugcauuagcacuagggaugaugguguuaaaaauaguaagaaauauggaaaaguaucaacuagcggucacgaucauggccauaagcugcguacccaacgcuguaauacuccagaaugcuuggaaagugucaugcaccauauuagcugcaguaucaguuucaccauuauuacuaacaucaucgcagcaaaaagcagauuggauaccauuagcacucacgauuaaagggcuaaauccaacggcaauauuuuuaacaacucuuagccgaacuagcaaaaaacguaguuggccgcuaaaugaagcuaucauggcagucgguaugguuagcauuuuagcaucuagucuauuaaaaaaugacaucccuaugaccggucccuuaguggcagguggacuuuugacgguuuguuacguauuaacuggcaggagcgcagaccucgaacuugaaagggcagcugaugugaaaugggaagaucaagccgaaauaagcggauccagcccuauccuuagcaucacuaucucagaggacgguuccauguccauaaagaaugaagaagaagaacagaccuugacuauauuaauccgaacuggauuauuaguaauaucggguguuuuuccugugaguauaccgauuacggccgcagcaugguaucuaugggaaguaaaaaaacaaagagcaggcguauuaugggauguaccuaguccucccccagucgguaaagcagaacuagaagacggugccuaucgaauuaagcagcgaggaauuuugggauacucccaaauuggggcagguguauacaaagaaggaacuuuucauaccauguggcacguaacacguggugcaguauuaaugcauagggguaagagaauagaaccaucaugggcagacguuaaaaaggauuuaauuagcuauggugggggauggaaacuugaaggugaauggaaagaaggugaagagguccagguauuagcauuagaacccggaaaaaacccgcgggcgguacaaacgaaaccagguauauuuaaaaccaacaccggaacaauaggagccgugagccuugauuuuaguccaggcacaagcgguaguccuauaguagaucgcaaagguaaagugguuggccuuuaugggaaugggguaguaacgaggucaggagcguauguaucagcuaucgcgcaaacagaaaaaaguauagaggacaaccccgagauagaggaugacauauuucguaaaaaacgccucaccauaauggauuuacauccgggggccggaaagacuaagcgcuaccuaccagccaucguucgagaggcgaucaaaagaggucuucguacacuuauucuagcaccaacacggguuguagccgcagaaauggaggaagcucuaaggggccuaccaauacguuaccagacgccggcaauacgagccgaacauacuggacgggaaauuguugaucuaaugugucacgccacuuucacaaugcgacuguuaucgccagucagaguucccaauuauaaccuaauaauaauggaugaagcccauuucacugacccagcaucuauagccgcaagaggauacauaucaacccgaguagaaaugggagaggcugcaggaaucuucaugacggcuacaccuccagggagccgagacccauuuccacaaaguaaugcuccaauaauggaugaggagagagaaauccccgaacguaguuggaauucgggucacgaaugggucacagacuuuaaaggaaaaacgguaugguuugugccaucaauuaaagcuggaaaugauaucgcagcaugccugaggaaaaauggaaagaaggucauacagcuauccagaaaaacuuuugauucugaauauguuaagacacgugcaaacgacugggacuuugucguuacaaccgauauauccgaaaugggagcgaacuuuaaagcggaaagaguaauagauccacguagauguaugaaaccaguuaucuuaacagauggagaggaacgagucauacuagcagguccaaugccggugacccacaguucagccgcacaaaggcgcggaaggaucggaagaaacccaaaaaaugaaaacgaucaguacauuuacaugggcgaaccucuagaaaaugacgaggauugugcccauuggaaagaagccaagaugcugcuagacaauauaaacacuccagagggcauaauaccaucaauguuugaaccggagcgggagaaaguugaugcuauagauggagaauaccgucuuagaggagaggcaagaaaaacauucguugaucugaugagacggggagaccuaccagucugguuagcauauaagguagcugcagaaggcauaaacuaugcagauagaaaauggugcuuugacggaauaaagaauaaucaaauacuugaagaaaaugucgaaguugagauuuggacuaaagaaggagaacguaaaaagcugaaaccaagaugguuggaugcucgaauauauagugacccucuggcguuaaaagaguucaaagaauucgcagcuggucgaaaaagcuuaacauugaaccugauuacugagaugggccgucucccuacguucaugacacagaaagcacggaaugcgcuagauaauuuagcaguuuuacacacagcagaggucggggguagagcauauaaucacgcauuguccgaauuaccagagacauuagaaacuuuguuguuacugacacuacuagcuacgguaaccgguggcauauucuuauuucuuaugucagggaaaggaauagguaaaaugacccuuggcauguguugcaucauaacugcaucuauccuucucugguacgcccaaauccaaccacacuggauugcagcgucaauaauacuugaguucuuucuaauaguacuuuuaauacccgaacccgagaaacaaagaaccccacaagacaaccaauugacauauguugucauagcaauauuaaccguaguggcagcaaccauggcaaacgaaauggguuucuuagaaaagacgaaaaaagaccuaggauuuggcaguauuacuacacaagaauccgagucaaacauacuagacauagaucuaagaccggcaagugcuuggacuuuauacgcaguggcuaccacauucguaacuccaaugcuuagacacucuauugaaaauaguagugucaauguuuccuuaacugcaauagcaaaucaagcgacaguauuaaugggccuaggaaagggcuggccgcuaucaaaaauggacauaggcguaccacuauuagcuaucgggugcuauucucaaguuaacccaauaacucuaaccgcugcucuacuauuacuaguggcacauuaugcgauuauagggcccggcuuacaagcaaaagcaacacgcgaagcccaaaaaagagcugcugccggaauuaugaaaaacccaacgguagacgguaucacgguuauagaccucgaacccauaccuuacgacccgaaauuugaaaaacaauuaggccaaguaauguugcuaauauuauguguuacgcaaguguuaaugaugagaacaacuugggcauuaugugaagcacuuacauuggcuacggguccaauaucgacauuaugggaggguaauccaggcagauucuggaacacaacgauagcaguuaguauggccaauauauuucgggguagcuauuuagcgggagcagguuuacuuuucagcauaaugaaaaauacgacuaacacgcgucggggcacgggaaacguuggcgaaacucucggcgaaaaauggaaaagccguuugaacgccuuaggaaaaucagaauuucaaauauacaaaaaaagcgggauacaagagguagauagaacacuagccaaggagggaauaaaacggggggagacagaucaccaugcagucagccguggcagugcuaaauugaggugguucguagagaggaauauggugaccccugaaggcaaaguaguagaucugggaugcggacguggaggguggucauacuacugcggggguuuaaagaaugucagggagguaaaagggcuaacaaaggguggacccggacaugaagagccaauuccaaugucaacauacggauggaaccugguucgcuugcagucggguguugaugucuuuuucacaccaccggagaaaugugauacguuauugugugacauaggagagagcucuccaaauccgacuauagaagcagguagaacauuacgaguccugaaucuagucgaaaauuggcuuaacaauaacacucaauuuuguauaaaaguucugaauccauauaugccgucugugauagaaaaaauggaaacacugcaacgcaaauacggcggagcuuugguccgaaacccacuuucacguaacaguacacaugaaauguauuggguaucaaaugccacuggaaauauaguuucauccgugaauaugauuaguagaauguuaauaaaccgguuuacaaugaaacauaaaaaagcuacuuaugagccugauguugaccuaggcagcggaacgaggaauauagguauugaaagugagauucccaacuuagauauuaucggcaagcgaauugagaagaucaaacaggaacaugaaaccucguggcauuacgaucaagaucauccauauaaaacgugggccuaucauggcagcuaugaaacgaaacagaccgguucagcguccaguaugguaaauggagugguacgacuucucacuaaacccugggacguaguucccauggugacacaaauggcaaugacugauacaacaccauucgggcaacaacgaguauuuaaagaaaagguugauacaagaacgcaggagccuaaagaggggacuaagaaacugaugaagauaacagccgagugguuguggaaagaacucggaaaggagaaaacaccucgaaugugcacacgggaagaauuuacgagaaaaguuaggucaaacgccgcuuuaggagccauuuuuacagacgaaaacaaguggaaaucagcaagggaagcgguugaagauggucgauuuugggaacuagucgauagagaaaggaauuuacaucucgaaggaaaaugcgaaacguguguuuacaacaugaugggcaagagggaaaaaaaauugggggaauuugguaaagcaaaaggaucuagagcuauaugguacaugugguuaggugcaagauuuuuggaauuugaagcacuaggcuuuuuaaacgaagaccacugguuuuccagagggaauagucuaucagguguagaaggugaaggucuucauaggcuagguuauauauuaagagaaguuggaaaaaaagaagguggggccauguaugccgaugacacugcaggaugggauacgcggauuacguuggaagaccuuaaaaaugaagaaaugguaacuaaucacaugaaaggagaacauaaaaaacuggcugaagcaaucuucaaauuaacuuaucagaauaaaguaguucgaguccaaagaccaaccccgcgcggaacgguaauggauaucauaucucggaaagaucaacguggaucaggacaagucgguacauauggucucaauacguucacgaauauggaagcccaacuaauucgccaaauggaaggggaaggcauuuuuaaaaguauccaacaucuuacagcaacugaagaaauagcagugcaaaauugguuggccagagucgggagagaacgucugagccgaauggcaauuucuggcgaugacugugucgucaaaccuauagacgaucguuuugcgagugcucuaacagcucuuaaugauauggggaaaguuaggaaggauauacagcaaugggaaccuaguagaggauggaaugacuggacacagguaccguuuugcucacaucacuuucacgaacuagucaugaaggacgguaggguacuaguaguuccauguaggaaccaagacgagcucauaggacgagcgaggauaucucagggugccggguggucauuaaaagagacagcgugccuaggcaaauccuaugcacaaauguggacauuaauguauuuucaucgccgagaucuaagguuagcugcuaacgccauaugcagugcggugcccucucauuggguuccaacgaguagaacuacuuggucaauccaugcgaaacaugaauggaugacaacugaagauauguuagcaguuuggaaucguguuuggauucaagaaaacccauggauggaagauaagacgcccgucgaaaguugggaagaaguuccauauuuagguaaaagggaagaucaauggugcgguucacuaauaggccuaacaucuagagccacaugggcaaagaauauacaaacggcaauaaaucaaguucguucuuuaaucgggaaugaagaauacacagacuacaugcccaguaugaaaagauuuagaagagaagaagaagaagcuggagugcuaugguga

SEQ ID NO: 22169 - RNA, 9876 nt, Artificial Sequence
  derived and/or modified CDS sequence (opt6) from DENV-2__LC121816__SS-prME
accguagggaugaucauaaugcuaauaccaaccgcgauggcauuucaccucacuacucguaauggagaaccgcauaugauuguuucaagacaagaaaaaggaaaauccuuguuguucaaaacugaagaugguguuaauauguguacucuaauggcaauggaucuuggagaacuuugugaagacacugucacuuacaacuguccauugcuacgacagaaugaaccggaagacaucgauugcugguguaacuccacaaguaccugggucacauacggaacguguacagcaacaggagaacaccgacgagagaaacgaaguguagcacuuguaccucacgugggaaugggacucgaaacuagaacugaaacuuggaugucaagcgaaggcgcauggaaacaugcucaaagaauugaaacauggauacuacggcacccuggauuuacaauuauggcugcaauauuagcucacacaauaggcacuaccuacuuucagagaguucugauauuuauccugcugacugcuguugccccuucaaugacaaugcgaugcauaggcauuucuaaucgugacuucguagaagguguaagcggagguucauggguagauauuguauuagaacacgguagcuguguuacgacaauggcuaaaaauaaaccaacauuagacuuugaacucauuaaaacugaagcuaaacaaccugcaaccuugagaaaauauugcaucgaagcaaaacucacaaauacuacaacggcuuccagaugucccacucaaggcgaacccuccuuaaaugaagaacaagacaaaagauuuguauguaaacauucgaugguugaucgcggcuggggcaacggguguggauuauuugguaaagguggcauagucacuugugccauguuuacgugcaaaaagaauauggaaggaaaaauaguacagccagaaaaucucgaguauacuaucgugaucacaccccauagcggggaggagaaugcugugggaaaugauacuggaaaacauggaaaagaaguaaaagugacgccgcaauccaguauuacugaagccgagcuuacuggauauggaaccgucacaauggaaugcucaccucgaacagggcuugacuucaaugaaaugguacucuuacagauggaaaauaaagccuggcuaguccaucgccaaugguuccuagaucugccguuaccaugguuacccggagcugauacacaagguagcaacuggauccagaaagaaacacucguaacauuuaaaaacccucaugcuaagaaacaggacguagucguacucgguagccaggagggagccaugcauaccgccuuaacuggagcaacugagauucagaugaguaguggaaauuuauuguucacgggucaucuaaaaugucggcuacggauggauaaacuccaacuaaaaggaaugucauauagcauguguacagguaaauuuaaaguagucaaagaaauagccgaaacucaacacgggacuauaguaauaagaguacaauacgagggcgaugggucacccuguaaaauuccguucgaaauaauggauuuggagaaaagacacguccugggaaggcuaaucacaguaaacccgauagucacggaaagagacuccccggucaacauugaagcagaaccaccauucggugauaguuauauaauuauugguguugaaccaggccaacuuaaacuaucaugguucaagaaaggaucuuccauuggacaaauguuugaaacgacgaugcguggggcgaaacgaauggcaaucuuaggagacacugcuugggacuuuggaucacuuggaggaguuuucaccucuauaggaaaagcacuucaucagguauuuggagcaauauauggagcugcuuuuuccggaguuagcuggacaaugaagauacuaauugguguagugaucacguggauaggaaugaacagucguucuacuucacuguccguuagccuugugcuaguugguguagugacucuauauuuaggagugaugguucaggccgacucaggcugcgugguaagcuggaagaacaaagaacugaagugcgggucuggcauauucaucacagauaauguucacaccuggacugaacaauauaaguuccaaccggaaagccccagcaaauuagcaucggcaauacaaaaagcguacgaagaagguauauguggaauacggucagugacaagauuagaaaaccuaauguggaagcaaauaacuccagaauuaaaucacauacuaagugaaaaugaagucaaauuaacaauuaugacaggugacauaaaagguauaaugcaagcugguaagcgaucuuuaagaccacaaccaacugaguuaaaguacucauggaaaaccuggggaaaagcaaaaauguuauccaccgagcaucauaaucaaacacuuuuaauagauggaccggaaacagcggaaugccccaacacgaauagagcauggaacucauuagaaguagaagacuauggcuuuggagucuuuacuacaaacauaugguugaaguuaaaagaacggcaagauguuuucugugauucuaaauuaaugucugcugcaaucaaagauaaucgagcuguucacgcagauauggguuacuggauugaaagcgcuuuaaaugauacauggaaaauugaaaaagcaaguuuuauugaagugaagaguugucauuggccaaaaagucacacgcuauggucgaaugguguucuagaaagugaaaugauaauucccaaaaauuuugcgggaccgguuucgcaacacaauuaucguccaggauaucacacccaaacagcggguccguggcacuuagguaaauuagaaauggauuucgauuucugcgaagguacgacugucguaguaacagaagacuguggaaacagagggccuagccugcgaaccacuacugcaagugguaaacuaauaacagaguggugcugccgaucauguacuuuacccccauugcguuauagaggggaagacgguugcugguauggcauggaaauucgcccguuaaaagagaaggaagaaaaucugguuaauucauuaguaacagcaggacauggacaaauagauaacuuuucucuaggaguacuuggaauggcacuauuuuuagaagaaaugcuuaggacucgcgucgggacuaaacacgcucugcuguuaguggccgugucauuuaugacccuaauaaccggcaauaugucauuucgagaccugggaagaguuaugguaaugguaggugcagcuaugacagaugauauuggaauggguguaacuuauuuagcguuacucgccgcuuucaaaguucggccaacguucgcugcgggauuguugcuaaggaaauuaacaaguaaagaacuaaugaugacaacaaucggcauuguucuauuaucucaaucaacaaucccugaaacaauccuggagcuuacggaugcacuggccuuaggcaugaugauacuuaagauagucagaaacauggaaaaauaccaacuugcgguaacaauaauggcgauacuaugugucccuaaugcuguaauuuugcaaaaugcauggaaaguaaguugcaccaucuuagcuguuguguccguuaccccuuuauuguuaacuucaagcagacagaaggccgauuggauuccucuggcccuuacuauaaaaggucuuaaucccacagcaauauucuuaacaacgcugucuagaaccaauaagaaaagaucuuggccucuaaacgaagcaauaauggcaguaggcaugguaucuauacuugccaguucauuacuaaagaacgauauacccaugacgggcccauuagucgcuggggguuuacuaacaguaugcuacguauuaacagggaggucugcggauuuagaacuagagagagcugcagaugugcgaugggaagaccaagcugagauaucaggaucaucaccgauuuugucaauaacaauuagugaagacggguccaugucaaucaaaaaugaagaagaagaacaaacguuaaccauacuaauaagaacugguuuacucguaauaagcggguuguucccagucucaauuccaauuacagcugccgcaugguaccuuugggaagucaagaaacaacgugccgguguauuaugggacguaccuucaccaccgccaguggggaaagccgaacucgaagauggcgcauauagaauuaaacaaaaagguaucuuaggauauucacaaauuggugcaggaguuuauaaagaaggaacguuucauacuauguggcauguaacgcgaggcgcaguauuaaugcacaaaggaaaacggaucgaaccuucaugggcugacguacguaaagaucugauaucguacggcgggggcuggaaauuagaaggagaguggaaagaaggagaagagguacaaguguuagcauuagagccaggcaagaacccucgcgcaguacaaacaaaaccaggguuauuuaaaacugauacaggcacuauaggcgcaguauccuuggacuuuucaccgggaacaaguggaucacccauagucgauaagaaagggaaagugguagguuuauacgguaauggaguggucaccaggagugguacuuauguauccgcaauugcgcaaacugaaaaaucaauagaggacaaccccgaaauagaagaugacauauucaggaaacgcaggcuaacaauaauggauuuacauccaggggcaggaaaaacaaaaagguacuuaccagccauugugcgggaggcuauaaagaggggacuacggacucuaauacuagcaccgacaagagugguagccgcagagauggaggaggcguuacgaggacuccccauacgauaccaaacgccugcuauuagagccgaacauacaggaagagaaauaguagaccugaugugucacgcuacauuuaccaugagauugcuaucaccaguacggguacccaauuauaauuuaauuauuauggaugaagcgcauuucacagacccagcaucaauagcugcacguggguauaucaguaccagggucgaaaugggagaagcagcaggcauuuuuaugacggcaacaccgccugggaguagggacccauuuccccaaaguaacgcaccuauuauggacgaagaaagagaaauuccugaacgaucauggaacucugggcacgaauggguuacggauuucaaaggcaaaacaguuugguucguaccaaguauaaaagcagguaaugauauagcagcgugccuacggaaaaacggcaagaaaguaauucaauugagcagaaagacauuugauucagaguacauuaaaacaagaacaaacgauugggauuucgugguaacgacugacauaucugaaaugggagcgaauuucaaagccgagcggguuauagauccacgucgaugcaugaaaccgguuauucuaacagauggcgaagaacggguuaucuuagccgguccuaugccgguuacucauucuagugcagcccagaggcggggccggauuggaaggaaccccaagaacgaaaacgaccaauauauauacaugggggaaccuuuggaaaaugaugaagacugugcccauuggaaagaggccaaaaugcuccuugauaacauaaauacaccggaggguauuauaccuagcauguuugaaccagaacgggaaaaaguagaugcaauagauggagaguaucgucucagaggagaagcucggaaaacguuuguagauuuaaugcgaagaggugaucuuccaguauggcuggccuacagaguggcugcggagggcaucaacuacgcagaucgccguugguguuuugacggaguuaagaauaaccagauucuagaggagaacgucgaaguugaaaucuggacuaaagaaggggaaaggaagaaacugaagccacggugguuagacgcucgaauauauagugauccucuagcguugaaagaguucaaggaguucgcagcaggcagaaaaucucuaaccuugaauuuaauuacagaaaugggacgacuaccaacuuuuaugacccaaaaggcgagaaacgcauuagauaauuuagcaguauugcacacugcagaagccggcggacgggcuuauaaucacgcauuaagugaacuaccagagacacuugaaacacugcuauuauugacauuauuagcuacuguuacugguggaauauuccuuuucuuaaugaguggcaaaggcaucggaaaaaugacacuuggcaugugcuguauaauaacugcgaguauacuacugugguaugcgcagauucaaccacauuggauugcagcaucaaucauuuuagaguucuuuuugaucguauuacugauuccugaacccgaaaaacaacggacuccacaagauaaucagcuaacuuaugucgucauagcgauauuaacagucguagcagcgaccauggcuaacgaaaugggguuccucgagaaaaccaagaaagauuucggccuaggaaguauugcaacccagcaaccggaaaguaauauauuggacauagaucuacgaccagcuuccgccuggacgcuuuaugcgguagcuacaacuuucaucacuccgaugcucaggcauaguauugaaaacaguagcguaaacgucucacuaacugcuauugcuaaccaagcuacggugcuaaugggucuaggcaagggauggccauuaucuaaaauggauauagguguaccucuucuugcaaucggaugcuauucacaaguuaauccuauaacacucaccgcugcacuauuacuccuugucgcacauuaugcgauaauuggaccaggauuacaagcaaaggcaacaagagaagcacagaagagagcagcugcgggcauaaugaaaaauccaacuguggacggaaucacuguaauugaucuggaccccauaccuuaugauccaaaauucgagaaacaacuaggacaggugaugcucuugguauuaugcguaacacaaguccuaaugaugagaaccacuugggcccuaugcgaagcacuaacgcuugcgacugggccaauuucaacccuuugggaaggcaauccgggacguuucuggaacacuacaauugcaguuucuauggccaauaucuucagagguaguuacuuagcaggcgccggguuacucuuuucuaucaugaagaacacgacuaauacacgccgugguacaggaaauacaggagaaacacugggcgaaaaguggaaaaaucgauuaaacgcccuggguaaaucugaauuucaaacuuacaagaaaucuggaauacaggaagucgacagaacuuuagcaaaagagggaauaaaaagaggagagacggaccaucaugcagugucacguggaagugcgaaacuacgcugguucguugaacgaaacuuaguuacacccgaaggaaaaguuguggacuugggauguggcagagggggauggucuuauuauugcgggggacuuaagaacgugagagaagucaagggccucacaaaaggaggcccgggacacgaggaacccauaccaaugaguaccuauggguggaauuuagugagguuacaaucugguguagacguauuuuucaccccaccggaaaagugcgauacacuccucugcgacauuggcgagagcucuccaaauccaacgguagaagcagggagaacauuaagaguauuaaauuuagucgagaacuggcuuaacaauaacacgcaauucugcauaaagguguuaaauccauauaugccuucgguaauugaaaagauggaggcgcuacaacguaaauacggaggugcacuuguucgaaacccacuuaguagaaacuccacucacgaaauguacuggguaucaaacgcaucgggcaauauaguaagcagugugaacaugauaucacggaugcuaauuaacagauucacuaugcggcauaagaaagcaacauacgagccagacguugauuuaggaagugguacacgaaacauuggaauagagucugaaacacccaaccuagacauaauaggcaaaagaaucgagaagauacgccaagaacaugaaacuucauggcauuacgaucaagaucacccauauaagacgugggcuuaucacgguaguuaugaaacaaaacaaacuggcagcgccucuucaaugguuaaugggguuguccgguuacuuacaaaaccaugggauguaauuccaaugguaacccagauggcaaugacggacacaacaccauuugggcaacaacgcguuuuuaaagaaaagguagacacaaggacucaagagccaaaagagggaacgaaaaaguuaaugaaaauaaccgcgaagugguuguggaaagagcuuggcaagaagaaaacaccacgaaugugcacacgagaggaauuuaccaggaaaguuagaaguaacgcggcccuuggagccauauuuacagacgaaaauaaguggaaaagugcccgugaggcaguggaagauaguagauuuugggaacuugucgacaaggaacguaaucuacaucuugaaggcaaaugcgaaacauguguuuauaauaugaugggaaaaagagagaagaaacuaggagaguuugguaaggcaaaagggagucgagcaauaugguauauguggcuaggggccagauuucuugaguuugaagcgcucgguuuucuuaaugaggaucacugguucagccgugaaaacucucucucggguguugaaggagagggacuccauaaauuaggauauauacuacgugaugugagcaagaaagaagguggugccauguaugcagacgauacugcuggcugggacacuaggaucaccuuggaagaccugaaaaacgaggagaugguuaccaaucauauggaaggugaacauaagaaauuagcggaagcgauauuuaaacuuacguaucaaaauaaaguaguucguguucaaagaccaacuccccgagggacugucauggauauaauuagcagaagagaccagcgagggagcggccagguaggcaccuauggucugaacaccuuuacuaacaugggagcacaguuaaucaggcaaauggagggugaggggguuuuuaaaucgauucaacauuuaacagcuacagaagaaaucgcuguacaagacuggcuugcaagaguaggaagagagagguuaaguaggauggcaauaucaggagaugacuguguaguaaaaccauuggaugacagauuugcuucagcguugacugcccuuaaugacaugggaaaaguaagaaaagauauccaacaaugggagccuuccagaggauggaacgacuggacacaaguuccuuuuugcagucaucauuuccacgaacuaauuaugaaagaugggagaguuuugguugucccuuguaggaaccaagaugaauuaauaggcagagcuagaauuucucaaggggccgguuggagcuuaagggaaacagcaugucucgguaaauccuacgcacaaauguggucuuuaauguauuuccaucggagggaccuaagauuggccgcaaaugcaaucuguucagcuguaccgagucacugggucccaacuucucgcacaacauggaguauacacgcgaaacacgaguggaugacaacugaggauaugcuaacaguauggaaucgcguauggauucaagagaacccauggauggaagauaagaccccaguugaaucuugggaagagauuccguauuuagguaagcgggaagaucaauggugcgguucuuuaauaggucuaacaucacgggcaacaugggccaaaaacauccaaaccgccauaaaccaagugagaagucuuauugguaaugaagaguacacugauuauaugccuucaaugaaacguuuuagaagagaggaagaagaggccggugucuuaugguga

SEQ ID NO: 22170 - RNA, 9876 nt, Artificial Sequence
  derived and/or modified CDS sequence (opt6) from DENV-2__LC111438__SS-prME
accgcggguaucauaauuaugaugaucccgacuguuauggcauuccaucuaacuacucgaaacggugaaccacauaugauuguuucuaggcaagaaaaaggaaaauccuuacuauuuaaaaccgaaaauggcguaaauauguguacuuuaauggcaauggaucuaggagaauugugcgaagauacaauuaccuauaauugcccccuacugcgucaaaacgaaccagaagacauugauuguuggugcaauaguaccucaacuuggguuacuuaugguacaugcacggcuacaggagaacaccggagagaaaaacgaucuguugcucuaguuccacauguugguaugggcuuggaaacacguacagaaacauggaugucuucagagggugcguggaaacaugcacaacgcauagaaacauggguacuacgacacccaggguuuacuauuauggcugcaauccuagcguauacaauagguacuacacauuuucaaagagucuuaauuuucauccuauuaacugcggucgcuccuucaaugacuaugcgaugcauagguauaucaaauagagauuucguagaagggguuagugggggaagcuggguggauauuguuuuagaacauggcuccugcguaacgaccauggccaaaaauaaaccuacgcuagauuuugaacuaauaaaaacagaggcaaaacaucccgcaacuuuaagaaaauauuguaucgaagcaaaacuaacuaacacgaccacugcaucuaggugcccaacccaaggcgagccaagccuaaaugaggaacaagacaaaagauucguuuguaaacauuccaugguagauagagggugggguaacggauguggcuuguuugguaaaggagggaucgugaccugugcaauguucacaugcaagaaaaacauggaaggaaaaguuguacaaccagaaaacuuagaguauaccauugucauaacaccgcauaguggagaagaaaaugcuguagguaaugauacaggaaaacauggaaaagagauaaaaguaacgccgcaaucuuccaucacagaagcagaacuuacuggauauggaacuguaacgauggaauguaguccccgcacuggcuuggauuucaacgagaugguacuguugcaaauggaaaauaaagcauggcuaguacauagacagugguucuuagacuuaccgcugcccugguuaccaggugcugacacacaaggaagcaauuggauucaaaaagagacgcuagucaccuucaaaaacccgcaugcuaagaaacaagauguugucguccuugguagccaggaaggagcuaugcauaccgcauuaacaggagcuaccgagauucaaaugucaagcgguaaucuacuguucacaggucauuugaaaugcagauugcguauggacaaauugcaacuuaaagggaugaguuauucaauguguaccggaaaguucaaggucguuaaagaaauagcugaaacucaacauggcacuaucguaauucgggugcaauaugaaggcgaugguucaccuugcaaaauuccauucgagauaauggaucuagagaagagacauguacuaggucgauugauaacugugaauccaauaguuacagaaaaagauucuccagucaauauagaagcagaaccaccauucggcgacagcuauauuauaauagggguugaaccaggccaacugaaacuuucuugguuuaaaaagggcaguucaauaggucaaauguuugaaacuaccaugcguggcgcaaaaagaauggcuauccuaggggauacagcuugggauuucgggagcuuaggaggaguauucacuucaauaggcaaagcucuacaccaaguauucggcgcaauuuauggagccgcauucaguggcguaucauggacuaugaagauacuaauagguguaguuauuaccuggauuggaaugaauagucgauccacaagucuuucaguaucucuaguccuaguaggaguagucacauuauauuuaggugucaugguccaggcggacucaggcugcguagucucauggaaaaauaaagaacuuaagugcggcucaggaaucuuuauaacugacaauguucauaccuggacggaacaauacaaauuucaaccagaaucaccacccaaauuagcaagugccauacagaaagcacaugaagaaggaaucugcgguauucguucggucacaagguuggaaaaucuaauguggaaacaaaucacaccugagcuaaaucacauuuuaagugaaaacgaaguaaagcucacgaucaugacaggagauaucaagggaaucaugcaagcaggaaaacgcagccuuagaccacaacccacagaauuaaaguauucauggaaagcaugggguaaagcuaagauguuguccacagaacugcacaaucauacauuuuuaaucgauggcccagagacugcggaauguccaaauaccaaucgggccuggaacucacucgaaguagaagacuauggauuuggaguauuuacuacuaauauauggcugaaauuaaaagaaaaacaagauguauuuugcgauaguaaauuaaugucugcugcaauuaaggacaauagagcuguucacgccgauauggguuauuggauagaaagcgcuuuaaaugauacauggaagauugaaaaagcauccuucauugaaguaaagucaugccacuggccaaaaucgcacacgcuuuggagcaacggcgugcuugagagugaaaugauuauaccgaagaauuuugcuggucccgucagucagcacaacuaccgucccggcuaccauacccaaacagcuggaccauggcauuuagggagucuggaaauggauuucgauuuuugugaagguacuacgguaguaguaaccgaagauuguggaaacaggggaccgucucuaagaacaaccacagcuaguggaaaacuuauaacggaaugguguuguagauccuguacacuaccaccucuacguuaucguggugaggaugguuguugguacggaauggagauuagaccacugaaagaaaaagaagagaaccuaguuaauucccuaguaacagcaggucauggacaaauugauaacuuuaguuuagguguauuagguauggcguuguucuuggaggaaaugcugagaacaaggguaggaacaaaacacgccauauuauugguggcaguaucuuucgugacccuaauaacaggaaauaugaguuucagggaccuaggaagagugauggucaugguaggagccacuaugaccgaugauauagguaugggaguaacuuacuuggcacuauuggccgcuuuuaaaauaagacccacauuugccgcaggucuguuacugagaaaguuaacaaguaaagagcuaaugaugacgacaauaggaaucgugcuauuaucgcaaagcacgauaccugaaacaaucuuggaauuaacagaugcguuagcacuaggcaugaugguccugaaaaucgucagaaacauggagaaauaucaguuggcugucacuauuauggcgauacuauguguuccaaacgcaguaauccuucaaaaugcauggaaagugucauguacaacuuuggccgugguuucaguaagcccguuacuccuaaccagcucacaacaaaaagcugacuggaucccauuagcccuaaccauaaaaggacuaaaucccacagcaauauuccuaaccacacuaaguagaacuucgaaaaagcgaaguuggccguuaaaugaagcuauaauggccguuggaaugguaucgauucucgcguccucgcugcugaaaaacgacauaccuaugacaggaccacugguugccggugguuugcucacaguguguuaugucuuaacaggucgaucugcugaucuagaacuagaaagagcagcugauguacggugggaagaacaagccgagauaaguggcucaagucccauauuaucaauaacuauaucagaggaugguucaauguccaucaaaaaugaagaggaggagcagacucuuacgauacucauaagaacuggacuccuuguaauuuccggacucuucccuguuucgauuccuaucacggcugcagccugguaccuaugggaagucaagaaacaaagagcugggguuuuaugggacguaccuucaccaccuccuguugguaaagcagaacuugaagauggcgcguauagaauaaaacaaaaagggauacuaggauauucacaaauaggugcggguguuuauaaagaagggaccuuccauacaauguggcaugugacucgaggagcaguuuuaaugcacaaaggaaagagaauugaacccuccugggcagacgucaagaaagacuuaaucuccuacgguggggguuggaaauuagaaggugaguggaaggagggagaagagguucaaguacuggcgcuagaaccaggcaaaaauccgagagccgugcaaacaaaaccuggacuauucaaaacuaacaccgguacaauaggagcaguaucucuggauuuuucaccuggcacaaguggaucuccgaucguugauaagaaaggcaaagucguaggucuuuauggaaacggaguaguaacacgaagcggaacauauguuucagccauagcgcagacagaaaagagcauugaagacaaucccgagauagaagaugauauauuuaggaaaaagagauuaaccauaauggaccuucauccuggugcugggaaaacaaagcguuauuugccggcaauaguacgagaagcaauaaaaagaggauuacggacgcugauauuggcuccaacccguguaguugcugcagaaauggaagaagcccuucgagguuuaccuauacgauaccaaacccccgcaauaagagcggaacauacuggccgagaaauaguugaccuuaugugccacgccacuuuuacaaugcggcuucuaucaccuauuagaguuccaaauuauaaccugauaauaauggaugaagcucacuuuacggauccagcuucaauugcggcgcgaggauacauaagcacgagaguagaaaugggcgaagcugcaggaauuuucaugacugcgacgcccccagggagcagagaucccuucccacaaucaaacgcgccaaucauggaugaggaacgagaaaucccggagaggaguuggaacucaggucacgaguggguuacagauuuuaaagguaagacaguuugguucgucccuucaauuaaagcugguaacgauauagccgcaugucucaggaaaaaugguaagaagguaauacagcuaagucgcaaaacuuucgauucagaguacauaaagacucgaacaaacgacugggacuucguaguaacaacugacauaagugagaugggagcaaacuucaaagccgagagagugauagacccacgaagauguaugaaaccugugauacuaacggauggagaagaaagagugauccucgcaggacccaugccuguuacacauucuucggcugcucaacgcagaggacggguagguagaaauccaaagaaugaaaaugaccaauauauauacaugggcgaaccauuggaaaaugacgaagauugcgcacacuggaaagaagcaaaaaugcucuuagauaacauuaacacacccgaaggaauuaucccgagcauguucgaaccagagagagaaaaagucgacgcgauagauggcgaauaucggcuaagaggagaagcaagaaaaacuuuuguagaucucaugcgaagaggggaucuaccugucuggcuugcuuacagaguagcugcagaaggaauaaauuaugcagacagaagguggugcuucgacggugucaaaaauaaucaaauauuagaagagaacguggaaguagagauauggacuaaagaaggggaaagaaagaagcucaaaccaagauggcuagacgcccgaauauauucugauccuuuagcauuaaaagaauuuaaagaguucgcugcgggccgcaagucucuagcacuaaaucugauuacugaaaugggacgauuaccaacauucaugacucaaaaggcaagaaacgcucuagauaaccuagcuguauuacauacagcagaagcgggcggucgagcuuauaaccacgcuuugucugaguuacccgaaaccuuagaaacuuuauugcuacuaacauuacuugcuacuguaacagguggaaucuuccuauuucuaaugucaggaaagggaaucggaaaaaugacaauggguaugugcuguaucauuaccgccaguauuuuauugugguacgcccaaauucaaccacauuggauagcggccucaauaauacucgaguucuuuuuaaucguacuccuaauaccagaacccgagaagcaaagaacaccucaagauaaucaauuaaccuacguuguaauagcaauacuaacaguugucgcagcaacgauggcaaacgaaaugggauuucuugagaaaacgaaaaaggauuucggguuggguucgaucgccacucagcaacccgagucuaauauucuagauauugauuuacguccggcaucagcguggacguuauaugcuguugcuacuacuuuuauaacgcccauguuacgacauaguauagaaaacucgucagucaaugucucucugacggcuauagcuaaccaagcuacaguauugaugggacuagggaaaggguggccgcuaucuaaaauggacauagggguuccccuccuagcuauuggauguuauucucaagucaacccgauuacuuuaauggcagccuuguuacuacuuguagcucacuaugccauuauaggacccgguuuacaagccaaagccacaagggaagcccagaaaagggcagcggcagguauuaugaaaaacccgacgguagauggaauaaccgucauugacuuagauccuauuccauaugauccaaaauucgaaaaacaacucgggcaaguaaugcuccuaguacugugcguaacgcaaguacuaaugaugcgcacaaccugggcauuaugcgaagcccuuacucuagcaacggggcccauaagcacccuaugggaaggaaauccggggcgcuuuuggaauacaacgauugcagugaguauggcuaauauuuuuaggggaucauaccuggcaggagcaggcuuacuauuuucaauuaugaaaaacacugcuaauacucguagagguacgggcaacacaggagaaacgcuuggagaaaaguggaaaaauagguuaaaugcucugggaaaaagugaguuccaaauauacaagaaaucaggcauucaagagguagauagaacucuagccaaggaagguaucaaacguggggaaacugaccaucacgcagucucccgcgggucagcaaaguuaagaugguuuguugagcguaaucugguuacaccugaggguaaagucguugaucucgguugcgggagaggaggcuggagcuauuauuguggcggccucaaaaauguaaaagagguuaaaggccucacuaaaggcggacccggccaugaagaaccuaucccuaugucuacauacggauggaaucuggugagauugcagucaggagucgauguauuuuucacaccgccagaaaagugcgauacacuuuugugcgacaucggugaaucaagcccgaauccgacaguggaggccggucgaacacuucgaguauugaauuugguugagaauuggcucaauaauaauacacaguucugcaucaaaguauuaaauccguauaugccaaguguuauagagaaaauggaagcauuacaacgcaaguacgguggagcacuuguccgaaacccgcuuagcaggaacuccacccaugaaauguauuggguaaguaaugcuucagguaauauagucaguucuguaaacaugauuucuagaaugcugauaaaucguuucacgaugagacacaaaaaggcuacauaugagccagaugucgacuugggaucagguaccaggaauauuggaauagaauccgaaacaccaaaccucgauauuauuggcaaacgaauagagaaaaucaaacaagaacacgaaacgaguuggcacuacgaucaagaccacccguacaaaacaugggcauaucacggaagcuaugagacuaaacaaacuggaagcgccucuaguaugguuaauggaguaguccgguuacuuacuaaaccaugggauguaauuccaaugguuacacaaauggcaaugacagacacaacuccguucggacaacaacgaguuuucaaggaaaaaguggauacuaggacacaagaacccaaggagggaacgaaaaagcucaugaaaauaacagcgaaaugguuauggaaagagcucggaaagaagaaaacuccaagaauguguaccagagaggaguucacccgaaaaguaagaagcaaugcugcauuaggggcaauauuuaccgacgaaaauaaauggaaaucagcuagagaagcagucgaagauucaggcuuuugggaguugguugacaaagaacgaaaccuucaucuggaagguaaaugcgaaacauguguguauaauaugaugggcaagagggagaagaaauuaggggaguuuggaaaagccaaaggaagucgggcgaucugguacauguggcuaggugcgagauuuuuagaguucgaagcacucgguuuucucaacgaagaucacugguucagccgugaaaacagcuuaucugguguugaaggugaaggguuacacaaacucggauauauacuaagagaugugucaaagaaagaaggaggagcaauguaugccgacgacacggcagguugggacacucggaucacacuagaagaucucaaaaacgaggaaauagucaccaauuacauggaaggugagcauaagaaacuagcagaagccauauuuaaacucacguaccaaaacaaaguuguacggguacaacgaccaacuccacguggcacuguuauggacauuauaucaagaagagaccagcgcggaucgggacaaguaguuacuuaugguuuaaacacuuucacaaauauggaagcacaacugauaagacagauggaaggagaggggguauucaaaaguauucaacaccucacaguaaccgaagagaucgcgguugaaaauugguuagucagaguuggcagagaaagauuaucacgcauggcgauaucaggagaugauugcguaguaaagccacuagacgauagauucgccagcgcgcucacggcacuuaaugauaugggcaaaguuagaaaagacauucaacaaugggagccgucgagaggauggaacgauuggacacaagugcccuuuuguucccaccacuuccaugaauuaauaaugaaagacggcaggguauugguuguacccugcagaaaucaagaugaacugauuggacgcgcacgaaucucacagggcgcgggauggaguuugagagaaacugcaugucuugguaaaaguuacgcccaaauguggucguugauguacuuccauagaagagauuuacguuuagcugccaaugcaauauguagugcuguacccucucacuggguacccacaucaagaacaacuuggucaauacaugccacgcaugaguggaugacuacagaagauaugcuaacgguauggaacagggucuggauacaagaaaauccauggauggaagauaagaccccaguagaaagcugggaagaaauuccuuauuugggaaagcgcgaggaucaauggugugguagccuaaucggucuaacuucuagagcgacgugggccaaaaauauacaaacugcuauuaaucaaguaaggagucuaaucggaaaugaagaauauacugacuauaugccgagcaugaaaagauuucgaagagaagaggaagaagcaggaguguuaugguga

SEQ ID NO: 22171 - RNA, 9876 nt, Artificial Sequence
  derived and/or modified CDS sequence (opt6) from DENV-2__KF744400__SS-prME
acagcaggaaugauaauuauguugauuccaacgguuauggcauuucaucugacuaccagaaauggugaaccacacaugauaguaucgcgccaggaaaaagggaaaagccuacuauuuaaaacagaaaauggcgugaauauguguacacuaauggcuauggauuuaggugaauugugcgaagauacgauaacauauaaaugcccuuuacuaagacaaaaugaaccagaagauauagauuguugguguaauucuacaucuacuugggugacuuacgggacuuguacgacuacuggcgaacacaggcgagaaaaacgaucgguagcucuaguuccccauguaggaauggggcuagaaacuagaacugaaacuuggauguccagcgaaggagcauggaaacaugcacaacgaauugaaacauggauauuacgacaucccggauucacucuaauggcagcaauucuagcauacacaauaggaacaacacauuuucaacgagcgcugauuuuuauucuucugacggcugucgcacccucaaugacgaugagaugcauuggaauaaguaauagagacuuuguggaaggagucucaggaggaucuugggucgacauaguacuagaacacggcucguguguuacaacuauggcuaaaaauaaaccaacucuagauuuugaauuaauuaaaaccgaagcaaaagaaccagcaacacuccggaaauauuguauugaagcuaaauugacaaacacgacuacugaaagucgcugcccgacacagggcgaacccagcuugaaugaagaacaagauaaaagauuuguuugcaaacacucaaugguugaucggggauggggaaauggcugcggauuauuugguaaaggagggauuguaacaugcgcuauguuuacuugcaagaaaaauauggaaggaaaaaucguucagccagaaaaucuagaauacacaauaguuauuacaccccacucaggugaagaacacgcaguuggcaaugauacuggaaaacauggaaaagaaaucaaaaucacaccccaaucaucgacaacagaagcugaguuaaccgguuauggcacgguaacuauggaauguagcccucgaacuggacuggauuuuaacgagaugguccuacuacaaauggagaauaaagcaugguugguacacagacaaugguuccuagauuugccguuaccauggcucccgggugcggauacgcaaggcaguaacuggauccaaaaagaaacucuagugacauuuaaaaacccacaugcuaagaaacaggacguggucguucuaggaucacaagaaggcgcaaugcauacagcacugacgggugcaaccgauauacagauguccucgggcaaccuucucuuuaccggacaucucaaaugucgacuuagaauggauaaauuacaauugaaaggaaugucauacaguaugugcacuggaaaauuuaaagucgucaaagaaauagcagaaacccaacauggaacaauugugguaagagugcaauacgaaggugacgguucaccuugcaaaaucccauucgaaauuauggaucuggagaaaaggcacguguuagggcgccuaaucacugucaaucccauaguaacagaaaaggacagucccguaaacauagaagcagaaccaccguucggggacucuuacguaaucauaggaguagaaccaggacagcuaaaacuuaauugguuuaagaaagggaguucaaucgggcaaauguucgaaaccaccaugagaggagcaaaacgcauggcuauauugggcgauacagccugggauuucgggagcuuaggagggguguucacuagcauaggaaaagcgcuccaccagguuuucggugcaauauauggcgcagcauucagugggguaagcuggacuaugaaaauucuuauaggcguuauaaucacuuggauaggcaugaacucaagauccacaagucuaaguguaucacuuguacuuguagguguagugacauuauaucuaggaguaguuguacaagcggauuccggcuguguaguaucauggaaaaauaaagaauugaaauguggcucaggaauuuucaucaccgacaacguacauacuuggacagaacaauauaaauuucaaccagaaucaccuucuaaacuagcaagcgcaauccagaaagcucaccaagaagggauuugcggaauaagaucaguaacucgauuggagaaucuaauguggaaacaaauaacuccggaacucaaucauaucuugagugaaaaugagguaaagcucacuauaaugacgggugauauuaaaggaauuaugcaugcaggaaaaagaucauuacguccacaacccacagagcuccgauauucauggaagacaugggguaaagcaaagauacucaguacagaaucacauaaucaaaccuucuuaauugauggcccugaaacggcagagugcccgaauacaaaucgcgcguggaacucucuagaagucgaggacuauggcuuuggaguguuuaccaccaauauuuggcugaaauugagagaaaaacaagacgcguucugugauccaaaacuuaugucugcugcuauaaaagacaauagagcagugcacgcagauauggguuacuggauagaaagugcauuaaaugauacauggaaaauugaaaaggcgucauuuauugaagugaaaaauugucauuggccuaaaagucacacucuuuggaguaacggcguauuagagucagaaaugauaauacccaaaaacuuugcaggaccugugucacaacauaacuauagaccaggauaucacacgcaaacagcagggcccuggcauuugggcaaacuagaacuagauuuugauuuuugugaagggacuacaguggucguuacggaagauugcggaaacaggggaccgucuuuaagaacgacgacugcaucaggaaaauuaaucacagaauggugcuguaggucaugcacauuaccaccacucagguacaagggagaagaugguuguugguauggaauggaaauaagaccuuuaaaggagaaggaagagaaucucgugagcucccucguaaccgcaggacacggccaaauagauaauuuuuccuuaggaguacuaggaauggcacucuuucuagaagagaugcuaaggacacgaguggguaugaaacaugcaauauuauuaguagcagugucuuuugucacuuugauaacuggaaauaugucauucagggaucuaggccgaguuauggugaugguaggugcuaccaugacugacgauaucggaaugggcgucacguaccuagcauuguuagcugcauucaaaguacguccgacguucgccgcuggguuauuauuaaggaaacuuaccaguaaagaauuaaugaugacaacaauagguaucguauuauugagccaaucaaccauaccggagacuauacucgaauuaaccgacgcauuggcauuggguaugaugguauugaaaauagucagaaagauggagagguaucaauuagcaguuaccauuauggcuauccucugcgucccaaacuccgugaucuuacaaaaugcuuggaaaguaucgugcacuauacuagccguggugagcgugagcccgcuucugcuaacuucaucucaacaaaaggcagauuggauaccucuugcauuaacgauaaaggggcuaaacccaacagcuaucuuccucacgacuuuaagcagaacaucuaagaaacguuccuggccacucaaugaagcaauaauggcaguugguauggucagcauucucgcgucuucucuacucaaaaaugauauuccgaugacuggaccguugguagcuggugguuuacuaaccguguguuacguccuuacuggacguucagcagauuuggaacuagaaaaagcggcagaugucaggugggaagaucaagcagagauaagugggucgucacccauauuaagcguaaucguuucagaggaugguucuaugucaaucaaaaaugaggaagaagaacaaauucugacgauucucaucagaacuggacuccuuguaaucucagggcuauucccugucaguauuccuaucaccgcagcagcgugguauuugugggaggucaagaaacaacgggccgguguacuuugggaugugccaucaccuccacccgucgguaaagcugaacuagaggauggcgcauauagaauaaaacagaaggguauauuaggauauucgcaaauaggggcgggaguauauaaagaagguacuuuucauacuauguggcacgucacuagaggggcaguguuaaugcacaaaggaaagcguaucgagcccucaugggcggauguaaagaaagauuuaauaucauauggaggagguuggaaauuagaaggggaauggaaggagggagaagaaguccaggugcuagcauuggaaccuggcaaaaauccccgagcgguucaaacgaagcccggcuuauucaaaacuaaugcgggcacaauuggggccguaucccuagacuucaguccgggaacaucugguucaccuaucauagacaagaaaggcaagguuguaggucuguacgggaacggcguuguaacuagaaauggaucauacguauccgcgauugcgcagacugagaaaucuauagaagauaauccagaaauagaagaugauauuuuccgaaagaagagguugacuaucauggaucuccacccaggggcugggaaaacaaaaagauaccuacccgcaauaguuagagaagcaauuaaaaggggcuuacgcacacuuauucuagcuccaacccgaguaguagccgcagaaauggaagaagcacuaagaggacuacccauaagauaucaaacaccagcuauacgagcugaacacacaggacgggaaauuguugacuuaaugugucacgcaacauucacaaugcgauuacuuagcccuauaagggugccuaacuauaaccuaauaaucauggacgaggcucacuucacugacccggcaucgauugcugcacggggauacauaucaacgagaguagagaugggcgaagcugcggggauauuuaugacugcaacaccgccaggaagucgcgauccuuucccucaauccaacgcaccuauuauggaugaagaaagagagauaccagaaagaucauggaacucaggacaugaauggguuaccgauuuuaaaggaaaaacaguuugguuugucccaaguauaaaagcaggaaaugauauagcagcuugcuuacgcaaaaaugguaagaaagugauucaacuuucaagaaaaaccuucgauagugaauauguuaaaacuagaaccaacgacugggauuuugugguaacaacagauaucagcgaaaugggggcgaauuuuaaagcugaaagagucauagacccacgccgauguaugaagccaguuauucuaacugauggagaagaacgaguuauacucgccggcccaaugccuguaacgcacagcucugcagcacagcgcaggggccgaauugggcgaaaucccaaaaacgaaaaugaccaauauauauauaugggagaaccgcuagagaacgacgaagauugugcgcacuggaaagaagcgaaaaugcuacuugacaauaucaacacaccggaagggauaauuccuucaauguuugaaccggaaagagaaaaaguagaugccaucgacggagaauauagacuucgaggcgaagcucggaaaacauucguggauuuaaugagacggggugauuuaccaguuugguuggcguauaaaguugccgcugaaggaauuaacuacgccgacagaagauggugcuuugacggcauaagaaacaaucaaauacuggaagaaaauguggaaguugaaaucuggaccaaagaaggagaaaggaaaaaguuaaagccacgcuggcucgacgccagaauauacagugauccacuggcacuaaaggaguuuaaggaguucgcugccggccgcaagucauuaacauuaaaucuuauuacugagauggggcgucuaccgacuuuuaugacacaaaaagcucgugaugcuuuggacaaccuagcaguauuacauaccgcagaggcugguggcagagccuacaaucaugcauugucugaauuaccagaaacgcuugaaacacucuuacucuuaacccuacucgcaacaguaacaggggguaucuuuuuauuuuuaaugaguggaagggguauaggcaagaugacccucggcauguguuguauaauuacggcuucuauacuucuuugguaugcacaaauucaaccacauuggauugcagccucaauuauauuggaguucuuucuuauaguuuuguuaauuccugaacccgaaaaacaaagaacgccgcaagauaaucaguuaacauauguugucauagcaauccuuaccguggucgcugcaacuauggcgaacgagaugggauuucuugagaaaacgaagaaggaucugggccuagguucaauagccacucaacagccugaaucaaauauuuuggauaucgaucugagaccagcgagugcuuggacgcuuuaugccguugcuaccaccuucaucacgccaaugcuaagacauuccauugaaaauaguucagucaaugucagucuaacagcaauagcuaaucaagccacaguuuuaauggguuuaggcaaaggguggcccuuaucgaaaauggacauuggagucccauugcuagcaaucgguuguuauagucaagucaauccaaucacgcuuacagcagcucuuuuguuguuaguagcacauuaugcaauaauagggccaggauugcaagccaaagcaacucgagaagcucagaagagagcugcugccggaaucaugaagaauccuacaguagacgguauuacggcaauugaucucgauccaauaccuuacgacccuaaauuugagaaacaacucggacaggugaugcuauuaguucuuugugucacgcaagugcuuaugaugcgaacaacuugggcucuaugugaagcacucacacuagcuacugggccaauaucgacgcucugggaagggaacccaggacgauuuuggaauacaacuauagccguuagcauggcaaauaucuucagagguagcuaucuagcaggggcaggucuacuauuuaguaucaugaagaauacgacaaacacacgacgaggaaccgggaacauuggagaaacucuaggagaaaaauggaaaucaagauuaaaugcgcuuggcaagagugaguuucaaauauauaagaaaucagguauacaagaaguggaucgcacgcuggcaaaagaaggaauaaaaaggggcgaaacugaucaucacgcuguaucacgagguucugcaaaguuacgcugguucguagagcguaacaugguaacgccggaaggaaaaguaguagauuuaggcugcggaagaggaggauggagcuacuauugcggggguuugaaaaauguaagggaaguaaaggggcuaacuaagggugggccaggucaugaagaaccuauuccaaugucuacuuaugguuggaacuugguuagauugcaaagcgguguugacguauucuuuacuccgccagagaaaugugacacgcuguuaugugacauaggggaaucaagccccaaucccacgguagaggccggaagaacauuaagaguauuaaaccuuguagaaaauuggcuaaauaauaauacucaauuuuguauaaaaguccuaaauccguacaugccaucaguaauagagaaaauggaagcguugcaaagaaaguauggaggugccuuaguuagaaaccccuuaagcaggaacucuacucaugaaauguauuggguaucgaaugcaucagguaacauuguaaguucaguuaacaugauaagccgaaugcuaauuaauagauuuaccaugaagcauaagaaggccacauaugagccagacguggacuuggguuccgggaccugcaauaucgggauagaaucggagguaccaaauuuagacauaauuggaaaaaggauagagaaaauaaagcaagaacacgaaaccucauggcauuaugaucaagaucacccguacaaaaccugggcauaccacggaagcuaugaagcaaaacaaacugguagcgcaucaaguaugguaaauggggucgugcgucuacucacaaagccgugggacgugauuccgaugguuacacaaauggcaaugacagauacuacacccuuuggacaacaaagaguguucaaggagaaagucgacacaagaacucaagaaccaaaagaagguaccaagaaacuaaugaaaauuacggccgaaugguuauggaaagaacuggggaagaagaaaacgccaagaauguguacuagggaagaauuuacuagaaaaguccggucaaacgcagcucugggagcuauauuuaccgaugagaauaaauggaaaucagcaagagaagccguagaagauaguagauuuugggaauuggucgauaaagaaagaaauuuacaucuagaaggcaagugugaaacgugcguuuacaauaugaugggaaaacgggaaaagaaauuaggggaguucgguaaagcgaagggcucaagggccaucugguacauguggcucggggcacgguucuuagaauuugaagcacuaggcuuccuaaaugaagaccacugguuuucgagagaaaacagccuaagugggguagaaggugaaggacuauacaaauuaggauacauccuucgagauguauccaaaaaggaaggcggugcaauguaugcagaugauacagcaggaugggacacgcgcauaacacuugaagaucucaaaaaugaagaaaugguuacaaaucacauggaaggagagcauaagaaacucgcggaagcaauauuuaaacuaaccuaccagaauaaagugguuagaguucagcgcccgaccccucggggcacaguaauggacaucauuagcagaagagaccaacguggcagcgggcaaguuggaacauacggccucaauacauuuacaaauauggaagcccaauuaauaaggcagauggaaggugaaggcauauucaaaagcauucagcaccuaaccgcaaccgaagaaauagcuguucaaaacugguuaacccgugucggaagggaaaggcuuucgcgaauggcaauaucuggggacgacugcguugugaaaccacuugaugauagauuugccagugcgcuaaccgcacucaaugacauggguaaaguccguaaagacauucaacaaugggaacccucgcgcgguuggaacgauuggacacagguuccuuucuguagccaucacuuccaugaacugaucaugaaagacggacgagucuuagucgucccgugccgcaaccaagacgaauuaauagguagagcacggauaucccaaggugcuggcuggagucuaagagaaacagcauguuuggguaaaucuuaugcucaaauguggagcuugauguauuuccaccggcgugauuuacgcuuagcugcgaaugccaucuguagugcuguaccaucucacuggguaccuaccuccagaacuacguggucgauccaugcuaagcacgaauggaugacaacagaagacauguugacuguauggaaccgaguuuggauccaggaaaaccccuggauggaagauaaaaccccaguugaaucuugggaggagauucccuauuugggaaaaagagaggaccaguggugcgggucacugaucggcuugacuucgcgagccacgugggcuaagaauauccaaacagcuaucaaccaaguaagaucacuaauuggcaaugaggaauauacagauuauaugccuuccaugaaaagguuucguagggaagaagaagaagcaggcguuuuaugguaa

SEQ ID NO: 22172 - RNA, 9876 nt, Artificial Sequence
  derived and/or modified CDS sequence (opt6) from DENV-2__KF744401__SS-prME
accgcagguaugauuauaaugcuaauaccaacaguuauggcuuuucacuuaacaacucguaacggagaaccacauaugauaguuagucgucaagaaaaaggaaaaaguuugcuuuucaaaacagaaaauggaguaaauauguguacccuaauggcaauggaucuuggagaacuaugugaagacacaauaacauacaaaugcccucuauuaagacaaaacgaaccggaagauauagauuguugguguaauucuacaucuaccuggguuaccuaugguacguguaccaccacuggugaacacagaagggagaaaagaagcguagcacucguaccccaugucggcaugggcuuagaaacuagaaccgaaacuuggaugaguagugaaggagcauggaaacaugcacagcgcauagaaacauggauacuaagacauccgggguuuacacucauggcugcaauucucgcguauacaauuggcacuacacacuuccaaagagcgcuaaucuucauauuauugacagcuguugcacccuccaugacuaugagguguauugguaucucaaauagagacuucguagaagggguaucuggaggauccuggguugacauaguguuagaacacgguucaugugugacaacaauggcgaaaaauaaaccuacauuggacuuugaguuaauuaaaacugaagcgaaagagccggcgacuuuaagaaaauauugcauagaagcuaaauuaacgaauacuacaacggaaucgcguuguccaacgcagggggaaccuagucuuaaugaagaacaagacaaacgcuucguguguaaacauucaaugguugaccgcggaugggggaauggcuguggauuauucggaaagggagggaucguaacuugugcuauguuuaccugcaagaaaaauauggaagguaagauuguccaaccugaaaacuuagaauacacaauaguaauaacuccgcauaguggugaggagcacgcuguaggaaaugauacaggaaagcaugggaaagagauaaaaaucaccccacaaaguagcacaacggaagcagaauugacugguuaugggacaguuacgauggaauguaguccacggacugggcuggauuuuaaugaaaugguauuauugcagauggagaauaaggcuugguuaguacaucgucaaugguuccucgaucuuccgcugccguggcugccuggugcagauacacagggaaguaauuggauacaaaaagagaccuuaguaacauucaaaaauccacacgcgaaaaagcaggacgucguuguucuuggaagucaggaaggagcaaugcauaccgcauuaacuggugcaacagaaauacaaaugaguucaggaaaucuauuauucacaggucaccuuaaaugccgauuacguauggacaaguuacaguuaaaaggaaugucauauagcauguguacagggaaauuuaagguuguaaaagaaauugcagaaacacaacacgguacuauuguuguacggguccaauacgaaggugauggaagucccuguaagaucccuuucgaaaucauggaccucgagaaaagacauguguugggaaggcuuauuacuguaaaccccauuguaacagaaaaagauucgccaguuaauauagaagcugaacccccauucggagacagcuaugucaucauaggaguagaaccaggacaauuaaaauuaaacugguuuaagaagggaagcucgauuggacaaauguuugaaaccacuaugcgcggagcuaagagaauggcaauuuuaggagacacagccugggauuucggcucacucgggggaguuuuuaccucuaucggaaaggcuuuacaccaaguauuuggcgcaauauauggugcugcguucagcggaguaucguggacaaugaaaauuuuaaucggagucauaauaacuuggauaggaaugaacucacgauccaccagccuuucagucaguuugguacugguaggagugguaaccuuguaucugggcgugguuguacaagcugacucgggaugcguugugucguggaaaaauaaagaauuaaaaugugguaguggaauuuuuauaaccgacaacguacauacauggacugaacaauauaaauuucaaccugaauccccgucaaaauuagcaagugcuauacagaaagcucaucaagagggaauuuguggaauaagaucaguuacaagacuagaaaaccuaauguggaagcaaauaacgcccgaacuaaaccacauacuaagcgaaaaugagguaaaguugacaauuaugacgggcgauaucaaaggcauaaugcacgcaggaaaaaggucacuaaggccgcagccgacagaauuaagauacuccuggaaaacaugggguaaagcgaaaauucuaucaacagaaucucauaaucaaacauuccuuauagauggacccgaaaccgccgaguguccaaacaccaacagagcauggaacucgcucgaaguagaagauuaugguuuuggcgucuuuacaacgaauauuuggcugaaauuacgugaaaagcaagaugcauucugcgacccgaaguugaugagcgcagccauaaaagacaauagagcaguacaugcugauauggguuacuggauagaaucagcacuaaacgauacauggaaaauagaaaaagcgucauuuaucgaaguaaagaacugucacuggccuaaaucucauaccuuauggucaaaugguguauuggaaagcgagaugauaauacccaaaaauuuugccgguccgguaucucaacauaauuaucggccagguuaucauacucaaacagcugguccauggcacuuaggcaagcuggaacucgacuuugacuucugugaaggaacaacuguuguagucacggaggauuguggaaauagaggcccgaguuuacgaacgacaaccgcgucuggcaaacuaaucacugaauggugcuguaggucauguacacuaccaccucuccgguacaaaggggaggacggcuguugguauggaauggaaauaagaccauuaaaagaaaaagaagaaaacuugguuaguucccuuguaacugccgggcacggacaaaucgacaacuuuucccugggcguucuaggaauggcacuuuuucuggaagaaaugcugagaacgagaguuggaaugaagcaugccauccuucugguugcaguuucguucgugacacucaucacgggaaauaugagcuucagggauuuaggccgugugaugguuauggugggugcaacaaugacagaugauauaggaaugggugucacauauuuagcucuuuuagccgcuuuuaagguaaggccaacauuugcagcuggacuuuuacugcgaaaguuaaccaguaaggaacucaugaugacgacaauagggauagucuuauuaucucaaucgacaauuccagaaacaauacuggaacucacugaugcguuagcucugggcaugaugguacuaaagauaguaagaaaaauggagcgguaccaauuagcugugacaauaauggcaauccuauguguccccaauucgguaauuuuacagaaugcauggaaagucuccugcacaauucuagcuguugugucagucuccccauuacuccucacuucaagucagcaaaaagccgauuggauaccguuagcacucacgauaaaaggauuaaacccgacggcaauauuccuaacuacucugagcaggacaucgaagaaaagaagcuggcccuuaaacgaagcaauaauggccguugggauggucucaauacuugcaucuaguuuacuuaaaaaugauauaccaaugacaggaccccugguggcagggggcuuguuaaccgucugcuauguucugacgggcagaucagccgacuuagagcucgaaaaagccgcugauguacgaugggaagaucaagcggaaauaucuggaucaucacccauauugaguguaaucguuucggaagacgggagcauguccaucaaaaaugaagaagaggaacagaccuugacuauccuaaucaggacaggauuacucguaauuaguggucuuuuuccuguauccauaccaauuacagcagcagcaugguacuugugggaaguaaagaaacaacgagcaggaguguuaugggacguccccucgccaccucccgugggaaaggcagaacuagaagacggagccuauagaauaaagcaaaaaggaauacuuggauauucccaaauaggagccggcguauacaaagaagggacauuucauacuauguggcacgucacccgaggugcaguauugaugcauaaaggaaaaagaauugaaccaucuugggcggaugugaagaaagaucucaucucauacggagguggauggaaauuagaaggagaauggaaagagggugaggaaguccaaguguuggcauuagaacccggcaagaacccacgagcaguacaaacuaagccuggauuauucaaaaccaaugcagguacgaucggagccguuagccuagauuucagcccagguacaagugggucuccuauaauugauaagaaaggaaaagugguuggguuauauggcaacggaguaguaacaagaaaugggagcuauguaagcgcaauagcucagacagaaaaaucgauugaagauaauccagagauagaggacgauaucuucaggaagaagagauuaacaauuauggauuuacauccuggcgcagguaagacgaaaagauaucuaccggcaaucguuagagaggcuaucaagagaggacuuaggacacucauauuagcaccaacucgaguuguagcggcugagauggaagaagcauuacgaggguugccgauaagguaccaaaccccugcaauucgugccgaacacacuggaagagaaaucguugaucuaaugugucaugcaacuuuuacuaugagguuguugagccccauuagaguaccuaauuacaacuuaauuauaauggacgaagcucacuucacugaucccgcaucgauugcagcuagagguuauauaagcacuaggguagaaaugggagaggcagccggaauauucaugaccgcuacaccaccggggucacgagauccauucccacaaagcaaugcuccgauaauggacgaagaaagagagauaccggaaagaucuuggaacucgggacaugaaugggugacugacuuuaaaggaaaaacaguuugguucguaccaucgauuaaagcaggaaacgacaucgcagcaugccuaaggaaaaauggcaagaaaguuauucaauuaucucggaaaaccuucgacucagaauaugucaaaaccagaacgaacgauugggauuuuguugugaccacggauauaucagaaaugggagcuaacuucaaggcagaaagaguuaucgacccaaggcgaugcaugaaaccuguaauccuaacggauggugaagaacgagugauucucgccgggccuaugcccguuacucauaguucugcagcgcagagaagaggacggauaggaagaaaucccaaaaaugagaaugaucaauauauauacaugggagagccacuagaaaaugaugaagacugugcacacuggaaagaagcaaaaaugcucuuagacaauauaaauacacccgaaggcauuauaccaucaauguuugaaccugaacgcgaaaagguagacgcuauagauggcgaguauagacuucgaggugaagcaagaaaaacguuuguggaccuaaugcgacgaggugacuuaccuguaugguuagcuuacaaaguugcggcugagggaaucaacuaugcugaucgccgcuggugcuuugacggaauaagaaauaaucaaauacucgaggaaaauguugagguagaaauauggacaaaggagggugagcggaagaaacuaaagccaagauggcuagaugccaggauuuauagugacccauuagccuugaaagaauuuaaggaauuugcugccggcaggaaaucauuaacccuaaaucucauaacggaaaugggaagauugccaacauuuaugacgcaaaaagcgagagacgcucucgacaaucuagcgguacuucacacugcagaagccgguggacgagcauauaaccacgcacuuucggaauuaccggaaacguuggaaacauugcuucuucugacacuguuagccacugucaccgguggcaucuuucuguuccucaugagcggcagaggaauaggcaaaaugacauuaggcauguguuguauaauaacugccagcauacuguuaugguacgcacagauacaaccucauuggauagcagcaaguaucauucuugaguucuuuuugauaguauuacuaauuccugaaccugaaaaacaacgaaccccacaggauaaccaacuuacguauguaguuauagccauacucaccguuguugcagcaaccauggcuaaugaaaugggguuccuggagaaaaccaagaaagaucugggcuuagggucuauugcaacgcaacaacccgaaaguaauauauuggauauugaccugcgcccugcaucagcguggacccuauaugcaguagcaacgacauuuaucacucccaugcuaagacauuccaucgaaaauaguucuguaaauguaucauuaacagcaauagccaaucaagccacaguuuuaaugggacuaggcaaaggauggccgcucuccaaaauggacauaggcgucccucuguuggcaauuggauguuacucacaaguaaacccgauuacccuaacggcagcuuuguuguuauuaguugcacauuacgcuauaauugggccaggauuacaagccaaagcaacacgggaagcccaaaaacgugcagcugcaggcauuaugaaaaauccgaccgucgaugguauuacagccauugaucuugauccuauacccuaugaccccaaguuugaaaaacaguuaggccaaguaaugcuucucguucucuguguaacucaaguguuaguuaugaggacgacaugggcuuugugugaagcauugacauuagcaacgggucccauaucgacacugugggaaggaaacccagggcgguuuuggaacacgacuauugcagucucuauggcaaauaucuuuaggggaaguuaccuagcuggugcgggauuacuuuuuaguauaaugaagaauacaacgaauacccgaagggguacugguaacaucggagagacauuaggcgaaaaauggaaauccaggcuaaaugcacuagguaaaagugaauuucaaauauacaagaagaguggaauacaagaaguagacagaacacuugcaaaagaaggaauaaaaagaggugaaacagaucaccacgcugucucgcguggaagugcuaaauugagaugguuuguagaacggaauaugguaacccccgaaggcaaaguaguugaucugggaugugguagaggugguuggucauauuacugcgggggacugaaaaaugugcgagaagugaaaggccuaacaaaaggaggcccaggccaugaagaaccaauuccuaugaguacguacggauggaaucuugugagacuacaaagcgguguugacguauucuucaccccuccagaaaagugcgacacccuucucugugauauaggugagaguucccccaacccaacggucgaagcgggacggacucuucgcguguuaaauuuaguagagaacuggcuaaacaacaacacacaauuuuguauaaaaguuuuaaauccuuauaugccaucuguaauagagaaaauggaagcguugcaaaggaaauauggcggagcccuaguuagaaauccguuaucccguaauaguacacacgaaauguacuggguaagcaacgcuagcgguaacauugucucaaguguuaauaugauuaguagaaugcugaucaauagguuuaccaugaagcacaaaaaggcuacauacgagccggacguugaucuaggcagcgguaccagaaauauaggaauagaaagugaaguaccaaacuuagauauaauuggcaaaaggauagagaaaauaaagcaagaacacgagaccucauggcauuacgaucaggaucauccuuauaaaacgugggcauaucauggguccuaugaagcuaaacagaccggaagcgcuucuaguaugguuaacgguguuguaagauuacucacaaaaccgugggauguaauaccaaugguuacucaaauggcaaugaccgacacaaccccuuuugggcagcaacgcguauucaaagaaaaaguggacacccgaacgcaagaaccaaaagaagggaccaagaaacucaugaaaaucaccgcugaauggcuauggaaagaauuaggaaagaagaaaaccccuagaauguguacacgugaagaguucacacgaaaaguaagaucgaacgcagcccuaggagcuauauucacugacgaaaacaaauggaaaagugcuagagaagcgguugaagauagucgauuuugggaauuaguugauaaagagagaaaccugcaccuagaaggaaaaugugaaacuuguguguauaauaugauggguaaaagagaaaagaaacuuggugaguucggcaaagcgaaaggaucacgagcuauaugguauauguggcucggagcaagauuuuuagaguucgaagcucuaggcuuuuuaaaugaagaucacugguuuucgcgagaaaacaguuugucuggugucgagggcgaaggacuauacaaacuagguuauauuuugagggacgugucgaagaaagaaggcggcgcaauguaugcagaugacacugcggggugggauacacgaaucacucuggaagaucucaaaaacgaggaaaugguaacuaaccauauggaaggugagcauaagaaacuagcugaagcaauauuuaagcuaacguaucaaaacaaaguaguaagagugcagcgaccuacgccaagggggacuguaauggacauaauuagcagaagagaucaacgcgggucaggccaaguagggacauauggacuaaacacuuuuacaaauauggaagcacaguugauacgccagauggagggugaggggauauucaaguccauucaacacuugacagccacagaagaaauagccgugcagaacuggcuuacaagaguaggaagagagcgucucagccguauggcuauuucuggugacgauuguguugucaagccccuagaugaucguuuugcaucagcauuaaccgcauugaaugacauggguaaaguaagaaaagauauccaacaaugggaaccaucuaggggguggaaugacuggacgcaagucccauuuuguagucaucacuuccacgagcuaauuaugaaggacggaagaguacuuguuguucccuguaggaaucaagacgaacuaauaggcagagcucguauuucacagggagcagguuggagucuacgagaaacagcauguuuaggaaaaagcuacgcgcaaauguggucuuuaauguacuuccacagaagggauuuaagacuggcggcaaacgcuauaugcucagcuguacccucccauuggguaccuacgucuagaacaacuuggucgauacacgcuaaacaugaauggaugacaacagaagauauguuaacagucuggaauaggguuuggauccaagaaaacccauggauggaggauaaaacaccuguugaaucuugggaagaaauucccuauuuagggaaaagagaagaucaguggugcggcucuuugauugggcucacuagccgggccacuugggccaagaauauucagacugcaauaaaucaagugagaucuuuaauuggcaacgaggaguauacggacuacaugcccagcaugaaaagauucaggagagaagaagaggaagcgggaguacugugguaa

SEQ ID NO: 22173 - RNA, 9876 nt, Artificial Sequence
  derived and/or modified CDS sequence (opt6) from DENV-2__KF744402__SS-prME
accgcaggaaugaucauaaugcucauacccacuguaauggcauuucauuugacaacgaggaauggcgaaccacacaugaucguguccaggcaagaaaaaggcaaaucauuauuauuuaaaacugaagacggaguaaacaugugcacuuuaauggcaauggauuuaggugaacucugugaagauacuauuacuuauaaaugccccuuauugcgucaaaaugaaccugaagauaucgauugcugguguaacucuacaaguacaugggugaccuauggaacauguacuacuacgggcgaacauagaagagaaaaacgauccguagcucuagucccucaugucgggaugggauuagaaacacgaacugaaacguggauguccagcgaaggcgcauggaaacaugcucagagaauagaaacuuggauuuuaagacacccggguuuuaccuuaauggcggcaauucuugcauacacaauugguaccacgaacuuucaacgagcuuuaaucuuuauccuuuuaaccgcaguggcgccgagcaugacuaugcgcugcaucggcauaucaaaccgggauuuugucgaaggaguguccggaggcaguuggguugacauaguuuuggaacacgggagcugcguuacaacaauggcuaaaaauaaaccgacucucgauuuugaacuuaucaaaacugaagcgaaacaccccgcuacgcuucguaaauacuguauugaagcaaaauuaaccaacacaacaacugaaagcagaugcccgacucaaggugaacccucguuaaacgaagaacaagauaaaagauucguaugcaaacacagcaugguugaucgggguuggggcaacggaugcggacuuuucggcaaaggaggaauagugacgugcgcaauguuuacauguaagaaaaacauggaagguaaaauaguucaaccugagaacuuggaauacaccauugucaucacaccucacaguggagaagaacaugccgucggcaaugacacagggaaacauggcaaagaaaucaaaguuacaccgcaaaguucuauuaccgaagcagaauuaacgggauauggaaccguaacuauggaguguucaccacgcaccggucuggauuucaacgagaugguacugcuacaaauggaaaauaaagcauggcuaguccaucgccaaugguuuuuagacuugccucuaccauggcuuccaggagcagacacacaaggcaguaacuggauacaaaaagaaacauuaguuacuuuuaaaaacccgcaugcgaagaaacaagauguuguaguauuagguucacaggagggagcaaugcacacugcacuuacuggcgcgacagaaauccaaaugucaucaggaaaucuucuauuuacaggacaucuaaaauguagacuccgaauggauaaauuacaguuaaaagggaugucguauucaaugugcacuggaaaauuuaaagucguaaaggaaauagcagaaacccaacacggaacuauaguggugaggguacaguacgaaggugacggaaguccauguaaaauacccuucgaaauuauggauuuagagaaaagacacguuuuaggaaggcucauaacggugaacccaauaguuacggaaaaagauagcccuguaaauauugaagcagaaccuccauucggagauucuuauguuaucaucggaguggaaccagggcaacucaaacuaaacugguucaagaaaggaucaucaaucgggcaaauguuugaaaccacaaugagaggugcaaagagaauggccauucuuggagacaccgcuugggauuucggaaguuuagggggcguguucacuucgauaggaaaagcccuacaucagguauuuggagcuauuuauggagcagccuuuucgggugugagcuggacaaugaagauccuaauaggcguaauuauuaccuggauaggcaugaauaguaggucaacgucacuaucaguaaguuuaauucugguaggaguggucacgcuauauuuagguguagucguacaggcagacagcgguuguguugucaguuggcgaaacaaagagcuaaaaugcgggaguggcauauuuauaacggauaaugugcauacuuggacugaacaguauaaauuucaaccagaaagcccuaguaagcuagcaucagcaauucaaaaagcacaucaggagggaauaugugguauacggucaguaaccagacucgagaaucuaauguggaaacaaauuacacccgaacucaaucacauuuuauccgaaaaugagguaaagcuaacuauaaugacuggagacaucaaaggaauuaugcacgcuggaaaacguuccuuaagaccacaacccacugagcuacguuacucauggaagacauggggaagggcaaaaauuuugucgacagaaucucauaaccaaacauuucugauagaugggccugaaacugcggaaugcccgaauaccaaccgagccuggaauagucuagaaguggaagacuacggguucgguguauucacuacuaacauauggcuaaaacuuaaggagcgacaggauguauuuugcgauucuaaauuaaugagcgccgcaauaaaagauaauagggccgugcaugcagauaugggcuacuggauugaaucugcauugaacgauacauggaaaauagaaaaggccucauucauagagguaaaaagcugucacuggccuaaaagccacacauuguggaguaacggagugcuagaaagugagaugauaauacccaaaaauuuugcagguccugugucccaacauaacuauagaccgggcuaccacacccaaacugcaggcccuuggcaccuagguaaguuagagauggacuuugauuuuugugaaggaacgacuguagucguuacggaggacuguggaaacagggggccaagccuccgaaccacaacugcuucaggaaaguuaauaacagaauggugcugucgcucuugcacucucccaccucugagauaccguggagaggaugguuguugguaugggauggagaucaggccauuaaaagagaaagaagagaaccugguaaauucacuuguaacggcggggcauggacaaauugauaacuuuuccuuggguguuuuagggauggcuuuauuccuggaagaaaugcucagaacaagagugggcacgaaacacacgauacuauuaguugcgguuaguuucguuacguugaucacaggaaauaugucguuuagagaucuuggccgagucaugguaaugguuggugccaccaugacggauaauauuggaaugggagugacauauuuagcacuucuugcagcuuuuaaaguacguccuacguucgcugcaggacuauuauugagaaaauuaacuuccaaggagcuaaugaugacuacuauagguauaguacuccuaagccagucuacuauaccugagaccauauuagaacuuaccgaugcacuggcauuaggaaugaugguauuaaaaauuguacgaaauauggaaaaauaccaauuagcaguaacaauaauggcgauacucuguguaccaaaugcaguaauauuacagaaugcauggaaaguuaguuguaccauuuuagcgguaguuucggucucuccacuauugcuaacaucgagccagcaaaaggcagacuggauaccucucgcacuuacaaucaaggggcuuaauccgaccgcuauauuccuuacuacgcucuccagaacgagcaagaaaagaagcuggccacuuaacgaagcuaucauggccguugguaugguaucaauacuagcuucuagcuugcuaaagaacgauauuccgaucaccgggccauuaguugcaggcggacuucuuacuguuugcuauguacuaacaggaagaagcgcagacuuagaauuagagcgcgcagcagauguacggugggaggaacaggcugaaaucucaggaucuucuccaauacuuagcauaauaauaucagaggaugggucuaugucaaucaaaaaugaagaagaggaacagacauuaacuauacugauacgaaccggucucuuaguaaucaguggguuauuccccguuucaauacccaucacggcggcugcuugguauuugugggaaguaaagaagcagcgcgcugguguacuuugggauguaccgucucccccaccagugggcaaggcagaacucgaagacggugcauaucguauaaaacaaaaagggauauuggguuacagccaaauaggugccggagucuauaaagaggguacuuuucacacaauguggcauguaacacgaggcgcagugcucaugcauaaggggaaacgaauagaaccaagcugggcagacgucaaaaaggauuuaauaucauauggagguggauggaaacuagaaggcgaauggaaggaaggagaggaaguucaaguguuagcuuuagagccuggcaaaaauccccgcgcuguacagacaaaaccaggcuuauucaaaacuaaugcaggcacuauaggugcgguaagccuagacuucagucccgguacgucgggaucacccaucauagauaagaaaggaaaagucguaggacuauacggaaauggcguuguuacgagaaacgguucuuacguaucugcaaucgcgcaaacaggaaaaaguauagaagacaaucccgaaauugaagaugacauuuuuaggaagaaacgguugacaauaauggaccuccacccuggcgcagggaaaaccaaaagauaucucccagcaauaguaagggaggcaauuaaaagagggcugcguacauuaauuuuagcgcccacacgaguaguagcagcagagauggaagaagcgcuuaggggcuuaccaauuagauaccaaacaccagcuaucagagcggaacacacaggaagagaaaucguugacuuaaugugccacgcgaccuuuacuaugagguuauugagucccauuagaguuccaaacuauaaccuaauuauaauggaugaagcucauuucacagauccagccaguauagcagcccgcgguuacauaaguacuagggucgaaaugggcgaagcugcggggauuuuuaugacagccacgccaccaggauccagagacccauuuccgcaaucgaaugccccaauaauggaugaagaacgugaaauaccggaacggaguuggaacucagggcaugaaugggucacugacuuuaaaggcaagacgguaugguucguaccaucaauaaaggcagguaaugacauagcggcuugucuucguaaaaaugggaagaaaguuauacaacuaucucguaaaacauuugauagugaguacguaaaaacacgcacgaaugauugggacuucguaguaaccacggauauaagcgaaaugggcgcaaauuucaaagccgaacgggugaucgacccccguagaugcaugaagccaguaauccuuacagacggcgaagaacguguaauuuuggcgggaccaaugccggucacacacagcagcgcagcacagcgacgggguagaauuggaagaaauccuaagaaugagaacgaucaauauauuuacaugggggaaccuuuagaaaaugacgaagaucacgcucauuggaaagaagcuaaaauguuauuggacaacauuaauacuccagaaggcauuauaccuagcauguucgagccagagagagaaaaaguagacgcaaucgauggggaauaccggcuuagaggggaagcucgaaaaacauucguagaccuaaugagaaggggugaccuaccaguaugguuggccuauaaaguagcggcagaagggaucaauuaugcugauagaaggugguguuuugaugguauaagaaauaaucaaauacuagaagaaaauguagaaguagagauuuggacuaaagaaggugagaggaagaaauuaaaacccagaugguuagacgcccgaauauauagcgauccacuagcauuaaaagaguucaaagaauuugcugcuggacgaaaaucucuuacauuaaauuugaucacagagaugggacguuugccuacauuuaugacucaaaaagcuagggacgcacucgauaauuuagcuguguugcauacggcagaagcugguggcagagcuuacaaucacgcacuuagugagcugccugaaacccuugaaacacuuuugcuacuaacauuacuagcaacuguaacaggcggcaucuuucucuuucuaaugucgggcaaggguauuggcaaaaugacauuaggaauguguugcauuauaacggccagcguguuguugugguaugcacaaauccaaccucacuggauagcggcaagcauaauacucgaguucuuuuuaauuguucuucuuauccccgaacccgaaaagcaacgaacaccacaagacaaucaacuuacguaugucguaauugcgauauuaacaguagucgcagcaacaauggcaaacgagaugggcuuucuagagaaaaccaagaaagauuuuggccuagggucgauagcuacccaacaaccagagucaaauaucuuagauauagacuuaagaccggcaagugccuggacuuuauaugccguagccacgacuuuuauaaccccaauguugagacacagcauagaaaauucaaguguuaacguuagcuuaacagcuauagcaaaccaagcaacaguacuuauggguuuaggcaaagguuggccauuaucaaaaauggauauaggagugccgcuccuagccaucgguugcuauucucaagugaacccuauaacauuaacagccgcauuacuauuauuaguagcucauuacgcuauaauuggaccgggauuacaagccaaagcaacucgagaagcacagaaaagggcagcugcuggaauaaugaaaaacccaaccguagacgguauuacaguaauugaucuugacccaauaccauacgauccgaaauuugaaaaacaacuaggucaggucaugcugcuaguauuaugcgugacacaaguacuuaugaugcgcaccacuugggcucuuugcgaggcuuugacccuugcaacuggacccauaagcacuuugugggaagguaaucccggccgauuuuggaauaccaccauagcgguuucuauggccaacauuuuuagagguaguuaucuagcaggagcaggacuacucuuuucaaucaugaagaacacgaccaauacacgaagagggacuggaaauauaggcgaaacucuaggcgagaaauggaaaucacgguuaaaugcccugggcaaguccgaauuucaaauauacaagaagucaggaauacaggaaguagaccguacgcuagccaaagaaggaauuaaacguggugaaacugaccaucaugcaguuaguagaggaucugcuaaauuaagaugguuuguugaacgaaauauggucaccccagagggaaaaguagucgaucuagggugcgguagaggggguuggucauacuauuguggaggacuaaagaauguaagagaaguaaaaggauuaacaaaaggugguccaggacacgaggagcccauccccaugaguacauacggcuggaaucuuguccgacuacaaucaggaguagauguauucuuuacuccaccggagaaaugcgauacucuacuaugugauaucggugagagcuccccaaaccccaccguugaagcaggaagaacuuuaaggguacugaauuuaguugaaaacuggcuaaacaacaacacucaauuuugcauaaaaguccuuaacccauacaugccauccguuauugagaaaauggaggcacuucaacguaaguaugguggagcucuaguaaggaauccuuugagccgcaauagcacucaugaaauguauuggguuaguaaugcuuccgggaauauuguuucguccguaaauaugauuuccaggaugcuaaucaaccguuucacaaugaggcacaagaaagcuacuuacgaaccggauguugauuuaggaagugguacgaggaauaucggaauagagucagaaguaccuaacuuagauauaaucggcaaaaggauagagaaaaucaaacaagaacaugaaaccucguggcauuaugaccaagaccauccauacaaaacaugggcuuaucauggaaguuacgaaacaaaacaaacggguucagcaucaaguaugguuaauggaguaguccggcuacuaacaaaacccugggauguaauucccauggugacacaaauggcaaugacagauaccacacccuucggacagcagagaguauucaaagaaaaaguagacacacgaacccaagaaccgaaagagggaacaaagaaauugaugaaaauuacagcugaaugguuauggaaagaacuuggaaagaagaaaacuccacgcauguguacucgagaggaguucacuaggaaaguuaggucuaaugcagcacuaggggcaauauuuacagaugagaauaaauggaaaucugccagagaagcuguagaagacucacguuucugggaauuaguugauaaagaaaggaacuuacauuuagaaggaaaaugugaaacauguguuuauaauaugauggggaagcgcgagaagaaauuaggagaauuugguaaagcaaaaggaaguagggcgauaugguauaugugguuaggcgcgcguuuucuugaauuugaagcccuaggcuucuuaaaugaagaucacugguuuagcagagagaacagcuugucggguguagagggagagggauugcauaaacuuggauacauuuuaagggacguaucaaagaaagagggcggggcaauguacgcggaugauacugcaggaugggauacgagaauaacuuuagaagaucuuaaaaacgaggagaugguuaccaaucauauggagggugaacauaagaaacuugcagaagcaaucuucaaacuuacauaucaaaacaaaguagugagaguucagcgaccaacaccuagaggaacgguaauggauauuaucucgaggcgagaccaacgcgggucaggccagguggggacauaugguuuaaauacauuuacuaauauggaagcccagcugauacgacaaauggaaggagaaggcguguuuaaaaguauacagcacuuaacugcgacagaagaaauagcuguucaaaauugguuagcuagagugggccgcgagcgucucucaagaauggcuauauccggggaugacugugugguaaagcccuuagaugauagauuugcgucugcauugaccgcucuuaacgauauggguaaagucagaaaagauauccaacagugggaaccgagucgaggauggaaugauuggacacaaguucccuucuguucccaucauuuucaugaacuaauaaugaaggacggcaggguccuagucguacccugccgaaaucaagacgaauuaauaggcagagcucgaauaucucaaggagccggauggucucucagagaaaccgcgugccuaggaaaaucauaugcacagauguggucccuuauguauuuccaccgcagagauuuacgucucgcggccaacgcaauaugcucugcaguuccaucccauugggugccgacaagcagaacaacuuggaguauacacgccaagcaugaauggaugaccacagaggacaugcuuacaguauggaacagaguuuggauacaagagaaccccuggauggaagacaaaacaccggucgaaucaugggaagaaaucccauaccucgguaaaagggaagaucaauggugcggauccuugauagguuuaacuucccgagcaacgugggccaaaaauauccaaacugcuauaaaucaaguacggucucugaucggcaaugaagaguauacagacuauaugcccagcaugaaaagauuuagacgagaggaagaggaggcaggaguacuaugguag

SEQ ID NO: 22174 - RNA, 9876 nt, Artificial Sequence
  derived and/or modified CDS sequence (opt6) from DENV-2__KF744408__SS-prME
acagcggguaugauaauaaugcucauaccuacaguaauggcuuuccauuuaacuacaagaaauggggaaccacauaugauaguaucgaggcaagaaaaaggaaaaucacuacucuucaaaacagaagaugguguaaacaugugcacuuuaauggcaauggauuuaggagaacugugcgaagacacuauuacauacaaaugcccauuauuaagacaaaaugaacccgaagacaucgacuguuggugcaauucaacgagcacgugggugacauauggaacuuguacaaccaccggggaacaccgaagagagaaaagauccguugcauuaguaccacaugucggaauggguuuagaaaccagaacagaaacauggaugaguucugaaggugcuuggaaacaugcacaacguauugaaacuuggauauuaagacacccugguuuuacccucauggcggcaauccuugcuuacacgauugggacuaccaacuuccaacgagcucucauauucauucuauuaacagcaguagcaccaaguaugacuaugcggugcauaggaaucaguaauagggauuuuguugaaggugugucuggugguucaugggucgauauuguucucgaacauggaucaugcguuacaaccauggccaaaaauaaaccaaccuuagauuucgaauuaaucaaaacugaagcaaaacacccugcgacauugcguaaauauugcauagaagcuaaacuaacaaauacaacgacugcaucaaggugcccaacgcaaggagaaccuucgcuaaaugaagaacaagacaaaagauuuguuugcaaacacucaaugguagacagaggcugggggaacggauguggccucuucggaaaaggugguauagugacaugugcgauguuuacauguaagaaaaauauggaagguaaaauaguacaacccgaaaauuuagaauacacaauugucauaacgccacauucaggugaagaacaugcgguagguaacgacacaggcaaacacgguaaagaaauuaaaauaacaccacaaaguaguauaacugaagcagaacucacaggcuauggcaccguaacgauggaauguucuccaagaacaggacugggcuucaacgaaaugguacuauuacagauggaagacaaagcauggcuaguccaccgccaaugguuccuugacuuaccuuugcccuggcuuccuggugcggauacgcaagguaguaauuggauucaaaaagaaacucuugugacuuuuaaaaauccacaugccaagaaacaagacgucguugucuuggguagucaggagggugcuaugcauaccgcacucacaggagcuaccgaaauacaaaugaguagcggaaaccuacucuuuacaggucacuuaaaauguagauuacgcauggacaaacuacaauuaaaaggaaugucguacaguaugugcacuggcaaauucaaaguuguuaaagagauagcugaaacccagcaugguacuaucgucgucagagugcaauaugagggagacgguucucccuguaaaaucccguuugaaauaauggaucuagagaaaagacacguacucggcagacuaauaaccgucaacccuaucguaaccgaaaaagacucuccaguuaauauagaggccgagccacccuuuggugauucuuacguuauaauaggcguugaaccgggacaacuuaaacucagcugguuuaagaaagggaguucaaucgggcagauguucgaaacaacuaugcgaggagcaaagagaauggcaauauugggugacacggcuugggauuuugggucucuaggaggagucuucacgaguaucggaaaggcucuccaucagguguuuggagcaauauacggagcggccuuuucagggguaagcuggaccaugaaaaucuuaauuggagugaucauuaccuggauaggaaugaauagcagaucaacaaguuuaucgguuagucuaguccucguuggaguagugaccuuguaucuaggaguuguuguacaagcugauucaggauguguugucagcuggaggaauaaagaacugaagugcgggagugggauuuucauaacagacaauguacauacuuggacagaacaauacaaguuucaaccagaaucaccgucaaaguuggccagugcaauucagaaggcccaccaagaaggaaucugcggcauaagaagcguaacaagacuggaaaacuuaauguggaaacaaauaacgccagaauugaaccacauacuuagugaaaacgaagucaaacucacgauuaugacaggugacauaaagggaaucaugcaagcugguaaaagaagccugagaccccagccaacagagcugcgcuauucauggaaaacauggggaaaagcaaaaauacuaaguaccgaaucacauaaucaaaccuuuuuaauugaugggccugaaaccgcagaaugcccgaacacuaaccgugcuuggaauagucuggagguagaggauuauggauucggcguauucacaacaaacauaugguuacgguuaagagagaaacaagacgcuuucugugacucgaaauuaauguccgcagcgauaaaagacaaccgagcaguacaugcugacaugggguauuggaucgaaagugcgcuuaacgauacuuggaaaauugaaaaagcgagcuucauugaaguuaaguccugccauuggccaaaaagccauacacuauggucaaaugggguacuugaaagcgaaaugauaauacccaaaaacuuugcugggcccguaagccaacacaauuaucggccuggauaccauacacagacagcaggaccguggcaccuaggaaagcuagaaauggauuuugacuuuuguaagggaacaacaguaguaguaacugaagauugugguaaucgaggaccaaguuuaagaacgacgacagcaaguggaaaacuaaucacugaaugguguuguaggagcuguacacucccaccccugcgguaucggggagaagaugguugcugguauggcauggaaauuaggcccuugaaagagaaggaagaaaaccuuguuaauucucuaguaaccgcaggccacgggcaaauagauaauuuuucucuagguguucuaggaauggccuuguuccuugaagagaugcuaagaacacgaguuggaacaaaacacgcuauucugcucguagcuguuucguuuguaacacuaaucaccgguaacaugucauucagggacuuaggcagaguuaugguuaugguaggugcaacaaugacggacgacauugggaugggcguaacguaucuagccuuacuagccgccuuuaaaguaagaccaacauuugcugcggggcuauuauuacgaaaauuaacgagcaaagaauuaaugaugaccacaauaggcauugucuuacuaagucaaaguacaauucccgagacgauuuuagaauuaaccgaugcauuagcgcuaggaaugauggucuugaagauugucagaaauauggaaaaauaucaauuagcuguuacaaucauggccauacuaugcgugccaaaugcaguaauuuuacaaaaugcauggaagguauccugcacaauuuuagcuguuguuagugugaguccauuacuguuaacauccagucaacaaaaggcagauuggauuccacuugcauuaaccauaaagggacuaaaucccacggcuauauuccuaacaacucuuucaaggaccucuaaaaagagaaguuggcccuuaaacgaagcaaucauggcagucgggaugguaagcauauuggcaucuucacuauuaaagaacgauauaccaaugacaggaccuuuaguagcaggaggccuacucacgguauguuacguucuaacuggaaggagugcagaccucgaguuggaaaaagcagcagacgucagaugggaagaccaagcagaaauaucaggaucaagcccgauauuaaguauuauaauaucagaagaugggucgaugucuaucaaaaaugaagaagaagaacaaacacucacgaucuugauuagaacuggucuauuaguaauaucaggauuguucccuguaucaauaccuaucacagcugcagcuugguacuugugggaggugaagaaacaacgcgcugggguccuuugggacgugccauccccgccaccgguggguaaagcugaacucgaggauggcgcauacagaauaaaacaaaaaggcauuuuagguuauagccaaauuggugcuggagucuauaaagaaggaacauuccauaccauguggcaugucacacguggagccguacugaugcauaaagguaaaagaauugaaccauccugggccgaugucaagaaagaccuaauuucauacggaggaggguggaaguuagaaggagaauggaaagagggugaagagguacaaguucucgccuuagaaccagguaaaaaccccagggcaguucaaaccaaaccuggucuauucaaaacaaacgcagggacuauaggugcaguuucacuugacuuuagccccgguacaucaggcagccccauaauugauaagaaaggcaaagucguuggacuuuaugguaacggaguggucacucgaaacgggucguauguuucggcaauugcacaaacggagaaguccauugaagauaacccugaaauagaagaugacauuuuucguaagaaaagguuaacaauaauggaccuucacccaggagccggaaaaacuaaaagauauuuaccugcaauaguucgagaggcuauaaaaagaggacuucguacauuaauccuagcaccaacaagaguaguugcagcagagauggaagaggcccuaaggggacuucccauaagauaucagacuccagcaauacgugcugagcauaccggcagagaaauaguugaccucaugugucaugcaacguuuaccaugcguuuacuauccccaauucguguaccaaauuacaaucuuauaauaauggacgaagcccacuuuacagauccggcuucuaucgcggccaggggauauauuuccacacgaguggaaaugggugaagcagcaggcaucuucaugacggcaacaccaccggguucgagagacccguuuccccaaaguaaugcaccaauaauggacgaggagagagaaauaccggaaagaucauggaacaguggucacgagugggucaccgauuuuaaagguaaaacagugugguuuguaccuaguauuaaagcuggaaaugauauugcagcgugccucaggaaaaauggaaagaaaguuauacaauugucgagaaaaacguuugauagcgaauacgucaaaacacggacaaaugauugggacuucguagucacaacagauauuucagaaaugggcgccaacuucaaagcagagcgugucauugacccaagacggugcaugaaaccggugauacugacggacggugaagaaagggucauauuagcuggaccaaugccgguaacucauaguucagccgcacaaagacgaggccggauaggacgaaaucccaaaaaugaaaacgaccaguauaucuacaugggugagccacuugaaaaugacgaagacugugcccauuggaaggaagccaagaugcuacuugacaauauaaacacccccgaaggcauuauaccaaguauguuugaaccagagagggaaaagguagacgcaaucgacggugaauauagauugaggggagaggcucgcaagacguucguugacuugaugcggcgaggcgaccuaccagugugguuagcguauaaagucgcugcagaagggauuaauuaugcugaccgacguuggugcuucgaugguauccgaaacaaucagauuuuagaggaaaacguagaaguugaaauauggacuaaagagggagaacggaaaaaguuaaagccaagaugguuagacgcaagaauauauagcgacccauuggccuuaaaggaauuuaaagaguuugcagcugguaggaaaucacuaaccuugaaccuaauuacagaaaugggaagacucccuacauucaugacccaaaaagcacguaacgcuuuagacaauuuagcaguauuacauacagcagaagccggugguagagccuacaaucacgcguuaucagaacugccggaaaccuuagagacccuccuauuacuuacguugcuggcgaccguaacuggcggaauuuuucuauuuuugauguccggcaaagggauaggcaaaaugacccuugggaugugcugcauaauuacagccucaguauuacuuugguaugcccaaauacaaccgcauuggauugcagcuucuauaauacuagaguucuuuuugauaguauuauuaauccccgaaccugaaaaacagaggacaccacaggauaaucagcugacguacguaguaauugcgauucuaacagucguggccgcaacuauggcaaaugaaaugggauuuuuagagaaaacgaaaaaggaucuagggcuuggaagcauaacuacacagcagccagagucaaauauacuagauaucgaucuaaggccagcgagugcauggacacuuuaugccguagcgacaaccuucauaacaccgaugcuucgucauucaauagaaaauuccucaguaaauguaucccuaacagcuauagcaaaucaagcaacugugcugauggggcugggcaaaggauggccucucucgaagauggacauagguguaccccuucuugcuauaggguguuacagucagguaaaucccauuacuuuaacagcagcacugcucuuguuaguugcacauuacgccaucauagggcccggacuccaagcaaaagccacacgugaagcucagaaaagagcugcugcaggaauaaugaagaacccaacaguagacggaaucacgguaaucgauuuagauccgauccccuaugauccuaaauucgaaaaacaacuuggacaaguuauguuguuagugcuguguguaacacaagucuuaaugaugcguacuacaugggcacugugcgaagcacuuacccuagcgacaggcccaauaagcacucuaugggaagguaauccaggacgcuucuggaacaccacaaucgcaguaucuauggcgaacauuuucagagggucauauuuggccggugcaggauuauuauucuccauaaugaagaauacgacaaauacacgaagaggaaccggaaauaucggagaaacacuuggggagaaauggaaaucucgauugaacgccuuagggaaaagugaauuucagaucuauaagaaaucagggauucaagaaguagauaggacucuagcgaaagaaggaauaaaacgaggagagacggaucaucaugcaguaucaagagggucagcaaaauugagaugguuuguagagaggaauaugauuacuccugaaggaaaaguaguagaccuaggcugcggacgaggaggguggagcuauuacugugguggccuaaagaacguucgugaaguaaaagggcuaacaaaaggcggaccuggucaugaagaaccuaucccaaugaguacuuauggauggaacuuaguuaggcuucaaaguggaguugaugucuucuuuacgccaccagagaaaugcgacacauugcucugugauauaggggaguccaguccuaacccuacgguagaagccggacgaacccuaagaguacucaauuugguugaaaacugguuaaauaacaacacacaauucuguauaaaaguccucaacccuuacaugccuucgguaauagagaaaauggaagcucuccagcguaaauacgggggugcucuuguaagaaauccucuuucacgcaacaguacacaugaaauguauuggguuagcaaugcuucuggcaauaucgugaguagcguaaauaugauuagucguaugcucauaaaucgauuuaccaugaaacauaagaaagccacuuaugaacccgaugucgaucucggaagcggaacuaggaacauuggaauugaaagcgaaguccccaaucuagauaucauaggaaaacgcauagagaaaauaaaacaggaacacgaaacaucuuggcauuacgaucaagaccauccauauaaaacgugggcuuaucauggaucauaugagacuaaacagacugguucagcaucuucaaugguuaauggugugguaagacuacuaaccaagcccugggacgucauaccaaugguaacgcaaauggcaaugacagacaccacaccguucggucaacaaagaguuuuuaaagaaaaaguggacacuaggacacaagaaccaaaagaagguacaaagaaacuuaugaaaaucaccgcugaguggcuauggaaagaacugggcaagaagaaaacgccaagaaugugcacacgcgaagaauuuacgcggaaaguucgaucaaaugccgcgcucggugcaauuuuuacugaugaaaacaaauggaaaagugcaagggaagcuguagaagauucaagauuuugggaauuaguagauaaagaacgaaaucuacacuuggaagguaaaugcgaaacuugcguauacaauaugaugggaaaacgugagaagaaacuuggugaguucggcaaagcgaaggguucacgagcuauaugguacaugugguuaggagcgcgauuucuagaauuugaggccuuagguuuucuaaaugaagaucauugguucucacgggaaaauucgcuaagugguguggagggagaaggacuccauaaauuaggguauauacuuagagacgugagcaagaaagagggaggagccauguaugcagacgauacugcagggugggacacacgcaucacucucgaagaccugaaaaaugaagaaaugguaacuaaucauauggaaggggaacacaagaaauuagcagaggcuaucuuuaaacuuacuuaccagaauaaagugguuaggguucaacgcccaacaccacgcgguacagugauggacauaauuucucguagagaucaacgaggaaguggacaaguuggaaccuacgguuuaaauacuuuuacaaacauggaggcgcaauuaauuaggcaaauggagggcgaaggagucuucaaauccauucaacaccuuaccgcuacagaagagauagcaguacaaaacuggcuggcaaggguugggagagaacgacugucgaggauggcgauaucuggcgaugacuguguaguaaagccgcuagaugaccgauucgcaucagcacuaacagcccuaaacgauauggguaaaguucgcaaggauauucaacagugggagccgucaaaagguuggaaugauuggacacaggucccauuuuguagucaucauuuccacgaacuaauaaugaaagauggacgugugcuaguuguacccugcagaaaucaggaugaacuuaucggcagagcuagaauaagucaaggugcuggguggagucuccgagaaacugccugucucgguaaaucguacgcgcaaauguggagucuaauguauuuccaccgaagagaucuucgauuggccgcgaaugcuauauguagugccgugccuucacacuggguccccacaagcaggaccacuuggaguauacaugcaaagcaugaauggaugacuacagaagacaugcuaacaguauggaaccguguauggauacaagagaaccccuggauggaagacaaaacgccaguugagucaugggaagagaucccguacuuaggaaaacgggaagaccaauggugcgggucacucauuggguugacgagucgugcaacaugggcuaaaaacauacaaacagcaauuaaccaagucagaucacuuaucggcaacgaagaauauacagauuauaugccgaguaugaaacgauuccgacgagaagaagaagaggccgguguccucugguaa

SEQ ID NO: 22175 - RNA, 9876 nt, Artificial Sequence
  derived and/or modified CDS sequence (opt6) from DENV-2__JX669476__SS-prME
acugccgggguaauaguaaugcuaauaccuacugcaauggcuuuccaccuaacuacaagaaacggagaaccucacaugauuguuggacgucaagaaaaagggaaaucacuuuuauuuaaaacugaagauggagucaauauguguacuuuaauggcuauagaucuaggggaauuaugugaagacacaauuacauacaaauguccauuacuucgccaaaaugaaccugaagacauagacugcugguguaacucuacaucuacauggguuacauacgggacauguacaacgacaggugaacauagacgagagaaacguuccguugcauuaguaccucacguggggaugggauuagagacccgaacggaaacauggauguccucagagggggcauggaaacauguacaaaggauagagacuuggauacuaagacauccgggauucaccauaauggccgcaauauuagcuuauacuauuggaacaacacauuuccaacgggcauuaaucuucauucugcuaacugcaguugcgccuucuaugaccaugcguuguaucgggauuagcaacagagauuucguugaggggguaucaggagggucuuggguagauauaguauuagaacacgguucaugcgucaccacuauggcuaaaaauaaaccaacacuggacuuugaacuaaucaaaacagaagcgaaacagccugcaacacuacgaaaauacuguauagaagcgaaacuaacaaacacuaccacugaaucacgcuguccaacacagggagaaccuucacugaacgaagaacaggauaaaagguuuauauguaaacacaguauggucgaccgaggauggggaaauggaugcggauuauuuggaaaagguggaauuguuacuugcgcaauguuuacaugcaagaaaaauauggagggaaaaauaguucaaucagaaaacuuggaguacacuauaguaauaacaccccacucaggagaagaacacgcagucgguaacgacacaggaaaacaugguaaagagauuaaaauuacaccgcaaucgucgaccacagaagcagaguuaacaggguacggaacaguuacuauggaaugcucaccuaggacaggauuagauuuuaacgaaauggugcuguuacaaauggaagacaaagcgugguuaguacaucgccaaugguucuuagauuuacccuuaccaugguugccuggagcagacacgcaagguucuaacuggauucaaaaagagacacucguaacguucaaaaauccacacgcgaagaaacaagauguugugguuuuagggagucaggaaggagcuaugcauacagcauuaacaggggcuaccgagauucaaauguccucagguaauuuauuauuuacuggccaucucaaauguagauuacggauggacaaacuacaauuaaaaggaaugucguacuccauguguaccgguaaauuuaaaauuguuaaagaaaucgccgagacccaacacgggacaauaguaauuaggguccaauacgaaggagacggauccccauguaaaauuccuuucgaaauaaccgaucuugagaaaagacauguauugggcagacuaaucacaguaaacccaauaguaacugaaaaagauucgcccgucaauauagaggccgagccuccauuuggugacagcuacauaauaguugguguagaacccggucaauuaaaacugaauugguucaagaaagguucuaguauaggccaaauguucgagacgacgaugagaggagcaaaaaggauggcuauucuaggugacacagcuugggacuucgguagcuuagguggaguauucacuucgauagggaaagcccugcaccagguauuuggugcgaucuauggggcagcauuuucagguguaucuuggacaaugaaaauauuaauaggagucauuauuacuuggauaggaaugaacuccagaucgacaagucugaguguaagucuuguccucguugggguggucacguuguaccucggugcgaugguacaagcagauucuggaugcauaguaucauggaaaaauaaagaacucaaaugcggaagcggaauauuuauaacagacaauguucauacuuggacugaacaauauaaauuucaacccgaauuuccaagcaaauuggcaagugccauacagaaagcacaugaggaagguauauguggaauacgaucgguaacuagauuagaaaaccugauguggaaacaaaucacaccugaauuaaaucauauauuaucugaaaaugaggucaaacuaacuauaaugacaggcgacauaaaaggaaucaugcaagccggcaaaaggagccuucgaccccaaccuaccgaguuaaaauacucuuggaaaacauggggaaaagccaaaaugcuaucuacagaaucacauaaccagacuuucuugauagacgggccugaaacagcggaaugcccuaacacaaaucgagccuggaacucucucgaaguugaagauuacggauucgggguuuuuacaacuaauauaugguuaaaauuacgagagaaacaagacguauuuugugauaguaaauuaaugucagcagcuauuaaagauaaucgagcaguacaugcagauaugggauauuggauugaaagugcccuaaacgacacuuggaaaguagaaaaagccuccuucauagaaguaaaauccugucauuggccaaaaagccauacuuuguggucuaacggaguccucgaaucugaaaugaucauacccaaaaauuucgcagguccagucucacaacauaauuauaggcccgguuaccacacacaaacagcagguccguggcaucuaggcaaacuggagauggauuuugauuucugugagggaacuaccguuguaguaacggaagauugugguaaucgggguccaucacucagaacaacaacugcgucaggaaaauugauuacggaaugguguugucguucgugcaccuuaccaccccuccgauauagaggagaagaugguuguugguacgggauggagauccgaccuuuaaaagaaaaagaggaaaaccuagucaauagccucguaacggcaggucauggucaaauagauaacuuuaguuuagguguauuagguauggcucuauuucuggaagagaugcuacguacacgcgugggcacgaaacaugcaauccuacuuguggcucuaucguuuguaacauuaauaacaggaaauaugucuuuuagggauuugggaagagucauggugaugguuggagcaacaaugacagaugauaucgggaugggcguuacuuaucuggcauuacuugcagccuuuaaaguacggccaacuuuugcggcugggcuauugcuacgaaaauugacaagcaaagaacugaugauggcuaccauugguauugcgcuucuaucacaaaguacgcuuccagaaacuauccuagaauugacugacgcgcuggccuuaggcaugauggcacuuaaaauuguaagaaauauggagaaauaccaauuagcagucacaaucauggcuauaagcugcguaccuaaugcaguuaucuuacaaaacgcguggaaaguaucguguaccauucucgcugcaguuucuguuucaccccucuuauuaacaagcagccagcagaaaacugauuggauaccucuugccuuaacaauuaaaggacuaaaucccacggcaaucuuccugaccacauuaucacgaacaaguaagaaaaggagcuggccauugaacgaagcuauuauggcuguugggaugguauccauucuggcuagcucuuugcuuaaaaaugacauacccaugacaggaccucuaguagcgggugguuuacuaaccguauguuacguccucacaggaaggagugcagaccuagaguuggaacgggcagcagaugucaagugggaagaccaagcagaaaucagcggaucaucaccaauacuauccauaacaauuagugaagaugguucuaugucaaucaaaaaugaagaagaagaacaaacuuuaacgauauuaauaagaacgggccuauuagugaucuccggcguuuucccagucaguauucccauuacagcugcugcuugguacuuaugggaagugaagaaacaacgugccggcguacugugggacguacccaguccaccaccgguagagaaagcugagcucgaagauggagcauauaggauuaagcaaagaggaauuuuggguuacucacaaauuggggcuggagucuacaaagaagggacauuucauacaauguggcaugugacucggggagcuguguugaugcaccgggguaagaggauugaaccaucaugggcggauguuaagaaagaccuuauaucauacgggggaggguggaagcuagaaggagaauggaaagaaggugaggaaguucagguccucgcucuggaaccgggcaaaaacccaagagccguacaaacaaaacccgguauauuuaaaacuaacacuggcaccaucggugcaguaucacucgauuucucaccuggaaccagcggcucuccaauaguugaccggaaagggaaaguaguaggacuauacgguaauggaguaguaacgaggaguggggcguauguuucugcuauugcacaaacagaaaaauccaucgaagauaauccagaaauagaggaugauauuuuccgcaagaaacgccuuacaaucauggacuuacauccaggagcaggcaagacaaagagguaccuucccgcaauaguccgggaagcaaucaaacgaggauuaagaacccucaucuuggcucccacucggguaguagccgcugaaauggaagaagcauuaagaggcuuaccgauucgcuaccaaacaccggcaauacgagcagagcauacgggacgagagauaguagaucuuaugugccaugcuacauucacaaugaggcuacuaagcccgguccgaguuccgaauuacaauuuaauaauaauggacgaggcucauuuuacugaccccgcaaguauugcggcccgagguuauauuuccacccgaguggaaaugggggaagcagcugguaucuuuaugacugcuacacccccuggcagcagggauccauuuccucaaucgaacgcuccuauuauggaugaagaaagagaaauaccagaaagaucauggaacuccgggcacgaauggguaacagacuucaaagguaaaaccgucugguucgucccaucaauaaaagcagguaaugauaucgcagccugcuuacggaaaaacgguaagaaagugauucagcugucaagaaagacauuugauucugaauauguaaaaacacgagcgaaugacugggauuucguaguaacuacugauauaucggagaugggagccaauuuuaaggcggaaagaguaauagauccuagacguugcaugaaaccaguaauccucacagacggagaagaacgagugauacuggccggacccaugccagugacucacucaagugcagcacaacguaggggaagaauaggaagaaacccuaaaaaugaaaaugaccaauauauuuauaugggcgaaccgcuagaaaaugacgaggauugcgcacauuggaaagaagcuaaaauguuacuagauaacaucaauacuccagaagguauuauaccaagcauguucgaaccggaacgugagaaaguugaugcgaucgacggggaauaucggcuucgaggugaagcucggaagacauuugucgaucucaugagacggggcgaucuucccguuugguuggcauauaagguagcggccgaggguauaaacuacgcggaucgcaaauggugcuuugaugguaucaaaaacaaucaaauacucgaggaaaacguagaaguggagauauggacgaaagaaggugagcgcaagaaauugaaaccacgaugguuagaugcucgaauuuacagugauccgcuagcguuaaaggaauuuaaggaguucgcugcaggacggaaaagucuaacuuuaaauuugauaacugaaauggggcgccuaccgacauucaugacucaaaaggcccguaacgcucuagauaauuuggcaguccuccauacagccgaggucgguggacgggcuuauacacaugcuuugucugaacugccagaaacguuagaaacauuacuacuguugacauuguuggcagcgguaacaggagguauauuucuauucuuaaugagcgguaaaggcauagguaaaaugacgcuaggaaugugcugcauaauaacugccucaaucuuacuaugguacgcacaaauucaaccacauuggauagcagcgucaauuauacuggaauuuuuccuaauaguuuugcugauaccagaaccagagaagcaaagaacuccccaagauaaucaacucacuuauguuguaauagcaauccuaacaguagucgcagcuacaauggcaaaugaaaugggauuccuagagaagacuaagaaagaccuaggcuucgguaguaucacuacccaagagucugaaaguaauauccuagauauugaccugaggcccgcaucagcauggacucuuuacgcaguagcaacaacuuuuguuacgccuaugcuucggcacucuaucgaaaauaguagcguaaacgugucauugacagccaucgcaaaccaagcgacgguacuaaugggauuagggaaaggauggccacugucgaaaauggacauuggaguccccuuacuugcaaucggauguuauagucaaguaaauccaauaacgcugacagccgcacuacuacuauuaguugcccauuacgcuauuauaggaccagguuuacaggcuaaagccacaagggaagcacaaaagagggcagccgcuggcauaaugaagaacccuacggucgauggcauaacuguuauugaucuugagcccauuccauacgaucccaaauuugaaaaacaguuaggccagguaauguuauuaauauuauguguaacucaaguacuaaugaugagaacuaccugggcccuaugcgaagcacuuacacucgccacaggaccaauauccacacugugggaaggcaacccuggaagauuuuggaacacaacaaucgcuguaucaauggcaaauaucuuuaggggaucauaucuggcaggggcgggucuucuauuuaguauaaugaaaaauacaacgaauacaagaagagguaccgguaacgugggagagacgcuuggugaaaaguggaaaagccguuuaaacgcccuagggaaaagcgaguuccaaauuuacaaaaagucaggcauacaagaaguagaucgaacgcuugcuaaagaaggcauuaaacgaggugagaccgaucaccaugccguaagucgugguagcgcaaaauuaagaugguuuguugaacguaacaugguuacgccagaagggaaaguaguagauuuggggugcggaaggggcgguuggaguuauuacugcggcggccugaaaaauguccgggaagugaaaggcuuaacuaaagguggaccgggucaugaagaaccgauuccaaugaguacuuauggguggaaccuaguuagacuccaaucaggcguagaugucuucuuuacaccgccagaaaaaugcgacacguuguuaugugauauuggagaaaguucgccaaauccaaccauagaggcagguagaacucuacggguuuugaaccuaguggaaaauuggcucaacaauaauacacaauuuugcauuaaaguucucaauccauacaugccuucaguuauugagaaaauggagacacuucaacguaaauacggaggugcucuuguccguaauccauuaaguaggaacucaacacacgaaauguauugggucucaaaugcuaccgguaauauugucucaucgguaaauaugauaucucgcaugcuuauuaauagauuuacgaugaaacacaagaaagcaacauaugagcccgauguugaccuugggagcggcacucguaacaucggaauagaaagugaaauucccaaucuagacaucauuggaaaacguauagaaaagauaaaacaagaacacgagauuucauggcauuaugaccaagaucaccccuacaaaacuugggccuaccacggaucuuacgaaacaaagcaaacggggagugcuaguaguauggucaacggcguuguacgccuguugaccaagccaugggauguaguuccuauggugacacaaauggcaaugacagauacgacgcccuuugggcaacaacggguguucaaagaaaagguagacacccgaacgcaggaaccuaaggaagguacuaagaaauuaaugaaaauaacagcggaauggcuguggaaggaauuggguaaggagaaaacuccacggauguguacgagagaagaauuuaccagaaaaguacgaaguaacgcagcguuaggagcuguguucaccgacgaaaauaaguggaagucugcaagggaggcggucgaggacgaccgauuuugggaacugguggauagagaacgaaauuuacaucuagaaggaaaaugcgaaacauguguauauaacaugauggguaagcgagagaagaaauuaggcgaguucggaaaagcaaaaggaucgagggcgaucugguacaugugguugggggcacgauuccuagaguucgaggcauuaggcuuuuuaaaugaagaucauugguucaguaggggaaauucccuaaguggaguggaaggagaaggucugcauagguuggguuacauuuugagggaaguagguaagaaagagggaggugcaauguaugccgacgacacggcagggugggauacccguauaacacucgaagacuugaagaaugaagaaauggugacuaaucauaugaagggggagcauaagaaacuagcugaggcaauauucaaacucacauaucaaaauaaaguaguacgaguccagaggccaacacccagaggaacuguuauggacauaauuaguaggaaagaccaaagagggucaggacaaguagggacauaugguuuaaauacuuuuacaaauauggaggcucaauuaaucagacagauggaaggagaagguauauucaagaguauccaacauuugacugcaacagaagaaauagcgguacaaaacugguuagcacguguaggaagagagagacugucaagaauggcaaucaguggagaugauugcguaguaaaaccgauagaugaccgauucgcaagcgcucuaaccgcauuaaacgacauggguaaaguaaggaaggauauacaacagugggaaccaucacgcggcuggaaugacuggacacaaguuccauucuguucacaucacuuccacgaauugguaaugaaagaugggagagucuuaguaguaccauguagaaaucaagacgagcugauuggcagagcaaggauaucgcagggugcugguuggagccuaaaggaaaccgcauguuuagguaaaaguuacgcccagauguggacacuaauguauuuccaccgacgagauuuaagguuagccgcgaacgcgauauguucggcaguaccaagucauuggguacccacaaguagaaccacauggaguauucaugcaaagcaugaguggaugacgacagaagacaugcuuacagucuggaaccguguauggauacaagaaaauccuuggauggaagauaaaacgcccguggaaaguugggaagaagugccuuaucuaggcaaaagggaagaccaauggugcgggucgcuaauugguuugacuucaagagcgacuugggccaaaaacauacaaacagcaaucaaccagguaaggucuuuaauagggaaugagggauacacugauuacaugcccucuaugaagcgauucagaagagaagaagaagaggcuggaguucuuugguaa

SEQ ID NO: 22176 - RNA, 9876 nt, Artificial Sequence
  derived and/or modified CDS sequence (opt6) from DENV-2__JX475906__SS-prME
acaguugggaugauaauuaugcuaauuccaacggcgauggcauuucaucuuacgacccguaacggagaaccacacaugauaguuagcaggcaagaaaaaggaaaaaguuugcuguucaaaaccgaagacgggguaaacauguguaccuugauggcaauggaucuuggcgaauuaugugaagauaccguuacauacaacugucccuuacugagacaaaaugaaccagaagauauagauuguugguguaauagcacaaguacuuggguaacauauggaaccuguacggcaaccggagaacaucgaagggagaaacgaagcguugcauuaguaccucacgugggaaugggguuagaaacacggaccgaaacguggaugucguccgaaggugcuuggaaacaugcgcaaagaauugaaacuuggauauuaaggcauccgggguucaccaucauggcugcaauauuggcauacacaauaggcacaacguacuuccaaagaguauuaaucuucauccuauuaacugcaguggcuccuucuaugaccaugcguugcauuggaauaucaaauagagacuuugucgaaggcguaagugguggauccuggguagauaucguauuggaacacgggaguugcguaacaacaauggccaaaaauaaacccacucuugauuucgaacucauaaagaccgaagcaaaacaaccagccacucuuagaaaauauuguauugaagcuaaacuaacaaacacuacaacagcaaguagauguccaacacaaggagaaccaucacuuaaugaagaacaagacaagcgauuuguauguaaacacucaaugguagauagagguugggguaaugggugcggacuauucgggaaaggagguauaguaacaugcgcgauguuuaccugcaagaaaaauauggagggcaaaauaguacaaccggaaaacuuagaauauacaaucguaaucacuccucauucaggggaagaaaacgcggucgguaaugauacgggaaaacacggaaaagaaguaaaaguaacaccacaaaguaguauuacagaagcugaacucacaggguauggaacgguaacaauggaaugcaguccaagaacgggacuugauuuuaacgaaaugguacuauugcagauggaaaauaaagcauggcuaguacauagacagugguuucuugacuuaccacuacccuggcugccuggagcugauacgcagggcucuaauuggauccaaaaagaaacuuuaguaacauucaaaaauccacacgccaagaaacaagauguuguaguacucgguucccaagagggggcuaugcauacagcauuaacaggugccacugagauacaaaugagcucuggaaaucuccuuuuuacaggucaccucaaaugucgucugagaauggauaaacugcaauuaaaagggaugucuuauagcaugugcacugguaaauuuaaagugguaaaagagaucgcagaaacucaacacgggacgauagugauacgcgugcaauacgaaggggaugguucucccuguaaaauaccuuucgaaauaauggaucuugagaaaagacauguauuagggaggcuaauaacaguaaauccaauaguuacagaaaaggauagccccguuaauaucgaagccgaacccccuuucggcgauagcuauauuauuauagguguggaaccagggcaauuaaagcugucaugguuuaagaaaggaaguaguauaggucaaauguuugagaccacaaugaggggagcaaagagaauggcuauacuaggugacacugcgugggacuucggaucauuaggaggggucuuuacaucaauuggcaaagcacuacaucaaguauucggugcaauauacggagcggcauucagugguguuagcuggacuaugaaaauauuaauaggaguaguuauaaccuggaucggaaugaauaguagaucaacaucacuaagcguuucauuagugcuaguaggcguugucacauuguaccuuggagucaugguucaagccgacucgggauguguaguaucuuggaaaaacaaagaauuaaagugugguucuggaauuuuuauaacugauaauguacauacuuggaccgaacaguauaaguuucaaccggaaaguccuuccaaacuugcgucggcaauucaaaaagcacaugaagagggaauaugugggauaagaucuguaacucgcuuggaaaaccuaauguggaaacaaauuacaccugaauuaaaccacauccucagcgagaacgaggucaaacuaacaauaaugaccggugacauuaaaggaauuaugcaagcaggaaaaagaucgcugagaccucaaccgaccgaauuaaaauauaguuggaagacuugggggaaagcgaaaaugcuaucgacagaaccccauaaucagaccuuucucauugauggaccugaaacagcagaauguccaaauaccaacagggcauggaacucacuggaaguagaagauuacgguuuugguguuuucacaacuaacaucugguuaaaauuaaaagagagacaagauguuuucugcgacagcaaacucaugagugcugccauaaaggacaaucgcgcgguacaugcagacaugggauauuggauagaaagugcgcucaacgacacauggaaaauagaaaaagccagcuucauagaagugaaaucaugccauuggccaaaaucucauaccuuauggucaaaugggguccuugaaucggaaaugauuaucccaaagaacuuugcaggaccgguaucacagcauaauuaucgaccaggguaucacacgcaaacagcugggccuuggcaucuugggaaacucgagauggacuuugacuucugugaaggaacaacugucguagugacagaagacugcggcaaccgagggcccuccuugcguaccacaacagcaagcgggaaguuaauaaccgaauggugcugucguucaugcacgcuaccuccgcuucgauauaggggagaagacggcuguugguacggcauggagauaagaccacucaaagaaaaggaagagaacuuaguaaacagucuggucaccgccggacacggucagauagacaacuucucccuagguguauuaggaauggcgcuuuucuuagaagaaaugcuuaggacaagaguaggaacuaagcaugcauuacuacucguagcaguaaguuucaugacuuugauaacaggcaauauguccuuucgagacuuaggccguguuaugguuaugguaggagcagcaaugacagaugacauuggaauggggguuacuuauuuagcauuacuagcagcauuuaaaguaagacccacauucgcagcaggauugcuucuucggaagcucacuucuaaagagcugaugaugacaacuauuggaauaguucuacuuagucaguccacaauaccggaaaccauacuugagcuaacagacgcacuagcuuuagguaugaugauauuaaagauugugcgaaacauggaaaaauaccaacuagcugucacuaucauggcuauacuguguguucccaacgcugugauucuacaaaaugcauggaaaguuuccuguacaauucuugcuguuguaucgguaucuccccuacuguugacuucuucacgucaaaaagcagacuggauaccuuuagcucugacgaucaaagggcuaaauccaacagcaauauuccucacaacacuaucaaggacaaacaagaagagaucuuggccccuaaacgaggcaauaauggcgguuggcauggucaguauccucgcaucgagucuacugaaaaaugauauaccgaugacaggaccauuaguugcuggcggguuacugacugugugcuacguacuuacaggucgaucagcagaucucgaauuggaacgagccgccgacguacgcugggaagaccaagcagaaauuagcggcuccagcccuauauugaguauuacuauaagugaagacggaaguaugaguauuaaaaacgaagaagaagaacaaacgcuuacaauccucaucagaacuggauuguuagucauuagcggccuuuuuccgguaucuauccccauuacagcagcggcaugguaccugugggaagucaagaaacaaagggcaggaguucugugggauguacccucacccccuccugugggaaaagcagaauuagaagauggagcuuauagaaucaagcaaaagggaauacuuggauacucucagauuggugcaggaguuuauaaagaaggaaccuuucauacaauguggcaugucacaagaggcgcuguguugaugcauaaaggaaagaggauugagcccucuugggcggauguuagaaaggaccucaucucguauggaggggguuggaagcuagaaggagaauggaaagaaggugaagaaguucaggugcuagcauuagagccaggcaaaaauccuagagcaguacagacaaaaccuggauuguuuaaaacaaauacagguacuauaggggcuguaucacucgacuuuagcccgggaacaagcgggucaccuauagucgacaagaaaggaaaaguaguugguuuguacggaaauggaguugucacgcguagugguacauacguuuccgcaauagcccaagcggagaaaagcauagaagacaauccagagaucgaagaugacauuuuuagaaaaagaagacugacgaucauggaccuacauccuggagcggggaagacuaagcgauauuuacccgcuaucguuagggaagcaaucaaaagaggacugcgaacucugauauuagcaccaacuagaguaguugccgcagaaauggaagaagcucuaagaggauugccuauucgauaucaaacccccgccauucgagcugaacauaccggaagagagauaguagaccucaugugucaugcaacuuuuacgaugcgcuuacuaagcccggucagagucccaaauuauaaucucauaauaauggaugaagcgcacuuuacagacccggcuaguaucgcagcacggggguauaucucaacgaggguagaaaugggugaagcugcgggcauauucaugaccgcuacuccaccuggaaguagggauccuuucccgcagaguaaugcaccaaucauggaugaagagagagaaauaccagagagaaguuggaauagcggucaugaauggguuacagauuuuaaaggaaaaacaguaugguuugucccaucuauuaaagccgguaaugauauagcggccugcuugaggaagaauggcaagaaggucauacaguuguccaggaaaacguuugauucagaguacauaaagaccaggaccaacgacugggacuuuguaguaacaacugauauuagugaaaugggugcgaauuuuaaagcagaaagaguuauugaccccagaagguguaugaagccagugaucuuaacagacggugaagaacguguaauacuugcaggacccaugcccgugacgcauucuagcgcagcacagaggaggggaagaauugggcguaauccaaagaaugaaaaugaccaauauauauauaugggagaaccccuugaaaaugaugaagauugugcacacuggaaagaagccaaaaugcuucuugauaauaucaauacaccugaaggaaucauacccagcauguucgaaccugagcgagaaaaggucgacgcuauagauggcgaauacagguuacgaggagaggcaagaaagacauucguugacuuaaugagacgaggugacuugccggucugguuagcauauaggguugcagcugaaggaauaaauuacgcagaccgaagauggugcuucgacggggugaagaauaaucaaaucuuagaagaaaauguagagguagaaauauggacaaaagaaggagaaagaaagaaauuaaagccuagauggcuugaugcacgaauuuacucugacccguuggcccuuaaggaguucaaggaauuugcagcaggaagaaaaagucuaacguuaaauuuaauuaccgaaaugggaagguuaccgacuuuuaugacacaaaaagcacgaaacgcauuggacaaucuagccguucuucauacagcagaagcaggggguagagcuuauaaccaugcucuuucagaacuaccugaaacacuagaaacacucuuauuacuaacuuuauuagcaacaguuacggguggaauauuuuuauuucuaauguccggaaagggcauugggaaaaugacgcuaggaaugugcugcaucauaaccgccucaauucuuuugugguaugcacaaauacaaccgcauuggauugcugcgaguaucauacuggaguucuucuugauaguucuucuuaucccugaaccugaaaagcaaagaacaccccaagacaaccaguugacuuaugucgucauagcaauauuaacagucguagcugccaccauggcaaaugaaauggguuuccuagagaaaacaaagaaagauuuuggacuugguuccauagccacccagcaaccagaaucgaacaucuuagauaucgaccuaagaccggccucugcauggacgcuguaugcgguugcuacuacuuuuaucacgccaauguuacgucauucaauagaaaauaguucagucaauguaucucucacugccauagcgaaucaggcgacaguacuaaugggucuuggaaaaggcuggccccuaucaaaaauggauauaggaguaccuuuacuugcuauaggaugcuauucacaagucaaucccaucacuuuaacagcagccuuacuauuacucguggcucauuaugcgauaauaggaccagguuuacaagcuaaagcaacaagggaagcacagaaaagagcagcugcugguauuaugaaaaacccuacaguagaugggauaacagucauagaccuggauccaauaccguacgacccaaaauucgaaaaacaacuugggcaagugauguuacuuguauuaugcgugacucaagucuugaugaugagaaccacaugggcguuaugugaagccuugacauuggcaacaggaccuauuaguacguugugggaggguaauccggggagauucuggaauacuacgauugcgguuucaauggcuaacauauucagaggcucauaucuugcuggugcaggguuacucuuuucaauuaugaagaacacuacaaauacuagaagagguaccggaaauacaggagaaacacuaggcgaaaaauggaaaaauagauugaaugcauugggcaaaagcgaauuucaaauuuauaaaaaguccgguauccaagaaguagauagaacgcucgcgaaagaaggaauaaaaagaggcgagacugaucaccacgccgucagucgcgguagugcaaaauuacguugguuuguagaaagaaaccugguaacacccgaagguaaaguaguggaucuaggcuguggaaggggaggcuggucauacuauugcggaggacuaaagaauguaagagagguaaaaggauuaacgaaaggcggaccuggacacgaagaaccuauuccaaugucaacauacggauggaaccuggucagacugcaaagcgguguggauguguucuuuaccccaccugaaaaaugcgacaccuuauuaugugacauaggagaaucaucuccuaaucccacuguagaagcgggaagaacacuccggguauugaauuuaguagaaaacugguuaaauaauaauacucaauucugcauuaagguccugaauccuuacaugccaagcguuauugagaaaauggaagcauugcaaagaaaauaugggggagccuuaguacggaacccguugucacgaaacagcacacaugaaauguacuggguaucaaacgcuucgggaaacauagucucaucagucaacaugauuagucgaaugcuaaucaaucgguuuacgaugcgacacaagaaagccaccuacgaacccgacguugaccuuggaucgggaacacgaaauaucgggauagaaagugaaaccccaaaucuagauauuauaggaaaaagaauagagaaaauaaaacaagaacacgaaaccaguuggcauuacgaccaggaucaccccuauaaaacaugggcguaccacggaucauacgaaacuaagcagacagguucggcaucuaguaugguaaacggaguaguccgucuauugacaaaacccugggacguuauuccuaugguaacgcaaauggcuaugacagacacuacaccguucgggcaacaaagaguauucaaagaaaaaguggauacacgaacacaggaaccaaaagaagguacuaagaaauuaaugaaaauuacugcggaauggcuuuggaaagaguugggaaagaagaaaacuccgagaaugugcacacgggaggaauuuacaaggaaaguuagaaguaaugccgcuuuaggagccaucuuuaccgacgaaaacaaauggaaaucagcaagagaagcaguugaagacucuagauucugggaacuuguagauaaggagagaaaccuucaucuugaagggaaaugugagaccugugucuacaauaugaugggaaagcgugagaagaaacucggagaguucggaaaagcaaaaggcuccagggccauuugguacauguggcuuggagcgcgauuucucgaguucgaagcgcuaggauuuuugaaugaagaccacugguuuagcagagaaaauuccuuaucuggaguugaaggugaaggguuacauaaauuaggcuauauccuaagggacguuucuaagaaggaagguggagcaauguaugcagacgacacagcggggugggacacgaggaucaccuuagaagauuugaaaaaugaagaaaugguuacaaaucauauggaaggagagcauaaaaagcuagcugaagcuaucuucaaauugaccuaucaaaauaaggucgugcguguacagaggccaacaccgcggggaacugucauggauauaauaucacgcagggaccagaggggcucuggucaaguagggacauauggauuaaacaccuucacaaacaugggagcgcaauuaaucagacagauggagggagaagguguuuuuaaaaguauacaacaccuuacagcuacugaggaaauagcagugcaagacuggcuugccagaguaggacgugaacgucuaagccggauggcgauuagcggagaugauugcguaguaaaaccacuagaugacagauuugcaagugcacuaaccgcacuaaacgauauggguaaaguacgcaaagauauacaacaaugggaaccaaguaggggguggaaugauuggacacaaguacccuuuugcucgcaucauuuucacgaacugauaaugaaagauggcaggguccuagugguacccuguagaaaucaagaugagcuaauagguagggcaagaaucucucagggugcagguuggagcuuacgagaaaccgcaugucugggcaagucauacgcgcaaauguggucucugauguacuuucacagaagagaccucagguuagcagcuaacgcgauaugcucugcaguuccuucucacugggucccgacuucacguacuacuuggaguauacaugcgaaacacgaauggaugacaaccgaagauauguugacagucuggaacagaguuuggauccaggagaauccguggauggaggacaaaacgccuguugaaucuugggaggagauacccuaccuugguaaacgcgaagaucaauggugugguucacucauuggccuuacgaguagagcgaccugggccaagaauauacaaacugcuauaaaccaaguuaggaguuugauagguaaugaggaauauacugacuauaugcccaguaugaaacguuuucgcagagaagaagaagaagcugguguucugugguag

SEQ ID NO: 22177 - RNA, 9876 nt, Artificial Sequence
  derived and/or modified CDS sequence (opt6) from DENV-2__JX669477__SS-prME
acggcuggagugaucguaaugcugauaccuacggcuauggcuuuccauuugacaacucgcaauggugaaccucauaugauuguaggacgccaggaaaaagguaaaagucuuuuauucaaaacagaagauggcguaaauaugugcacgcugauggcgauugaucuuggugaauuaugcgaagauacaauaacuuauaaauguccuuuacuaaggcaaaaugaaccggaagacauagauugcuggugcaacagcaccuccacuuggguaacauacggaacauguacaacuacaggcgaacaucggcgagaaaaacguuccguugcuuuagugccacacguagguaugggguuagaaacuaggacagaaacuuggaugaguucagaaggagcauggaaacacguucaaaggauugaaaccuggauuuugcgacauccuggauuuaccaucauggcagcuaucuuggcauacacaauaggcaccacucacuuccagagggcccuuauauuuauccuauuaaccgcaguagcaccaagcaugacaaugcgauguauagguaucucaaaucgagacuucguagaaggaguaagcgggggcucaugggucgauauaguauuagaacaugguucauguguaacaacaauggcgaaaaacaaacccacacuagauuucgaacucauuaaaacagaagcaaaacaaccugcaacucuccggaaauacuguaucgaagcgaaauuaaccaacacaacgacagaaaguagaugcccaacucaaggcgaaccaucacuuaaugaagaacaagauaaaagauuuaucugcaaacacucaauggucgauagaggcugggguaauggauguggacuguucggcaaaggugguauaguaaccugugcaauguucacuuguaaaaagaauauggaagguaaaauaguucaaccagaaaacuuagaguacacaauagucaucacgccacacaguggagaggaacacgccgugggcaacgauaccgguaaacacggaaaagaaauuaaaaucacuccccagagcagcacaaccgaagccgaauuaacaggauaugguacgguaacaauggagugcucaccuagaacaggcuuagauuuuaacgaaaugguucugcuacaaauggaggauaaggcaugguugguacaccgacaaugguuuuuggauuugccauuaccguggcucccaggcgcggauacacaggguaguaauuggauacaaaaggaaacuuuaguaacguucaagaacccccacgcuaagaaacaagacguaguaguauuaggcagccaagaaggagcuaugcauaccgcauuaacgggugcaacggaaauucagaugaguucagggaaucuacuauucacuggucacuuaaaaugcagguuacgaauggauaaguuacaauugaaagguaugucuuauucaaugugcacuggaaaauuuaagaucguaaaagaaaucgcugagacccaacacgguaccauuguuauaagaguucaguaugaaggagauggcucaccuugcaaaauuccuuuugagauaaccgaucuagagaaaagacauguucuggguagacuuauaacugugaaucccauaguuaccgagaaggacaguccaguaaauauugaggcugaacccccauuuggcgauaguuauaucaucguugguguagaaccaggucaauuaaaauuaaauugguuuaaaaaggguagcaguauuggucaaauguucgaaacaacgaugcgcggugcaaagcgaauggcaauacuaggagauacagcaugggauuuuggaucccuagguggagucuucaccucaauaggaaaggcgcuacaucaaguauuuggagcuauuuacggugcagcauucucagguguaaguuggacaaugaagauacuaauaggagucauaauuacuuggauuggaaugaacucacguagcacaucucucagcguaucacuuguauuagugggagucguuacgcuuuaucugggagcgaugguacaggccgauagugguugcaucguuaguuggaaaaacaaagaacuaaaaugcggaagcggaauuuucauaacugacaauguacacacauggacggaacaauacaaauuucaaccagagaguccaucaaaauuagcuagugcuauucaaaaagcccaugaagaaggaauaugcggcauucgcucagugacccguuuggaaaaucuaauguggaaacaaaucacuccagaauuaaaccacauuuuaagugaaaaugaaguaaaacuaacaauaaugacaggggauauaaagggcauuaugcaagccgggaagcgauccuugcgaccacaaccuacagaacuuaaauauucauggaaaacaugggggaaggcuaagaugcugagcacagaaagucauaaucaaacauuucuaauagauggaccagaaacugcagaauguccaaauacaaaccgagcguggaacuccuuagaagucgaagauuauggcuucggaguguuuacaaccaauauaugguuaaaacuaagagaaaaacaagacgucuuuugugacucuaaauuaaugagugcugcaauaaaagacaacagagccgugcacgcagauaugggauauuggauagaaucggcucuaaaugauacuuggaaaauggaaaaagccuccuuuauugaagugaaaaguugucauuggccuaaaagccacacucuguggaguaaugguguccuagaauccgagaugaucauucccaaaaauuuugcuggucccguaucccagcauaacuacagaccaggauaccauacacaaacagcuggaccauggcaccuugggaaacuugaaauggacuuugauuucugcgaagguacaacgguaguaguaacugaagauuguggaaacagagguccaaguuugagaacaacuacagccuccgguaaacucauuacagaaugguguuguagaucuuguacuuugccgccgcuccgauauaggggagaagacggauguugguauggcauggaaauacgaccauuaaaagaaaaagaagaaaaucuaguaaauagccuugugacagcgggucauggccaaauagauaauuucucacuaggaguauugggaauggccuuauuucuagaagaaauguugagaacaagaguuggaacgaaacaugcgaucuugcuaguggcacuaucauuugucacucucauuacagguaacaugucuuuucgggaccucggcagaguaaugguuaugguaggagcuacgaugacugaugacaucgguauggguguuacauaucuagcgcuacucgcggccuucaaaguacgccccacauucgcggcuggacucuuacuuagaaaauuaacauccaaggaauuaaugauggcuacaauagggaucgcauuguuaagccaaucgacucugccugaaaccauucuggaacuaacagaugcauuggccuuagguaugauggcuuuaaaaauaguucgaaacauggaaaaauaccaauuggccguaacaaucauggcgauaucauguguuccuaacaccguuauccuucagaacgcguggaagguuaguuguacuauauuggcugcagucucagugucaccauuauuauugacgucuagucaacagaaggcagacuggauuccauuggcucuuacaauuaagggauugaauccuacggcuaucuuccuaacaacccuuagucgaacaaguaagaaacguucauggccucuaaaugaagcgauaauggcuguaggaaugguaagcauacuagcguccagucuccucaaaaaugacauaccuaugacaggcccgcuuguggcggguggauuacuaacuguuuguuauguucuaacuggccguagcgcugauuuggagcuugaaagagccgcagacguaaaaugggaagaccaggcagaaauuagcgguuccagcccgauauuaucaauaacuauuagcgaagaugggaguaugucaauuaagaacgaggaggaagaacaaacucucacgauauuaauccggacaggacuauugguaauaucagggguauuccccgugucuauaccaauaacagcagcugcaugguacuugugggaaguuaaaaagcagagagcaggaguauuaugggacgucccaucaccgccaccuguggggaaagcugaacuagaagacggugcauauagaauuaaacaaagaggaauuuuagguuauucccaaaucggggccggaguuuacaaagaaggaacguuccauacaauguggcauguuacgcgaggggcaguucugaugcauagagguaagaggauugagccaaguugggccgaugucaagaaagauuuaaucucauauggcggcgguuggaaauuagaaggugaauggaaggaaggggaagaaguccaaguacuugcucuagagcccgguaaaaauccucgggcuguucaaacuaaaccggguaucuuuaaaacaaacacuggaacaauaggagcaguaucuuuagauuucucuccugggacauccggaucaccuauaguugauaggaaaggaaagguuguuggauuauaugggaauggaguagucaccagaagcggggcuuauguauccgcaaucgcgcaaacagaaaagucgauagaagacaacccggaaauagaagaugauauauuccguaaaaagagacuaacaauaauggaucuucauccuggagcgggaaaaacaaaaagauaucugcccgcgaucguuagagaagcaauuaaaagaggauuacguacacuaaucuuggcaccaacacgaguaguagcugcagaaauggaggaagcccuacgagguuugcccauacgauaucaaacaccggcuauaagggccgaacacacaggaagggaaauuguagauuuaaugugucaugcuacauucacaaugagguuauugagcccggugcgggucccuaauuacaaucuaaucauaauggacgaggcacauuucacagacccugcuaguauugcggcgagggguuacauaucaacaagaguugaaaugggagaggcugcaggcauauucaugacggcaacuccaccugguucucgagauccauuuccgcaaucgaaugcaccuauaauggacgaggaacgcgagauuccugaaagaaguuggaauagcgggcaugaauggguaacagacuuuaaaggaaaaacagucugguuugugcccuccauaaaagcgggaaaugauaucgcugcaugccuaagaaagaauggcaagaaagucauucaauugagccggaagaccuuugacucggaguauguaaaaacaagagcuaacgauugggauuuuguaguuacgacagauauauccgagaugggugcuaauuucaaggcugaacguguaaucgacccaagacgauguaugaaaccaguuauccuaacagauggugaagaaaggguaauacuugcagguccuaugccuguuacgcauucaagcgcagcgcaacgccgaggaagaauaggccgcaacccaaagaacgagaaugaucaauauauauauaugggagaaccgcuagaaaaugaugaagauugugcacauuggaaggaagcuaaaauguuauuagauaacauuaacacaccugaagguauaauaccuaguauguuugaaccagaaagagagaaaguggacgcaauagacggggaauaccgguuaaggggugaagcgcgcaagacauucguugaucuaaugagaagaggggaucuuccuguuuggcuggcguauaagguugcagcugaaggcauaaauuacgcagaucguaaauggugcuuugaugggauuaaaaauaaucaaauauuggaagagaauguggaaguugaaauauggacgaaagaaggagaaagaaagaaauuaaaaccgagauggcucgacgcucgaauuuauucugacccauuggcauuaaaagaauuuaaagaauuugccgcaggccgaaaaaguuugacccugaauuuaauaacagaaauggggagauugccaaccuuuaugacucaaaaagcgagaaaugcgcucgauaacuuagcggugcuacacacggcagagguagguggaaaagcacauacccacgcacuaagugaacuuccagaaaccuuagaaacauuacuccuacugacccucuuagcggccgugacaggcggaauauuuuuguuuuuaaugucuggaaaaggcauaggcaagaugacccuugguauguguuguaucauuaccgcaucaauauuauuaugguaugcacaaauccagccacacuggauagccgcguccaucauucuggaguucuuuuugauaguauuacuuauuccagaaccugaaaaacaaagaacgccgcaagacaaccaacuuacguacgucguaauugcgauauuaaccgugguugcagcaacaauggcaaaugagaugggguucuuggagaaaaccaagaaagacuuaggcuuuggaaguauuacaacucaagaguccgaaagcaauauucucgauauagacuuaaggccagcuagcgcuuggacacuauaugcuguagcgacaacguuuguaacucccaugcuaagacacagcauagaaaacucaucaguuaaugugucauuaacagcaauagccaaccaagcuacagucuuaaugggacugggaaagggauggccguugaguaaaauggacauaggagugccuuuguuggcuauaggaugcuauagucaaguaaauccaauaacacuuacagcugcucuuuuauuacucguggcccacuaugcgaucauaggaccuggccuacaagccaaggcgacaagagaagcacaaaaacgggcugcugcaggcauaaugaaaaaucccacgguugauggaaucaccguuauagacuuagaaccgauaccuuaugauccaaaguucgaaaaacaacucggccagguuauguuacucauccuguguguaacgcagguauuaaugaugaggacuacaugggcacuuugugaggcuuuaacacuagcuacaggcccgauuagcacuuugugggaaggaaaucccggccguuuuuggaauaccacuauagccgucucaauggcgaauauuuuccggggcagcuacuuggcuggagccggucuucuguuuucgaucaugaaaaauacgacuaacacaagaagaggaacaggaaaugugggugaaacucucggcgagaaauggaaaucacgguuaaacgcuuugggcaaaucugaguuccaaaucuacaaaaagucuggaauacaagaaguggauaggacauuggcuaaagaagguauuaaaagaggagaaacggaucaucaugccguaucgagaggguccgcaaaacucagaugguuuguggaaagaaacaugguaacacccgaagguaaagucguggauuuaggaugcgggagggguggcuggucauacuacugcggaggacuuaaaaauguuagagaagucaaggggcuaacaaagggugguccuggacacgaggaaccgauaccaaugaguacauacgguuggaaccuaguucgcuuacagucaggggucgauguguuuuucaccccaccugaaaaaugugacacuuuguuaugcgacauuggagaaucaucaccaaacccgacaauagaagcaggaaggacauugcgcguacucaacuuaguugaaaauuggcuuaacaauaauacgcaauucuguauaaaaguauuaaauccauauaugcccagcgucauugagaaaauggaaacauuacaacggaaguacggaggagcgcugguccguaauccgcuaucuaggaacucaacccacgagauguauugggugaguaacgcuacuggaaauauaguaagcucugucaacaugauaucaagaaugcuaauaaaucgguucacaaugaaacauaagaaagcaacuuacgaaccagauguagacuuagguucaggcacgcggaauauaggaauugaguccgaaauaccaaacuuagacauuauaggaaaacgcauagagaagauaaaacaagaacaugaaacaucauggcacuacgaccaggaccacccauauaaaaccugggcguaucauggaucauacgaaacuaagcaaacaggaucggccucgucuaugguuaacggggucgugagauuacucacuaaaccaugggacgugguacccaugguaacucagauggcaaugaccgacacaaccccuuuuggccagcagcgaguauuuaaagaaaagguugauacaagaacgcaagagccuaaagaggguacaaagaaauugaugaaaauaacagcagaaugguuauggaaagaacuugguaaagagaaaacaccuagaaugugcacuagagaagaauuuacuagaaaaguaagaagcaaugcagcgcuuggggccguguucacugacgaaaacaaauggaaauccgcacgugaggcaguugaggauggaagauuuugggaacucguugaucgagaacgaaauuugcauuuggaagggaaaugugaaaccugugucuauaacaugaugggaaaacgagagaagaaacugggugaauuugggaaagccaaaggaucacgcgccauaugguacaugugguuaggggcuagguucuuagaguucgaggcacucgguuuucugaaugaagaucacugguuuucgcgcgaaaauucauuauccggaguagaaggugaaggacuccaccgucuaggguauauacuuagagaugugucaaagaaagaaggaggagcuauguaugcggacgauaccgcgggcugggauacaagaaucacauuagaagaucugaaaaaugaggagaugguuacgaaccauaugaagggcgaacauaagaaauuggcagaagcaauauucaaacuaacauaccaaaacaaaguaguaagggugcaacgaccuacaccucgugguaccguuauggauauaauaagucgaaaagaccagagagguucaggccaggugggaacuuacggcuuaaacacguuuacuaauauggaagcucagcugauucgucaaauggagggagaagggauauuuagaucuauacaacaucuuacugcuacugaagaaauagcgguucaaaauuggcuugcgcgugucggacgcgaaagacuaucucguauggccauuucaggcgaugauugcguuguaaagccaauagacgaucgauucgcgucagcuuuaacggcacuaaacgauauggguaagguuaggaaggacauccaacaaugggaaccaucccgaggguggaacgacuggacacaaguuccauuuuguucacaucacuuccacgaguuaguuaugaaagacggucggguccuagugguuccaugccguaaucaagacgaacuuauagggagggcucguauaucacaaggcgcuggauggucguuaaaggagacagcauguuuagguaaaaguuaugcacaaauguggacuuugauguauuuccaucguagggaucuuaggcuagcagcuaacgcaaucuguucagcgguaccaucccauuggguucccacuucaagaacaaccuggucuauacaugcuaaacacgaauggaugacgacagaagauaugcuagcuguauggaaccgaguauggauacaggaaaauccauggauggaagauaaaacaccaguagaaucaugggaagaaguuccauauuuagggaaaagggaggaccaauggugcggcagucuaauaggcuuaaccagccgugcgacaugggccaaaaacauccaaaccgccauaaaucaagucagaucguuaauaggaaacgaaggauacacagauuacaugccaucgaugaaaagauuccgaagggaagaagaggaagcgggaguccuuugguga

SEQ ID NO: 22178 - RNA, 9876 nt, Artificial Sequence
  derived and/or modified CDS sequence (opt6) from DENV-2__JX669478__SS-prME
acagcggguguuauaguuaugcuaauuccaaccgcgauggcauuucaucuaaccaccagaaacggagaaccacauaugauaguaggaagacaagaaaaaggaaaauccuuguuauucaaaacagaagacggugucaacaugugcacacuuauggcaauagauuuaggagaauuaugugaagauacuauaacauacaaauguccauuauuacgacaaaacgaaccugaagauaucgacuguuggugcaacaguacuucuaccuggguaacuuacggaacguguacaacaacgggggaacaucggagagaaaaacggaguguggcauuagugccgcacgucggaaugggacuagaaacucguacagaaacuuggaugucaucagaaggugcauggaaacacguacagagaaucgaaacguggauauuacggcauccgggcuucacgaucauggcagcaaucuuagcuuauacgauuggcacaacacacuuccagagagcucuaaucuucauacuacucacugcagucgcccccagcaugacuaugcgcuguauuggcauaucaaaucgagauuucguagagggagucaguggaggaagcuggguagauauuguccuugaacauggaucuugcgucacuaccauggcuaaaaacaaaccgacccuagacuucgaacuuauaaaaacggaagcaaaacagccugcaacauuaagaaaauacuguauagaagcaaaauugacaaauacaacuaccgaaucgcgcugccccacacaaggagaacccucucuuaaugaagaacaggauaaacgguuuauuuguaaacacaguaugguggauagagguugggggaauggcugcggacuauuuggaaaaggcggcaucgugacgugugcgauguuuacuugcaagaaaaauauggaagguaaaaucgugcaacccgaaaauuuggaauauacuauugugauaaccccacauagcggagaagaacaugccgugggaaaugauacaggaaaacaugguaaagaaauaaaaauaacgccucaaucaucuacaacugaagcugaacugacggguuauggcacugugacuauggagugcucaccuaggaccggauuagauuuuaaugaaaugguuuuacuacaaauggaagauaaagcaugguuaguacauagacaaugguuucuggaucuaccuuuaccauggcuaccuggagcugacacacaggguucaaacuggauccagaaagaaaccuuaguuacuuucaaaaauccacaugccaagaaacaagaugucguaguacucggcagucaagagggagcaaugcauacagccuuaaccggagcgaccgaaauucagaugaguagcggcaaccuccuuuuuacaggacaccucaaauguaggcuaagaauggacaaauugcaguuaaaaggaaugucuuauucuaugugcacuggcaaauucaaaaucguaaaagagauugccgaaacacagcauggaacaauaguaaucagagugcaauacgaaggugauggaucaccaugcaaaauccccuuugaaauaacagauuuagagaaaagacacgucuugggucgacuuauaacgguaaacccuauaguaacggaaaaagauagcccaguaaauaucgaggccgaacccccauuuggugacaguuacaucauugucggcguagagccaggacaacugaaauuaaauugguucaagaaaggaucuucaauaggucagauguuugaaacaacuaugaggggagccaaaagaauggcuauucugggggauaccgcuugggacuuuggaagucuaggcgguguuuucacaaguaucgggaaagcucugcaccaaguuuucggugcgauuuacggggccgcauuuucaggaguuagcuggaccaugaaaauucuuauaggcguuauuaucacguggauuggcaugaacucaagauccacgagcuuauccguaagccucguacuggucggaguaguaaccuuauacuugggcgcaaugguacaagcggauagcgguuguauaguaaguuggaaaaauaaagagcuaaaaugcggcuccgguauauucauaacagauaauguccacacguggacagaacaauacaaauuucaaccugaaucuccauccaaacuagcgucagcuauucaaaaagcacaugaagaaggaauaugcggaauaagaucugucacuagguuagaaaauuuaauguggaaacaaauaaccccagaacugaaccacaucuuaucagaaaaugaggugaaacucacuauaaugacuggugauauaaaaggaaucaugcaagcaggaaaacgaagucuaagaccacagccaaccgaauuaaaguacucguggaaaacgugggggaaagcuaaaauguuaaguacugagagucauaaucaaacguuuuuaauagacggcccagaaacagcagaaugcccaaacacaaacagggcauggaauagccucgaaguagaggauuacggcuuuggaguauucacuacaaauauaugguuaaaauuaagggaaaaacaagauguauuuugugacaguaaacugaugagugcggcgauaaaagauaaucgagccguccacgcagacaugggguauuggauugaguccgccuuaaacgacacguggaaaauggagaaggcuuccuuuauagagguuaagagcugucauuggccaaaaagccacacacugugguccaacgggguacuggaaucagaaaugaucauaccaaagaacuucgccgggccuguuagccaacauaacuacagaccuggauaucacacgcaaacagccgguccauggcauuuagggaaauuagaaauggauuuugauuuuugcgaagguacuacgguuguaguaacugaagauugugguaaucguggaccgucucucaggacaacgaccgcgucaggcaaacucauaacugaguggugcugccgcucuuguacacuucccccacuaagauaucgaggagaggaugggugcugguauggaauggaaauaagaccucuuaaagagaaggaagagaaucuaguaaauagcuuaguaacagcagggcauggacagaucgauaacuuuagucuuggcgugcuagguauggcacuauuuuuggaagagaugcuacgaacacguguuggaaccaagcaugcaaucuuauuaguggcucucagcuuuguuacguuaaucacugguaacaugucuuuccgagauuuaggcaggguaauggugaugguaggagcaacaaugacggacgauauuggaaugggagugacauaccuagccuuacuugcugccuucaaaguacgcccgacuuuugcggccggcuugcuuuugcggaagcugacaucuaaagaguuaaugauggccacuaucggcauagcccuauuaagccagaguacauugcccgaaacaauuuuggagcucacugacgcguuggcccuagggaugauggccuugaagaucgugagaaauauggaaaaauaccagcuagcuguuacaauuauggcaauuucauguguaccuaacgccgucaucuugcaaaaugcauggaaaguuucgugcacgauucuagcagccgugagugugucgccacuauuauugaccucgucacagcagaaagcugacuggauuccacuagcgcugacaaucaagggcuugaaccccacugcaauauuccugacaacgcuuucuaggacuucuaagaaacgaucuuggccgcuaaacgaggcaauuauggccguuggaaugguaucuauacuugcuagcucacuacucaaaaaugacaucccaaugacuggcccccuaguagcgggagguuuauuaacaguauguuaugugcuaacggggagaagcgccgaucuagaguuagaacgcgcggcagacgucaaaugggaagaccaggcggaaauaucaggaagcagcccaaucuuguccaucacaauuucagaagacggauccaugucaauaaagaacgaagaggaagaacaaacccuaacaauauuaauuagaacaggacuauuaguaauaucagggguauucccaguuaguauaccaauuacagcugccgcgugguauuuaugggaaguuaagaaacaaagagcuggggucuugugggaugugccauccccgccucccguugguaaagcggaauuagaagauggggcauaucgcauaaaacagagaggcauuuuuggauacagucagauuggggcaggaguuuauaaagagggaacguuucauacuauguggcaugucacgaggggugccguuuugaugcauagagggaaaaggauagagccauccugggcggacguuaagaaagacuuaaucucuuauggagggggauggaaacuagaaggcgaguggaaagagggugaagagguacaaguauuagcacuugaaccuggcaaaaauccacgagcaguacaaaccaagccagguauuuucaaaacaaauaccggaaccauuggugcugucucucucgauuuuagcccgggcacaagcggaucgccgaucguugaucgaaaaggaaaaguggucggacuuuaugguaacgggguaguaacaagaucaggcgcuuauguuagugcaauagcucaaacugagaaaaguauagaagacaauccggaaauugaggaugacauauuuaggaagaaaagguuaacaauaauggaucuucaccccggugccggaaaaacaaaacgcuaccucccugcgaucguccgagaagcaauaaaacgagguuuaaggacguuaauucuagcacccacacgcguaguagcagcugaaauggaagaagcauuacgaggacuuccuauuagguaucagacgcccgccauacgcgcggagcauaccgggagagagauagucgauuuaaugugucaugcgacuuuuacuaugagacuacuaagccccgucagagucccuaacuauaaccuuauuaucauggacgaagcucacuucaccgauccagccaguauagcagcgcgggguuacaucagcacacgaguggaaaugggagaggcagcgggaaucuuuaugacagcuacaccaccaggaucacgcgacccauuuccccaaucaaaugcgccaaucauggaugaggaacgugaaauacccgaaaggaguuggaacucaggucacgaauggguaacggacuuuaaaggaaaaacggucugguuugucccaagcauaaaggcaggaaaugacauugcggcuugucuaaggaaaaauggaaagaaagucauacagcuaucacgcaaaacuuuugacagcgaauauguaaaaacgagggcgaaugacugggauuuugugguaacgacagauauaucggaaaugggagcuaauuuuaaagcugaacggguuauagauccaagacgcugcaugaaacccguuauccuaacggacggagaagaaagaguuauccuagcaggccccaugccaguuacgcauucaucugcugcacaacgucgagguaggauugggagaaaucccaaaaaugaaaaugaucaguauauauacaugggagaaccucuagaaaaugacgaagauugcgcacauuggaaggaagccaagauguuacucgacaauauaaacacaccugaagggaucauacccucaauguucgaacccgaaagagaaaaaguagaugccauagacggugaguacagauuaagaggcgaagcacgcaaaacuuuuguugauuuaaugcgacgcggggaucugccaguuuggcuugcuuacaagguugccgcggaaggcauaaacuaugcagaccgaaaaugguguuucgaugguaucaaaaauaaucagauacuggaagaaaauguagagguugaaauauggacaaaggaaggugaaaggaagaaacuaaagccgcggugguuagaugcaaggauauacucagauccguuggcauuaaaagaauuuaaggaauuugcagcaggaaggaaaaguuuaacuuugaaucuaauaacagaaaugggaagacuuccuacauucaugacgcaaaaagcacggaaugcucuugacaauuuggcaguguuacacacggcagaaguagguggaaaggcuuauacacacgcauuaagcgaauuaccggagacacuagaaacacuucuacuccuaacacuacuugcugcaguaacaggugguaucuuucuauuuuuaaugucugggaaaggcauugguaaaaugacuuuaggcaugugcuguauuauaacagcgucuauauuauuaugguacgcucagauccagccgcacuggauagccgcuucaauaauauuggaguucuuucuaauuguucuauugauaccagaaccggaaaaacaacguacgccccaagacaaccagcuaaccuacgucgucauagcaauauugaccgucguggcagcgacgauggcaaaugaaaugggauucuuagagaaaacgaagaaagacuugggcuucggcucaauaacuacucaagaaagugaaaguaacaucuuagacauagaucuccgaccagcuagcgcguggacacucuacgcaguggcuaccacguucguaacuccuaugcucagacauaguauagaaaauagcagcguuaacguuagucuaaccgcuauagccaaccaagcuacuguacucaugggacuaggcaaagguuggccauuaaguaagauggauauaggagucccauuacuagcaauaggauguuauucucaaguuaaucccauuacacuaacagcagcucuguuacuucuuguugcacauuacgcgauaauagggccagguuuacaagccaaagcaacaagagaggcccagaaacgagcggcugcaggaauaaugaagaauccaacgguagauggaauaacaguaauagaucuagaaccaauacccuacgacccuaaauucgagaaacaauugggacaaguaaugcuauugauacugugcguuacacaaguccuuaugaugagaacgacgugggcuuuaugugaagcgcuuacauuagccacaggaccgauuucgacauuaugggaaggaaaccccggaagguuuuggaacacgacuaucgcgguuaguauggcuaacaucuuccgaggaucuuauuuagccggcgccgguuugcuauuuucaauuaugaagaacaccacuaacacucgccgcggaacagggaacgugggcgaaacauuaggagaaaaguggaaaagcaggcuuaacgcccuugggaaaagcgaauuucaaauauauaagaaaucuggcauacaggagguagacagaacccucgcaaaagaaggaauaaaaaggggugaaacagaccaucaugcgguauccagggggucggccaaacuacgcugguuuguggaacgcaauaugguuacaccagagggaaaagucgucgaucuugguugugggagaggggguuggucauauuauuguggaggauuaaagaacguuagggagguaaaaggguuaacuaagggagguccugggcaugaagaaccaauuccuaugucaaccuacggauggaaucuagugagacuacagagcggaguugacguauucuuuacaccgccagaaaagugugauacacuucugugugacauaggcgagaguucaccgaauccuacgauagaagcuggcagaaccuuaagaguuuugaacuuaguagaaaacugguuaaacaauaacacucaauuuuguauaaagguauuaaaccccuauaugccuucaguaauugagaaaauggaaacccuucaaaggaaguauggaggagcuuugguuagaaacccuuuaucacgaaauucaacacaugaaauguauuggguuagcaaugcaacgggaaacauaguaagcagcguuaauaugauaagccggaugcucauaaaucgauuuaccaugaaacauaagaaagccacauacgaaccggauguugauuuagguucuggcacgagaaauauagguauagaaucagaaauaccaaaucuggacauaauugggaaaaggauugagaaaauuaaacaggagcaugaaacaagcuggcauuacgaucaagaccaucccuauaagacaugggcauaucauggcucauacgaaacuaaacaaacugguagcgcgucaucaauggugaauggaguuguacgccugcuuacuaagccuugggauguaauuccaauggugacucaaauggcaaugacugauacaacaccauuugggcaacagagaguauucaaagagaaggucgauacuagaacgcaagaaccuaaagaagguacuaagaaauuaaugaaaauuaccgccgaguggcuuuggaaagaauuaggcaaagagaagacaccuaggauguguacaagggaagaguucacgcgaaaaguacguagcaacgcugcauuaggagccguuuuuacagaugaaaauaaauggaagagugcaagggaagccguugaagacgggagauuuugggaguugguggaucgugaaagaaacuuacauuuagaaggaaagugcgagacauguguguacaacaugaugggcaaacgagagaaaaagcuaggagaauuugguaaagcgaaagguagccgugcuauuugguacauguggcugggagcgcgcuucuuagaguucgaagcccucggcuuccuaaaugaagaucauugguucucucgcgguaacucacucaguggagucgaaggcgaaggucuacacagacuaggauacauauuacgagagguaggcaagaaagaaggcggagcuauguaugcugaugacacagcaggaugggauacaagaauaacuuuagaggaucucaaaaaugaagagaugguaacaaaucauaugaagggagaacacaagaaauuagcugaagcaauauucaaguuaacuuaccagaacaaaguugugcgaguacaaaggccuacaccgcgcgguacaguuauggacaucauaucaaggaaagaucaaagaggaucaggccaaguuggaacguacggacuaaauacuuuuacaaauauggaagcucaacucauaagacaaauggaaggagaagguauuuucaaaagcauucaacaucucacagcaaccgaggagauagcagugcaaaauuggcuugcuagaguaggaagagaacgguuaagcagaauggcuauuucgggcgacgauugcgugguaaaaccaaucgaugacagauucgcgucugcucugacagcauuaaaugacaugggaaagguucguaaagacauccaacaaugggaaccaucuagaggauggaacgauuggacacaagugccuuuuugcagucaccauuuucacgagcuaguaaugaaagacgggcgcguccuagucguaccguguagaaaucaagacgaguuaauagggagagcuagaauaagucaaggggcggguuggucguuaaaagagaccgcgugcuuaggaaagucuuacgcccaaauguggacacugauguauuuucaccgcagggauuugcgguuagcggcaaacgcuauuugcucagccguaccuucacauugggugccaaccucccguacaacuuggucuauacacgcaaagcacgaguggaugacaacagaagauauguuagcaguuuggaaccgcguauggauacaagagaacccauggauggaagauaaaacuccaguugaauccugggaagaaguacccuaucuaggcaaacgagaggaccaaugguguggaaguuugauaggcuuaacuucacgggcuacuugggcuaaaaacauucaaacagcuaucaaucagguacguucauuaauugguaaugaaggauauaucgacuauaugccuucaaugaaacgauucaggagagaagaagaagaagcgggcguguuaugguaa

SEQ ID NO: 22179 - RNA, 9876 nt, Artificial Sequence
  derived and/or modified CDS sequence (opt6) from DENV-2__JX669480__SS-prME
acugcuggaguuauuauuaugcuuauucccacugcgauggcauuucaucugaccacccguaauggugaaccucauaugauaguuggaaggcaagaaaaagguaaaucucuccuguuuaaaacggaagacgguguaaacaugugcacacugauggccauugaucugggcgaacugugugaagauaccauuacguacaaaugcccuuuauugaggcaaaaugaaccagaagacauagauuguuggugcaauuccacgucaaccuggguaaccuauggaacaugcacgacuacuggcgaacauagaagggagaaaagaagugucgccuugguaccgcauguaggaauggggcucgaaacaagaacagaaacauggaugucaagcgaaggcgcuuggaaacauguccaaaggauugagacauggauucuuaggcacccaggauuugcuauaauggcagcaauauuagcauauacaaucggaaccacucacuuccaacgcgcccuuauauuuauucuucucacagcagucgcuccuucuaugacuaugagauguauaggaauuucaaauagggauuucguggaaggcguaucgggaggaaguugggucgauauagucuuagagcauggcucauguguaacaacgauggcgaaaaauaaaccaacauuagacuuugaauuaauaaaaacggaggccaaacaaccagcaacacuuagaaaauauuguauagaagcuaaacuaaccaacacaacaacugaaagucguuguccaacccaaggugaaccuaguuuaaaugaagaacaagauaaaagauucauuugcaaacauaguaugguggacagagguuggggaaauggguguggacuuuucggaaaaggagggauaguaacgugcgcaauguucacaugcaagaaaaacauggaagggaaagugguccuuccggaaaacuuagaauacaccauuguuauaacaccacacagcggagaggaacaugccguagguaacgacacaggaaaacacggggaagaaauaaaaauaacaccgcaaaguucgaucacugaagcggaauugaccgguuaugguacaguuacaauggaauguucgccuagaacaggacuagauuuuaacgaaaugguguugcuacagauggaggaaaaagccugguugguacaccgccaaugguuucuggaccucccccugccuuggcucccgggagccgauacucaaggaaguaauuggauacagaaagaaacuuuaguaacauuuaaaaauccccaugcuaagaaacaagauguagucgugcuugggagccaagaaggagcaaugcauacagcacuaacaggagcgacugaaauacagaugagcucgggaaaucuacucuucacuggacaucugaaaugucgauugcgaauggauaaacugcagcuaaaaggaaugucuuacucuauguguacggguaaauuuaagauaguaaaagagauugcggaaacucaacaugggacgauaguaauccguguucaauacgaaggagacgguagcccaugcaagauaccauucgagauaauggauuuagagaaaagacauguauuaggacgacuaaucaccguaaacccaauugucacugaaaaagacagcccgguaaauauugaagccgagcccccauuuggagauaguuauauuauaauugguguugaaccugggcaauuaaaauuaaauugguuuaaaaagggaucaucuaucggucagauguucgaaacaacgaugagaggugcgaaaagaauggcgauccuaggagacacagccugggacuucggaagucuagguggaguguuuacaaguauagggaaggcauugcaccaaguguucggugcaauuuacggugccgcauuuucuggugugucguggacgaugaaaauccuuaucgguguaauuauaacguggauaggaaugaacagucgaucaacaaguuuaagcguaaguuuaguguuagucggaguaguaacacuauauuuaggugcgaugguacaggcagacucaggaugugugguaucauggaagaauaaagaauuaaaauguggaaguggcauauuuauaacagauaauguacauacguggacagaacaauauaaauuccaaccggaaucuccaucaaaacuagcgucagcaauccaaaaagcgcacgaagaagguaucugcgguauaagauccguaacacgguuagagaacuuaauguggaaacaaauuacacccgaacuaaaucauauauuaucugaaaaugaagugaaacugacaaucaugacaggagauauaaaaggaauaaugcaggcaggcaaacgaucccuucgaccucagccaacagaacuaaaauacucuuggaaaacauggggaaaagcgaaaauguuaaguacagaaucacacaaccaaacauuccugauagacgguccugaaacagccgaauguccuaauacgaaccgagccuggaacucacuggaaguugaagacuauggcuuuggcguauucacuacaaauaucuggcuuaaauugcgcgaaaaacaagauguguuuugugauucgaaacuaauguccgcagcaauuaaagauaaccgggcaguccaugcagauauggguuacuggauagaaagugcacuaaaugacacauggaaaauggagaaagcauccuucauugaagucaaaucuugucauuggccaaaaucgcacacguuauggaguaauggcguucucgaaucggaaaugaucauaccuaagaacuuugcagggccggucucucagcacaauuaucggccuggauaucacacgcaaacagcuggcccguggcaccuaggcaaauuagaaauggauuuugauuucugcgaagggacuacaguagucguaacagaagacugcgguaauaggggcccaucgcugagaacgacaacagcaagcgguaaauuaauaaccgagugguguugccgaucgugcacguugccuccacuuagauaccguggggaagauggaugcugguauggaauggaaauacgaccguugaaagagaaagaagaaaaccuuguaaauucgcucguuaccgcaggacacggccaaaucgauaauuucucauuagguguccuaggaauggcccuauuuuuagaagagaugcuaagaacaagaguaggaacaaaacaugcgauacuucuaguagcgguguccuuuguaacguugauaacagggaauaugucauuccgcgauuuagguagaguaaugguaaugguaggaguaacaaugacugaugauaucgggauggguguaaccuaucuagcucuguuagcugcguuuaagguucgaccaacuuuugcagcagguuuguuacugaggaagcuaacauccaaagagcuaaugauggcgacaauaggaauuacccucuuaucacaaucaaccauuccagaaaccauauuagaacuuacugaugcacuagcuuuggggaugaugguguugaaaauaguaagaaauauggagaaauaccaacucgcaguuacaauuauggcaaucucauguguaccuaaugcaguaauccuguuaaacgcuuggaaagucucuugcaccauacuagcugcuguaucuguauccccguugcuguuaacuuccagccaacagaaaaccgacuggauuccucuugcacuaacaaucaaaggauuaaacccaacagcuauauuuuuaacuacucucagcagaaccagcaagaaaaggaguuggccacuaaacgaagcugucauggcuguugguaugguuucaauacuagcaucgagcuuacugaaaaaugauauaccaaugacagggccacugguggcuggaggauuacuuaccguauguuaugugcuaacugguaggagugcugacuuagaacuagaaagagcagcggaugugaaaugggaagaccaagcagagauaucgggcucaagcccaauucucuccauaacuauaucggaagaugggagcaugucaauaaagaacgaagaggaagaacaaacccuuacaauauuaauacgcacuggauugcuggucauaagcgguguauuuccaguuucaaucccaaucacugcugcagccugguacuuaugggaaguuaagaaacaaagagcagggguucucugggauguuccuagcccgccaccagucggcaaagcagaauuggaagauggugcuuauagaaucaaacaacgaggaauacuaggauacagucaaauaggagccgguguauauaaagaaggaacguuucacacgauguggcaugucacucguggugcuguacuaaugcaucgaggaaaaaggauagaaccauccugggcugaugugaaaaaggauuuaaucaguuauggagguggguggaaauuagagggggaguggaaggaaggagaagagguacagguuuuagcacucgaaccuggcaaaaacccgcgagcaguacagacaaaaccagggcuauuuaaaacgaauacggguacgauaggcgcaguaucacuagauuucucaccagggaccaguggcucaccaauaguugauagaaagggaaaaguuguuggacuauacggaaacgguguaguuacaagaucuggcgccuacguaagcgcuauagcacaaacagagaaaagcauagaggacaauccggaaaucgaggacgauauauucaggaagaaaagacuaacaauaauggacuuacauccaggagcagguaaaacaaagcguuaccuccccgcuauuguuagggaggcaauaaaacgaggucuacgaaccuugauucuagcaccuacacgaguaguagcugcagagauggaagaggcguuaagaggguuaccuauuagguaccaaacaccggcaauaagggccgaacacacggguagagaaauaguugauuuaaugugucaugcaacuuucacaaugcgcuuacuaagcccgguucguguaccuaauuauaaucuaauuauaauggaugaggcccauuuuaccgauccagcgucuaucgcagcgaggggcuacauaucuacgagaguagaaaugggugaggcugcgggcauauucaugacagcgacaccaccuggcucaagggauccauuuccucaaucgaaugcaccgauuauggaugaagaacgcgaaauaccagagcguaguuggaacagugggcacgaauggguuacggacuuuaaggggaaaacuguaugguuuguuccgagcauuaaagccgggaaugauaucgcagcauguuuacgaaagaacggaaagaaagucauccaauuaucuagaaaaacguucgauagugaauacgugaaaacuagagccaacgauugggacuucguaguaacaacagauauaagugaaaugggugccaacuuuagagcggaaagagugauugauccaagacguugcaugaagccuguuauacuuacugauggugaagaaagagugaucuuagcaggucccaugcccgucacucauucuucggcagcacagcgacgaggcagagucggcagaaauccgaaaaaugaaaaugaucaauauaucuauaugggugaaccccuugaaaacgacgaagauugcgcucauuggaaagaagcaaagauguuguuagacaauauaaacacgccagaagggauuaucccaucaauguucgagccagaacgagaaaaaguagacgcaaucgacggagaauaucgcuuaagaggugaagcaaggaagaccuuugucgaucuaaugagacgaggugauuugccgguaugguuagcauauagaguagcugcggaaggaauuaauuaugcagaucgaagauggugcuucgauggaaucaaaaacaaucaaauccuugaagaaaacguagaaguagaaaucuggaccaaagaaggggaaagaaagaaacuaaaaccacgaugguuagacgcgagaauauauagugacccucucgccuugaaagaguucaaagaauuugcagcuggaagaaaaagccuaacacuuaaucugauaaccgaaaugggacgacugccaaccuuuaugacucagaaaacuagagaugcacuagauaaccuagcaguacuacacacggcugaggcgggugggagagcauauaaccacgcacuaucugaacuacccgaaacuuuagaaacauugcuauuacucacacuacuugcuacuguaacuggagggauuuuucuauuuuuaaugagcgggaaagguaucggaaaaaugacucucgggauguguugcauuauaacagccuccauccuucuuugguaugcacagauucaaccacacuggauugcagcgucuauaauacuagaguucuuccuuauaguauuacuuauucccgagccugaaaaacaacggacaccgcaggauaaccaguuaacauacgucguaaucgcuauacugacuguuguggccgcaacuauggcuaacgagaugggcuuucuugagaaaacgaaaaaggaccucggacuugggagcauaaccacacaagaauccgaaaguaacauucuagacauagauuuaagaccagccuccgccuggacacucuaugccguagcuacuacguuugugacuccuauguugcgacauaguauugaaaauuccucgguuaacguguccuuaacugcgauugcuaaucaggcaacaguacuaauggguuugggcaagggauggccacuaucuaaaauggacaucggcguaccgcugcuugccaucgguuguuacucacaaguaaaucccauuacacuuaccgcggcgcuacuauuguuaguggcucauuauacaauaauagggcccggucuucaagcaaaagccacacgagaagcacagaaaagggcagcagcuggaauaaugaagaauccaacagucgaugguauaacaguaaucgaccuagaacccauuccuuacgauccgaaauuugagaaacaguuaggccaggucauguuauugauuuuauguguaacacaaguucucaugaugagaacaacgugggcacucugcgaagcacuaacacuagcaacugguccuauaaguacuuuaugggaaggaaaucccgggagguuuuggaacacuacuauagcaguaucuauggcgaauauuuuucgcggaucauacuuagccggugcaggacuauuauuuuccauaaugaagaacacuacaaacacuagaagggguaccgguaacauuggagagacacuuggagaaaaauggaagucacgccuuaacgcguuagguaaaagugaguuccaaauauauaagaaaucaggaauacaagaaguggaucgaacauuggcaaaagaaggaaucaagagaggcgagacggaucaucaugcuguaucaagagguagugcgaaacuaaggugguucguggaacguaacaugguuacaccugaaggaaaaguuguggaucuugguugugggagagggggaugguccuacuacugcggagggcucaagaauguucgagagguuaagggauuaacuaaaggaggaccaggucaugaagaaccaauuccaaugucaaccuauggcuggaauuuaguccgcuugcaauccggaguugacguauucuuuaccccaccagaaaaaugugauacauuauuaugcgauauuggcgaguccucaccgaacccaacaauagaagcaggaagaacucuuagaguacugaaucugguagaaaauugguugaauaacaauacgcaauuuuguauaaagguguuaaauccuuauaugcccucgguaauugaaaagauggagacacuccaacgaaaauaugguggagcauuagugcgaaacccacuuagucgaaauucgacccaugaaauguacuggguuucaaaugccacaggcaauaucguuucaucuguaaauaugauuucuagaaugcuuauaaacagguuuacgaugaagcauaaaaaggcgacauaugaaccagaugucgacuuagggucagguacaagaaauauuggaauagaaucggaaauaccaaaucuagacauaauuggaaagcgaauagagaaaaucaaacaggaacaugaaacaagcuggcacuacgaccaggaccauccguauaaaacuugggcauaucacggaucauaugaaacaaagcaaacagguagcgccagcuccaugguaaaugggguggugcgucuccugaccaaaccaugggacguuguaccuaugguuacucagauggcgaugacugauaccaccccauucggacaacagagaguuuucaaagagaagguggacacccggacacaagaacccaaagaaggcaccaaaaagcuaaugagaauuaccgccgagugguuauggaaagaauugggcaaaaagaagacaccacgaaugugcacccgagaggaguucacucggaaaguucguucuaacgccgcauuaggcgcaauuuucacugacgaaaauaaauggaaaucggcaagagaggcgguugaagacucgagauuuugggaauuagucgauagggagaggaaucugcacuuagaaggaaaaugcgaaacauguguuuacaacaugaugggcaaacgggagaaaaagcucggcgaguucgguaaagcgaagggcagcagagcgauaugguauauguggcuaggagccagauuuuuagaauuugaagcacuuggguuccuuaacgaagaucacugguuuucccgcgguaacucguugucggguguagaaggugagggccuacauagacuaggauauauccuuagagauguauccaaaaaggaaggcggggcaauguacgcagacgacacagcagguugggauacuagaauaacacuagaagaucuaaagaacgaggagaugguaacuaaccauaugaaaggggaacauaagaaauuagcagaagccauuuuuaaacuaacuuaucaaaauaagguuguacgaguacaaaggccaacaccccggggcacaguaauggacaucaucucaagaagagaucagcgaggaucugggcagguagggaccuauggauugaacacauuuacaaacauggaagcacaacuaauuagacaaauggaaggagaagggauuuuuaaaaguauacaacaucuaacaguaacugaagagauugcgguacagaauugguuagcgcgagucggcagagaacgacugucccgaauggcaauaaguggagaugauuguguagucaaaccauuagaugauagauuugcaucggcacucacggcucuuaacgacauggguaaaguuagaaaagauauacaacaaugggaaccaaguagaggguggaacgauuggacacaaguaccguuuuguucgcaucauuuucaugagcucguuaugaaagacggcaggguacugguuguaccgugcagaaaccaagaugaguuaauuggaagggcacguaucagccaaggcgcuggguggagccuaaaagaaaccgcaugccucggaaagaguuaugcgcaaauguggacgcuaauguauuuucauaggagagauuuaagacuugccgcgaaugcgauauguucugccgucccgucacauuggguaccuacuucacgaacgacguggucaauucacgcaaagcacgaauggaugacgacagaagacauguuggcagucuggaauaggguuuggauacaagaaaaccccuggauggaagauaagacaccuguggaaaguugggaagaagugccauaccuugguaaacgagaagaccaguggugcggcucccugauugggcuuacaucucgcgcaacuugggcgaaaaacauccaaacagccauuaaucaaguacgcuccuuaauugguaacgaagaauauacggacuacaugcccaguaugaaaagauucaggcgagaagaagaagaagccggaguacuuugguaa

SEQ ID NO: 22180 - RNA, 9876 nt, Artificial Sequence
  derived and/or modified CDS sequence (opt6) from DENV-2__JX669483__SS-prME
acagcuggggugauuauaauguuaauuccaacggcaauggcuuuucaucuuacaacacgaaacggugaaccacauaugauaguaggacgacaggaaaaaggaaaaucauuauuauuuaaaacagaagacgguguuaacauguguacgcucauggcaauagacuuaggagaauuaugcgaagacacaauuaccuacaaaugcccccuauuacgucaaaaugagccugaagacaucgauugcuggugcaauuccacaaguacauggguaacauaugguacuugcacuacaacgggugagcaucgacgagagaaacgaagcgucgcauugguaccacauguugguaugggacuugaaacccgaaccgaaacauggaugagcuccgaaggagcauggaaacauguccaacguauugaaacguggauacugaggcaucccggauuugcgauaauggcagcgauacuggcauauacgauagguacuacucacuuucaacgggcgcuaaucuucauccuacuaacggcggucgcaccaucuaugacuaugcguuguauugguaucucaaaucgagacuucguggaggggguuucuggugguuccuggguagauauugugcucgaacauggaucgugcguuacuacuauggccaaaaauaaaccgacacuagauuucgaguugauuaaaacugaagcuaaacaaccagcgaccuugcguaaauacuguauugaagcuaaauuaacuaacacuacaacagaaaguaggugccccacacaaggggaaccgucccuuaaugaagaacaagauaaacgcuuuauuugcaaacauucaaugguagaucgcgguugggguaaugggugcggcuuauucggaaaagggggaauugucaccugugcuauguucacuugcaagaaaaacauggagggaaaaguaguucuuccggaaaaucuagaguacacaauagugauaacaccucauucaggagaagaacaugcugucgguaaugauacggggaaacacggagaagaaauaaaaauuacgccgcaaaguucaauuaccgaggcggaguuaacuggauauggaaccguaacgauggaguguagucccaggaccggcuuagacuuuaacgaaauggucuuacugcaaauggaggaaaaagccugguuaguucaccgacagugguucuuggaccuaccguuaccauggcuuccgggugcugacacgcaggggagcaacuggauucaaaaagaaacccugguuacauuuaaaaacccacacgccaagaaacaagauguuguugucuuagguucacaagagggugcaaugcauacggcacuaacgggcgccacagaaauccaaaugaguucaggaaacuuauuguuuacaggccauuuaaaauguagacugaggauggacaaacuacaacucaaaggaaugucauauaguauguguacaggaaaauuuaaaauaguuaaagaaauugcggagacacaacaugguaccaucguaaucaaaguacaauaugaaggugacggcucaccauguaagauucccuuugaaauaauggaucuugaaaagagacauguacuaggccguuuaauaacuguaaauccaauugugacagaaaaagauucaccagugaauauagaagcagagccaccauucggagauagcuauauaauaauuggaguagaaccagggcagcuaaaguuaaauugguuuaagaaagggagcagcauuggccagauguucgaaacaacgaugagaggggccaaaagaauggcgauuuuaggugauacagcaugggauuuuggaaguuuaggcggaguauucacgucaauaggaaaggcuuuacaucaagucuucggagcuauauacggggcugcguuuucggguguaaguuggacaaugaagauacuaauaggaguaauaauaacuuggauuggaaugaacagucguuccaccucacuuucgguaucacucguacuuguuggaguaguaacucuguauuugggugcgauggugcaagcugauucgggcugugucguaaguuggaaaaauaaggaacuaaaaugugguucagggauauuuaucaccgauaacguucacacuuggacagagcaguacaaauuucagccugaaucaccuaguaaacucgcuagugcuauucaaaaggcccaugaagaaggcauaugcggaauaagaagcgugacgagguuagagaauuuaauguggaaacaaauaacaccggaauuaaaucauauucuaagcgaaaaugaaguuaaguugacuauaaugacaggggauauaaagggaauaaugcaggcggguaaaagaucauuacgaccgcaaccuaccgaauugaaauauucuuggaagacuuggggaaaagcuaaaaugcucucaacagaaucucacaaucaaacuuucuuaauugauggaccagaaacagcugagugccccaauaccaaucgagccuggaauagcuuggaaguagaagauuaugguuuuggcgucuucacaacgaacauaugguuaaaacuucgagaaaaacaggacguguuuugugauucaaaguugaugagcgcagccauaaaagacaauagagcuguacacgccgacaugggcuauuggauagagucagcccucaaugauacuuggaaaauggaaaaagcaaguuucaucgagguaaaauccugccacuggcccaagucacauacacuuuggaguaauggcguucuagaaagugaaaugaucaucccgaagaacuuugcgggccccguuucucaacauaacuacagaccaggguaccacacccaaacggccgguccuuggcaucugggaaaauuagaaauggauuuugauuucugcgagggaacgacaguaguaguaacagaggacuguggaaauagaggaccaucauuacgaaccacuacugcaucugguaaauuaauuaccgagugguguugucguucauguacucuuccgccauuaagguauagaggagaagauggauguugguaugggauggagauacgaccuuugaaagaaaaagaagaaaacuuaguaaauagcuuagugacagcuggucauggacaaauugacaauuuuucacuagguguccucggaauggcucuguuucuagaagagaugcuuagaacacguguuggcaccaaacaugcaauucuuuugguagcaguaucauucgucacacuaaucacaggaaauaugucguuuagagacuuaggccgaguuaugguuauggucgguguaacaaugacagaugacauagggaugggcguaaccuaucuugccuuauuggcugcguuuaaagucagacccaccuuugcagcuggucuauuacuaagaaaauugacauccaaagaauugaugauggccacaauugggauuacacugcuuucacaaagcacgauaccugaaaccauacucgagcuaacagacgcacuggcucuugguaugaugguguugaaaauaguaagaaacauggaaaaguaccaacucgcaguaaccauaauggcaaucaguugcguaccgaaugcaguaauacuacucaacgccuggaaagugucuuguaccauauuagcugcaguaucagucaguccauuacugcugacaucaucacaacagaagacagauuggaucccauuggcucuuacaauaaaaggcuuaaauccaaccgccauauuuuuaacuacccuaagccgaacaagcaagaaaagaucauggccucuaaaugaagcagugauggcagucgggauggucucaauacucgcaucaucauuguuaaagaaugacauuccuaugacuggcccacuuguagcuggcggacucuuaacgguuuguuauguauuaaccggaagaucggcagaucuagaguuagaacgugcggcagacgucaaaugggaagaucaagccgaaauuucuggaucuaguccuauauuaucaauaacuauuagugaggaugggagcauguccauuaaaaaugaagaggaagaacagacuuuaacaauccugauuagaacagguuuauuaguaaucagcggaguauuuccuguaaguauaccaauaacagcugcagccugguaucugugggaggucaaaaagcaaagagccgguguauugugggaugugccgucaccgcccccagucgggaaagcagaacuugaagauggugccuacagaaucaaacaacgugggauucuuggcuacucccagauaggggcuggugucuauaaagaggguacuuuucacacuauguggcacguaacgcggggagcaguuuuaaugcaccgugguaaaagaauagaaccauccugggccgacgucaagaaagacuuaauaaguuaugguggagguuggaaauuagaaggagaauggaaggaaggagaagagguacaagucuuagcauuggaaccaggcaaaaauccgagggcuguacaaacuaaaccaggucuuuuuaaaacaaauacugguacaauuggagcaguaucguuagacuuuagccccggaacaagcggcucaccaaucguagaucgaaaagguaaaguggucggacuauauggaaauggcguuguaaccagaaguggagccuacgucucagcgauagcacaaacagagaaaaguauagaggacaacccagagauagaagacgauauauuuaggaagaaaagauuaacaauuauggacuugcacccaggggcugggaaaaccaaaagguauuuaccagcuauagucagagaagcaauaaagagagguuuacgaacuuugauacuugcaccaacuagaguugucgcagcugagauggaagaggcauuacgaggucuccccauccgauaccagaccccagcaauaagagcugagcauacagggagagaaaucguggauuuaaugugccacgccacauucaccaugcgacuccuaucgccagugagaguaccaaacuauaaucugauaauaauggaugaagcacacuuuacagaccccgcgucaaucgcagcgcguggguauaucaguacacguguugaaaugggagaagcggcagguauauucaugacagcgacaccucccgguaguagggauccguuuccgcaguccaaugcgccgauaauggaugaagaacgugaaaucccagagagaucauggaauagcgggcaugaauggguuacagauuucaaagguaagacugucugguucguucccuccauaaaggcuggcaacgacauagcugcguguuuacggaaaaacgguaaaaagguaauucaauuaagccgaaaaacauucgauagcgaguacguaaaaacacgugccaaugacugggacuucgucguuaccacagauauaagugaaaugggugcuaauuucagggcggagaggguaauagauccccguagaugcaugaaaccagugauauuaacagauggagaagaacggguuauauuggcagggccgaugcccgugacccauucaagugcagcccagcguagaggcaggguaggacggaaucccaaaaaugagaacgaucaguacauauacaugggagagccauuagaaaaugacgaagauugugcacauuggaaagaagccaagauguuauuggauaauauaaacacuccagaaggaauaauaccuucaauguuugaaccagaacgagagaaaguugaugcaauugacggagaauacagacuaagaggggaggcuaggaaaacauucgucgaucuuaugagaagaggggaccugccggucugguuggcguaucggguggcugccgaagggaucaauuaugcggaucgaagaugguguuucgauggaaucaaaaauaaucaaauauuagaagagaacguggagguagagauuuggacaaaggagggagaaaggaagaaacuuaaaccaaggugguuagaugcacgaauauacagugauccccuugcguuaaaagaauuuaaagaguuugccgcugguaggaaaaguuuaaccuuaaaucuaauaacggaaaugggaagguugcccacguuuaugacacaaaagacccgagaugcauuggacaauuuggcaguucuucacacugcagaagcuggggguagagcauacaaucaugcacucucagaacuuccagaaacuuuagaaacccuuuuauuacuaacgcuauuagcaacaguaacaggaggaauauuccuuuuccuaaugucugguaaagggaucggaaaaaugacacuugguauguguugcauaauuacagcaaguauacuacuaugguacgcgcaaauucaaccacauuggaucgcugcuaguaucauacuagaguucuuucuuaucguacuacuuauaccugagccagaaaaacaacguacuccucaggacaaccaauuaacauacguagugauagcuauccugaccgugguugcagcaaccauggccaaugaaaugggguucuuggagaaaaccaagaaagaccuaggcuuaggauccauaacuacacaagaaucagaaucaaauauauuagacauugaucuucgcccagcaagcgcuuggacuuuguacgcaguagcuacaacauuuguuacaccaaugcuacgacauuccauagaaaacucaucgguaaacgucucacugacggcaauagcuaaccaagcaacuguccugauggguuuagguaaaggcuggccucuuucaaaaauggacauuggaguaccauuguuggcaauaggaugcuacucgcagguaaacccuauaacacugacggcagcccugcuucuauuaguugcccauuauacuauaaucgggccaggacuacaggcaaaggcaacaagagaagcacaaaaacgugcagcagcggguauaaugaaaaaccccacaguggacgguauuaccguuaucgaccucgaaccaauuccauaugacccaaaauuugaaaaacaguuaggacaaguaauguuauugauauuaugcguaacccagguacuaaugaugcgaaccacgugggcccuaugugaagcacugacucucgcuacaggaccgaucucuacauugugggaaggaaacccuggccgcuucuggaauacuacuaucgccgucucaauggcaaacauauuuagggggucauaucucgcuggggcaggguuguuauuuucaauuaugaagaacacgacaaacacgagaagagguacaggaaauauuggcgaaacgcucggggagaaguggaaaucacgauuaaacgcucuaggaaaaagcgaauuucaaaucuauaagaaguccggcauccaggaaguggacagaacuuuagcgaaagagggaauuaaacguggagaaacugaucaccaugcaguuucuagaggaucugcaaaauugaggugguuuguagaacgcaacaugguaacuccugaaggaaaaguaguggaccucgggugugggagaggugguuggucguacuacuguggaggacuaaagaauguuagggaaguuaaaggguuaacgaagggugguccgggacacgaagaaccaauaccaaugaguacauauggguggaacuuagugcgacuacaaucugguguugaugucuucuuuacaccacccgagaaaugcgacacccuauuaugugauauaggcgaaucaucaccaaauccaacuauagaagcaggcaggacguuacguguuuuaaauuuaguugaaaacuggcuaaauaauaacacacaauuuugcauuaaaguauuaaauccauauaugccaucagugauugagaagauggaaacgcugcaaaggaaauauggaggagcguuaguaagaaauccuuuaagucguaauaguacccacgaaauguacuggguaucuaacgcaacugggaacauaguaucaucugugaauaugauaucaagaaugcucauaaacagauucacuaugaaacauaagaaagcgacauacgaaccagacgucgaccucgggaguggcacaagaaacauuggaaucgagucagaaauaccaaaucuagauauaauagguaagcguauagagaagauuaaacaagaacacgagacgaguuggcauuacgaucaagaccauccuuauaagaccugggcauaucauggaucguacgagacaaagcaaacgggaagugcaucgucuaugguaaauggcguaguucgcuuacugacaaagcccugggacguaguacccaugguuacucaaauggcgaugacggacacaacaccguuugggcaacaacggguuuuuaaagagaaaguugacacaaggacucaggaaccuaaggaagggaccaaaaagcuaaugcggauuaccgcugaauggcuauggaaagaacuagggaaaaagaaaaccccuaggaugugcacgagggaggaauuuacacguaagguaagaucgaacgcagcauuaggggcaauauuuaccgacgaaaacaaauggaaaucugccagagaggcagucgaggauucaagguuuugggaguuaguggauagagagagaaauuuacaucuugagggaaaaugcgaaacuugcguguauaauaugauggguaaacgggagaagaaauugggagaauuugggaaagcaaaaggaaguagagccauaugguauaugugguuaggagccagauaucuagaauuugaggcacuuggauuuuuaaaugaagaucauugguuuucuagaggaaauucccuaagcggaguagaaggcgagggguugcauagauuaggcuauauuuuaagagauguuagcaagaaagaaggcggugccauguaugcagacgacacagcugguugggauacaagaauaacuuuagaagaccucaaaaacgaggagaugguaacaaaccacaugaaaggagaacauaagaaacuagccgaagcgauuuucaaacuuacuuaccaaaacaaaguugugaggguccaacguccaaccccacgcggaacugucauggacauuauaucaaggagagaccaaagagggagcggacaggugggcacguacggacuuaauaccuuuacgaauauggaagcacaacuuauacgucagauggaaggagaaggaaucuuuaagaguauucaacauuuaacggugacggaggaaauagcaguucaaaauugguuagcaaggguagggcgagaaaggcuauccaggauggcaauuucaggggacgauugcgucgucaagccucuugaugacagauuugcuagcgcauuaacagcuuuaaaugauaugggaaaaguuagaaaggauauacaacaaugggaaccaagccguggauggaaugauuggacccaggugccuuuuugcucacaucauuuccacgaacucguuaugaaggacggacgaguauuaguugucccuugcaggaaucaagacgaacuaauaggacgcgcgaggauaagucaaggagcgggcuggagccuaaaagaaacugcaugccuggggaagucauacgcccaaauguggacacugauguacuuccauagacgagaccuacgccuagccgcgaacgcgauaugcucugcgguaccaucucauugggucccuacaagucgaaccacuuggucuauccacgcuaaacacgaauggaugacgaccgaggauaugcuagcaguauggaacagaguauggauacaggaaaacccguggauggaagacaagacuccaguagaaaguugggaggagguaccauaucuugguaaacgcgaagaucaguggugugguagcuugauagggcuaaccagccgagcgacaugggccaaaaauauucaaacugcaauaaaccagguacguucgcuuauagguaaugaagaauacaccgacuauaugccguccaugaaacgauuccgacgagaagaagaagaagcaggaguucugugguaa

SEQ ID NO: 22181 - RNA, 9876 nt, Artificial Sequence
  derived and/or modified CDS sequence (opt6) from DENV-2__JX669484__SS-prME
accgcaggaguaauaauaaugcuuauaccaacugcgauggcauuucauuuaacaacacgaaauggagaaccucauaugauagucgggcgccaagaaaaagggaaaaguuuauuauuuaaaacggaagauggaguuaacauguguacguuaauggcaauugauuuaggggaacuaugugaagacacaauaaccuacaaauguccauuacuacggcaaaacgaaccagaagacauugacuguugguguaauagcaccagcacuugggucaccuaugguacuuguacuacuaccggagaacacagacgugaaaaacgcucaguugcacucguaccacauguaggaaugggguuagaaacaaggacugaaacauggauguccagcgaaggagcuuggaaacaugugcagagaauugaaacauggauacuuagacaucccggauucgcaauaauggcagcaauucuagcguauacaauugguaccacccacuuucaaagggcacuaauauuuauacuacuuaccgcaguggcaccuagcaugacaaugcgguguauagggauuucuaauagggauuucguggaaggagucucuggggguucguggguagauauaguccuugaacacgggaguugcguaaccaccauggccaaaaauaaaccaaccuuagauuucgaacuaauuaaaacagaagcaaaacagccagcaacucuuagaaaauacugcauagaagcuaaacuuacaaauacuaccacugagucacgcugcccuacacaaggagaaccaagucuaaaugaggaacaagacaaacguuucauauguaaacacuccaugguagaucgaggauggggaaaugguuguggucuauuugggaaagguggaauuguuacaugcgcgauguuuacuuguaagaaaaauauggaagguaaagucguacuuccugaaaaucuugaauauacuaucguuaucacaccccauagcggagaggagcacgcaguggguaacgacacuggaaaacaugguaaagaaauuaaaauaacaccgcagagcaguauaacugaagccgagcuaacaggauauggaacuguuacuauggaguguucaccaagaacaggucuggauuuuaacgaaaugguauuauuacaaauggaagaaaaagcgugguuaguacaccgccaaugguucuuagaucuuccccuuccauggcuaccaggagcagacacucagggaucuaacuggauacaaaaagagacgcuaguaacguuuaagaauccccaugccaagaaacaggauguugugguauuagggagccaagagggagcuaugcacacggcauuaacuggugcaacugaaauacaaaugagcucgggaaacuuacuauuuacuggacacuuaaagugucgacugaggauggacaaacuacaacuuaagggaaugucauacucuaugugcacaggaaaauuuaaaauaguuaaagaaauugcggaaacacaacacgggaccauaguaauuagaguacaauacgaaggggauggaucgccuugcaaaaucccuuuugaaauaauggaccuugagaaaaggcauguacucggccguuuaauaacggucaauccaauaguuacagaaaaggacucaccgguuaauauagaagcggaaccuccuuucggagauucuuacauaauuaucgggguugaaccaggccaacuuaaauuaaauugguuuaagaaaggcagcucaaucgggcaaauguuugaaacaacuaugagaggcgcuaaacguauggcaauacucggcgacacagccugggacuucggcagcuuaggagguguauucaccucuaucgguaaagcacugcaucaaguguuuggagcgauauauggagcugcauuuucuggagucucauggaccaugaagauauugaucggugugauuauaacauggauugguaugaacucaagauccacaaguuuaucugucucauuaguauuagucgguguuguaacauuauauuuaggggcaauggugcaagcagauucugguuguguuguaucguggaagaauaaagaauuaaaaugcgggucggggauauucauuacagauaacguacauacauggacagagcaguacaaguuucagccagaauccccuaguaaacuagcauccgccauccaaaaagcacacgaggaaggaauaugcgggauucgaagcguaacacgacuagaaaacuuaauguggaaacaaaucacuccugaacuuaaucacauuuuaagugagaaugaaguuaaauuaacgauaaugacaggugauaucaaaggaauuaugcaagcaggaaaacguucucuacgaccacagcccacugaauuaaaauauaguuggaaaacauggggaaaagccaagaugcuuagcacggagagucauaaucagacguuucuaauagacggcccugaaacggcggaauguccgaauacuaauagagcuuggaacaguuuagaaguugaagacuacggauucggaguuuuuacaacaaauauauggcuaaaacuacgggaaaaacaagacguuuucugcgauaguaaauuaaugucagcagcuauaaaagacaaucgcgcuguccaugcagauauggguuauuggauagaauccgcacuaaacgguacauggaaaauggaaaaagcgucauuuauugagguaaaaagcugucauuggccaaaaagucauacgcuuugguccaauggcgucuuagaaucagaaaugauaauucccaagaauuuugcuggaccaguaucacaacauaacuacagaccaggguaucacacacaaacagccgguccauggcaccuaggaaaguuagaaauggacuucgauuuuugugaaggcacuacugucgucguaacagaagauugcgggaacagagggcccagccuucguacaacgacagcaucaggaaaauugauaacggaaugguguugucgaucuugcacacugccucccuuacgauauaggggagaagaugggugcugguacggaauggaaauaaggccauuaaaagaaaaagaagagaaucuuguaaacagucucgucacagcuggucauggacagauagacaauuuuucacuuggagucuuggggauggcucuguuuuuagaagaaauguugagaacucgcgucggaaccaaacacgccauacuauuaguugcgguuaguuucguaacauuaauaacagggaacauguccuuuaaagaccuaggccggguaaugguuaugguaggggucgcgaugacagacgauaucggaaugggcguaacuuacuuagcacuacuugcagcguucaaaguuagaccaacauuugcugcuggacuacuucugagaaaguuaaccuccaaggaauuaaugauggcaacaaucggcauaacuuuguuaucacaaaguacuauccccgagacaauucuugagcucacggaugcgcucgcauuaggaaugaugguucuaaaaauagugcguaauauggaaaaauaucagcuagcagugacuauuaugacaauaagcuguguaccaaaugcagucauacuauuaaaugcauggaaaguaucuugcacaauacucgccgcagucucuguaucacccuuacuuuuaacaucaagccaacaaaagacagauuggauaccgcuugcgcuaacuauaaaaggucuaaaucccacugcuaucuuuuuaacaacacuaucaaggacuucuaagaaacguaguuggccacuaaaugaagccguaauggcaguuggaaugguuagcauacuugccaguagccuguuaaagaacgauauccccaugacagguccucuaguagcugggggucuuuugacuguuuguuacgugcuaaccgggaggucggccgaucuagaauuagagagggccgcugacguuaaaugggaagaccaagccgagaucucgggaucaagcccgauucuaaguauuaccauauccgaagaugggaguaugucuaucaaaaaugaagaggaggagcagacuuuaacaauauugaucagaacaggauugcucguuauuaguggaguauuuccugugaguaucccuauaacagccgcagcuugguaccuuugggaagucaagaaacaacgugcaggaguauuaugggacguaccuucaccaccacccguaggaaaggccgaauuggaggauggagcguaccggauuaaacaaagagggauacuuggcuauucacagaucggcgcggggguuuacaaagaagggacguuucacacaauguggcaugugacuagaggugcaguauugaugcaucgaggcaaaaggauugagccgucaugggcggaugucaagaaagauuugauuucuuauggaggcggauggaaauuggaaggggaguggaaggagggagaagaaguacagguauuagcucuggaacccgguaaaaauccaagagcaguccaaacaaaaccaggacuauucaagacaaauacaggcacuauaggcgcgguaucauuagauuuuagucccggaacgagcggcaguccuaucguugauagaaaaggaaaaguaguaggcuuauauggaaacggagucguaacacgaucuggggcauauguaagugccauagcgcaaaccgagaaauccauugaggauaaccccgagaucgaagaugauauauuucgcaaaaagagauuaacgaucauggaccuacaucccggagcuggcaagacaaaaagauacuugccagcgauaguuagagaagcuauaaaacgaggacuaagaacuuugauacuagcaccuacccgaguugucgcggccgaaauggaggaagcacuaagaggguuaccaauaagauaucaaaccccugcaauacgugcagaacauaccggucgugagauuguagaucuuaugugccaugcaacguuuacuaugcggcuuuugucgccuguacggguaccaaauuacaaccuuaucauuauggaugaggcucauuucacagacccagcaagcauugcggcacggggguacauaaguacucgaguugagaugggggaggccgccgguaucuucaugacugcaacgccaccuggaucaagggauccguucccccaaaguaacgcaccaauaauggacgaagaaagagaaaucccugagagguccuggaacucgggacaugaauggguaacagauuucaaaggaaaaacaguaugguucgucccuucaaucaaagcgggaaacgauaucgcagcuugucuucgcaagaauggcaagaaagucauccaauuaagccguaaaacguuugacagcgaauacgucaaaacccgagcaaaugacugggauuuuguaguaacaaccgacauaucagaaaugggagcaaauuuuagagcagagagaguaauagauccucgccgauguaugaaacccguaauauuaaccgacggugaagaaaggguaauuuuagccggucccaugccugugacgcauaguagugccgcucaaagaagaggucgcguuggucguaaccccaaaaacgaaaaugaucaauacaucuauaugggagagccccuagagaacgaugaggacugugcacauuggaaggaggcaaaaaugcuacuugauaacauuaacacacccgaaggcauaaucccuucgauguucgaaccagaaagggaaaaaguagacgcuauagauggagaauauagacuucgaggagaagcgaggaaaacauuuguagauuuaaugagacguggagacuuaccuguauggcuugcauaucgaguagcagccgaggggauaaacuaugccgaucgccgauggugcuucgauggcaucaaaaacaaccaaauucuugaagaaaauguagaaguagaaauuuggacuaaagagggggaaagaaagaaacuuaaaccucguuggcucgaugcaagaauauauagcgacccccuugcucuuaaagaauuuaaagaguucgccgcaggacggaaaucacuaacauuaaauuuaauaaccgaaaugggacgccugccaacuuuuaugacacagaaggcucgcgaugcucucgauaacuuggcaguacugcacacagccgaagcuggcggcagggcauauaaucacgcauugagugaacuuccggagacacuagaaaccuuguuguuguuaacucuacuggcaacaguaacuggagguauauuccucuuccuuauguccggaaagggaguaggaaagaugacuuuggggauguguuguaucaucacggcgucuauacuauuaugguacgcacagauucagccacacuggauugcagcaaguauuauacuagaguucuuucuuauuguccuucuuauucccgaaccugaaaaacaaagaacaccacaagacaaucaacuaacuuaugucguaauugccauacuaacugugguagcugcuacaauggcaaacgagauggguuuccuagagaagacuaagaaagauuuggguuuagggagcauuacaacacaggaaagcgagucaaacauauuagauauugaucuacgaccagcuucggcuuggacuuuauacgccguugcgacgacauuuguuacucccauguugaggcauaguauugaaaauuccuccguaaacgugagucugacagcuaucgccaaucaggcgacgguacuaauggguuuagguaaaggguggccgcuuagcaaaauggacauaggaguaccacuuuuagcaaucggguguuauucucaaguaaacccuauuacacuaacagccgcccuccuacuucugguugcgcauuacgcaauaaucgggccuggauuacaagcaaaagccacccgagaagcucaaaaacgggcggcggcuggcauuaugaaaaaccccacuguggacgguaucacaguaauagauuuggagcccauucccuaugauccaaaauuugagaaacagcuuggacaagucaugcuauuaauuuuaugugugacacaaguccuuaugaugcgaacaacuugggccuugugcgaagcacuaacuuuagcuacaggcccaauaaguacgcuuugggaaggaaacccuggacgguucuggaauacuacaauugcgguuucgauggccaacauuuucagaggcagcuaucuggccggggccggccuucuguuuagcauaaugaaaaauacuacgaacacuagaagaggaacugguaauauaggagaaacuuuaggcgaaaaauggaaaucacgguugaaugcacuaggaaagucagaguuccagauauauaagaaauccggcauucaagaaguagaccggacguuagccaaagaaggcauuaaacgaggagaaacggaccaucacgcaguuucuagaggcagcgcuaaauuaagaugguuugucgaaagaaacaugguuaccccagaaggaaaaguaguagacuugggauguggcagaggcggaugguccuauuauuguggcggacuaaagaacguaagggaaguaaaagggcuaacgaaaggaggccccggucaugaagaaccaauacccaugucaacuuaugguuggaauuuaguaagauuacaaucagggguagauguauucuuuaccccaccagaaaaaugugauacauuauuaugugauauaggcgaaucgucgccgaacccgacgaucgaggccgguagaacccuaagaguacuaaauuuaguggaaaauuggcugaauaacaacacacaauucuguauaaaaguacuaaauccauauaugccaaguguaaucgagaaaauggaaacucuacagagaaaauaugguggcgcucuuguaagaaauccauugucccguaacaguacccaugaaauguacuggguuucuaaugccacaggcaacauuguuagcagcgugaauaugauaaguaggaugcuuauaaauagauuuacaaugaaacacaaaaaggcaacguaugaaccagauguagacuuagguuccgggacgcgaaauaucggcauugaaucugaaauuccaaaccucgacauaaucggaaaaagaaucgagaaaaucaaacaagaacaugagacguccuggcauuacgaucaagaucacccauacaaaacgugggcauaucauggaaguuacgaaacuaagcagaccgggagugcaaguuccaugguuaauggcguaguccgguuacucacgaaaccuugggacgugguaccgauggucacacaaauggcaaugacagacacaacgcccuuuggacaacaacguguguuuaaagagaaagucgauaccagaacacaagagccuaaagagggcacaaagaaacuuaugcgcauuacggcggaauggcucuggaaggaauuaggcaagaagaaaacgccuaggaugugcacccgagaggaguucacacggaaaguaagaaguaaugcagcacucggagcaaucuucacagacgaaaacaaguggaaaucagcaagagaagcgguagaggauucucgauuuugggaacucguagaucgugaacguaauuuacaccuagagggcaaaugugaaacguguguauauaauaugaugggaaaaagagaaaagaaacuaggggaguucggaaaagcaaaaggaaguagagcaauuugguauauguggcugggagcgagguuccuugaauuugaagcucuuggauuucuaaacgaagaucauugguuuagccgaggcaauagucuuucugguguugagggugaaggccuccaccgauuagguuacauacuucgcgauguaagcaagaaagaagggggagcaauguacgcagaugauaccgcuggaugggacacccguauuacauuagaagauuuaaagaaugaggaaaugguuauaaaucauaugaagggugaacacaagaaacuagcugaagcaauauucaaacucacauaccaaaacaaagugguucggguccaaagaccuacuccucggggaacgguaauggacauaauaucaaggagagaccagaggggcucaggacaaguagguacguacggcuuaaacacauucacaaauauggaagcacaauuaauaagacaaauggagggugaaggaauauucaaaucaauucaacaucuuacuguuaccgaagagauagcaguucaaaauuggcuugcacgaguuggaagagagaggcugucacguauggccaucagcggagacgacugcguaguuaaaccauuagaugauagguuugcaucugcucucacggcccuuaaugauauggggaaagugagaaaagauauucaacagugggaaccaagcaggggguggaaugauuggacccaaguaccauuuuguagucaucacuuccaugaauuagucaugaaagauggucgaguauugguugucccuuguagaaaucaagaugaacuaauugguagagcuagaauaucacaaggugccgguuggagucucaaagagacugcuugccucgggaaaucuuaugcucaaauguggacccuuauguauuuucacagaagggaucugagacuugcugcgaacgcuauaugcucagcuguaccuagucacuggguuccaacaucucguaccaccuggucuauccaugcaaaacaugaauggaugacaacugaagauauguuagccguuuggaauagaguauggauucaagagaauccauggauggaggacaagacuccgguagaaaguugggaggagguaccguaucucggaaaacgugaagaucaauggugcgguucacuaauaggucucacaaguagagccacaugggccaaaaauauacaaacugccauuaaccaagucagaucacuuauuggcaacgaagaauacacagauuauaugccuucgaugaaacgauuccggagggaagaagaggaagccgguguacugugguag

SEQ ID NO: 22182 - RNA, 9876 nt, Artificial Sequence
  derived and/or modified CDS sequence (opt6) from DENV-2__JX669485__SS-prME
acugcggggguuauaauaauguuaauaccaacugcaauggcauuucaccuaacgacgcgaaauggagaaccccacaugauaguagguaaacaggaaaaaggaaaaucccuucuguucaaaaccgaagacggaguaaauaugugcacuuugauggcaauugaucucggagaacucugcgaagauacuauaaccuacaaauguccauugcuacgucagaaugaacccgaagauaucgauugcugguguaacuccacaucaacguggguaacuuacggaaccuguacuacaaccggcgaacauagaagagaaaaacgcaguguagccuuagugccacacgucggaaugggcuuggaaaccaggacagaaacauggaugaguucagaaggcgcauggaaacauguacagcguauagaaacauggauuuuaagacacccuggcuuugcgauaauggcagcuauccuugcauauaccauaggcacuacgcauuuucaaagagcauuaauauucauacuccuaacagcgguagcaccaucuaugacuaugcgauguaucggaaucucgaaucgagauuuugucgaaggaguaucaggagguaguuggguggacauaguccuugaacauggauccugcgugacaacuauggcuaaaaacaaaccuacuuuagacuuugaauuaauuaaaacagaagcuaaacaaccagcaacuuuaaggaaauacuguauagaagcaaaacugacaaacacaacuaccgaaagucguuguccaacgcaaggggaaccauccuugaaugaagaacaagacaaaagguuuauaugcaaacauaguaugguagacaggggauggggaaaugguugcgguuuauucggaaaaggugggauaguuacaugcgcaauguucacauguaagaaaaacauggaaggaaaagucguucuaccggaaaauuuggaguauacaauagugaucacgccucacaguggcgaggaacaugccguaggcaacgacacuggaaaacacgguaaagaaaucaaaauaacaccccaaucgagcauuacugaagcagaauugacaggauaugggacuguuacaauggaaugcuccccacgaacagguuuggauuucaacgagauggucuuauuacagauggaggaaaaagcaugguuagugcacagacagugguucuuagauuuaccccuaccuuggcuaccgggcgcagauacucagggaaguaauuggauacaaaaagaaacauuggugacauucaaaaauccgcacgcuaagaaacaggauguuguuguuuuagggucacaggaaggcgcgaugcauaccgccuugacaggcgcuacugagauacaaaugucaucaggaaauuuguuauuuacaggacaccugaaaugcagacuccgaauggacaaacuacaacugaaagguaugagcuacaguauguguaccgguaaauuuaaaauaguaaaagaaauagcggaaacgcaacaugguacaaucguaauaagaguacaauaugaaggcgacggcaguccuuguaaaauuccuuucgaaauaauggacuuagagaaaaggcacguguugggucgguuaaucacagugaauccuauagucacagaaaaagauaguccaguaaauauagaagcugagccacccuucggagacucuuauauaauuauaggcguugaaccaggacaauuaaaacuaaauugguuuaagaaaggaagcagcauaggacaaauguuugagacuacaaugcgaggagccaaaagaauggcuauucucggcgauaccgcgugggauuuugguucgcuaggugguguauuuacaaguauagguaaggcgcugcaucaaguauucggagcgaucuacggagcagcguucagcgggguaucauggaccaugaaaauucuuaucggaguaauuauuacauggaucgggaugaauaguaggucaacaagucuaucgguaucacucguucuaguaggagucguaacauuauauuuaggcgcaaugguucaggcggacucagguugcguuguuucauggaaaaauaaagaguugaaauguggaagcggaauauucaucacagacaauguucacacauggacagaacaauauaaguuucagccugaaagcccuagcaaacuagccuccgcgauacaaaaagcgcacgaagaggggauauguggcauuagaucgguaacacgacuugaaaauuugauguggaagcaaauuacgccagaauuaaaccauauacugucagaaaaugaaguaaaacuaacaauaaugacaggagauaucaagggaauaaugcaagcugguaagcgaucauuacguccucaaccgacagaacuuaaguauucuuggaaaacgugggguaaagcaaagauguugucuacugagagucacaaucagacauucuuaauagauggcccagaaaccgcggagugucccaauacaaaucgagcguggaacagucuggaaguagaggauuauggauucgggguuuucacuacgaacauauggcuaaaguuacgagaaaagcaagauguauuuugcgauucuaaauuaaugucagcagcgauaaaggacaauagggcgguacaugcagauaugggauauuggauagagagugcucugaaugggacuuggaagauggagaaagcaucuuucaucgaagucaaaaguugucacuggccaaagagccauacuuuauggaguaaugguguacuggaaagcgagaugaucauaccgaagaacuucgccggaccaguaucacagcauaauuaucguccaggcuaucauacacaaaccgccggacccuggcaucuuggaaaauuagaaauggacuuugauuuuugugaagguacuacaguaguugucacagaagauugcggaaauaggggaccuaguuuaaggacaacuacggcgaguggaaaacuuauaacggaguggugcugcagaucauguaccuuaccuccguuaagauacagaggugaagaugguugcugguauggaauggaaauucgaccacugaaagaaaaggaagagaaccuuguaaauucguuaguaaccgccggucauggacaaauagauaacuuuucucuaggaguuuuggguauggcgcuguuccuagaagagauguuaagaacacgaguuggaacaaagcacgcaauuuuauugguagccguaucauucguuacucuaaucacagguaauaugagcuuuagagaccuaggcagagugauaguuaugguagguguaacaaugaccgaugacauagggaugggaguaacuuaccucgcguuguuagcugcuuucaaagugagaccuacuuucgcugcaggacuccuauuacggaaacugacgucuaaagaauugaugauggcaacaaucgggauaacguuauuaucccaaaguacaauaccggagacaauacucgaacuuacagaugcuuuagcacuagguaugauggugcuuaaaauugugagaaauauggaaaaauaucaauuagccguaacaauaauggcuauaucgugcguaccgaaugcaguaauauuauuaaacgccuggaaagugaguuguacaauucuagcaguagugaguguuagcccacugcuguuaacaaguagucagcagaagaccgauuggaucccucuggcacugacaauaaaagguuuaaauccaacggcaauauuuuuaacaacgcucucgcgaacaaguaagaaacgcucauggccucuuaaugaagcggucauggcgguugguauggucucaauuuuagcuuccuccuuacugaaaaacgauaucccaaugacuggaccuuuggucgcggguggcuuacugacaguuugcuauguauuaacagguaggucagcagaccuugaguuggaaagagcagcggauguuaaaugggaagaucaagccgagauaagcgguaguuccccaauccuaaguauaacaauaucagaggacggaucaaugucaaucaaaaaugaagaagaagaacaaacacucacaauccuuauucgcacuggacuccuaguaauuuccgguguauuucccguuucuauaccuaucacugcggcugccugguaccuaugggaaguaaagaagcaacgagcugguguauugugggaugucccaaguccaccaccgguagagaaagcagaauuagaagacggagcauaccgcauaaagcaacgcgguauccuaggguacagucagauaggagccgguguauacaaggaggggacauuccacacaauguggcaugugacaagaggugcuguauuaaugcauagaggcaaaaggauagaaccauccugggccgaugugaagaaagaccugaucucuuauggagguggauggaaacuagaaggagaauggaaagaaggcgaagaggugcagguucuagcauuagaaccagguaaaaauccaagagccguucagacgaaaccaggccuauucaagacuaacacaggcacaauuggagcuguuucucuagauuucucgccggggacaagugggucgccaauaguagaccgaaaaggaaaaguaguugguuuauauggaaauggaguaguuacacgaagcggggcguaugucagugcuauugcacaaacagaaaaaucaaucgaggauaauccugaaauagaagaugauauuuuccggaagaaacgauuaacgauuauggauuuacaucccggugcuggaaaaaccaagagauaccuuccggcaaucguccgcgaggcaauaaaaaggggucucaggaccuugauauuagcaccgacacgagugguggcggcagaaauggaggaagcauuacgaggucucccuauccgguaucagacuccugccauacgugcagaacauacaggcagagagaucguagaccuuaugugucaugccaccuuuacgaugagauuauuaucgcccgugagagugcccaauuauaaccuuauaauaauggaugaagcucacuuuacagaccccgcgucuauagccgcucgugguuauauuagcacaaggguggaaaugggcgaggcggcagguauauuuaugacugcgacgccucccgggucacgggauccauuuccacaaucuaaugcaccuauaauggacgaagaaagagaaauaccagaacgaucguggaacagcggucacgaauggguaacagauuucaagggaaagacagucugguuuguccccucuauuaaagcagggaaugacauugcugcaugcuuaaggaaaaacgguaagaaggugauucaauugucccgcaaaacguuugauagugaauacguaaaaacccgggcaaacgacugggauuuuguaguaacuacagauauuagugagaugggagcuaacuuuaaagcagaaagaguaauugacccaagacgguguaugaaaccaguaauuuuaaccgauggggaagaaagggugauauuagcugguccaaugccgguaacacauucgagcgcagcacaaaggcgcggacgcgucgguaggaauccuaaaaacgagaaugaucaauauauauacaugggagaaccacuagagaacgaugaagauugugcacauuggaaggaagcaaaaaugcugcucgauaauauaaauacacccgaaggaauaauacccucaauguucgagcccgaacgagaaaaaguagaugcaaucgacggagaauaucggcuaagaggagaggcuagaaaaacguuugucgaucuaaugcgaagaggcgauuuaccagugugguuggcuuaccgcguggcagcagaagguaucaauuaugcggauaggagauggugcuuugacgggauuaagaauaaucaaauacuugaagaaaauguugaaguugaaauuuggacuaaagaaggggagaggaagaaacuaaaaccacgcugguuagacgcccgaauauauagcgacccucuagcuuuaaaagaguucaaagaguuugcagccggaagaaaaagucuaacccugaauuuaauaacggaaaugggccgauuacccacauuuaugacccaaaaggcaagggaugcacuagacaaucuagcuguuuuacauacggcggaagcugguggcagggcguacaaucaugcacuuagcgaacuaccagaaacgcucgaaaccuuacugcuccucacacuauuagcuacuguaaccgguggaauuuuucuuuuccucaugagugggaaagguauuggaaagaugacguuaggaauguguuguauuauuaccgcuaguauauuacuaugguacgcacaaauacaaccgcacuggauugcugccuccauuauucuagaguucuuucuuauaguucuccuaauuccugaaccugaaaaacaaagaacuccacaggacaaccagcucacuuauguaguaaucgccauacucaccguaguagcagccacaauggcuaaugagaugggguuucuagagaaaacuaagaaagaccuaggucucggaaguauaacgacacaagagagugaaucaaacaucuuagacauagauuuacggccagcauccgcauggacucuauacgcaguagcuacaacauuuguuacuccaauguuaagacauucaauagaaaauucaagcguaaaugucucauuaacagccaucgcuaaucaagcgacuguacuaaugggucugggcaaagguuggccucuaagcaaaauggauauuggagucccccuacuagcuauuggaugcuauucccaggugaacccaauaacucuuacagcugcacuccugcuuuugguugcacacuaugcuauaaucgguccaggauuacaggcaaaggcaacuagagaagcucaaaaacgugcagcugcuggaauuaugaaaaacccaaccguagaugguaucacgguaauugaccuugaaccaauucccuacgacccaaaauucgaaaaacaacuuggacaagucaugcuuuuaauccuuugugugacacaaguauugaugaugcggacaacaugggcuuuaugcgaagccuuaacguuggccacggguccuauaucaacauuaugggaagguaauccaggucgcuuuuggaauacuaccauugccguaucgauggcuaacauuuuucgugggucuuaucuugcuggggccggauuguuguucaguauaaugaaaaacacuacuaacacccguagaggaaccggaaacaucggugaaacuuuaggugaaaaauggaaaaguagguugaacgcuuuagggaaaucagaguuucagauuuacaagaaaaguggcauacaggaggucgauagaacacuagcgaaagaaggaauaaagaggggagaaacagaucaucaugcuguaucaagaggaucugcgaaauugaggugguuugucgaaagaaauaugguaaccccagaaggaaaaguugucgauuuagggugugguagaggagguuggucauacuacugugguggccuuaaaaacgucagggaggucaaaggacucacaaagggaggcccaggacaugaagaaccaauaccaaugagcaccuauggauggaacuugguacgcuuacaaucuggggucgauguguuuuucacaccaccagaaaaaugcgacacccuauuaugcgauauaggcgagaguucaccaaacccaaccauagaggcuggucgaaccuuacgaguacuaaauuuggucgagaauugguuaaauaauaauacucaguuuuguauaaaaguauuaaaccccuauaugcccucugugauagagaaaauggaaacucuacaaagaaaauauggaggcgcccuaguaagaaauccuuuguccagaaauucaacccacgaaauguauuggguuucuaacgccacuggaaacauagucaguucaguaaacaugauaucgagaaugcuaaucaauagauuuacaaugaagcauaagaaagcaaccuacgaacuagacguugauuuaggcuccggaacuagaaacauagggauugagucagaaacgccaaacuuagacaucauuggcaaacggauagagaaaauuaaacaagaacacgaaacgucuuggcauuacgaucaggaucauccuuauaaaacgugggcguaccacggcucuuaugaaacuaagcaaacgggaagcgcaucuagcauggucaacggagucguaagguuacuaaccaaaccuugggacgugguaccaaugguuacccaaauggcaaugacugacaccaccccauuuggacaacaaaggguauuuaaagagaaaguugacacucgaacucaagagccaaaagaaggaacuaagaaauugaugcgaauaacggcagagugguuauggaaagagcuagguaaaaagaaaacuccucguaugugcacccgugaagaguuuacucgaaagguucgauccaaugcggcuuuaggagcuauuuuuacugacgaaaacaaauggaaaucagcccgagaagcuguggaagauucgagguucugggaacuugucgacagagaacggaauuugcaucuugaaggaaaaugugagacgugugucuacaacaugauggggaaacgggagaagaaacuuggagaguucggaaaagcuaaggguaguagggccauuugguauaugugguuaggagcacgguuuuuagaguucgaagcucucggauuuuuaaaugaagaccacugguuuagucguggaaacagucuaaguggcguggagggggaaggcuugcacagguugggcuauauucuaagagauguaaguaagaaagaaggaggugcgauguacgcggacgacacggcugguugggacacuagaauaacccucgaagaucucaaaaaugaagagaugguaacaaaucauaugaaaggagagcauaaaaaguuggcugaagcgaucuucaaacuuacauaucaaaacaaagucguaagaguucaacgcccaacgccaaggggaacgguuauggauauuaucucgcggcgcgaccaaagaggcagcgggcaaguagggacauacggacuuaauacuuucacuaacauggaagcacaauugauaagacaaauggaaggcgagggaauauucaaaucaauucagcaucugacaguuacugaagaaauugcaguacaaaauuggcuagcaaggguaggaagagaacgacuaucgaggauggcuauauccggagaugacugcguuguuaaaccauuagaugaucgauucgcuagugccuuaacggcuuuaaaugauauggggaaaguaagaaaagacauacaacaaugggaacccucaagaggauggaaugacuggacacaaguuccguucugcucgcaccauuuccaugaauuagucaugaaggauggccggguauuagugguuccaugcagaaaucaagacgaguuaauaggcagagcuagaauuagucaaggagcuggauggagucuaaaggagaccgcauguuuaggaaaauccuacgcccaaauguggacacugauguacuuccaucgccgugauuugcggcucgcggcaaacgcuauauguucagcuguaccaagccacugggucccaacaucuagaaccacguggucaauacacgcaaagcacgaauggaugacaacagaagacauguuggcagucuggaacagaguauggauccaagaaaauccauggauggaagauaagacgcccgucgaaaguugggaagagguaccguaucuuggcaaaagagaggaccaauggugcgggucacuuaucggucuaacgucucgcgcuacuugggcuaaaaacauucaaaccgcaauaaaccaaguucguagccuuauaggaaaugaagaauauacagacuacaugccauccaugaaaagguuucgaagagaagaggaagaagcaggagucuugugguga

SEQ ID NO: 22183 - RNA, 9876 nt, Artificial Sequence
  derived and/or modified CDS sequence (opt6) from DENV-2__JX669486__SS-prME
acggcuggcgugauaauaaugcucauaccuacugcgauggcauuucauuugacuacccggaacggggaaccucacaugauuguuggaagacaggaaaaaggcaaaucguuguuauuuaaaacggaagauggaguaaauaugugcacucuaauggcuaucgacuuaggggaauuaugcgaagauacaauuaccuacaaaugcccuuugcuucgacagaaugaaccggaagauaucgacugcuggugcaacuccacaaguacuuggguaacuuauggaacgugcacuacaacaggcgaacacagacgagagaaaagaucgguugcucucgugccucauguuggcaugggucucgaaacaagaacggaaaccuggaugaguagcgaaggggcauggaaacauguucaaagaauagaaacuuggauauuacgacaucccggguucgcaauuauggcggcaauuuuagcauacacgauaggaaccacccacuuucaacgugcacuuauuuucauacuucuaacagccguugcaccauccaugacuaugcgauguauaggaauuagcaauagggacuucguagaaggaguaucaggugguucauggguugacauuguucucgaacauggaucauguguuaccacuauggccaaaaauaaaccuacuuuagauuuugaauuaauuaaaaccgaagcuaaacaaccagcaacacugagaaaauauugcaucgaagcgaaguuaacaaacaccaccacggaaagucgauguccaacacaaggagaaccauccuugaaugaagaacaagauaagagauucauuuguaaacacaguaugguagacaggggauggggaaaugguugcgguuuauucggcaaagggggcaucguuaccugugcaauguucacauguaagaaaaacauggaaggaaaaguaguacuaccagagaauuuggaauacacaauuguaauaacgccgcauucgggagaagaacacgcagugggaaaugauacaggcaaacacggugaggagauuaagauuacaccucaauccaguauaaccgaagccgaacuuacaggauacggaacuguaacaauggaaugcaguccaagaaccggccuugacuucaaugaaaugguccuacuacaaauggaggaaaaggcuuggcuaguccaccgucaaugguuuuuagaccuaccauuaccuugguugccaggugcagacacccaaggauccaacuggauccaaaaagaaacauuaguaacuuuuaaaaauccucaugccaagaaacaagacguagugguucuagguucacaagaaggagcaaugcacaccgcacugacuggagcuacugagauacaaaugucaucaggcaaccuauuauucacuggacaccugaaauguagacuuaggauggacaaacuucaacuuaaagggauguccuacucuauguguacugguaaauuuaaaauaguuaaggaaauagcagaaacgcaacaugguaccauaguaauuaggguccaguaugaaggagaugguucacccuguaagauacccuuugaaauuauggaucuagaaaaacgacauguuuugggaagauuaaucacugucaauccgaucguaacggaaaaagacucaccagucaacauugaagcagaaccuccauuuggugauucauacauaaucauagguguagagccgggccaacugaaacuuaacugguucaagaaaggcagcaguaucggacagauguucgaaacgacaaugcggggugcuaagagaauggcuauacuuggugauacugcgugggauuuugguucacugggagguguauuuacgaguauagggaaggcuuugcaccagguauucggggcuauauauggcgcggcguucagcggaguuucauggacaaugaaaauucuaauuggggugaucauuacuuggauaggaaugaacucacguuccaccuccuuguccguaucuuuaguucucguggguguaguuacauuauaucucggggcaaugguccaagcugacaguggauguguaguaaguuggaaaaauaaagaauuaaaaugugguucaggcauuuuuauaacggacaauguacauacauggacggaacaauauaaauuccaaccugaaucaccaucaaaauuagccagcgcgauacaaaaagcucaugaagagggcaucugcgguaucagaagcgucacacgucuugaaaacuuaauguggaaacaaauuacuccugaguugaaucacauccuaagugaaaaugaggucaaacuuacuaucaugacuggagauauaaaaggcaucaugcaagcgggaaaaaggucauugaggccucagccaacugaauuaaaguauucguggaaaacuuggggcaaagcaaagaugcuuucaacggaaucacauaaccaaacguuuuuaauagacggacccgaaacagccgaguguccgaauaccaaucgagcauggaacucgcucgaaguugaagauuauggauuuggaguguuuacaaccaacauauggcucaaauuacgagaaaaacaagacgucuuuugugauuccaaauuaaugucagcagcuauaaaagacaaccgugcaguacacgcagacaugggguacuggauagagucugcgcuuaacgauaccuggaaaauggagaaggccuccuucauagagguuaaaucaugccauuggccaaaaucgcauaccuuauggaguaauggcguuuuagagagugagaugauuauaccaaagaauuuugcaggaccgguaucacagcauaauuaucgaccagguuaucauacacagacagcugggccguggcaucuaggcaaacuagagauggacuuugauuucugugaaggaacuacaguaguugucacggaagacuguggaaaccgcggacccaguuuacgaacaacaacagccuccggcaaauuaauaacggagugguguugcaggaguuguacauuacccccucugagauacagaggagaagauggauguugguacgggauggaaaucagaccacugaaagagaaagaggaaaaucucguaaauucuuuagugaccgcgggccacggacaaauugauaacuucucauugggcguuuugggcauggcuuuauuucuggaagagauguugagaacaagggucggcacaaagcacgcaauccuauuaguugcggucagcuuugucacguuaauaacaggaaacaugaguuucagagaucucggaaggguuaugguaaugguaggcgugacuaugacggacgauaucggaaugggcguaacguaucuagcauuacuagcugcuuucaaaguacgacccacauuugcggcuggacucuuacuuagaaaacuuacuucgaaagaacuaaugauggcgacuauagggauuacauuauugucccaaucaacuacaccagaaacaauucuagagcuuacugacgcucuggcacuagguaugaugguccugaaaaucguaagaaauauggagaaauaccagcucgcaguuaccauaaugacuauuuuauguguaccaaaugcagugaucuuauuaaaugcuuggaaaguaaguuguacgauacuagccguagucucggucucaccacuguugcucacgaguagucaacagaaaacugauuggauuccuuuggcucucacaaucaaaggauuaaacccaacggcgauuuuucuaacuacauuaucaagaacaaguaagaaaagaucguggccucuuaaugaagcugugauggcaguagggauggucucaauacuagcuucaucacuuuuaaagaacgacauaccuaugacggguccauuaguagcuggugguuuacuuacgguauguuauguuuuaacagguagaucagcagaucuugaauuggaaagagccgcugaugucaagugggaggaccaagccgagauaucuggaucaucacccauacuuucgauaacaauaucagaagacggaucgauguccaucaaaaaugaagaggaggaacagacacugacgauacugauaagaacaggguuacugguaauaaguggggucuucccugucagcaucccuauuaccgccgcugcuugguauuuaugggaagucaaaaagcaaagagcaggaguuuuaugggaugugccgucaccacccccgguagaaaaagcugaacuagaagauggagcauaccggauaaaacagagagguauuuuggguuacucacaaauaggugccggagucuacaaagaaggaacauuucauacaauguggcauguuacuagaggggcuguucuuaugcaucgagguaaaagaaucgaacccucaugggcagaugucaagaaagauuuaauaagcuacggaggaggcuggaaauuggagggugaauggaaagaaggagaagaaguacaaguuuuagcguuagaaccggggaagaaucccagagcaguucagacaaaacccggucucuuuaagaccaauacuggaacuauaggagcaguuagucuggauuuuucaccgggaacuucaggaagcccuauaguagaucgaaagggaaaaguaguaggcuuauauggaaauggagucgugacccggaguggagcauauguuagugcuaucgcgcaaacugaaaaaucuauagaggauaacccggaaauagaggaugacauauuuaggaagaaaagacuaacgaucauggacuuacauccaggagcggggaaaacaaaacguuaccuuccugcgaucguucgugaagcgauaaaaaggggauugagaacgcucauacuggcuccuacgaggguaguggcugcagaaauggaagaggcuuuacgaggucugccaauucguuaucaaacaccggcgaucagggcggaacauacaggaagagaaauuguagacuuaaugugccaugcgacuuuuacuaugcgacuacuauccccugucagaguaccaaauuauaaucucauuauaauggaugaagcgcacuucacagacccagcuucaaucgcagccagaggauauauaucuacgcguguagaaaugggugaagcggcagguauuuucaugacugcgacaccaccaggaaguagagacccguuuccacaaucaaacgcuccaauuauggaugaagaaagggaaauuccagaacgaucauggaacucaggucacgaguggguaacagacuuuaaaggaaaaacuguaugguuuguuccaaguauuaaagcugggaacgauauagcagcuugucucagaaagaauggaaagaaaguaauccaacugucaagaaagacauucgauucagaguaugugaaaacgagagcaaaugauugggauuuuguuguuacaacugacauuucugagaugggagccaacuuucgcgcagaacguguaauagacccaagaagauguaugaaaccaguuauacugacugacggagaggaaaggguuauccucgcaggaccuaugccaguaacccauagcucagccgcacaaaggaggggacgaguuggcagaaauccaaagaacgaaaaugaucaauauauauauaugggugaaccacuagaaaacgaugaagacugugcgcacuggaaagaggcgaaaauguuguuagacaacaucaacacuccggaaggaauaauaccuucuauguuugaaccugaacgcgagaaaguggacgcuauugauggagaauaccgacuaagaggagaggcucgaaaaacauuuguagauuuaaugagacgaggagaucuacccguuuggcuagcauaccguguggcagcggaaggaauaaauuaugcugauaggagauggugcuuugacgggaucaaaaacaaccagauauuagaagaaaauguagaggucgagauauggacaaaggaaggcgaaaggaagaaacuuaagcccagauggcucgaugccagaauuuauagcgauccccuagccuugaaagaauuuaaagaauuugcugcuggacgaaaaaguuugacauuaaaccucauuacugagauggguagguuaccuacuuuuaugacgcaaaaagcccgcaaugcucuagacaauuuagcaguucugcacacagcggaggcaggagggcgagcauacaaccacgcguuaucagaacucccggaaacucuagaaacuuuacuacuacuaacgcuacuugcaacagucacaggggguaucuuccuauuuuuaaugucagguaaaggcaucgguaaaaugacuuuaggaaugugcugcauuauuacugcaucaguauuauuaugguaugcucaaauucagccgcacuggauagcagccuccaucauuuuggaauuuuucuuaaucguacuccuuauaccagaaccggaaaaacaaagaacaccacaagauaaucaacucacauauguuguaauagcaauauuaacggucgucgcggcuacgauggccaaugagauggguuuccuugaaaagacgaagaaagaucuugggcuggggucgauaacgacccaggaaagugaaaguaacauuuuagauauagacuugagaccagcaucagcauggacacuauacgccguagcuaccacauucguaacaccaauguugcggcacagcauugaaaacagcucgguuaaugucagccuuacugcuauugcuaaccaggcgacuguacuaauggguuuaggaaaaggauggccguuaaguaaaauggacaucggggugccauuauuagcgauagguugcuacagucaaguuaauccaauuacacuaacggcugcacuacuccugcuaguggcgcacuaugcuaucauuggaccgggauuacaggcaaaagcaacuagagaagcccagaaaagggcagcugcaggcaucaugaagaauccgacaguagacggaauaaccguugucgaucuagaaccgauccccuaugauccaaaauucgaaaagcaacuaggacaaguuauguuacuuauauugugugugacucaaguacucaugaugaggacaacgugggcucuaugcgaagcacuaacucuugcaacaggaccgauuaguacguuaugggaagguaauccaggaagauucuggaauacuacaaucgcgguaagcauggccaacaucuucaggggaucauaucucgcuggugcaggucuauuauuuaguauaaugaagaauacaacuaacaccaggagaggcacuggaaacauuggagaaacuuuaggcgaaaaauggaaaucacgacuaaaugcguuggguaagagcgaauuucaaauauauaaaagaagcgguauucaggaaguagaucguacacuggcgaaggaaggcauaaagagaggagaaaccgaccaccacgcaguuucaagagguucggcaaagcuaaggugguucgucgagcguaauaugguaaccccagagggaaaaguugucgauuuagguuguggaagaggcggauggucauauuacugcgguggauuaaagaauguccgagagguuaaaggacuaacgaaagguggaccugggcaugaagaaccuauucccaugucaacuuauggcuggaaucuagugcgauuacagucggggguugauguauucuuuaccccaccugagaaaugugauacucuauuaugugacauaggcgaaucuucgccuaaccccaccauagaggccggucgaacauugagaguacugaauuuaguggaaaacuggcuuaacaacaauacacaauuuuguaucaaaguacuaaacccauacaugccuucaguaauagagaaaauggagacgcuacaaagaaaguauggaggugcuuuaguucgaaauccuuuaucgcgaaauucaacucacgaaauguacuggguuucaaaugcaaccgggaacauaguguccucuguaaacaugauaucuagaaugcuuauuaaccguuuuacuaugaagcacaagaaagcgacuuacgagccagauguggacuuagguuccggaaccagaaacauugggaucgaauccgaaauaccaaacuuggauauuauugggaaaaggaucgagaagauaaaacaagaacacgaaacaagcuggcauuacgaucaagaucacccuuauaagacuugggcuuaucacggcuccuacgaaacuaagcaaacagguucagccucgucuaugguaaacggaguaguacgacuauuaacaaaaccuugggaugucguaccgaugguaacucaaauggcaaugacagauaccacaccauucggucaacaaagaguauucaaggaaaagguugacacgagaacacaggaaccaaaggaagguacaaagaaacuaaugcgaauuacugcggaaugguuauggaaggaacuaggcaagaagaaaaccccucgaauguguacacgagaagaauuuaccaggaaggucaggagcaacgcagcauuaggcgcuauauuuaccgaugaaaauaaauggaaaagugcgagggaagccguagaagacucacguuuuugggagcuaguggauagagagagaaauuugcaucuugaaggaaaaugcgaaaccuguguuuauaauaugauggggaagagagagaagaaacuuggcgaguucggcaaagcaaaagggagucgggcaaucugguauaugugguuaggcgcccgauuuuuggaguucgaagcccuaggauuucuaaaugaagaccauugguuuagucgcggcaauagccucucuggcguugagggugaaggccuucacagauuggguuacauacuacgcgacguauccaagaaggaaggaggagccauguacgcagaugauacagcaggaugggauacaagaauuacacuagaggacuuaaagaacgaagaaaugguaacgaaccauaugaaaggcgagcacaagaaauuagcggaagccguauuuaaacuuaccuaccaaaacaagguaguucgcguccaaagacccacaccgcgaggaaccgugauggauauaauaucacguagggaucaacgagguaguggacaagucggaaccuacgggcucaauacauuuaccaauauggaagcacaauuaauuagacaaauggaaggagaaggcauauuuaaaucaauucagcaccuaacaguuacugaggaaauugcugugcaaaauugguuggcccgaguagggagagaacgccugaguagaauggcaauaucaggggaugacugugugguaaaaccauuagaugaucguuuugccuccgcucuaaccgcuuuaaacgacaugggcaaaguucggaaagauauacaacaaugggaaccuucacguggguggaaugacuggacccaaguaccauuuugcucucaccacuuucaugaacucguuaugaaagauggacgaguccugguaguaccauguaggaaucaggaugaacucauaggcagagccaggaucucccaaggagcaggauggucauuaaaagagacggcaugcuuagggaaaagcuaugcucagauguggacguugauguacuuucauagaagagaccuaagauuggcugcaaaugcaauaugcagugcgguuccuucccacuggguaccuacgagcagaaccacauggagcauacacgcaaaacacgaauggaugaccacagaagacauguuagcaguguggaauaggguauggauucaagaaaaucccuggauggaagauaagacgccugucgaaucaugggaagaagugccguaccuuggaaaacgggaagaucaguggugugguucacugauuggccuuacauccagagcuaccugggccaaaaauauacaaaccgcuaucaaucaaguacgauccuuaauaggaaaugaggaguauacugacuacaugccaucuaugaaacgcuuuagaagggaagaagaagaagccggcgucuuaugguag

SEQ ID NO: 22184 - RNA, 9876 nt, Artificial Sequence
  derived and/or modified CDS sequence (opt6) from DENV-2__JX669487__SS-prME
acagcuggagucauaauuauguuaauaccgacagcaauggcauuucacuugaccacacguaauggcgagccgcauaugauuguaggacggcaagaaaagggaaaaaguuuacuuuuuaaaacagaggacgguguaaauauguguacucuaauggcuauagauuugggcgaguugugcgaggauaccauaaccuacaaaugcccauuacuccggcaaaacgagccagaagauauugauuguugguguaauagcacaaguacaugggugaccuauggaacuuguacaaccacaggagaacaucgacgcgaaaaacguucaguagcucuuguaccacauguaggaaugggccuagaaacacguacugaaacguggaugaguuccgaaggggcguggaaacacguucaacguauugaaacuuggauucuucgccaucccggauuugcaauaauggcagcaauucuugccuauacuauugguacuacacauuuucaacgugcacugauauuuauacuguuaacugccguugcaccuagcaugacaaugagauguauugguauuaguaauagggauuucguagaaggcguuagcgguggcucauggguagacauuguauuagagcacggcucgugcgugacaacuauggccaaaaauaaaccuacauuggauuucgaacuuauaaaaacagaagccaaacaaccggcaacccuccgaaaauauugcauagaagcaaaguugacaaauacgacaaccgaaucaagguguccaacacagggcgaaccgaguuuaaacgaggagcaagacaagagauuuauuuguaaacauagcaugguagauagagguuggggaaaugguugcgguuuguucgguaaagguggaauagugacaugugcgauguucaccuguaaaaaaaauauggaggggaaagugguucuaccugagaaccuagaauauacuaucaugaucacaccucacagcggagaagaacaugcaguaggcaacgacaccggaaagcacggcaaggaaauuaaaauaacaccacagucuuccauuacagaagcagaguuaacuggguacggcaccguuacaauggaaugcagcccacggacggguuuggacuucaaugagaugguguuacuucagauggaggaaaaagcuugguugguacacagacaaugguuucuagaucuaccgcuaccaugguuaccaggagcagauacucaggguaguaauuggauucaaaaggaaacucuagucacguucaagaauccucacgcaaaaaaacaggauguaguaguuuugggaucccaagaaggugcaaugcacacugcucugacaggugcuacugaaauacagauguccagugggaauuuguuguuuacaggacauuuaaaaugucgacugaggauggacaaauuacaauuaaaagggaugucauauaguauguguacggggaaauuuaagauugucaaagagauugcggaaacccaacauggaacuaucgucauuaggguacaauacgaaggagacggcucaccgugcaaaauuccauucgaaauaauggaucuugaaaaaagacauguucuaggccguuuaauaacaguuaauccgaucguaacagagaaagauagucccgucaacaucgaagccgaaccaccuuuuggagacucuuacauaauaauaggcguugaaccaggacaacuaaaauuaaacugguucaagaaagguucaucuauaggucaaauguuugaaacaaccaugcgaggagcuaagcguauggcuauauuaggagauacggcaugggacuuuggcagccucgggggaguuuucacaucuaucggaaaagcgcuacaucaaguauuuggagccauauauggggccgcuuuuucuggcguaucuuggaccaugaaaauucuaauaggaguaauaauuaccuggauugguaugaauaguagauccacaucacuuuccguaagucuaguacuaguuggcguuguaacgcuauaccuaggagcaaugguacaggcggacucugguuguguuguaucauggaaaaacaaagaguuaaaaugcgguucaggcauuuuuauaacugauaauguacacacguggacugaacaauacaaauuucaacccgaaagcccauccaaacucgcaucggcaauucaaaaggcacaugaagaagguauauguggaauuagaaguguaacgagacucgaaaacuugauguggaaacaaauaaccccggaauuaaaccauauuuuaagcgaaaaugaaguaaaacuaacaauaaugacaggggauauuaaaggcauuaugcaagcuggaaaacggucucuucgcccgcaacccacggaguuaaaauauucuuggaaaacuuggggaaaagcaaaaauguuaaguacugaaagucacaaccaaacguuucuaaucgaugguccugaaacagcagaguguccaaacacgaauagagcauggaauucacucgaagucgaagacuaugguuucggcguauucacaacuaacaucuggcuaaaacucagggagaaacaggacguauuuugugauucuaaacuaauguccgcggcuauaaaagauaauagagccguacaugcugauaugggguacuggauugaaucugcucucaacgauacguggaaaauggagaaagcaucauuuauugaaguaaaaucuugccauuggcccaaaucacauacgcuauggucuaauggaguguuggagagugaaaugaucauuccaaaaaacuuugcggggccaguuucucagcacaauuacaggccuggauaccacacccagacagccgguccauggcauuuagguaaacuggaaauggacuuugauuucugugaagguacaacaguggucguaacugaagauugcgguaauagagguccuucccuaaggacuacaacugcgucgggaaaauuaauuacugaaugguguugcagaucgugcacccuaccaccauuaagauacagaggugaagaugguugcugguacggaauggaaauaaggccuuuaaaagagaaagaggagaacuuagugaacucgcucguaacggcagggcauggacaaaucgauaauuuuucccuaggaguguuagguauggccuuauuucuugaagagaugcuucgaacacgaguagguaccaaacacgcuauuuuauuaguggccguauccuuuguaacccuaauaaccgguaacaugaguuuuagagacuuaggacgagugaugguaauggugggagugaccaugacggacgacauuggcaugggagucaccuaucucgcccuauuagcggcuuuuaaaguaagaccuacauuugccgcaggucuacuauuaaggaagcuaacaagcaaagaacuaaugauggcgacaaucggcauagcuuuguuaucacagucaacaauuccugagacgauuuuagaguugacagacgcauuagcauugggaaugaugguacugagaauaguaagaaauauggaaaaguaucaguuggcaguaacuauuauggcaauaucaugcgugccuaacgccguaauuuuguugaacgccuggaaaguaaguuguacaaucuuagccgcgguuaguguaagcccauuauuacuuacuaguagccaacaaaaaacggauuggauaccccuugcauuaacaauaaagggcuuaaauccaacagcaauauuccuuacaacucuuagucguaccucaaagaaaagaaguuggcccuuaaaugaagcagugauggcaguuggcaugguaucgauucuagcaucaaguuuauuaaaaaaugauauuccaaugacaggcccauuaguagcuggggguuuacuuacaguuugcuacguacuaaccggaagaagugccgauuuggaacucgaacgggcggcagauguuaagugggaggaucaggcagagauuucugggaguucgccuauccuuucuauaacaauaagugaagaugguucuaugagcaucaaaaaugaggaagaagagcaaacacugacaauuuuaauuagaacaggcuuacucgugauaucaggaguauucccgguaagcaucccgauuacagcagcggcuugguaccuaugggaagugaagaaacaacgugccggaguauuaugggacguucccaguccgccaccaguggaaaaagccgaguuagaagauggagcuuauaggauaaagcaaagaggaauucuagguuacagccaaauuggggcgggggucuacaaagagggaacauuucauacaauguggcacgugacaagaggagcagugcugaugcaucgcggcaaaaggaucgaaccaaguugggcagacguaaaaaaagauuuaauuuccuauggcggugguuggaaacuggagggggaauggaaagagggugaagaagugcaaguauuggcacuagaaccgggaaagaauccaagggcgguucaaacgaaacccggacuuuucaagaccaauaccggaaccaucggagccauauccuuagauuuuaguccaggaacaaguggcucaccaauugucgauagaaaaggaaaaguagucggacucuacgguaacggggucgucaccagaaguggugcuuauguuucggcuauagcucaaacggaaaaaucaauagaagauaauccugagauagaagacgacauauuuagaaaaaagcgauuaacaauaauggaucuccacccgggagcugggaaaacaaaaagauaucuuccagcaauaguaagagaggccauuaaacgaggucugcgaacacuaauacuagccccuacgcggguaguagcugcugaaauggaggaggcacuaaggggucuuccuauaagauaucaaacuccagcaauacgggccgagcacacuggaagggaaauugucgaucugaugugccacgccaccuuuacuaugagauuauuaucaccuguaaggguuccgaauuacaacuuaaucauaauggaugaagcccauuucaccgauccugcuucgauagcagcgagggguuauaucaguacgagaguggaaaugggugaagcugccggcaucuuuaugacagcaacaccaccaggaucaagagauccuuuuccacaaagcaaugcuccgaucauggaugaagaacgugagauuccagaaagaaguuggaauucuggacacgaauggguaaccgauuucaagggaaaaacuguaugguuuguaccgucaauaaaggcaggaaacgacauugcagccugccuacgaaagaauggaaaaaagguuauacaguugucgaggaaaacauucgacucagaguaugugaaaacacgugcaaaugacugggacuucguagucacgacagacauuucggaaaugggagcaaauuucagagcagaaagagucauugauccgaggagguguaugaaacccgugauucuaacagacggugaagagagggucauacuagcggguccgaugccgguaacacacaguuccgcagcacaacguagaggcagaauaggacguaacccuaagaacgaaaaugaucaguacauauacaugggggaaccacuagaaaaugaugaagauugugcccauuggaaggaagcaaaaauguuguuagauaauaucaauacaccagaaggaauaauucccucuauguucgaacccgaaagggagaaaguggacgcaauugacggagaguaccgccuacgaggugaagcccguaaaacguuuguugauuuaaugagaaggggugaucuaccaguguggcucgcauauagaguugcagcagaaggcauaaacuaugcagacagaagaugguguuucgauggcauuaagaauaaccaaauauuggaagaaaauguagaggucgaaauauggacaaaggaaggcgagagaaaaaaauuaaagccacguugguuagaugcccggauauacucugacccauuagcacucaaggaauuuaaggaguuugcagcagggagaaaaucguuaacacuaaaccuaauaacagagaugggacggcuacccacuuuuaugacacaaaaagcacgugacgccuuagacaaccucgcgguguuacacaccgccgaggcaggaggaagagcauauaaacaugcacuaucagaauuaccugagacccuggaaacucuccuacuacuaacacuuuuagcaacagugaccggcggcauauucuuauuuuuaaugagugguaagggaauuggaaaaaugacacugggcauguguuguauaauuacggcuaguauccuuuuaugguacgcgcaaauccaaccucauuggaucgcugcaagcaucaucuuagaauucuucuugaucguccuucuaauuccggaaccagagaagcaaagaacuccccaagauaaccaacuaacauauguugucauagcuauucuuacugugguagcggcaacaauggcuaaugagauggguuucuuagaaaaaaccaaaaaggacuuggggcucgguaguauaaccacucaagaaagugaaucaaacauacuagauauugauuuaagaccagccucggcauggacuuuguaugcaguugcgacuacuuucgugacuccaauguuaagacauucaauugaaaacucaucaguuaacguaucacucacugcgauugcuaaucaggcuacaguauuaaugggucuugggaaagguuggccucucucuaaaauggacauuggcgugccuuugcuugcgauaggcuguuauagucagguuaaccccaucacacuuacagcugcucuucuccucuuagucgcacauuacgcaauuaucggaccaggguuacaagccaaagcaacaagagaagcucagaagagggcagcugcuggaauaaugaaaaacccuaccgucgaugguauuacaguaauugauuuagaaccuauuccguacgauccuaaguuugaaaaacaacugggacaaguaaugcuacugauacuaugcguuacacaaguguugaugaugagaacaacaugggccuugugugaagcguuaacacuugcaacaggccccaucucuacccuaugggaagguaauccuggaagauuuuggaacacuacaaucgcagucagcauggcaaauauauucagagguuccuaccuggcaggagcuggguuauuauuuagcauaaugaaaaauacgaccaacacaagaagaggcacgggaaauaucggggaaaccuuaggcgagaaauggaaaucacgucuaaacgcguuaggaaaaucagaauuucagauauacaagaaguccggaauccaggaaguagaucgcacacucgcaaaagaagguauaaagagaggcgaaaccgaucaccaugcaguaucacgagguucggcaaagcuccgcugguucguagaacgcaauaugguaacgccagaaggcaagguaguagaucuugguugcggacgaggagguuggucguauuacugcggcggguuaaaaaacgugcgugagguuaaaggacuuacgaaaggugggccggggcacgaagagcccauaccaaugagcacauacggcuggaauuuaguacgccuccaaaguggagucgaugucuucuuuacgccaccagagaaaugcgauacacuacuaugcgauauuggugaauccucgcccaacccaaccauagaagcgggacggacauuacgcguguuaaauuuagcugaaaauuggcuaaacaauaacacacaguucugcaucaaaguacuuaauccuuauaugccaaguguaauagagaaaauggaaacauugcagaggaaguaugggggcgcacuuguccgaaauccucucucucgaaauucuacucaugaaauguauugggugucaaaugcgacggggaacauagucaguucagugaacaugauuucacggauguuaaucaauagauuuacuaugaaacacaaaaaggcaacauaugagccugauguagauuuaggaagcggaacgcguaauauaggaauugagucagagaucccuaaucuagauauuauaggaaagcguauagaaaagaucaaacaggaacaugaaacauccuggcauuaugaccaagaucauccguauaaaacgugggccuaucacggcucauaugaaacaaaacagacagguucagcaucuucuauggucaauggaguugugagacuccugacuaaacccugggauguaguaccuaugguaacccaaauggcaaugacagacacaacgccauuuggacaacagagaguguucaaagaaaaggucgauacgcggacacaagaaccuaaagagggaacgaaaaaacuaaugcgcauaacagcugaauggcuauggaaagaguuaggaaaaaaaaaaacuccgcgaauguguacgagagaagaguuuacuaggaagguuagaucuaacgcagcucuaggugcaaucuuuacugaugaaaacaaauggaagagugcaagagaagcuguagaggauucucgguuuugggaguugguagacagagaacgcaaccuacauuuggaagguaaaugugaaacuuguguuuacaacaugaugggcaaacgagagaaaaaacuuggagaauucggaaaagccaaagguucucgugcaauaugguauauguggcugggugccagauuccucgaguuugaagcucuuggcuuucuaaacgaagaucacugguucagcagaggcaacucccucucagguguggaaggagagggacuacacaggcuuggauauauucuaagagaugucucaaaaaaagagggaggugcuauguaugcggaugacacagcugguugggauacgagaauaacauuagaagacuuaaaaaacgaggaaauggucacgaaccauaugaaaggagaacauaaaaaguuagcugaggcuauauucaaauugacguaucagaacaaaguaguacgaguccaaagaccaacaccacgggguacgguaauggauauaauaagucgaaaagaucaacgggguagcggacagguagggacauacggauuaaacacguuuacgaacauggaagcccaacuaauaaggcaaauggagggagaagguauuuuuaaaucaauacaacacuugacgguaacagaagagaucgcaguucaaaacugguuagcaagaguuggaagagaacgccuuucuagaauggcaaucucaggcgacgauuguguugugaaacccuuagacgauagauucgcuagugcacugacagcguugaacgauauggguaaggucagaaaggauauacagcagugggaaccaaguaggggauggaacgacuggacgcaagucccguuuugcagccaucacuuccaugaacugguaaugaaagacgggcgcguguuagucguaccaugcagaaaucaagaugaacuaauagguagagcccguauuucacaaggggcgggauggagccugaaagagaccgcaugccuagggaagagcuacgcccaaauguggacacuuauguacuuucaccggagagaucuucgauuggccgcgaaugcaaucuguucggcgguaccaucucauugggugccaacuaguaggacgacauggaguauucaugcgaaacacgaguggaugacgaccgaagauauguuagcuguauggaacagaguuuggauacaggaaaacccauggauggaagauaaaacaccagucgaaucuugggaagaaguuccauaucuaggaaagcgcgaagaccaguggugcgggagccuaauaggacuuacaucucgugcaacaugggcgaaaaauauccaaacagcuauaaaucaggucaggucacucauagggaaugaagaauacacugauuauaugcccagcaugaagagauucagaagagaagaagaagaagcagguguacuuugguaa

SEQ ID NO: 22185 - RNA, 9876 nt, Artificial Sequence
  derived and/or modified CDS sequence (opt6) from DENV-2__JX669488__SS-prME
acagcuggaguaauaauaauguuaauaccgacagcaauggcauuccaucuuacaacccgaaauggcgaaccacauaugaucguagguagacaagaaaaggguaaaucuuugcucuuuaaaacagaagaugguguaaacaugugcacguugauggcaauagauuugggagaauuaugugaggacacgauuacauauaagugcccuuuacuaaggcaaaacgaacccgaagauauagacuguuggugcaacagcacuuccacauggguaacguaugggaccugcacaacgacuggugagcauaggagagaaaaacggagcguagccuuagucccucauguagguaugggacuagaaacucgaacagagacauggaugaguagugaaggagccuggaaacacgugcaaagaauagagaccuggauccucagacauccagguuuugcgauaauggcggcgauacucgcauacacuauaggcaccacccauuuucagagggcauuaauauuuauacucuugacggcuguggcucccaguaugacuaugagguguauuggaauaucgaaccgggauuuuguagaaggcguguccgguggaucauggguagauauuguuuuagagcaugggucauguguaacaacaauggcaaaaaauaaacccaccuuggacuuugaacugauuaagacagaagcaaagcaacccgccacucuuaggaaauauuguaucgaagcaaaauuaacuaacacaacgaccgaaucccgcugccccacacaaggagaaccuucguuaaaugaggaacaagauaaaagauuuauauguaagcauaguaugguugaccgaggcugggguaaugggugcggacuauuuggcaaaggaggcauuguuacuugugcgauguucacauguaagaaaaacauggaaggaaaaguuguccuuccagaaaaucucgaauauacaauaguuaucacaccacacucaggggaagagcaugcgguaggaaacgauacuggaaaacacggaaaagaaauaaaaauuacaccacaaucuucgaucacagaggcggaauuaacaggguacggaacgguaacuauggaguguucaccgagaacagggcuagauuuuaaugagaugguauuacuacaaauggaagaaaaagcauggcucguacauaggcaaugguucuuagacuuaccucuaccuuggcuaccaggagcggauacgcaagguucaaacuggauccagaaagaaacuuuagucacuuuuaaaaacccccaugcgaagaagcaagauguagucguacuaggaagucaagaaggagcgaugcauacggcgcuaaccggagcaacugaaauucaaaugucaagcggaaauuugcucuucaccggucaccugaaauguagacuacgaauggauaagcugcaacucaagggaaugaguuauagcauguguaccgggaaguuuaagauaguaaaagaaauugcggaaacucaacaugggacgauuguaauuagaguucaguacgaaggagaugggucgccguguaaaaucccuuuugaaaucauggacuuagaaaaaaggcaugugcuagggagacuuauaacagucaauccuauagugacugaaaaagauucaccaguaaauauagaagcugaaccgccguucggagacucauauaucauuauagguguugaaccuggacaacuaaaguuaaauugguucaaaaaaggaagcaguauaggacaaauguuugaaacuacaaugagaggggccaagaggauggcaauacuuggagacacugcaugggauuucgguucguuagguggaguauuuaccaguauaggcaaagcauugcaccaaguguuuggggcaaucuacggugcggccuucucaggaguauccuggacuaugaaaauacuaauaggcguuauuauuacauggauaggaaugaauagucggagcaccucacuaaguguuucauugguuuuaguaggaguugucacauuauauuugggcgcaaugguccaagcugacucggggugugucgugagcuggaaaaacaaagaguugaaaugcggauccggcauauuuauaaccgauaauguacauaccuggacugagcaauauaaguuccaacccgagucgccaaguaaauuagcaucagcaauccaaaaagcgcaugaggaaggaauaugcggaauucgaucaguuacacgcuuggagaauuuaauguggaagcagaucaccccugaauuaaaccauauucuuagcgaaaaugaaguuaaacuuacuauuaugacgggggauauaaaggguaucaugcaggccggcaagcguucguugagaccucaaccuaccgaauuaaaauacuccuggaaaacguggggaaaggcaaaaaugcuuaguacugaaagccacaaucaaacuuucuuaauugacggcccagagacagccgagugccccaauacaaauagagcuuggaauucguuagaaguugaagauuacggguuuggcgucuuuacaacgaacauuugguugaaauuaagggaaaagcaagacguauuuugugacucuaaauuaaugucagcggcuaucaaagauaaucgggcuguccaugcugauaugggcuacuggauugaaucagcauuaaaugauaccuggaaaauggaaaaagcaagcuucaucgaaguaaaaagcugucauuggccuaaaucacacacuuuauggaguaaugguguacucgagagugagaugauaauaccgaaaaacuuugccggucccgucagccaacauaauuauagaccgggauaccauacgcagacagccggaccuuggcacuuaggaaaauuagaaauggacuucgauuucugcgaaggaacgacagugguaguaacggaagauuguggaaacagaggaccgucauuacguacaacaacggcaucaggaaaacuaauaacugaauggugcugccgcuccuguacacuaccaccucuuagauaucguggggaggacggauguugguacgguauggaaauacgaccucuuaaggaaaaggaagaaaaucuuguaaacucccuagugacggccggacauggucaaauagacaauuuuagucuugguguacuggggauggcauuguuccuagaagagauguuaagaacccgugugggaacaaagcaugcuauauuacuuguagccgcgucauuuguaacguugauaacugggaacaugaguuuccgugaucugggaaggguaaugguaaugguaggugcgaccaugacagacgacauagggaugggugucacuuaucucgcacuucucgcugcuuucaagguacggccgaccuucgccgcaggacuacuucuuagaaagcuaacgucaaaagaauuaaugauggcaacgaucggaauugcguuacuuucucagucuacgauuccagaaaccauucucgaacuaacagaugcuuuggccuuaggcaugauggugcuucgaauagugagaaacauggagaaauaccaacuagcagucacaauuauggccauuucgugcguaccgaaugcagugauacuacuaaacgcuuggaaggucucaugcacaauucucgcggcgguguccguauccccguuauuacuaacaaguucucaacaaaagacugauuggauuccacucgcuuuaacaauaaaaggauuaaacccgaccgcaaucuuuuuaacaacacuaaguagaacgagcaaaaaaaggucauggccacuaaaugaggccguaauggcaguaggaauggugucgaucuuagcuaguagcuuauuaaaaaaugacauaccaaugacuggaccacuaguggcggggggccuucuaaccguuuguuacguauuaacgggaagaagcgcagaucuagaauuagagagagcggcagauguuaagugggaagaucaggcagaaauuuccggcagcucuccuauucugucgauuaccaucucagaagaugguaguaugucgauaaagaaugaagaggaagagcaaacacuuaccauuuuaauuagaacaggacuacuuguuauaucugguguauuuccagugucuauacccauaaccgccgcagcgugguacuuaugggaaguaaagaaacaaagagcgggcguauuaugggacguacccaguccaccuccaguugaaaaagcagaacuagaagauggagcguaccgaauuaagcaacgagguauacuuggauauucccaaauaggugcagguguauauaaggaagggacauuucauacuauguggcauguaacuagaggggcaguauuaaugcaccggggcaaaagaauugaaccgagcugggcagacguaaagaaagauuuaauaagcuauggcggaggguggaaauuagagggggaauggaaagaaggcgaggaaguucaaguauuagcccuagaaccaggaaagaauccgcgugcaguacaaaccaaacccggauuguuuaaaacaaauacuggaacuauaggagccauaucuuuagauuuuaguccuggaacuucagggagcccaauugucgaccgcaaagggaaaguagucggacucuacggcaacgguguaguaacucgaucuggugcuuauguaagcgcaaucgcacaaacagagaaaaguauugaagacaauccagaaaucgaagaugacauuuuuagaaaaaaaagacugaccauuauggauuuacauccuggagcggguaaaacaaaacguuaucuuccagccauagucagagaagcaauaaagagaggauuaagaacguuaauacuugcgccuacuagaguagucgcagcggagauggaagaggcacuccgcggauuaccuauucgguaccagacaccggcaauucgugcagaacacacagguagagaaauaguagaucuuaugugucaugcgaccuuuacaaugcggcuauuaagcccugugcgaguaccuaauuauaauuugauaaucauggaugaagcccauuucacugauccagcuucuauagcagcacgagguuacauaaguacaagaguagagaugggugaggcggcagguauauuuaugacugccacaccaccagggagucgugacccauuuccacagagcaacgcacccauaauggacgaagagagagagauaccagaaagaucuuggaauaguggacaugaguggguaacggauuucaaaggaaaaacaguaugguuugucccuucaaucaaagccgguaacgauauagcagcuugucucaggaagaaugguaagaagguuauacaauugucaagaaaaacauuugacuccgaguauguaaagacaagagccaacgauugggacuucgucguaacaacggauauuagugaaaugggagcaaauuuucgagcggaacguguaauagaccccaggagauguaugaaaccaguaauucuuacggauggugaagagcgaguaauuuuagcgggcccaaugccgguuacacauagcagugcugcgcagcguagagggagaauagggagaaacccaaaaaacgaaaacgaucaauauauauacaugggagagccauuggaaaaugaugaggauugugcucauuggaaggaggcaaaaauguuacuagacaauaucaacaccccggaaggaauaauuccuagcauguuugagccagaaagagagaaaguagacgcgauugacggugaauacagacuacgaggugaagcgcgaaagacuuucgucgaucuuaugaggagaggcgaccuaccggucuggcuugcguauaaaguagcagcagaagguauaaacuaugcugauagaagaugguguuuugacggaaucaaaaacaaucaaauccucgaagagaauguugaaguggaaauauggacaaaagaaggugaaaggaaaaaauuaaagcccagaugguuagaugcucguauauacucagaccccuuagcauuaaaggaauucaaagaguucgccgcaggaagaaaaagccuuacguuaaacuugauuaccgaaaugggacgguuaccuacauuuaugacacaaaaagcacgagaugcucuagauaauuuagcuguacuucauacggcagaagcagguggccgugcauacaaacaugcauugagugaauugccagagacgcuagaaacacuucuuuuacuuacuuuacuagcuacagugacuggagguauauuccuauucuuaaugagugggaaaggcauugguaagaugacuuugggaauguguuguauuauuacagcgaguauccuccuuugguaugcucagauucaaccucauuggauagcugcaucaaucauacucgaauuuuuccuaauugucuugcuaaucccggagccagaaaagcaaagaacaccucaagauaaccaauugacguaugugguaaucgcuauauugaccguuguagccgcaacuauggcuaacgaaaugggguucuuagaaaaaacaaagaaagaccuuggacuugguuccaucacaacgcaggaaagugaaaguaacauucuugauauagacuuaaggccggcgagugccuggacgcuuuaugcgguugcuacgaccuucgucacuccuaugcuuagacauucgauagagaauucaaguguaaauguuucucucacggcuaucgcgaaucaggcaacgguacugaugggauuaggcaaaggguggcccuuaucuaaaauggacauuggaguaccauuguuagcaauuggauguuacucacaggugaauccaauaacuuugacggcugcucuguuacuucucguagcacauuacgcgauuauagguccuggauuacaagcaaaagcgacacgugaagcucaaaagcgggccgccgcagggauaaugaaaaauccaacuguugauggaauaacuguuaucgaucucgaaccaauuccuuaugauccuaaauucgagaagcagcuaggacaaguuauguuacuuauccuauguguaacucaggugcugaugaugcgaacaacuugggcauuaugugaagcauugaccuuagccaccgggcccaucagcacucuuugggaagggaacccaggacgcuucuggaauaccacaauagccguaaguauggcuaauaucuuucgcggaagcuacuuggcaggagcggguuuacuauucuccauaaugaaaaacacagccaacacacgacgagggacagggaauaucggggaaacuuugggagaaaaauggaaauccagacuuaacgcucuaggaaaaagcgaauuccagauuuauaagaaaucugguauacaagaaguggacagaacacuagcgaaagaaggcauaaaacguggagaaaccgaucaccaugcaguaucuagagggucagcgaagcucagaugguucguagaaaggaauaugguaaccccagaaggcaaaguuguagacuuagguugcggacgcgggggguggaguuauuacugugggggguuaaaaaaugugcgugaagucaaagguuuaacaaaaggcgguccaggacacgaagagccuaucccgaugucaacauauggguggaauuugguacgacuacaaagugguguugauguuuuuuucaccccaccagaaaaaugcgauacgcuccuaugugauauaggcgaaucuucgccuaauccaacaauagaagccggcaggaccuuaagggucuugaaucuugcagaaaauugguuaaauaacaauacacaauuuuguaucaaaguccuuaauccauauaugccuaguguuauagaaaagauggagacauuacaacgaaaauacggcggagcuuuagugcgcaauccucuaucacgcaauuccacucacgaaauguauugggugaguaacgcaacuggaaacauugucagcagcguaaacaugauaucuaggauguuaauaaaccguuucacgaugaaacauaaaaaggcgacauaugagccggauguggaccuaggaagugguaccagaaauauugggauugaaagcgagaucccaaaucuagacauuauaggaaagagaauagagaaaaucaaacaagagcaugaaacaucauggcauuaugaucaagaucacccauauaaaacgugggcguaccacggcuccuaugaaaccaagcagacuggaagcgcuagcucgauggucaacggagugguacgacuuuuaacuaagccuugggauguuguaccaaugguaacccagauggcaaugacagauacgacgccauucggucagcagagaguauuuaaagaaaaaguugauacacgcacccaagagccgaaagaaggaacaaagaaacuuaugcguaucacggcggaaugguuauggaaagaacuagggaagaagaaaacaccgagaaugugcacgcgggaggaauuuacaagaaaagucagguccaaugcagcauuaggagcaauauucacugacgaaaacaaauggaagucggcacgagaagcuguagaggauagucgcuuuugggaauuaguggaccgagaacggaauuuacacuuggaaggcaagugcgaaaccugcguguacaauaugaugggaaaacgagaaaagaaacuuggugaauuuggaaaagcgaaaggaaguagagcaaucugguauaugugguuaggggcacgguuucuagaauuugaagcacuggguuuccuaaacgaggaucauugguucucacgggggaauucucuuagcggaguagagggagaaggauuacauagguuaggauacauauugagggacguaagcaagaaagaggguggagcaauguacgcugaugacacagcugggugggacacaagaauuacuuuggaggauuuaaagaaugaggaaaugguaacuaaucauauggaaggggagcauaaaaaauuagcagaagcgauauucaaacuaacauaccaaaauaaaguuguacguguccaaaggccaacuccacgagggacagucauggacauuauaaguagaaaagaccaaagagggucuggucaagucgguacuuauggauuaaacaccuucaccaacauggaagcacaacucauuagacaaauggaaggagaagggaucuucaaaucaauccaacaccuaacaguaacugaagaaaucgccguacaaaacuggcuggcucgaguuggucgcgaaaggcucucgcgcauggccauuuccggcgaugauugcguagucaaaccguuagaugaccgauuugcaucggcacuaaccgcacugaaugauauggggaagguaagaaaagauauacaacaaugggagccuagcagagguuggaaugauuggacucaaguuccauucuguucacaucacuuccaugaacuggugaugaaagauggacguguccuagucgucccgugcagaaaccaagacgaauuaauagguagagcucgaauuucccaaggagcaggguggagccugaaagaaacagcaugucuuggaaaaaguuaugcccaaauguggacauuaauguauuuccacaggagggaccuacgauuagccgcuaaugcaauuuguucugcgguaccuucacauuggguaccgacaucuagaacgacaugguccauccacgcaaagcacgaguggaugacaaccgaagauauguuggcagucuggaaucgaguauggauucaagaaaauccuuggauggaggacaaaacuccuguugagaguugggaagaaguaccauaucuuggaaaacgggaggaucagugguguggcaguuuaaucggacugacaagucgagcuaccugggcuaagaauauucaaacggcaaucaaccaaguacgaucccuaauaggaaacgaagaguauacagacuacaugccaagcaugaagagauuucggagggaggaagaagaagcaggaguucuaugguaa

SEQ ID NO: 22186 - RNA, 9876 nt, Artificial Sequence
  derived and/or modified CDS sequence (opt6) from DENV-2__JX669479__SS-prME
acugcaggaguaauaguaauguuaauacccacugcaauggcauuucaccuaacuacgcgaaauggugaaccucauaugauagucggaaggcaagaaaaagguaaaagucuuuuauuuaaaaccgaagauggcgugaauaugugcaccuuaauggccauagaccuaggcgaacuaugugaagauacuauuacguacaaauguccguuacuacgccaaaacgaaccugaagauaucgauuguuggugcaauaguacgagcacaugggugacauaugguacuugcacuaccacgggcgaacaucgacgagaaaaacggucaguagcauuaguaccacacguagguaugggucuggaaacacguacagaaacguggaugucuagugaaggagcauggaaacauguacaacgaauagaaacauggaucuuaaggcauccaggauuuacaauuauggccgcaauacuugcuuacaccauagggacaacucauuuccagcgagcauuaauuuucauccuauuaacagccguagcgccaagcaugacuaugagauguauaggaauaagcaacagagauuucgucgaagggguauccggagguaguuggguagauauuguucuagaacaugguaguuguguaacuacuauggcgaaaaacaaaccuacauuagacuucgaauugaucaaaacugaagccaaacaacccgcgacacuuaggaaauauuguauagaagcaaaauuaacaaauaccacaacugaaucacgaugcccuacucagggcgaaccgucgcuaaaugaagaacaggauaaacgauucauaugcaaacauucaauggucgaucgaggguggggaaaugggugcggacuauucgguaaaggaggaauaguaacaugcgccauguucacauguaagaaaaacauggaaggcaaaauuguucaaucugaaaaucuagaauauacaauaguuauaacaccgcauucaggugaagaacacgccgucggaaaugauaccgguaaacacggcaaagaaaucaaaauaacuccacaaagcuccacaacugaagcggaauuaacaggauacggaacagugacaauggaaugcucaccaagaacaggucuugauuucaacgaaaugguccuacuacagauggaggauaaagccugguuaguacaucgacagugguuccuagacuuaccacuuccaugguuaccaggcgccgacacacaaggaaguaacuggauacaaaaagaaacacucguaacguucaaaaauccucaugccaagaaacaggacguuguaguacuuggaucucaagagggagcgaugcacacugcccuaacaggcgcaacagaaauucaaaugucuaguggaaaccugcuauuuacaggacaucuuaaaugucgacucagaauggauaaacuccaacuaaaaggaaugucuuauucaauguguacagguaaauucaaaauaguaaaagagauugcggaaacucaacacgguacgauuguaauucgcguucaauacgaaggcgauggcaguccauguaaaauaccuuucgaaauaaccgauuuagagaaacgucauguacuaggcagacuaauuacaguaaauccaauuguuacugaaaaagacucaccagugaacaucgaggcagaaccucccuuuggcgauucuuacauaauaguuggagucgaaccaggacaacuaaaacuaaauugguucaagaaagggucaucuauaggacaaauguucgaaacuacaaugcgaggcgccaagcgaauggcgauucuaggcgacacugccugggacuuugggucgcucggaggaguauuuaccucuauugguaaagcacuucaucaaguguuuggugccaucuacggugccgccuucucagggguaagcuggacuaugaaaaucuugaucgguguaauuauaacauggauaggaaugaauagcagaucaacaucgcucagcguuucuuuaguacuuguuggugugguaaccuuauaucugggcgccaugguucaggcugacagcggaugcauuguaucauggaaaaacaaagaacuaaaaugcggaucaggcauuuucauaacugacaacguacauacauggacggagcaauacaaauuucaaccagaaucuccaucuaaacuagcaucggcgauacaaaaagcgcaugaagaaggaaucugcggaauaagaaguguuacgcgacucgaaaaucugauguggaagcaaauuacaccggaacuaaaccacauauugucggagaacgaaguuaaacuuacaauaaugacuggagacaucaaagggauaaugcaagcagguaagagaucacugagaccccaaccuacagaacuaaaauacagcuggaaaacguggggcaaagccaaaauguuaaguacagaaagccauaaccaaacauuuuugauagauggaccugaaacagcggaauguccgaacacaaacagagcauggaacucucuagaaguagaagacuauggauuuggaguauucacaacaaauaucuggcuaaaacuacgagaaaaacaggacgucuuuugugauucaaaauuaaugucagccgcuauaaaagauaaccgggcgguacaugcagacauggguuauuggaucgaaucugcucucaacgauacauggaaaauggagaaagcaucguucauagagguaaaaucuugucauuggccuaagucacacaccuuauggucaaaugguguauuagaaucagaaaugauuauuccuaaaaauuuugcgggcccagucucccagcauaauuaccgcccaggauaccauacacaaacggcuggaccauggcauuuggguaaauuggaaauggauuuugauuuuugugaagguacgacugugguuguuaccgaagacugcgguaacagggguccaucauuaagaaccacaacugcuucaggaaaacugauaacugaguggugcugucgauccuguacuuuaccaccucuucguuaucgcggugaagaugguuguugguauggcauggaaauaagaccacuaaaggaaaaagaggagaaccuagucaacucucuaguaaccgccggacacggucaaauagacaacuucucauugggaguccuugguauggccuuauuccucgaagagauguuaagaacacgggugggaacaaagcacgcaauacuguuaguggccuugucauucguaacuuuaauuaccgggaauaugucuuucagagauuugggucgugucaugguaaugguuggggcaacaaugacagaugauauuggcauggggguuaccuaccuagcauuauuagcagcguucaaagucaggcccacuuucgcagcugguuuacuauuaaggaaauuaacauccaaagaguuaaugauggcaacaauagguauugcucuacuuagucaaaguaccuuaccagaaaccauuuuagaauuaacggacgcacuagcacuagguaugauggcguugaaaauaguaaggaauauggaaaaguaccaguuagcagugaccauaauggcaaucaguuguguccccaacgcuguuauuuuacaaaaugcuuggaaagucucaugcacaauucuugcggcuguuucuguuuccccguuauugcuuaccucuagucaacaaaaagcugauuggauuccacuggcccuuaccaucaagggauugaauccaacagcgaucuuucuuacuacacuaucucguacaaguaagaaacggagcuggccuuugaacgaagccauaauggcggucggaaugguuucuauccuugccucgucgcuacucaaaaacgauauaccuaugacaggaccacuuguggccggcggacuccuaacaguaugcuauguguuaacagggcggagugcagacuuagaauuggaacgagcggcagacguaaaaugggaagaucaggcagaaauaagugguuccucaccaauuuuaagcauuacaauaagugaggacggcucaaugucaauaaagaacgaggaagaagaacaaacucuaacgauacucauccgaacaggauuauugguaauuucgggaguuuucccaguaucaauaccaauaacggcagcagcaugguacuuaugggaagugaagaaacaaagagcuggaguguuaugggacguuccaagcccacccccaguugaaaaggcagaauuagaggacggggcauacaggauaaagcaaagagguauuuugggguacagucaaauaggcgcugggguauacaaagaagguacauuccacacaauguggcaugucacacgcggagcaguguugaugcaccggggaaaaagaaucgagccaucaugggcagauguuaagaaagacuuaauaucuuauggaggaggauggaagcuagagggugaguggaaagaaggcgaagaaguccaaguauuggcauuagaaccaggaaagaauccccgggcaguucaaacaaagccagguauauucaaaacaaauacggguacuauuggagcgguaagucuugauuuuagcccagguacaucaggcucgccgaucguagaucgaaagggcaaagucguaggcuuauaugggaacggcguuguaacaagauccggcgcauaugucucagcaauugcucaaacagagaaaaguauagaagacaauccagagauagaggacgacaucuucagaaagaaacgacugacaauaauggacuuacacccgggugccggaaaaacaaaacguuacuuacccgcaauaguaagggaagcgauaaaacgaggauugagaacuuuaauucuagcgccaacgcgagucguugcagcggaaauggaagaagcacuaagaggcuuacccauucgauaccagacuccggcaauaagagcugagcauacaggccgugaaauaguugauuugaugugccaugcuacguuuacaaugagauuauuaaguccaguccgaguucccaauuacaauuugauaaucauggaugaagcucacuuuacagauccagcuucuauagcagcuagaggauacauaaguacgcggguagaaaugggagaagcggcagggauauucaugacagcuacgccaccagguagucgcgaccccuucccgcaaaguaaugcacccauaauggaugaagaaagagaaauaccagaaagaucauggaacucgggacaugaaugggugacagauuuuaaagguaagacuguuugguuuguuccuaguauaaaggcagggaacgauauugcugcaugucugaggaaaaauggcaagaaaguaauccaauuaucgagaaaaacauucgauagcgaguauguuaaaacuagagcaaacgacugggauuuugucguaacaaccgacaucuccgaaaugggagcaaacuuuaaggcugaacgagugauugaucccagaagauguaugaaacccgucaucuuaacugauggugaggaacgaguuauucuugccggcccaaugccaguuacgcauucaagcgcagcacaaagacgaggcagaaucggucgaaaccccaaaaacgaaaaugaucaguauauauauaugggagagccauuagaaaacgaugaagacugcgcucauuggaaagaagcgaagauguugcuagauaauauaaauacaccugagggcauaauccccuccauguuugaacccgaacgugaaaaaguugacgccaucgauggagaauaucgacuacguggagaggcuaggaaaacauucgucgauuugaugcgaaggggugaucuuccgguauggcuugcguauaaagucgcagcugaaggaaucaauuaugccgauagaaaaugguguuuugauggaauuaaaaacaaccaaauauuagaagaaaacguagaaguagaaaucuggacaaaagaaggcgagagaaagaaauuaaaaccacgauggcucgaugcuaggaucuacucagauccauuggcgcucaaagaguuuaaggaauuugcugcaggaaggaaaaguuugacguuaaaucucauuacggaaaugggaagauuacccacguucaugacucagaaagcaagaaaugcauuggacaaucuugcaguauugcauaccgcugaaguaggagggcgagcguacacacaugcacuaagugaacuuccugaaacacuugaaacccuacucuuacuaacacuacuagcagcgguaacaggaggaaucuuccuauuuuugaugucgggaaaaggaauuggaaaaaugacuuuaggaauguguugcauaauuaccgcuuccauauuauugugguacgcacaaauccaaccgcauuggauagcagcaaguauaauuuuagaguuuuuccuaauaguacuauuaauucccgaacccgaaaaacaaagaacgccucaagauaaucaacucacauauguaguuauagccauacuaacaguuguagcggcgacuauggcaaacgaaaugggauuucuugagaagacuaagaaagaccuugguuuuggaagcaucacaacacaggaaucagaaucuaacauacuagacauugacuugagaccagcaucggccuggacguuauacgcuguugcaacuacauucguuacucccaugcuaagacauucaauagaaaacuccucuguuaacguaucacuaaccgcaauagcaaaucaagcaacgguucuaaugggauuagguaaggguuggccccuuucuaaaauggauauagguguaccacucuuggcgaucggcuguuacucucaagucaaccccaucacauuaacggcagcuuuguuauuacugguggcccacuacgcaauuauaggacccggauuacaagcgaaagcaacgcgcgaagcucagaaaagggcagcagcagguauuaugaaaaacccuacuguagacggcauaacagugauagauuuggaaccaauuccguacgacccuaaauucgaaaaacaacugggacagguuauguugcuuauuuuaugcguaacacaaguacuaaugaugaggacaacaugggcauuaugcgaagcucuuacccucgccaccggcccaauaucuacacucugggaagguaauccuggcagguuuuggaauaccaccauugcagugucaauggcuaauauauucaggggaagcuauuuggccggugcuggauuguuauucucuauaaugaagaauacuacaaacacaagacgcggaaccggaaacguaggagaaacacuaggugaaaaauggaaaaguagacugaaagcguugggaaaaucagaguuccaaauauacaaaaagagugguauucaggaaguggauaggacacuugccaaagaagguauuaaacguggagaaaccgaccaucaugcggugucgagaggaagcgccaagcugagaugguucguagaaagaaacauggugacaccagaagggaaaguaguugauuugggauguggccguggaggauggucguacuauuguggaggucugaagaacguuagagaaguuaaaggauuaacgaaaggaggcccagggcacgaagaaccuaucccaaugucgacauacggguggaaucuaguuagacuccagagcggugucgacguuuucuucacaccuccagaaaagugugacacacugcuaugugacauuggcgaaagcucaccuaauccuacuaucgaagcagggagaacuuuacgggugcugaaccucgucgagaacugguuaaauaacaauacacaguuuuguauaaaaguauuaaacccauauaugcccucaguaaucgagaaaauggaaacuuuacaaaggaaguacggcggagcgcucguccgaaauccucugucacgaaacucuacacacgagauguauugggucucaaaugcaaccgguaauauagucuccagcgugaacaugauuuccaggauguugauaaacagauuuacaaugaaacacaaaaaggcaacauaugaacccgacguggaucucggcucgggcacucguaacauagggaucgaaucagagauaccaaacuuggacauuauaggaaaacggaucgagaaaauaaaacaagaacaugagacaaguuggcacuaugaccaagaccauccauacaaaaccugggccuaucacggaaguuacgagacgaaacagacaggcagcgcuaguaguauggugaauggaguagugcgucuguuaacaaaaccaugggacguaguaccgaugguuacucagauggcaaugacagauacaacgccauucggccaacagcgaguauucaaggaaaaaguugauacacggacccaagagcccaaagagggaacuaaaaagcucaugaaaauaacagcagaaugguuauggaaggaguuagguaaagagaaaacuccgagaaugugcacaagagaagaguucacacgaaagguacgaucgaaugcugcucucggagcgguuuuuacagaugaaaacaaguggaaauccgccagagaagcgguugaagauggaagauuuugggagcuaguagauagggagagaaaucuacaucuagagggaaagugcgagacuugugucuauaauaugauggguaagcgugagaagaaacugggcgaguuuggcaaagcuaaaggaucaagagcaauuugguauaugugguugggcgcgcgcuuccuagaguucgaagcacuuggauuuuugaacgaagaucauugguuuucucgugggaauagcuugucagguguagaaggagaaggacuucauagacuugguuacauauuacgggaagucggcaagaaagaaggaggagcuauguaugcagaugauacagcagguugggauacaagaauaacacuagaggaccucaaaaaugaagaaaugguaacaaaucauaugaaaggagaacacaagaaauuagcugaagcgauauuuaaauugaccuaucagaacaaagugguucgaguacaacggccuacucccaggggaacugucauggauauuauuagucgaaaagaccagcgaggaaguggacaaguaggaacguacggauuaaauacauucacaaauauggaggcacagcucauaaggcaaauggaaggagaggggaucuucaaaucgauucagcaucuaacggcaacugaagaaauugcuguacagaacuggcuagccagaguaggccgagagaggcugucaagaauggcaauaucaggcgaugacugugugguaaaaccaauagacgauagguuugccagcgcacuuacagcuuuaaaugacauggguaaaguaaggaaagacauccaacagugggaaccuaguagagguuggaaugauuggacucaagucccauucuguagccaccacuuccaugagcuuguaaugaaagacgguagaguacuuguuguaccaugccgcaaucaagacgaauugauuggacgagccagaaucagucaaggugccggguggagccuuaaggaaacugccugucuaggaaaaagcuaugcccaaauguggacccuaauguauuuccaucgucgugacuuacgucuagccgccaacgcaauauguagcgcagugccgucacacugggugccaacaagucgaacuacuuggagcauucaugcaaaacacgaauggaugacaacugaagacaugcucgcgguauggaaucgcgucuggauacaagaaaaucccuggauggaggacaaaaccccuguugaaagcugggaggaaguaccauaucuaggaaaacgcgaagaccaguggugugguucucuaauaggucuaacuucgcgagcaaccugggccaaaaacauacaaaccgcaauaaaccagguuagaucauuaauagggaacgaaggauauacugacuacaugccaaguaugaaacgcuuucguagagaagaagaagaagccggcguucuaugguaa

SEQ ID NO: 22187 - RNA, 9876 nt, Artificial Sequence
  derived and/or modified CDS sequence (opt6) from DENV-2__KF744403__SS-prME
acugcagggaugauaauaauguugaucccaacagugauggcauuccaccugacgacucguaauggagaaccucauaugauugucucuagacaggagaaaggaaaaagucuuuuauucaaaacagaagauggagucaacauguguacauuaauggcuauggacuugggagaacuuugugaagauacgauaacauauaaaugcccucuucugagacaaaaugaaccagaagauauagauuguugguguaauucaacaucaacgugggugacauacggcacauguacaacaacaggagaacacagaagagaaaaacggucgguugcacuugucccucacgucggaaugggucuagaaaccaggacagaaacauggaugagcucagaaggcgcauggaaacaugcacaacgcaucgagacguggauccucagacauccaggguuuacuuuaauggcugcuauauuagcauacacaaucggaacgacgaacuuucaaagagcacuuauuuuuaucuuauuaacggccgucgccccaagcaugaccaugcgauguauagguaucuccaaucgcgacuucguagaaggggucaguggcgggaguuggguugauauuguacuagagcacggauccugugucacuacaauggccaaaaauaaaccaacacuagauuucgaacugauaaaaacagaagcaaaacagccugccacacucagaaaauauuguauagaagcuaaacuaacgaauacaacaaccgaaucuagguguccuacucaaggugaaccaagccuaaaugaagaacaagacaaacgauucguuugcaaacauucuauggucgauagagguugggggaaugguugcggacuuuucgguaaagguggaaucguaaccugugcuauguucacauguaagaaaaauauggaggguaaaaucguacaaccggaaaaccucgaauauacaauaguuaucacgccgcauagcggagaagaacaugccguaggcaacgauaccggaaaacaugguaaagagauuaaaauaacgccccaauccuccauaacagaagccgaauuaacggguuauggaacaguuacaauggagugcuccccuagaacuggauuggauuuuaacgagaugguauuauugcagauggaaaacaaagcauggcuggugcacaggcaaugguuucucgaucucccccuaccuuggcuaccgggagcagacacucaagguuccaauuggauucaaaaagaaacgcuagugacguuuaaaaacccucacgccaagaaacaggauguuguaguccuuggaucacaagagggcgcaaugcauacugcguuaacgggcgcaaccgagauacagaugagcucagggaaccucuuauuuacagggcacuuaaaauguagguuacgaauggauaaacuacaguuaaaaggaaugucuuauucgaugugcacuggaaaauucaaaguaguaaaagaaauugcugaaacacagcaugguacaauugucguaagaguccaguacgaaggggauggcucaccauguaaaauaccuuuugaaauaauggauuuggagaaaagacacguguuaggacgcuuaauaacagugaacccgauagucacagaaaaagacaguccaguaaacauugaagcugaaccaccuuucggugauaguuacguaauuauugguguagaaccaggucaauugaaacuaaacugguuuaagaaagguaguucuauagggcaaauguuugagacgacuaugagaggcgcuaaaagaauggcuauacuaggagacacagcgugggauuucggcucacuaggcggcguuuuuacaaguauugguaaagcauuacaucagguguucggagcaauauacggcgcugccuuuucagggguaaguuggacgaugaaaauacuuauagggguuauuauaacauggaucggcaugaacucaagauccacaucauuaucaguaucauuggucuuaguuggaguggucacgcuuuauuuaggugucgucguacaagccgacucaggguguguaguuucuuggcgaaauaaagaacuuaaauguggaucugggauuuuuauaacagauaauguucacacguggacggagcaauauaaauuccagccagaauccccuucaaaauuggcuucagcgauacaaaaagcgcaccaagaaggaaucugcggaauacgcuccgugacaagacucgaaaacuugauguggaaacaaauuacaccugaauuaaaucauauucucucugaaaaugagguaaaacuaacuauuaugacgggggauaucaaaggaauuaugcaugccggaaaacguucgcuccggccacaaccaacagaacuacgauauucuuggaaaacuuggggcaaagccaaaauacucaguacugaaagucauaaccaaacauuucucauugauggaccagaaacggcugagugcccaaacacaaauagagcauggaacucacuagagguagaggauuaugguuuuggaguauucaccacaaauaucuggcuuagguuaagagaaaaacaagaugcauucugcgacuccaaacucaugagugcagccauaaaagauaauagagcuguacacgcggauauggguuacuggauagaaucggcccuaaaugauacuuggaagauagagaaggcaaguuucauagaaguaaagucaugccacuggccaaaaucacauacacuguggaguaauggaguucuagaaucugaaaugauaauaccaaagaauuuugcaggaccaguaagucaacauaacuaucgccccggauaccauacgcaaaccgcggggccuuggcacuuagggaaacuagagauggauuuugauuuuuguaaagggacgacuguaguugucacugaagauuguggaaauagaggacccucauuaagaacuacuacggccagugguaaguugauaacagaaugguguugucggucauguacacucccaccauuacguuauagaggugaagaugggugcugguacgguauggagauaaggccccucaaggagaaagaagaaaaucucguuuccagcuuggucacagcuggucacgggcaaaucgauaauuucaguuuaggugucuuagggauggcuuuguuucuagaagaaaugcucagaacacgagucggaacaaaacaugcgauccuauuagucgccguuaguuucgugacuuugauuacggggaacaugucuuuuagagaccuaggcagaguuauggugaugguuggugccacaaugacagaugauauaggcaugggcguuacuuauuuagcgcuuuuagccgcguuuaagguacgaccaacauuugcugcaggauuauugcuacggaaauuaacaucaaaagaauuaaugaugacaacuauaggaauaguucuucuaagucaaagcacuauaccagagacuaucuuagaauuaaccgacgcucuugcauugggaaugaugguauuaaaaauagugaggaagauggaacgcuaccaguuagcaguuacuauaauggcaauuuugugugugccgaacgcagugauucugcagaacgcauggaaagugucgugcaccauccucgcaguugugucaguaucaccuuuguuguuaaccucaucccagcaaaaggcagacuggauaccccuagcucucacuauaaaaggacugaauccaaccgcaauauuccuuacaacuuugucaagaacaagcaagaaacguagcuggccauuaaacgaagcaauaauggcaguugguaugguaucaauacuugcuucaucacuauuaaagaaugacauuccuaugaccgguccccuaguggcugguggauuacugacagugugcuacguucugacaggucgcucugcagauuuagaacuagaaaaagcagcggacgugaggugggaagaucaagcagaaauuucggggucgucuccuauacugucuaucauaauaagugaagacgguucuaugaguaucaaaaaugaagaagaagaacaaacuuugaccauacuaauuagaacaggguuauuaguaauauccggucuauucccaguuaguauaccaauuaccgccgcagcaugguauuuaugggaaguuaagaagcagcgagcaggcgugcuuugggauguccccucuccaccgccaguaggcaaagcggaacuagaagauggagcguacaggauaaaacaaaagggaaucuugggauacucucaaauuggugcaggaguguacaaggagggcaccuuccauaccauguggcacguaacucgaggggcuguacuuaugcauaaagguaagagaaucgaaccauccugggcagacguaaagaaagauuugaucucauaugggggagguuggaaacuagaaggcgaauggaaagaaggagaagagguacaaguucucgcauuagaaccaggaaagaauccaagagcuguacaaacaaaaccagguuuauucaaaacaaacgcaggcacuaucggagcgguuuccuuggauuuuucaccagguacuucuggcucaccaauaauagauaagaaaggaaaagucguaggucuuuauggaaaugguguaguaacaagaaaugguagcuauguaucugcuauagcccaaacugagaaguccauugaagauaauccugaaauugaggacgauauuuuuagaaagaaacgacuuacuauaauggauuugcauccuggggcugguaaaacgaaaagguaccuaccagcaaucgugagagaagcaauuaaaagaggauugcguacacuaauucuggcaccuacuagagugguggcugccgaaauggaggaagcucuaagaggucuuccaauaagguaccaaaccccagcgauaagggcagaacacacaggcagagagaucguagaucuaaugugccacgcgaccuuuacgaugcgccuacuuagcccuaucagaguaccuaauuacaacuuaauaauaauggaugaagcgcauuuuacugauccugcaucuauugcggcacgagguuacaucucaaccagaguagagaugggagaagcugcagggauauuuaugacugccacgccacccgguagucgagauccuuuuccacagaguaaugcuccgauaauggaugaggaacgcgaaauuccagaaagaucguggaacucuggacaugaauggguaacggacuuuaaaggaaaaacaguaugguucguaccuaguauuaaagcuggcaaugauauugcagcaugccuaaggaaaaacgggaagaaaguaauucaauugagucggaaaacuuucgauagugaauacguuaaaacaagaacuaacgauugggauuucguagugacaacggauauuagugaaaugggugcaaacuucaaagcugaaagagucauugacccuagaagaugcaugaagcccgugauucugacugacggugaggaaagggugauacucgccggaccaaugcccguaacccauagcucagcagcucaacgacggggccgaauuggaaggaaccccaaaaacgaaaacgaucaguacauauauaugggcgaaccccucgaaaaugaugaggacugugcacauuggaaggaagcaaagaugcucuuagauaauauaaacacaccagaaggaauuauacccucuauguuugaaccugaaagggaaaaggucgacgcaauagauggagaguauagauugagaggugaagcgcgaaagacuuucguggauuuaaugcgacgaggcgaucuaccugucugguuagcauauaaaguagccgcagaagggauaaacuacgcggauagacguugguguuuugauggaauaagaaauaaucagauacuagaagagaacguagaaguagagauauggacaaaagaaggggaaaggaagaaguugaaaccuagauggcuugacgcccguauauauagcgauccgcucgcucuuaaggaauuuaaagaguuugcagcggguagaaaaagucugacucuaaacuugauuacggaaaugggaagacuaccgacauuuaugacucagaaagcaagagacgccuuggauaacuuagcaguguugcauacugccgaagccggcggccgagcguacaaccacgcccuuagcgaacuacccgagacacucgaaauuuuauuacuauuaaccuuacuugcgaccguaacaggcggaaucuucuuguucuuaaugucuggaagagguauaggaaaaaugacacuaggaauguguugcauuauaacugcaagcauucuacuaugguaugcacagauucagccacacuggaucgcugcaucuaucauuuuggaguuuuuccuaauuguacuuuugauacccgaaccagaaaaacagagaacaccccaagacaaucaacuaacuuauguagucaucgcgauucucacuguaguagcagcuacuauggccaaugaaaugggauuucucgagaaaaccaagaaagaucuaggacuagggucgauaacuacucaacaaccagaaucaaacauccucgauaucgaccugcggcccgcauccgccuggacauuguacgcaguugccacaacuuucauaacaccuauguuacgccacagcauugagaacagcaguguaaaugugagucuaacugcaauagcuaaucaggcaacgguuuugaugggccuuggaaaaggauggccacuaucuaaaauggauaucggggucccauuguuagcaauaggguguuauagucaaguaaacccaauaacacugacagcugcacuauuacuuuuaguggcacauuacgcgauaauaggaccuggacuucaagccaaagcuacgagagaggcacaaaaacgcgccgccgcaggaauaaugaagaacccuacaguugauggaaucacggucauagaucuugauccaauaccuuaugauccuaaguucgaaaagcaacuaggucaagucaugcuauuaguccuauguguuacacaaguguuaaugaugcguacaacuugggcacuaugugaagcacuuacacuggcuacaggucccaucuccacacucugggaagggaaccccgguagauucuggaauaccacuauagcaguaucaauggcuaauauauuuagaggaucuuaucuagcuggugccggacugcuauuuuccauaaugaaaaacacaacuaacacccgcagagguaccggaaauaucggugaaacguuaggugagaaauggaaaucacgcuuaaaugcucuggggaaaucggaauuucagauauauaagaaaucuggaauacaggagguugauagaacauuagcuaaagaaggcauaaaaagaggugaaacugaucaccacgcugugaguagggguagugcaaaacuccguugguuuguagaacgaaacaugauuaccccagaaggcaaagugguagauuugggaugcggcagagguggauggaguuacuauugcggaggguuaaagaacgugagagaaguuaaaggccuaaccaagggcgguccgggccaugaagaaccgauuccuaugagcacauauggcuggaaucucgucaggcuacaaagugguguugauguauucuuuacuccaccagaaaaaugugauacucuccugugugauauaggugaaucuucaccaaauccuacgguugaggcagguagaacucugagaguucuuaacuuaguagaaaauuggcucaauaauaauacgcaguuuuguauaaaaguauugaauccuuacaugccaagcguaauugagaaaauggaagccuugcagaggaaauauggaggugcguuaguaaggaauccuuugucuagaaauaguacgcaugagauguauuggguaucuaaugccucaggaaacaucguuucuucuguuaauaugauaucacgaauguugaucaauagguuuacgaugaaacauaagaaagcaacguaugaaccugaugucgaccuuggaucugguacgagaaauauagggaucgaaagcgaagucccaaauuuagacaucauagguaagaggauagagaaaauaaagcaggaacaugaaaccaguuggcacuaugaucaagaccauccauacaaaacaugggcauaucauggaucauacgaaacgaaacaaaccggaucagcgucuucgaugguaaaugggguggucagguuacuaaccaaaccgugggacguaauaccuaugguuacucagauggcaaugacagauacgacaccauucggacaacaaagagucuucaaagaaaagguugauacuagaacucaagagccuaaagaagggaccaagaaacuaaugaaaauaacagcagaaugguuauggaaggaacuugguaagaagaaaacuccacgcauguguacaagagaagaauuuacaagaaaagugagaucaaaugcagccuugggcgcaauauuuacagacgaaaacaaguggaaaucagcgagagaagcaguagaagacaguagauucugggaacuggucgauaaggagaggaauuuacauuuagaagguaaaugugaaacaugcguuuacaauaugauggggaagagagagaagaaauugggagaauuugggaaagccaaagggagcagagcaauaugguauaugugguuaggggcgagauuuuuggaauuugaagcguuaggguuucucaacgaagaccauugguucagccgagaaaauagcuuaucuggugucgaaggcgaaggacuccauaagcucggauacaucuugcgagaugucagcaagaaagaaggaggggcaauguaugcagaugauacagcagguugggauaccaggauaacacuugaagacuuaaagaaugaggaaauggucacuaaccauauggaaggcgaacacaagaaauuagcagaagccauauuuaaacuaaccuaccagaacaagguagugcgaguucagagaccgacacccagaggaaccguaauggauaucauaucacgucgcgaucaaagaggaucaggucagguugggacguacggucuuaauacuuuuacgaauauggaagcucaauugauacggcaaauggagggugaggggguuuuuaaauccauacagcaucuaaccgcaacagaagaaauagccguucaaaauuggcucgcaagggucggacgcgagagguuaucccgaauggcaauuucuggagacgacugcgucgugaaaccucuugaugaccguuuugcuucagcacuaaccgcuuuaaaugacaugggaaaaguucgaaaagacauacaacagugggaaccaucgaaaggauggaaugauuggacucaaguaccuuuuugcucgcaucacuuccaugagcuaauaaugaaggacggucgagucuugguuguaccuugcaggaaucaagacgaauuaauuggacgggcacgaauuucccagggcgcaggcuggagcuuaagagaaaccgcaugccuaggcaaaucauaugcucaaauguggucacucauguacuuucaucgaagagaccucagguuagccgcgaaugcgaucugcagcgcugucccuucacacugggugccuacaucaagaacaacauggucuauccaugcaaaacacgaguggaugaccacugaagacauguuaaccguauggaacaggguuuggauccaagaaaauccauggauggaagacaaaacaccaguugagucgugggaagaaauaccauauuugggcaaaagggaagaucaauggugugguagucuaaucggcuuaacaucuagagcuacgugggccaaaaacauacagaccgcaauaaaucaaguccgaucucucaucgguaacgaagaauacacugacuauaugccauccaugaaacguuuuagacgggaagaagaggaagcuggaguacuaugguaa

SEQ ID NO: 22188 - RNA, 9876 nt, Artificial Sequence
  derived and/or modified CDS sequence (opt6) from DENV-2__KF744406__SS-prME
acagcggguaugauuauaauguuaauuccgacagugauggcuuuccaucugaccacuagaaacggugaaccgcacaugauagugucucgucaagaaaaaggaaaauccuuacuauuuaaaacugaagaugguguaaacauguguacucuaauggcaauggauuuaggagaacuuugugaggacacuauaacguauaaaugcccacuuuuacgccaaaacgaaccugaagauauagauuguuggugcaacucaaccaguacauggguaacauauggaacaugcacuacuacaggugaacauagaagagagaaaagaucuguggcauuaguuccgcacguaggaaugggcuuagaaacucgaacugaaacauggaugucaucagaaggagcauggaaacaugcucaaagaauagaaacauggauucuucgacacccaggauucacacuuauggcagcaauauuggcauauaccaucggaaccacaaauuuccaacgagccuuaauauuuauccuucuaacugcggucgcaccuucaaugacuaugagauguauuggaauaagcaaucgagauuuuguagaaggcguuuccggagggaguuggguagacauaguucuagagcaugguucaugcguaacaacaauggccaaaaauaaaccaacccuugauuucgaauugauaaaaacugaggcuaaacagccggcuacacuucgaaaauacuguauagaggcuaaauugacaaacacuacaacagaaucccgcugcccuacucagggggagccuaguuuaaaugaggaacaagacaaaagauucguaugcaaacauucaaugguugauaggggcugggggaacggaugcgguuuauuugguaaaggcgggauaguuaccugugccauguuuacuuguaagaaaaacauggaaggaaaaauaguucaaccagaaaacuuagaguacacgauuguaauaacaccgcauaguggagaagaacacgcagucggaaacgauaccggcaaacacggaaaagagauaaaaauaacaccccagucgucuauaacagaagcagaacucacagguuacggcacagugacuauggaaugcaguccucggacaggccuugacuuuaacgagaugguuuuauuacaaauggaaaauaaggccuggcucguucauagacaaugguucuuagaccuaccauugccaugguugccaggagcggacacacaagggucuaauuggauucaaaaagaaacguuaguaacauucaagaacccgcaugccaagaaacaagaugucgugguguugggaucacaggaaggagcuaugcauacggcauugaccggagccaccgaaauacagaugagcucgggaaaucuacucuucacggggcacuuaaaaugucgucucagaauggauaaauuacaauuaaaaggcauguccuacaguauguguaccgguaaguuuaaagucgugaaggaaauagccgaaacccaacacggcacuauagucguccgugugcaauaugaaggugacgguucuccaugcaagaucccauuugaaauaauggauuuagagaaacgacauguauugggacgauuaauuacugugaauccaaucguuacugaaaaagauucuccugucaacauugaagcagaaccucccuuuggggauucauauguaauaauaggaguugagccuggacaauuaaaacugaauugguuuaagaaaggaagcaguauagggcagauguucgaaaccacaaugcggggagcaaaacgaauggccauauuaggugauacugcaugggacuuuggaagccuuggagguguauucacaucaauuggaaaggccuuacaucaagucuucggugcaauauauggcgcagcauucucaggaguuucauggacuaugaaaauauuaauugguguuauuauaaccuggauagggaugaacaguagaaguacaucucucaguguuucguuaguacucgucgggguagugacacuuuaucuuggcguuguaguacaggcugauuccgggugcgugguuucguggagaaauaaagaauuaaagugugggagcgggauuuuuauaacagauaauguacauacuuggacggaacaauacaaguuucaaccagaaucucccaguaaacuagcaucagcuauacaaaaagcacaccaagaaggaauuugcggaaucaggagcguuacacgguuagaaaaccuaauguggaaacaaauaacgcccgaauuaaaccauauacuaucagagaacgaaguaaaguuaaccauaaugacaggggacaucaaagguauaaugcacgcugguaaaaggucauuaaggccacaaccaacugagcuuagguauucauggaaaaccuggggaaaggccaagauccuuaguacagaaagccacaaccaaacauuucuaaucgacggcccagaaacagccgaaugccccaacacaaauagagccuggaacucacuagaaguugaggacuauggauucggcguguuuacaacaaauaucuggcugagauuacgugagaaacaagacgcauucugcgacaguaaauugaugagugcagcaauuaaagauaaccgagcugugcaugcggauaugggguacuggaucgaaucugcacugaacgauacguggaagauugaaaaagcaucauuuaucgagguaaaaucuugccacuggccuaaaucgcacacacuauggucuaacggcguuuuggaaagugaaaugaucauacccaaaaauuucgcgggaccaguaucccaacauaauuaccguccaggauaucauacucaaacggccgggccauggcaccuuggaaaacuugaaauggacuuugacuuuugcaaagggacaacaguggugguaacagaggacugcgguaauagaggaccaucacucagaaccacgacugcaucggggaaacugauuacagaauggugcugcagaagcugcaccuugccuccauuacgauauagaggugaagacggcugcugguauggaauggaaauaagacccuuaaaggaaaaggaggaaaaucuuguaucuagucuggucacagcaggucaugggcagauugauaacuuuucauugggugucuuagggauggcacuauuuuuagaagaaaugcuaagaacccgagugggaacaaaacacgcaauacuauuaguugcuguaucguuuguaacgcuaauuacagggaauaugucguucagagacuuaggaagagucauggugaugguuggugcgaccaugacugaugauauaggaauggguguaacauauuuagcguuacuggcugcuuucaaaguccgcccaaccuuugccgcgggucuacucuuaagaaaguugacuucaaaagaauugaugaugaccaccauuggaaucgucuugcuuucacagucuacaauacccgaaacuauauuagaacugaccgaugcgcucgcacuuggaaugaugguguuaaaaauaguucgaaagauggagagauaucaacucgcuguaaccauaauggccauucucugcguaccaaacgccguaaucuuacaaaaugcuuggaagguaucgugcacgauacuugcuguugucucuguaucaccucuucuauuaacaagcucacagcaaaaggcggacuggauaccacuugcgcuuacaauaaaaggccuuaacccgacggccauauuuuuaacuacgcucuccaggacauccaaaaagcgaucuuggccauuaaacgaagcaauuauggcuguaggcaugguuuccauacuugccaguucccuucuuaaaaaugauauaccuaugacaggcccccucgucgcaggaggacuauugacaguauguuauguauuaacggggcguuccgcagauuuagaguuagaaaaggccgcugauguacguugggaggaucaagcugagaucagcggaucaaguccaauauuaucaauaaucauauccgaggauggcucuaugucuaucaaaaacgaagaagaagaacaaacgcuuaccauacugauccgaacuggucuacuuguaauaucagggcuauuucccgugucaauccccauaacagcagcugcuugguaccugugggaagucaagaagcaacgagcuggaguucugugggacgucccaucgccgccuccgguagggaaagcagagcuagaagacggagcuuaucguauuaaacaaaaaggcauauuagguuauucccaaauaggagcugguguauacaaagaagguacauuccauacuauguggcaugugacuaggggagccguucuuaugcauaaggguaaacguauugagccuucaugggcagacguaaagaaagauuugauaucauaugggggaggguggaaacuagagggagaguggaaagagggagaagaaguccagguauuagccuuagaaccagguaagaauccacgcgcaguucagacgaagccaggauuauuuaagacaaacgcugguacgauaggugcaguaaguuuagacuucucgccagguacaagcggaucacccauaauagacaaaaagggcaagguuguaggcuuauaugguaacgggguaguuacgcgaaacggaucguauguuucagcgaucgcacaaacugaaaagagcauagaggauaauccugaaauagaggaugacauuuuuagaaagaaacgauugaccauaauggacuuacaucccggcgcggggaaaacuaaaagauaccucccggccauaguacgagaagcaauaaaaagaggccuccgaacucuaauucuagcgccaacaagggucgucgccgccgaaauggaagaagcccuacgugggcuaccaaucagauaucaaacacccgcaauuagagcagagcacacaggaagagaaauagucgauuuaaugugucaugccaccuucacaaugcgacuacucagcccgaucagaguaccgaauuacaauuuaauaauuauggacgaagcacacuuuacugauccugcaaguauagcugcgcggggauauauaaguacacguguagagaugggagaggcagcuggaauauucaugacugcaacaccacccgguagucgagauccuuuuccgcaaucaaaugcuccaauaauggacgaggaacgagagauaccugagcgaucauggaacucuggacacgaaugggugacagacuuuaaaggaaaaaccgugugguucguuccaaguaucaaagcuggcaacgauauagcagcaugucuuaggaaaaaugggaagaaaguaauacaacugucucguaaaacuuuugacagugaguaugucaaaacaagaacaaaugacugggacuuuguugugacgacggauauuucugagaugggagcuaauuuuaaagcggagagagugauagauccaagaagaugcaugaaaccaguuauccuaacggauggcgaagaaagggucauauuagcaggaccaaugccagucacgcauaguagugcugcacaaaggcgaggucguauuggaagaaaucccaaaaaugagaacgaucaauacauauacaugggagagccauuagaaaaugaugaagauugugcgcacuggaaagaagcaaaaaugcugcuugauaauaucaacacgccagaaggcaucaucccaaguauguuugaaccugagagagaaaaaguagaugcaaucgauggugaauacagauugaggggcgaggcaagaaagacauuugucgauuuaaugaggagaggugaucuaccggucugguuggccuauaaaguggcugccgaagguauaaauuaugccgacagaagauggugcuucgaugguauuaggaauaaucaaauacuugaggagaaugucgaaguagaaauauggaccaaagaaggugaaaggaagaaacucaaaccacgauggcuagaugcaagaauauauagcgauccucuugcccuuaaagaguuuaaagaauuugcggcggguagaaaaucauuaaccuuaaacuuaauaacagaaauggguaggcuuccuacauucaugacacaaaaggccagagacgccuuggauaaccuagccgugcuacauacugcagaagccggugguagagcauacaaucaugcacuaucugaacuuccugaaacacuagagauaagccugcucuuaacucuacuagcaacgguuacugggggaauauuccuguuccugaugagcggaagaggcauugguaaaaugacuuuaggcauguguuguauaauaacugcaucaauacuuuugugguaugcacaaauacaaccacacuggaucgcggcgucgaucauauuggaauuuuuccucauaguauuacuuaucccagagccugaaaaacaaagaaccccucaagacaaccagcuaaccuauguaguuauagcgaucuuaacaguaguagcagccacgauggcuaaugaaaugggauuuuuagagaaaacuaagaaagaucucggacugggaaguauaaccacucaacagccagaaagcaacauccuagauauugauuugcguccagccucagcauggacccucuaugccguugccaccacguucauaacgccaaugcugaggcauaguauugaaaacuccagcguaaaugugucccuaacugcgauugcaaaucaagccacuguucuaauggggcucgggaaaggguggccacuaucaaaaauggacauaggaguaccacugcuagcaaucggaugcuauucacaaguuaacccaauaacuuugacagcagcauuauuacuauuaguugcccauuaugcgauaauaggacccggacuacaagccaaagcaacaagagaggcucaaaaacgcgcagcugcaggaauuaugaagaauccaacuguagauggcauaaccgucaucgacuuggaccccauaccuuaugauccaaaauuugaaaaacaacuaggucagguaaugcucuuagugcuaugcgugacacaaguccuaaugaugcgcacgacgugggcacugugugaagcauugacucuugcuacaggaccaaucuccacauuaugggagggaaauccagggagauucuggaauacaacgauagcuguaucaauggcaaauauauucaggggaucuuaccucgcaggcgccgggcuacuauuuaguauaaugaaaaauacuaccaauacucggagaggcacugguaauauaggagaaaccuuaggugagaaauggaaaucgcguuugaaugcccuaggaaaaagcgaguuccaaauauauaagaaaagcgguauacaagaaguugacaggacgcuggcuaaagaagguauaaaaagaggagaaacugaucaucaugcaguuuccaggggcucugcuaaacucagaugguuuguugaacguaacaugauaacaccggaagguaaaguagucgaucuuggcugcgggcguggagguuggucauauuacugugguggacucaaaaauguaagagaagugaaagggcuaacuaaaggagggcccggucaugaagaaccuauccccaugaguacguacggcuggaaccuggucagauuacaaucuggcguagauguauuuuucacuccaccagagaaaugugacacauuacuaugugauauaggagaaucaucaccgaauccuacaguugaagcaggacgaacuuuaaggguauuaaaucuugucgaaaauuggcucaacaacaacacucaguucuguauaaaaguacucaaccccuauaugccaucgguuauagaaaagauggaagcgcuacaacgaaaguaugggggagccuuaguacggaacccuuuaagccggaauaguacacaugagauguauuggguaucuaaugccucgggcaauauaguuuccagcguaaauaugauaucucgaauguuaauuaaucgauuuacaaugaaacauaagaaagcuacguacgaaccugauguggacuuaggaucaggaacgagaaauauuggcauugaaucagaaguaccgaaccuugacauaauaggaaaaagaauagagaaaauaaaacaagaacaugaaacgucuuggcauuaugaucaagaucauccuuauaagaccugggcguaccacggaucauaugaaacuaagcaaacaggcucagcaucgucaaugguuaauggugugguacgacuacuaacgaaaccuugggaugugauaccuaugguaacucaaauggccaugacugacacaacaccauuuggacaacaaagagucuuuaaagaaaaaguagauacuagaacacaagaaccaaaagaaggcaccaagaaauuaaugaaaauaaccgcagaauggcuauggaaagaacuaggaaagaagaaaacgccucggauguguacgcgggaagaauuuaccagaaaaguacggagcaacgccgcauuaggugcgauuuucacggacgaaaacaaguggaagagugccagggaagcuguagaggacagucguuucugggaacuuguugauaaagaaagaaaccugcaccuagaggggaaaugcgaaacuugugucuauaauaugaugggaaaacgugagaagaaauuaggagaauuugguaaagccaaaggaagcagggcuauuugguauaugugguugggggcucgauuuuuagaguucgaagcccuaggauuuuugaacgaagaccacugguuuucuagagaaaauucuuuaagcggaguugaaggagaagggcuccacaaacuaggguauauacuaagagacguuucuaaaaaggaagguggugcaauguacgccgacgauacagcuggaugggauacuagaaucacacuagaagaucuuaaaaaugaagagaugguaacaaaucacauggaaggagaacacaagaagcuggccgaggcaauauucaaauuaacuuaccaaaauaagguagugaggguucagcggccaacacccagggguacaguaauggacaucaucucccgcagggaucagcguggaucuggucaagugggaacuuauggauugaacacauucacaaauauggaagcgcaguuaauaagacaaauggaaggugaagguguguucaaauccauacaacacuuaacugcaacagaagagauagccguacaaaauuggcuugcaagaguaggcagggagcgucuaagccgaauggcaaucucuggagaugauugcguaguaaaaccauuagaugaucgguuugccucggcgcuuacagcccugaacgauaugggaaagguaagaaaagacauacagcaaugggaacccuccaagggauggaaugauuggacacaaguaccguuuugcucgcaccauuuucaugaacuaauaaugaaggacgguagaguucuuguaguuccuugucggaaucaagacgagcuuauuggaagggcccggauaagccaaggggcaggauggagucuuagggaaacagcaugcuugggcaagucauacgcacagauguggucgcugauguacuuucacagacgggacuuacguuuagccgccaaugccauauguagugcaguacccagucauuggguuccaaccucgcgaacuaccuggagcauucaugcaaaacacgaguggaugacgaccgaggauauguuaacaguauggaauagaguuuggauucaggaaaacccauggauggaagauaagacgccugucgagaguugggaagaaauaccauaucuagguaaaagagaggaccaguggugcgggucacuaaucgggcuaacaucaagagcaacgugggccaaaaacauucaaacagcuauaaaucaagugaggaguuugauaggaaacgaagaauacacggauuacaugccgucuaugaaaagauuccguagagaggaagaagaagcuggaguacugugguga

SEQ ID NO: 22189 - RNA, 9876 nt, Artificial Sequence
  derived and/or modified CDS sequence (opt6) from DENV-2__KF744404__SS-prME
acggcugggaugauuauaauguuaauaccaacagugauggcauuccaucuaacaacaaggaauggagaaccgcacaugauaguaaguagacaagaaaaaggaaaauccuugcuauuuaaaacagaagaugggguuaauaugugcacgcuaauggcuauggaccuaggcgaacucugugaagacaccauaaccuacaaauguccauuauuacgacaaaaugaaccagaagacauagacugcuggugcaauaguacaucuacguggguaaccuaugggacguguacaaccaccggggaacaccgacgugaaaaacguucaguugcauuagugccgcauguuggcaugggacucgaaacgagaacugaaacauggauguccucugaaggggcauggaaacacgcucaaaggauugaaacauggauacuuaggcacccgggauucacguuaauggcugcaauacuggcuuauacaauaggcaccaccaacuuccaacgugcuuuaauuuucauacucuugacagcgguagcaccaaguaugacaaugagguguauaggaauauccaauagggauuuuguugaagguguaucaggaggaagcugggucgacauaguacuggaacauggguccuguguaacaacaauggccaaaaauaaaccgacacucgauuucgaacuuauaaaaacagaagcaaaacaaccagcaaccuugagaaaauauuguauagaagccaaacugacuaauacaacgacggaaucuaggugcccuacacagggagaacccuccuuaaaugaagaacaagacaaaagauucguuugcaaacauuccauggucgaccggggauggggcaacggauguggguuguuuggcaaagguggaauaguaacgugugcaauguucacauguaagaaaaauauggaaggcaaaauagugcagccagaaaaccucgaauauacuauagucauuacaccccauucuggcgaagaacacgccguuggcaaugauacuggaaaacauggaaaagaaauaaaaaucaccccacaaagcucuaucaccgaagcagaauuaacggguuauggaacggucacaauggaauguaguccuagaacaggcuuggauuuuaaugagaugguauuacugcaaauggaaaauaaagcauggcuagugcacagacaaugguuucuggaucucccucucccguggcuaccgggcgcagauacucaaggaucaaacuggauacaaaaagaaacucuagugacuuucaaaaauccgcaugcuaagaaacaagacgucguaguauuaggaucucaagaaggcgcuaugcauacugcuuugacgggcgcaaccgaaauucagaugucaaguggaaacuuacuuuucacaggacaucuaaaauguagguuacgcauggauaaacuacaacuaaagggcaugucauacucaaugugcaccggaaaguucaaagugguaaaagaaauugcagaaacucaacauggcacaauuguggugagaguacaauacgagggagauggcucgccauguaaaaucccauucgaaauaauggaccucgagaaaagacacguauuaggucgcuuaauuacugugaacccgauagucacggaaaaagacaguccagucaauauagaagcagaaccgcccuuuggugauucuuacguuauaauuggagucgagccgggucagcuuaaauugaauugguucaagaaaggcucaaguauagggcagauguuugaaacuaccaugcgaggagcaaaacgcauggccauucuaggcgacacagcaugggacuucgggucgcucggcgguguguuuacaaguaucggaaaagcucuccaucaaguguucggagcaauauauggcgcagcauucucaggugugucauggacaaugaaaauucucauuggagucauaauaacguggauaggaaugaacucuagauccacaucacuuagugugucguuagucuuagucggaguugucaccuuauaccuaggaguaguuguacaggccgauucgggaugcgucgucucuuggagaaauaaagagcuaaaauguggaucuggcauauuuaucacugauaacguucacaccuggaccgaacaauauaaauuucaaccggaauccccaucgaaguuagcaucagcaauccaaaaagcacaucaagaaggaauuugcggaauacgaagcguaaccagacucgaaaacuugauguggaagcaaauaaccccugaauugaaccacaucuuaucagagaacgaaguaaaauugacaauaaugacaggugacauaaaagguauuaugcacgcagggaagcggucuuugcgaccacaaccaaccgaacucagguauaguuggaaaacuugggguaaggccaagauauuaaguacagaaagucacaaccaaacauuucugauagacgggccagagacagcagaauguccgaauacaaaccgggcuuggaacagccuggaaguggaggauuauggguuugggguauucacuacaaacaucuggcuucgguugcgugagaagcaagaugcauucugcgacucgaaguuaaugagcgcagcaauaaaagacaauagggccguacaugccgauaugggcuauuggauugaaucggcucucaaugacaccuggaaaauagaaaaagcaucauuuauugaaguaaaaucaugucacuggccgaaaucacauacacuauggaguaauggaguucuugaaagugaaaugaucauccccaaaaauuuugcaggccccguaagucagcauaacuaucguccuggguaucauacgcaaacagccgguccauggcaucugggaaaauuagaaauggauuuugacuuuuguaaaggaacuacaguaguaguuacugaggacugcggaaaucgaggacccucauuaaggaccacgacggcaucgggcaaguuaauaacagaauggugcugccgcagcuguacguuacccccuuuacgguaucgcggagaagacggauguugguacgguauggaaauaagaccuuuaaaagaaaaagaagaaaacuuggucaguucacuuguuacggcgggccacggacaaauugacaacuucaguuuaggugugcucgguauggcacucuuucuagaagagauguugagaacacguguagguacuaaacaugcgauacuuuuaguagcugucucuuuugugacacucauuacagguaauaugucuuucagggaccuuggacgagugaugguaaugguaggggcaacgaugacugaugauauaggaauggggguaacauacuuagcuuugcuugccgcauuuaagguaagaccuacguucgcagcuggucuccuauuaagaaaacucaccuccaaagaauugaugaugacuacaauaggaauaguccuacucucacaaucaacuauuccagagacaaucuuagaacuuaccgaugccuuagcauuaggaaugaugguguuaaaaauuguacgaaaaauggaaagguaucaauuggccguaacaaucauggccauauuguguguuccgaaugcaguuauauuacagaacgcauggaaaguaaguugcacaaucuuagccgucguaucaguaucgccccugcuucugacaucaucacagcaaaaggcggacuggauacccuuagcauugacaauaaagggucuaaaucccaccgcuauauucuuaacuacucuaucacgaacuagcaagaaacggucauggccgcucaacgaagcuauaauggcggugggaaugguuucaaucuuagcuucaucauuacuuaaaaaugacauuccgaugacagguccuuuggucgcugggggacuuuuaacugucuguuacguuuuaacuggucgcagcgcggaccucgaacuugagaaagcagcugauguuaggugggaggaucaggcggagauaucagguucaucuccgauacuuagcauaauaauaucugaagacggaucgaugaguaucaaaaaugaagaagaggaacagacauuaacaauucugauaaggacagggcuacucguuauaagcggauuauuuccaguaucgauuccaauaacagcagcggcaugguauuuaugggaaguaaagaaacaacgagccgguguucuuugggauguucccucgccaccuccaguaggcaaggcugaacuagaagacggagcauacaggauuaaacaaaaaggaauacuggguuacucucaaauuggggcaggaguguauaaagaggguacguuucacacaauguggcauguaacccgcggggcaguacucaugcauaaaggaaaaaggauugaaccaucuugggccgauguuaagaaggaucuuauaucuuaugguggcgguuggaaguuagagggagaauggaaagaaggugaggaaguacagguacucgcuuuggaaccaggcaaaaacccuagggccguccagaccaaaccgggcuuauuuaaaacaaaugcaggaacaauaggcgcgguaucuuuagauuucaguccaggcacaucagguagcccuauaauagacaagaaagguaagguaguagguuuauacgguaacggcguagugacaagaaacgguucauacguauccgcaauagcucaaacggaaaaaucaauagaagauaauccugaaauagaggaugauauauuucgcaaaaagcgccuuacuauaauggaccuacaucccggagcaggaaaaacaaaacgauauuuaccagcuauaguucgggaggcaauuaaacgaggacuuaggacucuuauacuagcuccuacccgaguaguagcagcagaaauggaagaagcacuccgaggacuaccuauacgauaucaaacuccagccauuagagccgaacauacuggcagggaaauaguagacuuaaugugccacgcuaccuucacgaugagauuauuaucacccauccguguaccaaacuauaacuuaauuauuauggacgaagcgcacuuuaccgacccagcuucgauugcugcuagaggcuauauaucaacaagggucgaaaugggagaagccgcaggaauauuuaugacugcuacuccacccggcuccagagauccauuuccucagucaaacgcuccaauaauggaugaagaacgcgagauaccugaaagaagcuggaauagcggccacgaaugggugacagacuucaaagguaaaacugucugguucgucccuaguauuaaagcuggaaaugauauugcugcuugccugaggaaaaauggaaagaaaguaauucaacugucaagaaagacuuuugacucugaauacguaaaaacaagaaccaacgacugggacuucguagucacuacagauauuagugaaaugggugcaaauuuuaaagcagaaagagugauagacccuaggagaugcaugaaaccgguuauacugacugauggagaggaaagaguuauacuggcggguccaaugcccguaacacauagcagcgcagcucaaaggagggguagaauugguagaaaccccaaaaaugaaaaugaccaauauauauauaugggagaaccuuuagaaaacgacgaagacugugcacauuggaaagaagcgaaaauguuguuagauaauauaaauacaccggaagguauuauuccaaguauguucgagccagagcgagaaaaagucgaugcaauugauggcgaauaccgacuccguggcgaagcacggaaaaccuucguggaucugaugcgcagaggggaucuaccuguauggcuagcauauaaaguagcugcugaaggaauaaauuaugcggaccgcagauggugcuuugauggcaucagaaacaaccaaauacucgaggagaauguagaaguugaaauuuggacaaaagaaggcgaaagaaagaaauuaaaaccuagguggcuugacgcccgcaucuacucagauccauuagcauuaaaagaauuuaaagaauuugcagcagguaggaagagucuuacacugaauuuaauuacagaaaugggcagauuaccuacauucaugacgcaaaaagccagagaugccuuagacaauuuagcaguuuuacacaccgccgaagcuggugggcgagcguacaaucaugcgcugagcgaauugccagagacgcuacagauaagucuccuccugacuuuguuagcaacagugacaggaggaaucuuccuauucuuaaugaguggacguggcauugggaaaaugacucucgguaugugcugcauaauuacagccagcauauugcucugguacgcacagauucaaccacauuggauagccgcauccauuauacuugaguucuuccucauugucuuauuaauaccagaaccugaaaaacaacgaacaccacaggacaaccaguugacauauguagucauagcuauucugacaguugucgcugcgaccauggcaaaugaaaugggauuucuagagaaaaccaagaaagacuuagggcuaggaagcauaaccacucaacaaccagaauccaacauccuagacauagacuuacguccagcuagcgcuuggacucuauacgcaguggcgaccacauuuauaacucccauguuaagacacucaauagaaaauucaucgguaaaugucucccugaccgcaauagcaaaccaagcuacaguucucaugggacuuggaaagggauggccuuuaaguaaaauggacauaggcguaccgcuauuagcuaucggguguuauucucaaguuaacccgauaacucucacugcugcacuacuuuuacucguagcacacuaugcuaucaucggaccuggccuacaagccaaagccacacgagaagcucagaaaagagccgccgccgggauaaugaaaaacccuaccguugacggaauaacggugauugaucuggacccuauuccuuaugacccaaaguucgaaaagcaacuuggucaaguuauguuacucguucuauguguaacgcaaguacuuaugaugagaacaacaugggcccuaugugaagcauuaacacuagcuacuggaccuauuaguacuuuaugggaggguaauccgggucguuuuuggaauaccacuauugcaguuuccauggcaaacauauucagaggaagcuauuuagcuggugcaggauugcuauucuccauaaugaagaauacaacaaauacgcguagagguacaggaaacaucggugagacuuuaggugaaaaauggaaaucaagacuuaaugccuuggguaaaagcgaguuccaaauuuauaaaaagagugguauccaagaagucgauagaaccuuggcaaaagaaggaauuaaaagaggagaaacagaucaccaugcggucagccguggcagcgcaaaacuccgaugguuuguggaaagaaacaugauuacuccugagggaaaagugguagaucugggcugcggcagaggagguuggucguacuacugcggugguuuaaagaaugucagggaagugaaaggacuaacaaaagguggaccuggacacgaggaaccaauaccgaugagcacauauggauggaauuuggugagacugcaaucugguguagauguguucuuuacgccacccgaaaaaugcgauacucuucuuugcgauauaggugaaaguaguccgaacccgacaguggaggcaggaagaacucuuagagucuugaaccugguggaaaauugguuaaacaauaacacucaauuuugcauaaaaguguuaaauccauacaugccaucugugaucgagaaaauggaggcuuuacaacgaaaauauggaggggcgcuaguuagaaauccauugucccgaaacuccacgcaugaaauguauuggguuuccaacgcaucuggaaauauuguaagcagcgugaauaugaucucacgaauguugauaaauagauuuacaaugaagcauaagaaagccacguaugagccagauguagaucugggaagugggacacggaacauaggaaucgagucagaagucccaaaccuagauauuauagguaaaaggauagagaagaucaaacaagagcacgaaacaaguuggcauuacgaccaagaucauccauauaaaacaugggcauaucaugggucguaugaaaccaaacaaacggggagugcgaguaguaugguuaacgguguagugaggcuuuugacaaagccuugggauguaauaccaaugguaacgcaaauggcgaugacagauacaaccccauucggacaacagagaguauucaaggaaaaaguagacaccagaacccaggaaccaaaagaaggaacgaagaaacucaugaaaaucacagcugaguggcuuuggaaagaacuagguaagaagaaaacuccacgaaugugcacuagagaagaguucacccguaaaguucgaaguaacgcagcacuaggugccauuuuuaccgacgaaaauaaauggaaaagugcacgagaggcaguagaagacucacgauuuugggaauugguugauaaagaacguaaucuacaccuggaaggcaagugugaaacaugcgucuauaauaugauggguaaaagagagaagaaauuaggugaguucgguaaagcaaaagguagucgugccaucugguauauguggcuaggcgcucgcuuccuagaauuugaagcacuagguuuucucaaugaagaccacugguuuagccgagaaaauucacuaucugguguagaaggugaaggacugcacaaauuaggauauaucuuaagagauguaucaaagaaagaagggggcgcaauguaugcggacgauacggcaggaugggacacacguauuacacuagaagaucuuaaaaacgaagaaaugguuacaaaccacauggaaggagaacauaagaaauuggcggaagcuauauuuaaacugacguaucaaaacaaaguaguaagaguccagaggccgaccccuagagggacaguuauggacauuauaucgcgaagagaccaacgugggucuggccagguuggaaccuauggacuuaauacauuuacaaauauggaagcucaauugauacgucagauggaaggagaagguguauuuaagucgauccaacaccucaccgcuacagaagaaaucgcgguacaaaacugguuagcacguguuggaagggaacgacuaagucgaauggcaaucuccggggaugacuguguuguaaaaccccucgaugauagauuugcguccgcucuuacagcccucaacgauauggguaaaguuaggaaagauauucaacaaugggaaccgaguaaaggguggaaugacuggacacagguuccauuuuguagucaccauuuccaugaauuaauaaugaaagacggucgaguauuaguaguuccguguagaaaccaagaugaauugauaggacgagcuagaauaucacaaggcgcgggauggucauuacgggaaacagccuguuuaggaaaaucguacgcacagauguggucucugauguauuuccaccgaagagaccuacgauuagcggccaaugcaauaugcagugcggugccaucccauuggguaccuacuucaaggacaacuuggagcauucaugcuaagcacgaauggaugacuacagaagacauguuaacaguguggaaccguguuuggauucaagagaacccuuggauggaagauaaaacuccuguggagucaugggaggaaauaccauaucuugguaaaagagaagaccaaugguguggaagccucauaggguugaccagcagagccacuugggccaaaaacauacaaacugcaauuaaucaagucagaagucuuaucgguaaugaagaguauacagacuauaugccgucuaugaaaagguuuaggagagaagaagaagaggcuggaguucuuugguaa

SEQ ID NO: 22190 - RNA, 9876 nt, Artificial Sequence
  derived and/or modified CDS sequence (opt6) from DENV-2__KF744407__SS-prME
acagcaggaaugauuauaauguuaauucccacgguaauggcauuucauuugacaacacguaauggcgaaccccauaugauagugucgcgucaagaaaaaggcaaaucauuguuauucaaaaccgaggauggggugaacauguguacgcugauggccauggaucucggagaauuaugcgaggauacgauuacuuauaaaugcccauuauuaagacagaacgaaccggaggacauagacuguuggugcaacucuaccuccaccugggucacauauggaacuugcacaacaacgggagaacacaggagagaaaaaagaucuguagcacucguuccccacguagguaugggucuagaaaccagaaccgagacauggaugagcucugaaggggcauggaaacaugcucaaaggauagaaacauggauauugcgacacccuggauuuacacuaauggcggcaauacucgcauacacaauagguacgacgaacuuucaacgugcacuaauauuuauucuucucacggcgguagcaccuagcaugacaaugagauguauaggcauuaguaauagagauuuuguggaagggguaaguggggguucauggguggacaucguacuagaacaugguaguugugugacaacuauggcuaagaacaagccgacacuagauuuugaauuaauuaaaacggaggcgaaacauccggcaacauuaagaaaauauugcauagaagcaaagcugacaaauacaacaacagcaagccguugucccacacaaggugagccaagucuaaaugaagaacaagacaaaagauucguauguaaacauagcaugguagaccgagguuggggaaacggcugcggauuauuuggaaaaggaggaauuguaacaugugcaauguucacuuguaaaaaaaauauggaaggcaaaguggugcaaccggaaaaucuugaguauacgauagucauuacaccucacucuggcgaggaacaugccguuggaaaugauaccggaaaacacggaaaggaaaucaagauaacgccccagagcucaauaaccgaagcagaacucacuggauacggcacaguaacaauggaaugcucaccacguacuggguuagauuuuaacgagaugguccuacuucaaauggaaaauaaagcaugguuaguccaccgacaaugguuucuugacuuaccauuacccugguuaccaggagcggacacucaaggaucuaacuggauacaaaaagaaacacucgugacauucaaaaauccacaugcaaaaaagcaggacguggucguuuuagggagucaggaaggugcuaugcauaccgcgcuuacuggugcgacagaaauucaaauguccucgggaaauuuacucuuuaccgggcaucuaaaaugucgacugaggauggauaaacuucaacuuaagggaaugucguauagcauguguaccgggaaguucaaaguaguaaaagaaaucgcggaaacucaacacggcacaauuguaguuaggguacaguacgaaggagacggaucuccaugcaaaauaccauucgaaauaauggauuuggaaaaaagacacguuuuaggacgucuuauaacugucaaccccauaguaaccgaaaaagauucaccuguaaauauugaggccgagccaccauuuggcgauaguuacguuauuauugguguagaaccugggcagcuuaaacuaaacugguuuaagaaaggauccucuauuggacagauguuugaaacuacuaugagaggcgcaaaaaggauggcgauucuuggagacacugcuugggauuucgguagucuugguggcguauuuacaaguauuggcaaggcacuacaccaaguauuuggcgccauauauggagccgcauuuucgggcguuagcuggacuaugaaaauauuaauuggcguaaucauuacuuggauagguaugaacucgagaaguaccagucugucuguaucacucguauuggucgggguagugacacuuuaucuagggguaaugguccaagccgauuccggcugcguagcaucuuggaaaaacaaggaauuaaagugcggcaguggcauuuucauuacugauaauguacacacuuggaccgaacaauacaaguuucagccggagucgcccagcaaguuggccuccgcaauacaaaaggcgcaucaagaaggcauuugugguauaagaaguguaaccagacuagaaaauuuaauguggaaacagauuacacccgaguuaaaccauauacuaucugaaaaugaaguuaaacuuacuauaaugacgggagacauaaaagguauaaugcaugcagggaaaagaagcuuacguccgcaaccuacugaacucagguauaguuggaagacuugggggaaagccaaaauacuaucgacagaaagccauaaccagacguuccuuauagacgguccugagacagcugaauguccgaauacaaauagagcauggaauagccuggaagucgaagacuauggguucggugucuucaccacaaauauuugguuaagauuaagagagaaacaagacgcauuuugugacucaaaacuaaugagcgcagcaauuaaagauaaucgcgcugugcaugcggacaugggguacuggauugagucugcauuaaaugauacuuggaagauugaaaaggcuagcuucauagaaguuaagaguugucacuggcccaaaagucacacguuguggaguaaugguguccuggaaucugaaaugauaauaccaaaaaacuuugcaggaccaguuagccaacauaacuacagaccgggauaucauacccaaaccgcggguccuuggcaucuugguaaacuugaaauggauuuugauuucugugagggcacaaccguaguaguuacugaagauugcggcaaucgaggaccuaguuuaagaacaacuacggcaaguggaaaauugaucacagagugguguugucguagcuguacgcuuccgccguuaagauauagaggagaagacggaugcugguauggaauggaaauacguccuuuaaaagaaaaggaagaaaauuuagugaguucuuuaguuaccgcuggccacggacaaauagauaacuucucgcugggaguauugggaauggcuuuauuucuugaagaaaugcugaggacuagagugggaacuaaacaugcaauauuauugguugcugucucauucguaacacucauaacagguaacauguccuuccgagauuuaggccgagugaugguaaugguuggugcuacgaugacugaugauaucgggauggguguaaccuauuuagccuuauuggcagcauucaaaguaaggcccacauucgcugcaggacuacucuuacguaaacuuacuucaaaagaguuaaugaugacaacaauaggaauuguacucuugucucaaucaacuauaccggaaacuauucuugaacucacggacgcguuagcauuggggaugauggucuuaaagauaguuagaaacauggaaaaauaucaguuggcaguuaccauaauggcaauacuguguguucccaacgcagucauucuccaaaacgcauggaaagugaguugcacgauccuagcgguaguuucuguaagcccauuauuauuaacaucgucccaacaaaaagcugauuggauuccucuugcccuaacaauaaaaggacuuaauccaacugcuaucuuccuaacgacucuuaguagaacgucaaagaaaagaagcuggccacuaaacgaagcgaucauggcaguuggcauggucaguauccuugccagcucuuuacucaaaaaugacauaccgaugacaggccccuuaguugcuggcggauuauuaacuguaugcuauguauugaccggacgaucugcggaccuggaacucgaaaaagcugcugaugugcgaugggaagaacaagcagaaauuucuggcagcucuccaauucuaaguauaauuauaucagaagauggaaguaugaguauaaaaaaugaagaagaggaacaaacucuuacgauucuaauuagaacuggauuguuaguuauaucgggucucuucccagucaguauucccauaacggcugcugcaugguauuuaugggaagucaaaaaacaaagggcaggagucuuaugggacguaccaucaccaccaccaguagguaaagcggagcuagaggauggcgcguaccgaaucaaacaaaaaggaauccuggguuacucgcaaauaggugcuggcguauauaaagaaggcacauuucauacaauguggcacguaacacgcggugcuguacugaugcauaaaggaaagcgaauagaacccucaugggcagauguaaagaaagacuuaaucaguuacggaggaggauggaaacuagagggcgaauggaaagaaggagaagagguacagguucucgcuuuagaaccaggaaaaaacccacgggcaguacaaaccaaaccgggucuauucaagacaaacgcuggcacaaucggagcaguaagucuugacuuuagucccggcacgaguggcucaccuauaauugacaaaaaaggaaaaguaguuggauuauacgguaacggagucguaacaagaaauggguccuauguaagugccauagcacaaacugagaaaucaauagaggauaaucccgaaauugaagacgacauuuuucgaaaaaaaagauugaccaucauggaccuacacccaggugcaggaaaaacuaaacguuauuuaccagcaauagugcgcgaagcuauaaaaagaggucucagaaccuuaauucuagcaccaacacgcguuguagcggcagagauggaggaagcguuaagaggucuuccaauucguuaucagacacccgcaauaagagccgaacacacagguagagagauugucgauuuaaugugccacgccacauuuacuaugagguugcuuaguccuaucagagucccuaauuacaaucuaauaauaauggacgaagcacacuuuaccgacccagccucgaucgcugcaagaggauacauuucuacaagaguggaaaugggagaggcagcggguauuuuuaugacugccacgccaccaggaucuagagauccguuuccacaaaguaacgcccccauaauggacgaagagcgagagaucccugaacgcucauggaacucaggucacgaauggguaacagacuucaagggaaaaacgguuugguuuguaccaucuaucaaagccgguaaugacaucgcugccugucuaaggaaaaacggaaaaaaaguaauacaguuaucgagaaaaaccuuugacucugaguauguaaaaacucguacuaacgacugggauuuuguuguaacaacagauaucucagaaaugggagcgaauuuuaaggcugaacgaguaauagauccaaggagaugcaugaaacccgucauauuaacggauggcgaggaaaggguaauccuagcaggucccaugccaguaacacauaguagcgcugcccaacgacgagggcgaauugguagaaaccccaaaaaugaaaacgaucaguacauauauaugggugaaccuuuagaaaaugacgaggacugugcacacuggaaggaagcaaaaauguuguuagauaauauuaacacaccugaagggauaauuccgucaauguucgaaccugaacgugagaagguggaugcuauagacggggaguacagauuaaggggagaagcgcgaaagacauuuguagauuuaaugagaaggggagaccuaccuguaugguuagcauauaagguagcagcagaagguauuaauuacgcagacagaagauggugcuucgaugguauucgaaacaaucagauacuagaagaaaacguagaaguagagauauggacaaaagagggggagcgaaaaaaacugaaaccaagguggcuagacgcaagaauuuacagcgauccuuuggcuuuaaaagaguucaaggaauuugcugcaggucguaaaucccuuacucuuaauuugauaacagaaaugggucgucuuccuaccuuuaugacacaaaaggcgagggacgcauuagacaauuuagcgguucuacacacagcggaagcagguggaagagcauauaaucaugcauuaucagaacucccagaaacauuagagacucucuuauuacuaacguuauuagcgacaguuaccgggggaauuuuuuuauuuuuaaugucuggaaagggaaucgguaagaugacucucggaaugugcugcauaauuacagcaagcguacuacuuugguacgcacaaauacagccgcacuggauagcugcaaguauaauacuagaguuuuuucucauaguacuauuaauaccggaacccgaaaaacaacguacuccacaagacaaccaacugaccuaugucguaauugccaucuuaacuguuguggcagcuaccauggcuaaugagaugggauuucuagaaaaaacgaaaaaagacuuuggcuuagggagcauagcaacgcaacaaccagaaucuaacauucuugauaucgauuugcgaccggcuagugcauggacguuauacgcaguugccacuacguucauaacucccauguuaagacauaguaucgaaaauagcaguguuaacgugucacucacugcuauagcuaaccaggcaacuguuuuaaugggauuagggaaagguuggccacucucaaaaauggauauaggggugccauuauuagcuauaggauguuauucccaaguaaauccaauaacucucacugcggcacuucuuuuacugguugcacacuacgcuauaauuggcccgggacuacaagcuaaagcgacgagagaggcacaaaagagagcagcagcaggcauuaugaagaauccgacuguagauggcauuacgguuaucgaccuggauccuauaccguaugauccaaaauucgagaaacaauuaggacaaguuaugcuacuaguucucugcguaacacaagugcugaugaugagaaccacuugggcacuaugugaagcgcuuaccuuagcaacuggacccaucucaacacuuugggaagguaauccagguagguuuuggaauacaacgauagcugugucuauggcuaacauuuuuagaggaaguuacuuagcaggcgcaggauuauuauuuuccauaaugaaaaacaccaccaauacucggcggggcaccgguaauauuggagaaacauuaggugagaaauggaagaguaggcucaaugcucugggaaaaagcgaauuucagaucuauaagaagucaggaauacaagagguggauagaacccuugcgaaagaaggaauaaaaagaggggaaaccgaucaucaugcaguaagccgggguuccgccaaacugcgcugguucguugaaagaaauaugauaacaccggaagguaaaguaguggaccuuggaugugggcguggcgguuggucuuauuacuguggaggacuuaaaaaugugagagaaguaaaagguuuaaccaagggagguccgggccacgaagaaccuauaccuaugagcacauacgguuggaaucuaguuagacuucaaucgggcguagacguuuucuucacaccuccagaaaaaugcgauacccuucuaugugacaucggugaaucaucaccaaacccaaccguagaagcgggccgaacuuuacggguccuaaaccuaguugagaauugguuaaacaauaauacgcaauuuugcauaaaaguguugaaccccuauaugcccagcguaauagagaagauggaggcucuacagagaaaauaugguggagccuuaguacgaaauccuuuaagcagaaauagcacucaugagauguacuggguaagcaacgcaucagggaauauagugagcagugucaacaugauuucaaggauguuaauuaaucgcuuuacaaugaaacauaaaaaggcaacguacgaaccugacguagaucugggaucagguacuagaaacauagggauugaaagcgaagucccuaaucuugacauaaucggcaaaaggaucgaaaaaauaaaacaagaacaugaaacaucauggcauuaugaucaagaccauccauauaaaacaugggcauaccaugguagcuaugagaccaaacaaacagggucggcaaguucuaugguaaacggcguagucagacuacucaccaaaccgugggaugucauuccuaugguuacccaaauggcuaugacagauacaacaccuuuuggucaacagaggguuuucaaagaaaaaguagauacaagaacucaggaaccaaaagaagguacuaaaaaacuaaugaagauuacagcugaauggcuauggaaagaacuaggaaaaaaaaaaacaccccggauguguacucgugaagaauuuacacggaaagugcgaucuaaugcggccuugggggcaaucuuuacggaugaaaauaaguggaaaucggcaagagaagcgguugaggauucgagauuuugggaacuagucgauaaagagcgcaaccuucaccuggaaggcaaaugugaaacauguguguacaacaugaugggcaagcgggaaaaaaagcucggugaauuuggcaaagcgaaaggcagucgagcaauuugguacauguggcuuggggcacgcuucuuagaauuugaagcauuaggcuuucuaaacgaagaucauugguuuucucgagaaaacucacuaaguggaguugagggggaaggauuacauaaacuugguuauaucuuaagagacgucucgaaaaaagaagguggcgcuauguacgcagacgacacugcaggaugggauacaagaauaacguuagaagauuuaaagaaugaggagaugguuacuaaucacauggaaggcgaacacaagaaacuagcggaagcuauauuuaagcugacuuaucaaaacaaagugguacguguccagagaccuacuccacgaggcacaguaauggauauaauaagcagaagggaucaaagaggaagcggucaaguagguacuuauggguugaauaccuuuacaaacauggaagcgcaauugauaagacaaauggaaggugagggcguauuuaagagcauccaacauuuaacggcaacugaagaaauagcaguacaaaauugguuaacuagaguaggucgugaacgcuugucaaggauggcaauaucgggagacgauugcguaguaaaaccuuuagaugacagauucgcuucagcuuugacugcguuaaaugacaugggaaaagugcgcaaagauauacaacaaugggagccaaguaaggguuggaacgacuggacccaaguaccuuuuugcucacaccauuuucaugaacuaauuaugaaagauggucguguucuuguaguacccugccguaaccaggaugaguugaucggaagggcaagaauaucccaaggggcggguuggucccuacgggagacagcgugucugggaaaaucauaugcacaaauguggucguuaauguacuuucauaggcgcgaccuucggcuugcagcaaacgcgaucuguuccgcgguaccaucgcauugggucccuacuucaagaacgacuuggucuauucacgcaaaacacgaauggaugacgaccgaggacaugcuaacgguuuggaauagaguauggauacaagaaaauccuuggauggaagauaagacuccaguagagagcugggaagagauucccuauuuagguaagcgcgaagaucaguggugcgggagccugaucggauugacaucgagggccaccugggcaaaaaauauucaaaccgcaaucaaccaagugagaucucugaucggaaacgaagaguacacugacuacaugccaucaaugaaaagguuccgaagagaagaagaagaagcaggaguauuaugguga

SEQ ID NO: 22191 - RNA, 9876 nt, Artificial Sequence
  derived and/or modified CDS sequence (opt6) from DENV-2__KF744399__SS-prME
acagccgguaugauaauaauguuaauacccacaguaauggcguuccaccuaaccacaagaaacggagaaccccacaugaucguuagcagacaagaaaaaggaaaaucacuauuauucaaaacugaagauggaguuaacauguguacgcuaauggcaauggauuuaggagagcucugugaagauacuaucacuuauaaguguccacuauugcgacaaaacgaaccagaggauaucgauuguugguguaauaguacaaguacauggguuacauacggcacguguacuaccacgggagaacacagaagagaaaaaagguccguugcauuggugccucauguagggauggggcuggaaacaagaaccgaaacuuggauguccucugagggugccuggaaacacgcacaacguauugaaacauggauauugaggcacccugguuucacccucauggcugcaauacuggccuauaccauugggacuaccaauuuccaacgcgcauugauuuuuauauuauugacagcaguagcaccaucaaugacgaugcgcuguauugguauuaguaaucgggauuuuguggaaggugucucuggcggaucuuggguggacauuguauuagaacauggaucauguguaacaacgauggcuaaaaacaaaccaacauuggauuucgaauuaauuaagacagaagcaaagcacccugccacucuuagaaaauauuguauagaggccaaacucacaaauacaacgacugaaucaagaugcccgacacaaggagagccaucauugaacgaagagcaagauaaacguuuugucuguaaacauucaauggucgaccgagguugggguaauggaugugggcuauuugggaaaggggggauagucacuugugcgauguucacguguaaaaaaaauauggaaggaaagaucguacaaccugagaacuuggaauacacuauaguuauuaccccacacucgggugaggaaaacgccguagggaaugacacuggaaaacacggaaaggaaauaaaagugacuccccaaucaucaauaacagaggcugaauuaaccggguacgguaccguuacaauggaaugcaguccacgaacuggccuagguuucaaugaaaugguucuuuugcagauggagaacaaagcuugguuaguucaucgacaaugguuccuagauuugccauugcccuggcugccaggggcagacacccaaggcucuaauuggauacaaaaagagacguuagucacauucaagaacccacacgccaaaaaacaagauguuguaguguuagggucccaagaaggggcuaugcauacagccuugaccggagcgacagagauacagaugaguaguggaaaucuauuguuuacaggccauuuaaaauguagauuacgaauggauaagcuccaacuuaagggaaugagcuacaguauguguacagggaaauucaaaguaguaaaagaaauugccgaaacccaacauggcaccauagucguuagaguucaauacgaaggcgauggaucaccauguaagaucccauucgagaucauggaccuugaaaaacggcauguuuuaggucgucuaauaacaguaaauccuaucguuacugaaaaagacaguccggucaauaucgaagccgaaccccccuucggagacagcuacgugauuauuggagucgaaccaggccaacuaaaacuaagcugguuuaaaaaagguuccaguauaggccaaauguucgaaacaacuaugcgaggugccaaacguauggcaauucuaggcgacacagcuugggauuuuggcucgcuggggggaguauuuacaagcauugguaaagcgcugcaccaaguuuuuggggccauauauggagcagcauuuucagguguaucuuggacuaugaagaucuugauaggaguuguaaucaccuggauuggaaugaauucccggagcacuagucucaguguaucucuaguauuagugggcgugguaacauuauauuuggguguuaugguccaggcagacuccgggugcguagugaguuggaaaaacaaagaguuaaagugugguucugggauauuuauaacagauaaugugcauaccuggaccgaacaauacaaguuccaaccagaaaguccuucaaaauuggcaagugcuauacaaaaagcccaucaggaaggaauaugcgggauaagaucaguuacuagguuagaaaaucuaauguggaagcaaauaaccccagaauugaaucauauuuuaucugaaaacgaaguuaaacuuacaauaaugacaggugacaucaaaggaauaaugcacgcggguaagagaucucuaagaccucaacccacugaacugagauauucuuggaaagcauggggaaaagcuaaaaucuuauccacagaauugcauaaucaaacguuuuugauagacggucccgaaacagcagaauguccuaacacaaaucgcgcguggaacagccucgaggucgaagacuacgguuucggaguauuuacgacuaacauauggcuaaagcuacgagaaaaacaggaugcguuuugcgauaguaaacuuaugucugcugcaauaaaagauaacagagcgguccaugcagauauggguuacuggauugagagugcacugaaugauacauggaaaauugaaaaagcguccuuuauugagguaaaauccugucauuggccgaaaucacacacguuauggagcaauggaguauuagaauccgaaaugauaauaccuaaaaauuuugcagggcccgucagccaacauaacuauagacccggcuaucauacgcagacagccggaccguggcaucuaggcaaacuugaaauggauuuugacuucuguaaaggaacgacaguuguagugacugaagauuguggcaaucgcgguccuucccuacgcacuacaaccgcauccggcaaacucauaaccgagugguguugcagaucaugcacacuaccuccauugcguuaucgaggggaagauggauguugguaugguauggaaauacgaccauugaaagaaaaagaggaaaauuuaguaaacucacuuguaacugcaggucauggucagaucgauaacuuuucacugggaguacuggguauggcguuauucuuagaagaaauguuaagaacccguguugguaccaaacaugcaauucucuuaguagcuguuagcuuuguaacuuuaauaacaggaaauaugaguuuucgcgauuuagguagaguaauggucaugguuggggcuacaaugaccgacgauauagggaugggcguaacuuaucuggcucucuuagcggcauucaaaguccguccaacauucgcagcgggauugcuccuucgaaaacuaaccaguaaagagcucaugaugacaacuauaggaauaguccuccuaagccaaagcacaauaccugaaacaaucuuagaguuaacggacgcacucgcccugggcaugaugguauugaaaauaguacguaaaauggaacgguaucaacuggcgguuaccaucauggcgauuuuauguguccccaacgcuguuauauuacagaaugccuggaaaguuucuugcacaauacuggcagucguaaguguuagcccauuguuacuaacaucuucucaacagaaagcggauuggauuccucuagcacuuacaauaaagggucuaaacccuacagcuauauucuuaacuacgcuaucgaggacaucaaaaaaacguaguuggccacuaaacgaagcuaucauggcuguaggaaugguuuccaucuuagcuaguucucuacucaaaaacgauauucccaugaccggaccgcuaguagcgggaggccuacuuaccgucuguuaugugcugaccggucggagugcugauuuagagcucgagaaagcagccgacguaagaugggaagaacaagcagaaaucaguggcucuucaccuauacucaguauaauaauuagugaagaugggaguaugaguauaaaaaaugaagaagaagagcaaacuuugacuauacuuauucguacgggguuauugguuaucagcggauuauucccaguaucuauucccauaacugcugccgcaugguaucuaugggaagucaaaaagcaaagagcugguguauugugggaugucccaagcccuccaccuguuggcaaggcggaauuagaagacggugccuauagaauaaaacagaaagggauccuggguuacucgcaaauaggagcgggaguauacaaagaaggaaccuuucacacaauguggcauguaacuaggggagcaguacuaaugcacaaaggaaaaagacuugaacccucaugggcagacgugaaaaaagacuuaauuucauauggcggugguuggaagcucgaaggagaauggaaagaaggcgaagaagugcaaguguuagcauuggaaccuggcaaaaacccaagggcgguucagacaaaaccugguuuauuuaaaaccaauacuggcaccauuggugcggucucuuuagauuucucaccaggcacgucaggcaguccaauaaucgacaaaaaagggaaaguugugggcuuauauggaaacggggucguaacaagaaauggauccuauguaagcgcuauagcucaaacugagaaaucgauagaagauaauccggaaauagaggaugauauuuucagaaagaaacgcuuaacaauaauggaucuucauccaggugcgggaaaaacaaaaagauacuuacccgcaauaguaagggaagcgaucaaaagaggacuuagaacacuaauacuggcaccaacaagagugguagcggcagaaauggaggaggcauugagaggcuugccuauaagauaccaaacucccgcaauccgugcugaacauaccggcagagaaauuguggacuuaaugugccaugcaaccuuuacaaugaggcuacucucaccaauaagagugccgaacuauaauuugauuauaauggacgaagcacauuuuacagauccggcguccauagcagcaagaggcuauauuucaacaagaguagagaugggugaagcugccgggauuuuuaugacagcaaccccgccaggaucgagagacccuuuuccacaaucuaaugcaccuaucauggaugaagaacgagaaauaccagaaagaucuuggaauuccggccaugaguggguaacagacuuuaagggaaagacuguuugguuugugcccagcauaaaagcggggaaugauaucgccgcuugcuugcgaaaaaauggcaagaaaguaauacaauuaucacgaaaaaccuucgacucggaguauguaaaaaccaggaccaacgauugggauuuugucguaacaacugauauuucagaaaugggggcuaauuuuaaagcugaacgugucauugacccgcgacgaugcaugaaaccaguaauacuaacagacggagaggagcgugugauucuagcagggccaaugccuguaacccacucuagcgcagcacagcgacgugggaggauagggcgaaauccaaaaaaugaaaaugaccaguauauuuauaugggagaaccgcucgaaaacgacgaagauugugcacacuggaaagaagccaaaaugcugcuagauaauauaaacacuccagaaggaauuaucccaucuauguuugaaccggaaagggagaaaguagacgcuauagacggggaauaucgauuacgaggagaagccaggaaaacauuuguugacuugaugaggagaggagauuugccaguaugguuagcuuauaaaguagcagccgagggaauaaauuaugcggauagaagguggugcuuugaugggauuagaaauaaucaaauauuagaagaaaauguagagguggaaauauggacaaaagaaggggaaagaaaaaaauuaaaaccacgauggcuagaugcgaggauauauagcgacccccuagcgcuaaaagaauuuaaagaauucgcugcgggaagaaagaguuuaaccuuaaauuuaaucacagaaaugggaagguuaccuacauuuaugacucagaaggcgagagaugcauuagacaauuuggcuguauuacauacugcugaagcagguggacgggcuuauaaucaugcuuugucugagcugccagaaacgcucgagacauuauuauugcuaacccuauuggcuacaguaacuggagggauauuucuauucuuaauguccgguaaaggcauagguaaaaugacacuaggaauguguugcaucauuaccgcuucaguacuguuaugguaugcucaaauucagccccacuggauugccgcaaguauaauucucgaguuuuuucuaaucguauuguuaauaccugaaccggagaaacaacgcacgccucaagacaaucaacuaaccuacguaguuauagccauauuaacagugguugcagcaaccauggcgaacgagaugggcuuccuggaaaaaaccaaaaaggauuuuggucuaggcaguauagcaacacaacaacccgaaaguaacaucuuagacauugauuuacgaccagcgagcgcauggacuuuauaugcgguagcgaccacauucaucacaccaauguugcgacacucgauagaaaacucaucagucaacgugucacucaccgcuauagcuaaccaagcuacaguuuugaugggccuugggaagggauggccccucagcaagauggauauaggugucccacugcuggcaauagguuguuauucccaggugaauccgauuacguuaacugcggcacuacuacuccuaguugcccacuacgcaauaauaggaccaggcuugcaagcaaaagcuaccagagaagcucaaaaacgagcugcagcaggaaucaugaaaaacccgacgguggauggaaucacugucauugacuuagauccaauacccuaugaucccaaguucgagaagcaacuaggucagguaaugcugcuuguguuaugugugacacaaguacuaaugaugcggaccacaugggcacuaugugaggcacuuacucuagcaaccgguccuaucucaacccuuugggaaggcaauccaggccgauuuuggaauacaacaauugcuguuucaauggcuaauauuuuuagaggauccuaccuugcaggcgcuggauuauuguucagcaucaugaagaauacaacaaauacaagaagggguaccggcaauauuggugaaacacuaggggaaaaauggaaaaguaggcugaacgccuugggcaaaucugaauuccagaucuacaagaagagugguauucaagagguugauaggacacuagcuaaggaaggaaucaagagaggagaaacagaucaccacgcugucagccgugggagugcuaaauuaagaugguuuguagagagaaauauggugacaccugaaggaaagguaguugaucuaggcuguggaagaggggguuggaguuauuauugugggggacuuaaaaauguucgggaggugaaaggauuaacgaaaggaggaccuggucacgaggaaccuauuccgaugagcacauacggauggaaccugguuagguugcaauccggugucgacguuuuuuuuacaccaccugaaaaaugugauacauuguuaugugauaucggggaaaguuccccaaaucccacaguugaagcaggaagaacauuaaggguucuuaauuuaguugagaacuggcucaacaacaauacacaauuuuguauaaaaguacuaaauccguauaugccuaguguuauagaaaaaauggaagcuuugcaaagaaaauacggaggggcauuaguacgaaauccccucucacgcaacagcacccaugaaauguauuggguuucuaacgcaagcgggaauauugugaguuccgugaacaugauaucgagaaugcuaauaaauagauuuacaaugcgucauaagaaagcaacauacgaaccugacguggauuuaggaucaggaacucggaauaucgguauagaaucugaaauuccgaaccuagacauaauagguaaaaggauagagaaaauaaagcaagaacaugagacaucuuggcauuacgaucaggaccacccguauaaaacuugggcauaucauggaucuuacgaaacuaaacaaaccggcucggcauccaguaugguaaauggaguuguacgacuuuuaacuaaaccuugggacgugauuccuaugguaacacaaauggcaaugacggauacaacuccauucggacagcaacguguuuuuaaggaaaaaguagauacaagaacacaagaaccgaaagagggaacgaagaaauuaaugaaaauaaccgcggaaugguuauggaaagaacuaggaaaaaaaaaaacaccaaggaugugcacucgugaggaguuuacuaggaaagugcgaagcaaugcagcuuugggggcaauauuuacugaugaaaauaaauggaaaagcgcucgagaggcaguagaagauagucgguuuugggaauuagucgacaaagagagaaacuuacaucuagaagggaaaugugaaaccugcguguacaauaugauggguaaacgugaaaaaaaauugggagaguucgggaaggcaaaaggcucuagagccauuugguauauguggcuuggggcucgauuucuggaauuugaagcauuagguuuccugaaugaggaucacugguuuagucgagaaaacagucugucugggguugaaggugagggucuacacaaguuagguuauauuuuacgugaaguaagcaaaaaagaaggcggugcgauguaugccgaugauaccgccgggugggacacucguauuacauuagaagauuugaaaaaugaagaaaugguaacaaaccacauggaaggcgaacauaagaaacucgcggaagcuauauuuaagcucacauaucagaauaagguaguccgaguacaacgaccuacaccucgugggacagugauggauaucauuucucggcgggaucaaagggggucugggcaaguugguaccuacggccuaaauaccuucacaaacauggaagcccaauuaaucagacaaauggaaggugaaggaguuuucaaaagcauacagcauuuaaccgcuacugaagagaacgcaguacaaaauugguuagcacgaguuggccgagagagacuaucaagaauggcgauaucuggagacgauugcgucgugaaaccucuagaugaucguuucgcaucagcacuaacugcucuaaaugauaugggaaaaguacguaaagacauucaacaaugggagccgagccgaggauggaaugauuggacacaaguucccuucugcagccaucauuuucacgagcuuauaaugaaagaugguaggguauuaguaguucccugucgcaaccaagacgaauuaauugguagagcucgcauaagucaaggugccggauggaguuugcgugaaacagcgugcuuggggaagagcuaugcacaaauguggucccuuauguacuuucaccgacgagauuuacgccuugcugcaaaugcuauaugcagcgcagugccaucacacuggguuccaacuucaaggacaacauggaguauucaugcaaaaaaugaauggaugaccaccgaggacauguugacuguuuggaauaggguguggauucaagaaaacccguggauggaggacaaaacuccaguggaaucuugggaagagauccccuaucugggaaaaagagaggaccaguggugcggcagccugaucggacuuacaucaagggcuacuugggcaaagaauauucaaacagcuauaaaucaaguccgaagcuuaauaggcaaugaagaauacacagauuauaugccgucaaugaaaagguuccgccgggaagaggaggaagccgguguucuuugguag

SEQ ID NO: 22192 - RNA, 9876 nt, Artificial Sequence
  derived and/or modified CDS sequence (opt6) from DENV-2__JX286516__SS-prME
accgcaggaguaauaguuaugcuaauuccaaccgcgauggcauuccauuuaacaacccgaaauggggaaccgcauaugauaguaggucgacaagaaaaagguaaaagccuguuguuuaaaacagaagauggugugaacauguguacgcucauggcaauagauuugggagaacuaugugaagauaccauaaccuauaaauguccguuguuacggcagaaugaaccagaagauauagacuguugguguaacucaacaagcacauggguaacauauggcacuuguacaacaacuggggaacaccggcgugaaaaacgauccguagcauugguuccacacguagggaugggacucgaaacgagaaccgaaacuuggaugucaucugaaggggcauggaaacacguucagcgaauugaaacauggauacuaagacauccgggauuuacuauaauggcagcuauauuggcauacacuaucgguacuacucauuuccaaagagcauuaauauucauccuucuaacagcuguagcuccuagcaugacgaugagaugcauaggaaucucaaauagagacuuuguugaaggaguguccggaggaagcuggguggauaucguucuagaacaugguaguuguguuacaacaauggccaaaaauaaaccaacacuggauuucgaauuaauuaaaaccgaagcgaaacagccggcuacauuacguaaauauuguauugaagcaaaacugaccaacaccacaacagaauccagauguccuacccagggagaacccagucuuaacgaagaacaagacaaacguuucauauguaaacacagcaugguagacagaggauggggaaacggauguggauuauuugggaaaggagggauaguuacaugugcaauguuuacgugcaagaaaaacauggagggaaaaauugugcaacccgagaaccuggaguauacaauugugauaacgccacacagcggagaggaacaugccguagguaaugauacugguaaacacggaaaagaaauuaaaauuacgccgcaaucaucuacaacugaggccgaguuaacgggcuauggaaucguuaccauggaguguucuccaagaacgggccuagacuuuaacgagaugguucuucuucagauggaagacaaagccugguugguccauagacaaugguuccuagaucuaccccuuccaugguugcccggagcggacacgcaaggcaguaacuggauacagaaagaaacucuuguaaccuuuaaaaacccucacgccaagaaacaagaugugguaguucuuggaucacaagaaggggcaaugcauacagcccuuacaggagccaccgagauacaaaugagcucaggaaaccuauuauucacaggacaccuaaaaugccgacuucgaauggacaaauuacaacuuaaaggaaugucguauucuauguguacaggaaaauuuaaaauuguaaaagaaauagcagaaacucaacauggaacaauuguaauucggguucaauaugagggggacgguucaccuuguaaaauaccauuugaaauuacagauuuagagaaacgacauguacuaggaagacugauaacuguuaauccuauaguuacugaaaaagauuccccagucaauauugaggcggaaccaccguuuggagacaguuauaucauuguaggaguggaaccaggacaguuaaaauuaaacugguucaagaaagguucuuccauaggccagauguuugagacuacaaugagaggagcaaagagaauggcaauccugggugacacugccugggauuuuggcucuuuaggaggcguauuuacgaguauaggcaaggccuuacaucagguguucggggcaauauauggcgcagcuuuuuccggaguaaguuggacuaugaaaauacuuaucggcguaauaauaacauggauagguaugaauagccgcaguacaucucuuaguguaucauuaguucucguaggaguagucacguuauaccucggugcgaugguccaggcagacucuggauguauuguuucauggaaaaacaaggaacugaaauguggaucugguauauucauaacugauaauguacauacauggacugaacaauacaaauuccagccagaaucaccgucaaaacuugcaagugcaauccaaaaagcgcacgaagaaggaauaugcggaaucagauccgucacccgauuagaaaaccuuauguggaaacagaucacgccugaauugaaccacauuuuaucagagaacgaagucaaacuaacgaucaugacaggagacaucaaagguauaaugcaggcaggcaaaagaaguuuaagaccacagccgacagagcuaaaguacucuuggaaaacaugggguaaggcuaaaauguugucuacggaaucucauaaucaaacauuucuaauagacggcccugaaacagcugaauguccaaacacuaaccgcgcguggaacucucuugagguugaggacuauggauucgguguuuucacaacuaauauuuggcugaaacuaagagagaagcaagacguauucugugacucaaaacuuauguccgcagcaaucaaggauaaccgagcugugcaugcugauaugggauauuggauagaaucagcccuaaaugauaccuggaagauggaaaaggcuucguuuauugaaguuaaauccugucacuggccaaaaucucauacuuuguggaguaaugggguauuggaaucugaaaugaucauuccaaagaauuuugcagggccaguuagccaacacaauuaccgccccggguaccauacacaaaccgccgguccuuggcauuuaggcaaguuagaaauggauuucgacuucugcgaaggaacuacuguagucgucacagaagauugugguaaccgcggaccaucacuacgaaccacaacugcgaguggcaagcuaaucacagaauggugcuguagaucguguacuuuaccaccccuaagauaucgaggagaggacggcuguugguaugggauggaaauacguccgcuaaaagaaaaggaggagaaccuuguaaacucguuaguuacagcggggcauggacagauagacaauuucucucuagguguguuaggaauggccuuguuuuuggaagaaaugcuaagaacccguguuggaaccaaacacgcuauuuuguuaguagcguuauccuuuguuaccuuaauaaccgguaacaugaguuuuagagaucuuggacgaguuaugguaaugguaggugcaacaaugacggaugacaucggcaugggcgugacauaucuagcgcucuuggcugcuuucaaggucaggccuacuuuugccgcuggcuuacuacuacgcaaacugacuagcaaagaguuaaugauggcuacaauagguauugcacuacucucacaaucuacccugccugagacuauacuagaacuaacagaugcacuggcucuuggaaugauggcucuaaaaauuguacgcaacauggaaaaguaucaauuagcuguuacuaucauggcuauaucauguguuccgaaugcagucauacuccaaaacgcauggaaaguuucauguacaauuuuagcagcaguuucaguuaguccacucuugcuaaccaguagucaacaaaaggcagauuggaucccuuuagcacuuacaauaaaaggauuaaauccaacggcgauauuccuuacaacacuuucgcguacuucaaagaaaagaagcuggcccuuaaaugaagcaauaauggcggucgguaugguuucaauacuugccucuucgcuacuuaaaaacgauauacccaugacaggaccauuagucgcaggaggcuuguuaacagucuguuauguacugaccggaaggagugcagauuuggagcuagaaagagcggcugacguaaaaugggaggaucaggccgagaucucaggaagcucuccgauuuugucaaucacaauaagugaggaugguucgaugagcaucaaaaacgaagaagaggagcaaacacugaccauauuaaucagaaccggauuguuagugauuagcggaguauucccaguaucaauaccaauuacugccgcugccugguaucucugggaggucaagaaacaaagagccggaguuuuaugggacguaccuagucccccaccagugggaaaagcugaacucgaagacggugccuacagaauuaaacagcgaggcauacuaggauacucacaaauaggggcgggaguauauaaagaaggaacauuucacacuauguggcauguaacacgaggagcuguccuuaugcauagagggaaaagaauagaaccuagcugggcugacgucaagaaagaucugauuuccuauggaggaggguggaaauuagaaggggaguggaaagaaggggaagagguucaaguucuagcacuugagccaggaaagaacccaagggccguacaaacaaaaccggguaucuuuaaaacaaauacgggaacuauuggggcuguuaguuuagauuuuuccccaggaacuagcggaagucccauaguugaucgcaaaggaaaaguuguaggauuguacggcaacggugugguaacaagauccggagcguaugucucugcaauugcacaaacagaaaaaucgaucgaagacaauccugaaauugaagacgauaucuucagaaagaaacgcuuaacaauuauggaccuucauccuggagcagguaaaacuaaacgcuaccugcccgcuauagugagagaagcaaucaaacguggacuucguacauuaauccuagcaccaacgagagucguggcugcugaaauggaggaggcacuuagaggccuacccauaagauaccagacuccugcaauaagagcugaacacacugggagggaaauaguagaucuuaugugucacgcuacguucacaaugcgacuacugucaccagugcgaguaccaaacuacaaccugauaauaauggacgaagcacauuucacugauccagcaucaauugcagccagggguuacauuagcacuagaguggagaugggugaagcagcaggaaucuucaugacggcaacaccuccagguucucgagacccauucccucaaucaaaugcccccaucauggaugaagaaagggaaauucccgaaagaucuuggaauaguggacacgaguggguaacugauuuuaaaggaaaaaccguuugguucguacccuccauaaaagcugggaacgauauugcagccugccucaggaaaaaugggaagaaaguaauacaauugucaaggaaaacuuucgauucugaauauguaaaaacacgcgcuaaugacugggacuucgucguaacuacagauauaucugaaaugggcgcaaauuuuaaagcggaaagaguaauugacccacgaaggugcaugaagcccguaauacuuaccgauggagaagagagaguaaucuuagcaggaccaaugccaguuacucacaguagcgcggcacaaagacgcggaagaauuggucgaaaccccaaaaaugagaacgaucaauacauauacaugggagagccccuagagaaugaugaggauugcgcacauuggaaagaggcuaaaaugcuauuagauaacaucaauacaccugagggaauuauaccuaguauguuugagccugaacgagaaaaagucgaugcaauugauggugaauauagauuaagaggugaagcucgaaaaaccuucgucgauuuaaugcggaggggagaccuaccaguguggcuagcguauaagguggccgcagagggcauaaacuacgcagauagaaaauggugcuuugacggaaucaaaaauaaucaaauauuggaagaaaacguagagguagaaauauggacgaaagaaggagaaagaaagaaacucaagccuaggugguuagacgcucgaauauacuccgauccuuuagccuugaaaggcuuuaaagaauuugcagcggggcgcaagagcuuaacguuaaaucucaucaccgaaaugggcagauuaccuacguuuaugacucagaaagcacgaaaugcacuagacaaccuggcaguguuacacacagcagaaguaggugguaaagcguauacacacgcacucagcgaacucccagaaacucuggaaacuuuacugcuuuuaacuuuauuagccgccgugacuggugguaucuucuuguuuuugaugucaggaaaggguauugguaaaaugacucuugggauguguugcauuauaacagcaucgauucuauuaugguaugcacaaauacagccacauuggauagccgcaagcauaauauuagaguucuuucuuauagucuuacuaauaccggagcccgaaaagcaaagaacgccgcaagacaaccaauuaacauaugucguuaucgcgauacuaacaguaguagcagcaacaauggcuaacgaaaugggcuucuuagagaaaacuaagaaagauuuagguuuuggaaguauuacaacccaagaaagugaaagcaauauacucgacauagaucugcggcccgccagugcauggacacucuacgcagucgccacuacauucguaaccccaauguuacgacauucuauugaaaacaguucuguaaauguuagucugaccgcuauagcuaaccaagcaaccguauuaaugggguuggggaaagguuggccgcucaguaaaauggauauaggagucccacuacucgcuauaggcuguuacucacagguaaauccaauuacacucaccgcugcucucuugcuauuaguagcgcacuacgcgauuauaggcccuggcuuacaagcaaaagcgacuagagaagcucaaaaacgcgcagcagcggggauaaugaaaaacccuacuguagauggcaucacugugaucgaucucgaaccaauaccauaugacccgaaauucgaaaaacaauuaggacagguaaugcucuuaauauuguguguuacgcaaguauuaaugaugaggaccacuugggcccucugugaggcuuuaacccuagcaacaggaccaauuucuacacucugggaagguaauccggggagguuuuggaacacaacaauagcugugaguauggcgaacaucuuucgugguaguuacuuggccggugcgggccuuuuauucucaauuaugaaaaacacaacaaacacgaggagagguacgggcaaugugggggaaacauugggcgaaaaguggaaaagcagguugaaugcccuaggaaaaagcgaauuucaaauauauaagaaaucgggcauacaggaaguugauagaaccuuagcuaaagaaggcauaaaaagaggagaaacugaucaucaugcagugaguagaggaucagcaaaguugagaugguucguagaacgaaacaugguaacuccagaaggcaaagucgucgauuugggaugugguagaggaggguggaguuacuauugugguggcuugaaaaauguacgagaaguaaagggcuuaacaaaggguggaccuggacacgaagaaccaauaccuaugucgaccuauggauggaauuuagugagacuccaauccggaguggauguauucuuuacaccaccugagaagugugauacguuauuaugugacauuggagaaaguucaccgaaucccacgauugaggcaggacggacacuucgaguauuaaacuuaguugaaaauuggcucaauaauaauacccaauuuuguauaaaagugcuaaacccuuacaugccuucaguuauagaaaagauggaaacguugcaaagaaaauaugggggugcacuuguacgcaacccauuaucacguaacucaacacacgaaauguauuggguaucaaacgcuacggggaauauuguuucuaguguaaacaugauuucucgcaugcuuauaaauagauuuacaaugaaacacaagaaagcgacguacgaacccgacguagaccuaggcagcggaaccaggaauauugguauugaguccgagauaccaaacuuggauaucauaggcaaacgcaucgagaaaauaaaacaagaacacgaaacaucauggcauuaugaccaggaucacccuuauaagacaugggcauaccauggaaguuaugaaaccaaacagacagguagugcauccuccauggugaauggcgugguuagacuauuaacaaagccaugggauguuguaccuaugguaacgcaaauggcaaugacggacaccacacccuuuggucaacaaagaguguucaaggaaaaaguagacacucggacccaagaaccuaaagaggguaccaagaaauuaaugaaaauaacugcugaguggcuguggaaagaacuuggaaaggagaaaacuccccgaauguguacuagagaggaguucacuagaaaaguucggaguaaugcggccuuaggagccguauuuacugaugaaaacaaguggaagucagcuagggaagcagucgaggauggacgauucugggaacuuguagacagagaaagaaaucuucaccuugaaggaaagugugaaacuugcgucuacaacaugaugggaaaacgagagaagaaacuaggugaguucggaaaggcaaaaggaucgcgcgcaauaugguauauguggcuuggagcuagauucuuagaguucgaagcgcugggauuucuuaacgaggaucacugguucucuagaggaaauagucuaagugguguagaaggugagggguuacauagacuugguuacauuuugagagagguagggaagaaagaaggaggagcgauguacgcugaugacacugcagggugggacacacgaauuacuuuagaagaccuuaaaaacgaagagaugguaaccaaucauaugaaaggcgaacauaagaaauuagcagaggccauuuuuaaacuaaccuaccaaaauaaaguggugcggguacaaaggccaacuccacggggcacggucauggauauaaucucgcgaaaagaccagagaggaaguggucagguagguacauacggucuuaacacauuuacuaauauggaagcacaauugauacgccaaauggaaggagaaggaauauuuaaauccauucaacaucuaacugcaaccgaagaaauagcggugcaaaacugguuagcucgggucggaagggaaagauuaucucgaauggcuaucagcggugaugacuguguuguaaaaccuauugaugaucgguucgcaagcgcgcuuacggcucugaaugauaugggcaagguaagaaaggacauacagcagugggagcccucgcggggcuggaaugacuggacacagguacccuucugcucccaccauuuccaugaguuagucaugaaagacgggcgaguccuagucguuccuuguagaaaccaggaugaauuaauaggccgggcuaggaucagucaaggggcaggcuggagccuuaaagaaacugcaugcuuggguaaaagcuacgcucaaauguggaccuuaauguacuuccacagaagagauuugagguuggcugccaaugcaaucuguuccgcuguaccgagucauuggguacccacaagucgaacuacuuggaguauucaugccaaacacgaguggaugacuacggaagauaugcucgcuguuuggaaccggguguggauacaagaaaauccauggauggaagacaaaacaccaguagagagcugggaagagguacccuaucucgguaaaagagaggaucaauggugugguagccuaauaggguugacauccagagcuacgugggcuaaaaacauucagaccgcaauaaaucaggugagaagucuaaucggaaacgaaggguacacugauuauaugccguccaugaagagauuccgaagagaagaagaagaagcugggguacuuugguga

SEQ ID NO: 22193 - RNA, 9876 nt, Artificial Sequence
  derived and/or modified CDS sequence (opt6) from DENV-2__JX286518__SS-prME
acagcaggaguaauagugauguuaauaccaacugcuauggcuuuucauuuaaccacaaggaacggagaaccgcauaugauaguagguaggcaagaaaaagggaaaagucugcuauuuaaaacugaagacggcguaaacauguguaccuuaauggcuauagaucugggagaauuaugcgaagacaccauaacauauaaaugucccuuauugcggcaaaacgaaccggaagauauagauugcugguguaacucgacaucuacauggguuacuuacgguacguguacuacgaccggcgaacauaggagggagaaaaggucgguagcauuaguuccacacguuggaaugggacuagaaacccgaacugaaacuuggaugagcagugaaggugcauggaaacacguacagagaauagaaacauggauauugagacacccagguuuuacuauaauggcagcaauuuuagcauauacaauaggaacaacacacuuccaacgugcauuaauauucauccugcucacagcuguagccccgucaaugacaaugagauguauaggaauuagcaauagagauuuuguagagggcgugucaggagguucauggguugacaucgugcuagaacacggcucuuguguaacaaccauggcuaaaaacaaaccaacacucgacuucgaacuaauaaaaacagaagcaaaacaaccugcaacucucagaaaauauuguaucgaagcuaaauugacuaauacuacaacggaauccagaugcccaacgcagggugagcccagucuuaacgaggaacaagauaaaagauuuauaugcaaacauaguaugguugacagaggguggggaaauggcuguggucuuuucggaaaagggggcauuguaacaugcgcaauguuuacauguaagaaaaacauggaaggaaaaauuguacaaccagaaaaucuagaauauacuauugucauuaccccacauucuggcgaagaacacgcaguagguaaugauacaggcaaacacggaaaagaaauaaaaaucacgccacaguccagcacaacugaagcugaauugaccgguuaugguacugucacgauggaaugcagcccccguacaggacuugacuuuaaugagaugguguuauugcagauggaggauaaagccuggcuugugcaucgacagugguuccuugauuuaccauugccauggcuuccuggagcagacacccaaggcaguaauuggauucaaaaagaaacuuugguuacauuuaaaaauccccaugcaaagaaacaagauguagugguacuagguucccaagaaggcgcuaugcauacagcacucacaggugcaacagaaauacaaaugagcucggguaaccuucucuucacaggacauuuaaaauguagacuccgcauggauaagcuacaacuaaagggaaugucauauaguaugugcacgggaaaauuuaaaauaguaaaagagaucgccgagacucaacauggaaccaucguaauuaggguccaauaugaaggagauggaagcccuuguaaaauaccuuuugaaauaacagauuuagagaaaaggcacguuuugggacggcucauuacaguaaauccgauagucaccgaaaaagacaguccuguaaacauugaggcugagccaccauucggugacucuuacauaauagucgguguggaaccuggucaauuaaaguugaauugguucaagaaagggucgucgauaggacaaauguucgaaacgaccaugagaggagcuaaaaggauggcuauuuugggagacacagcuugggauuucgguucauugggaggaguauuuaccucaauuggcaaagcauuacaccagguguuuggagcaaucuacggcgcagcguuuagcggcguuuccuggaccaugaagauucuaauuggaguaauuauuacauggauaggaaugaacagucgaucuacuucuuuaucggucagccuaguucuugugggggugguaacauuauaucugggcgcuaugguucaagcagacucaggauguaucguaaguuggaaaaauaaggaguuaaagugcggaucuggcauuuuuauuacagauaauguucauacguggacagaacaguacaaguuucaaccagaaucaccuaguaaacuagcuagcgcuauccagaaagcacacgaagaagguauaugcggcauaagaagugugacacggcucgaaaaucugauguggaagcaaauaacaccagaacuuaaccauauccuguccgaaaaugaagugaaauugacgauuaugacaggagacauuaaaggcauuaugcaggcggggaaacgcucacuacgaccccaaccaacagaguugaaauacucauggaagacuugggggaaggccaaaaugcuaaguacagaaucucauaaucaaaccuuccuaauugaugguccugaaacagcugaaugccccaacacuaauagagcuuggaacucuuuagaaguagaggauuauggauucgguguuuuuacaacaaacauauggcugaaauugagagagaaacaagauguuuucugcgauucgaaauuaauguccgcagcuauaaaagauaaucgagcaguacaugcugauauggguuauuggaucgagucugccuuaaaugacaccuggaaaauggagaaggcuucguucauugaaguaaaaucgugucauuggccaaaaucucacacacuauggucuaaugguguguuggaauccgaaaugauaauccccaaaaacuucgccggaccaguaucucaacacaacuaucgucccggauaucauacacagacagcugguccauggcauuuagguaaacuagagauggacuuugauuucugcgaaggcacaacaguuguuguuacugaagacuguggaaaucgaggcccaagccuucgaaccacaaccgcaucaggaaaacucauaaccgaauggugcugccguucuuguacacuacccccacuacgcuaccgcggagaagauggaugcugguacgggauggaaauacguccccugaaggaaaaagaggagaauuuggugaauagccuaguaaccgcuggacacggacaaauugauaauuuuucauuaggagugcuuggcauggcucuguuuuuggaagagauguuacggacacguguaggaacuaaacaugcaauccuauuaguagcgcuaucauucguaacgcuaaucacagggaacaugaguuucagagauuuaggucgugugaugguuauggucggagcaacuaugacugacgacauuggcauggguguaacauauuuggcauuauuggccgcuuuuaaagugaggccuacauuugccgcugggcuauuacuuagaaaacuaacuucgaaagaauuaaugauggcaacaauagguauugcuuuauuaucacaaucgaccuuaccugaaacuaucuuggaacuaacagacgccuuagcacuaggcaugauggccuugaagauaguccgaaauauggagaaauaccaacuagccgucacaauaauggcaaucaguuguguaccgaacgccguaauauuacaaaaugcauggaagguaucuuguacgauauuggcugcggugucaguuaguccacuucuccuuaccuccagucaacaaaaggcagauuggauuccacuagcucuaacuauaaaaggauuaaacccgacugcaauuuuucuaacaacauuaucacgaacaucuaagaaaagaaguuggccucuaaacgaagcuauaauggcaguuggcauggucagcauccucgcuaguucgcuauuaaagaacgacaucccuaugacaggaccccugguagccggaggauuguuaacaguaugcuacguauuaacuggacguagcgcagaucuagaacucgaaagagcagcggaugucaaaugggaagaucaggcugagauuucaggaaguucgccuauacuuucuauuacuauuuccgaagacggcaguaugaguauuaaaaacgaagaagaagaacaaacacugacuauucuaauucgcaccggccuuuuaguuauaagcggagucuuuccuguuucgauaccuauaacugcugcggcaugguaucuuugggaaguuaagaaacaaagggcgggcguacugugggacguccccaguccuccuccaguagggaaggcagaacuggaggacggagcuuauaggaucaaacaaagagguauauugggauauucccaaauaggugcugggguuuauaaagaaggaacuuuucacacaauguggcauguaacaagaggcgccguauugaugcauaggggaaaacggauagaacccucuugggccgacgucaaaaaggauuugaucaguuauggaggcgguuggaaguuggaaggagaauggaaggaaggagaagaaguacagguacuagccuuagaaccuggaaagaaccccagagccguucaaacuaaacccggaauauuuaagacaaacacaggaaccaucggggcggugucuuuggauuucucuccaggaaccaguggaagcccaaucguugaccgaaagggaaaaguagucgggcucuauggaaacggcguaguuacucguucgggagcauauguaagcgcuauugcacaaaccgagaaaaguauagaagacaacccggaaaucgaagaugacauauucagaaagaaacgacuaacuauuauggaucuccacccaggagcggguaagaccaagcguuaccuucccgcaauugucagggaagcaaucaaacgcggcuuacgaacgcuuaucuuagccccaacccgugucguugccgcagagauggaagaagcucuacgcggacuaccgauaagguaucagaccccugcaauacgggcggagcauacuggcagagaaauuguugauuuaaugugccaugcaacauuuacaaugcgucuucuaagccccgucagagugccgaauuauaauuuaaucauuauggaugaagcgcauuuuacugauccagcaagcauugccgcacguggauauauaucgacucgagucgaaaugggugaagcggcagguauuuuuaugacagcaaccccaccuggcagcagggacccuuuuccccaaaguaaugcaccgauuauggaugaagaaagagaaauaccggaaaggucauggaacaguggucaugaauggguaaccgacuucaaaggaaaaacagucugguuuguucccucaauaaaggcgggcaacgacauagcagcaugucuaaggaaaaacggaaagaaaguuauccaauuaucgaggaaaaccuucgauuccgaauacguaaaaacuagagcgaaugacugggauuuuguggucaccacugacauuucugaaaugggagcaaauuucaaagcggaacgugugaucgacccgagacgauguaugaaaccgguaauuuugaccgauggugaagaaaggguuauacuagcagguccgaugccggucacacacagcucagcagcacaaaggagagggcgcaucggaagaaauccuaaaaacgagaaugaccaguacaucuauaugggugaaccucuagagaaugaugaggauugcgcacauuggaaggaagccaaaauguuacucgauaacauaaauacacccgagggcauaaucccuuccauguucgaaccugaacgugaaaaaguggaugcaauagauggcgaguacaggcuaaggggcgaagcaagaaaaacuuucguggauuuaaugaggagaggugacuuaccgguguggcuagcauaccgaguugcugcugaaggcauuaauuaugcugacaggaagugguguuuugacggaaucaaaaacaaccaaauucuugaagaaaauguugaagucgaaauauggaccaaggagggggaaaggaagaaacugaaacccagguggcuagaugcaagaauauauucugauccacuagcacuaaaggaguuuaaagaguucgccgcagggaggaagagucuaacccugaaucuaauaacggagaugggcagauugccaaccuuuaugacacagaaagcacguaacgcauuagauaaccuggcaguacuucauacagcagaagucggaggaaaggcuuauacacaugccuuaagugagcucccugaaacacuagaaacucuccucuuacuaacacugcucgcagcgguaacggguggaauuuucuuguuucugaugucagguaaagguaucgguaagaugacauuggguaugugcuguauuauaacggccucaauccuauuaugguacgcacaaauacaaccgcauuggaucgccgcuuccauaauuuuagaguucuuuuuaauuguacuucucauaccggaaccugagaaacaacggacuccccaagacaaccaauugacuuacguuguaauagcuauauuaacaguaguagcagcuacaauggcaaacgaaaugggauuccuagagaaaacgaagaaagaucucggauucggaaguaucacaacacaagaaagcgaaagcaauauacucgauauugaucuccgaccagcuuccgccuggacuuuauaugcugucgcaacaaccuuuguaacgccgaugcuacgucauagcaucgaaaacagcucgguaaauguuucgcuuacagcuaucgccaaccaagcaacgguacucaugggcuuagggaaggguuggccuuuguccaagauggacauuggcguuccguuacucgccauuggauguuauucucaaguuaauccaauaacauuaacagccgcauugcuuuuauugguugcacauuaugcaaucaucggaccaggacuucaagcaaaagcaacccgcgaagcccaaaagagggccgcagcaggaauuaugaagaacccaacuguggacgguauaacgguuaucgauuuggaacccauuccguaugacccaaaauuugagaaacaacuaggacagguaaugcuauuaauuuuguguguuacacaaguacucaugaugagaacgaccugggcuuugugcgaagcccuaacuuuagcaacuggccccaucucaacauuaugggaaggcaauccagguagguuuuggaauacaaccauugcggucagcauggccaauauuuuccgagguaguuauuuagccggugcagggcuccuauucucuaucaugaagaauaccacaaauacacguagaggaacuggaaauguaggagaaacauuaggugagaaauggaagucaagacuuaacgcauugggcaaaucugaguuccaaauauacaagaaaaguggaauccaagaaguagacagaacacuagcaaaggaaggaauuaagaggggcgaaacagaucaucacgcaguaaguagagguucagcgaagcuacgaugguuuguugaaagaaauauggucacgccugagggaaaaguuguagaccuagggugugggagaggggguuggagcuauuacugugguggacucaaaaacgucagagaaguaaaaggcuugacaaaaggcgggccaggccaugaagaaccgauacccaugaguacuuauggauggaauuuaguacgucuacaaagugguguagauguauuuuucacacccccagagaaaugugauacccuauuaugugauaucggagaaucaagccccaauccaacaauugaagccgggcgcacauuacgcguacuuaaucuuguagagaauugguuaaauaacaacacacaauuuugcauuaaaguccuaaauccauauaugccaucuguaauagagaaaauggaaacuuugcagagaaaauauggaggagcccuagucaggaaucccuugucuagaaauucaacacaugaaauguauuggguuucaaaugcaacaggaaauaucguuuccagugucaauaugauaagucguaugcuaaucaaucgauuuacaaugaaacacaaaaaggcuaccuacgagccagacguugaucucggaucagggacacgaaacauuggcauugaaucagagauuccaaauuuagauauaauaggcaaaagaaucgagaaaauaaagcaagaacaugaaacaucguggcauuaugaucaagaccauccauauaagacaugggcuuaucauggaaguuaugaaacuaaacagacugggucugccucaucaaugguuaauggaguaguaagauugcugacaaaaccaugggauguugucccgaugguaacccagauggcgaugacagacaccacgccuuuugggcaacaacgaguguucaaagaaaaagucgacacucgcacccaagaaccaaaggaaggaacaaagaaauugaugaaaauuaccgcagaauggcuauggaaagaacuggggaaagagaaaacuccuaggaugugcacacgcgaagaauuuacaagaaaaguacggucgaaugccgcauuaggcgccguauucacggaugaaaacaaguggaaaucagcgagagaagccguagaagauggacgauucugggaauuaguagauagagagagaaaucuacauuuagaaggaaaaugcgagacuuguguuuacaauaugaugggcaaaagagaaaagaaacuaggggaauuuggaaaagcgaaagggucaagagccauaugguacauguggcugggugccagguucuuagaauuugaagcauuaggauucuugaacgaagaucacugguucucgagggguaauagccugucaggagucgaaggugagggauuacauagacuagguuauauucuaagagaaguuggcaagaaggaaggaggugcaauguaugcggaugauaccgcagguugggauacgcgaauuacacucgaagaccuuaaaaacgaagaaauggucacaaaucauaugaaaggugagcacaaaaagcuagcagaagccaucuuuaaauugacauaucaaaacaagguagugcgagugcaacgaccaacaccucgagggacgguaauggacauaauaagcagaaaagaucaaagagguagcggacaaguaggaaccuacggguuaaauacguucacuaacauggaagcccaguugauucgucaaauggagggagaaggcauauuuaaaucuauacaacaucuaacagccaccgaagaaaucgcaguucaaaacuggcuugcgcggguaggaagagaaaggcuaucuagaauggcaauaucaggugacgauugugugguuaagccgaucgaugaucgauucgcaucagcucuaacugcacuaaacgauauggggaagguacggaaagauauacaacaaugggaaccuucgagagguuggaacgauuggacacagguaccuuuuuguucucaucacuuccaugaacugguaaugaaagauggaaggguauuaguaguaccauguagaaaccaagaugaauuaauuggaagggcaagaaucagucaaggagccggcuggucacuuaaggagacagcuugccucggaaaaucguaugcccaaauguggacacuaauguacuuucauaggagagacuuaagacuugcagccaaugccauaugcucagcaguaccuagccauuggguuccaacgucaagaacaacauggaguauacaugcaaagcacgaauggaugacgacugaagauaugcuugcuguuuggaauagaguguggauacaggaaaauccauggauggaggacaaaacccccguggaaagcugggaagagguuccauaucuuggaaaacgagaagaucaauggugugggucuuuaauagguuuaacgagucgugcuacaugggcuaagaacauccaaacugcaaucaaucaaguucguucucuaauugggaaugaaggguacacagauuacaugcccucgaugaaacguuuccgaagggaagaggaggaagcgggugucuuaugguaa

SEQ ID NO: 22194 - RNA, 9876 nt, Artificial Sequence
  derived and/or modified CDS sequence (opt6) from DENV-2__JX286519__SS-prME
acugcgggaguaauugucaugcuuauaccaaccgcaauggcauuucauuugacaacaaggaauggugaaccucacaugauuguuggucggcaagaaaaagguaaaaguuuauuguuuaaaacugaagaugguauuaauaugugcacacuaauggcaauagaucuaggugaauuaugcgaagauacuaucacauauaaauguccacuuuuaagacaaaaugaaccagaagacauagacuguuggugcaauagcacuucaacuuggguaacuuacgguacauguacgaccacaggagaacauagacgagaaaaacgaaguguagcgcuagucccacacguagggauggguuuggaaaccaggacagaaacauggaugucuucggaaggagcauggaaacacguacagcggauugaaacguggauacuucggcauccagguuuuacuauaauggcugcaauuuuggcuuauacaauagguacaacacacuuccagcgagcgcugauauucauucugcuuacugcagucgcaccaucaaugacaaugcguugcauagguauaucaaacagagauuucguagagggagucucaggaggauccuggguugauauaguguuagagcacggcuccugcguuaccaccauggccaaaaauaaaccuacucuagacuucgagcuaaucaaaacugaggcaaaacaaccugcuacguugcguaaauauuguauagaagcaaaacuaacaaacacaacgacagaaucacgauguccuacacaaggggagcccagccuaaacgaagaacaggauaaaagauucauauguaaacauucuaugguagauaggggauggggaaaugguugcgggcuauuugguaaaggagggauuguaaccugugcaauguuuaccuguaaaaagaacauggaagggaagauaguacaacccgaaaauuuagaauauacgauagugauuacaccacauagcggggaggaacaugccguugguaacgauacgggaaaacauggcaaagaaauaaaaaucacaccgcaaaguuccaccacugaagcagaacuaacuggguacggaacaguuacaauggaaugcagcccucgaacgggacuugauuuuaaugaaaugguccuacuacaaauggaagauaaagcaugguugguacauagacagugguucuuagaucugccacucccauggcucccgggagcagacacacaagguucuaauuggauacaaaaagagacucucguuacauuuaaaaauccacaugccaaaaagcaagaugugguaguucucgggucucaagaaggagcaaugcauaccgcucuuacaggagccacagagauacaaaugaguagugggaaucuucucuucacuggucaccuaaaaugccgguuacguauggauaaacuucaguuaaaaggaaugaguuauucaaugugcacgggaaaauuuaaaauaguaaaagaaaucgcugagacucaacacggcacaaucgugauaagaguacaauacgaaggugacgggucaccuugcaaaauaccauuugaaauuacggaucuugagaaaagacacgucuuaggaaggcugauaaccguaaacccaauaguuacugaaaaagauucucccguaaauaucgaagcagaacccccuuuuggagauaguuauauaauaguaggaguggaaccaggucagcucaaacuaaauugguuuaagaaggguagcucuauuggacagauguucgaaacuacaaugcgcggcgcaaaaagaauggcaauacuuggggauacagcuugggacuuugguucuuuaggagguguauucacaucuauuggcaaagcacuucaucaaguguuuggggcaaucuacggcgccgccuucaguggaguuucuuggacaaugaaaauuuugauuggagugauuauaacguggauugggaugaacucaagaucuacaucuuuaucugugaguuuaguucuugugggaguuguaacacuguauuuaggagcgaugguccaggcagauucugguugcauaguaagcuggaagaacaaagaauuaaaaugcggaagcggcaucuucauaaccgauaacguucauacuuggaccgaacaauauaaauuccaaccugagagucccucaaaguuagcaagugcgauacaaaaagcacaugaagaaggcauuuguggaauuagauccguaacuaggcuagaaaaucuaauguggaaacaaauuacaccggaguuaaaccacauauugucagagaaugaaguaaaguugaccauaaugacaggagacauaaagggaaucaugcaggcgggaaaacgcucacuccguccccaaccaacagaguugaaauacaguuggaaaacguggggaaaagcaaaaaugcugucgacagagucacauaaucaaaccuuucuuauagacggaccugaaacagcagaaugcccaaauacgaauagagcauggaacucacucgaaguugaggauuauggauucggaguuuuuacuacaaauauaugguuaaaacuacgagaaaaacaagacguguucugugauucaaaacuuaugagugcagcuaucaaggacaauagagccguccacgcugauaugggauauuggauagaaucagcauuaaacgauacuuggaaaauggagaaagcauccuuuauagagguuaaaaguugccauuggccuaaaagucauacauuguggucaaaugggguauuagaaagugaaaugauaauccccaaaaauuuugcggguccuguaucucaacauaauuauaggccuggcuaccacacccaaacugcugggccguggcaccuggguaaacucgaaauggacuuugauuucugugaaggaacaaccguuguaguaacagaagauuguggaaauagaggcccuucauuaaggacaacaaccgcuucugguaaacuaauuacagaauggugcugucggaguuguacacugccucccuuacgauauagaggcgaagaugguuguugguacgguauggaaauacguccauuaaaagagaaagaagaaaauuugguaaauaguuuaguuacagcugggcacggucagaucgauaauuuuucgcuuggugucuuggggauggcguuauuucuugaggagaugcuacgaacaagaguaggaacuaaacaugcgauucuauugguagcauuaucauuuguuacacuaauaaccggcaacaugucuuucagggacuuaggccgggucauggugaugguaggagcgacaaugacugacgauauaggaaugggcguuacguauuuggcccucuuggcagcguuuaaaguaagaccaacuuuugcagccggucuguuauuacgaaaguugaccaguaaagaacuuaugauggccacuauaggaauugcacuacuuagucaauccacauugccugaaacaauacuugaacugacagaugcguuagcgcuaggcaugauggcucuaaagauagugagaaacauggaaaaguaucaacucgcgguaacaauuauggcaauaagcugcguuccuaaugcaguaauucugcaaaacgcuuggaagguuaguugcacaauucuagcagccguaucgguguccccuuuacuauugacaucaagccaacaaaaagcagacuggauuccucuugcacuaacgaucaaaggacucaacccaaccgcuauauuuuuaaccacguugucaaggacaagcaagaaacggagcuggccacuuaacgaagcuauaauggcuguaggaauggucaguaucuuggcuucaucauuauuaaagaacgauauaccuaugaccggaccuuuaguugccggaggauugcucacuguuugcuauguuuuaacuggacgcagugcugaccuugaacuagagcgugcagcagacgucaagugggaagaucaagcugagaucagcgggucuaguccgaucuuauccauaacgauauccgaagauggcuccaugucgauaaagaaugaagaagaagaacagacucuuacaauacuaauuagaacggguuuauugguaauaagugguguguuuccgguaucaauaccaauuacugcggcagccugguaucucugggaggugaaaaagcaaagagcuggaguuuuaugggacgucccaagcccaccgcccguagguaaagcagaauuggaagacggcgcauauagaauuaaacaaagaggcauacuaggauacagucagaucggcgcaggagucuauaaagaaggaacguuccacacaauguggcaugucacaagaggagcuguacuaaugcauaggggaaaaagaauagaaccgucaugggcagaugucaagaaagaccuuauaucauacgguggugguuggaaacuagaaggggaguggaaagaaggagaagaaguccaagucuuagcacuagaaccaggcaaaaauccuagggcgguacaaacaaaacccgguauuuucaaaacuaacacaggcacaauaggugccguuucacuggacuucucccccgggacaagcggaagcccuauuguagauaggaaagguaagguagucggacuauaugguaauggaguaguaacgcguuccggagcauauguaagcgcgauugcucaaacagagaaaagcaucgaggauaauccggaaauagaggacgauauauucaggaagaaacguuuaacuauaauggacuugcacccaggagcaggaaaaacuaaaagauacuugccugcaauuguaagggaagcaauaaaacgggguuuaaggacgcucauucuugcccccacaagaguaguggcagcagaaauggaagaggcuuuaagaggucuaccaauacgcuaccaaacuccagccauuagagccgaacauacuggaagagagaucguggaccuuaugugucacgcuaccuucacgaugaggcuauuaucaccaguuagaguaccaaacuauaauuugaucauuauggaugaagcucacuucaccgaccccgcaucaauugcagcaagaggauacauuucuacacgcguugagaugggagaagcagcugguauauuuaugacagcaacuccucccggaucacgggacccuuuuccgcaaagcaaugcuccaauuauggaugaggaaagggaaaucccagaacgaucauggaacucuggacacgaauggguuacagauuuuaagggcaaaacuguaugguuugugccaucuauaaaggcuggaaacgacaucgcggcuugucugcgaaagaauggcaaaaaggugauccaguuaucaagaaaaacuuucgauucagaauauguaaagacacgagcaaaugauugggauuucguggugacaacggacauaucggagaugggagcuaacuucaaagcagaaagaguaauagacccucgacguuguaugaagccugucauccugacugauggcgaagaacggguaauuuuagcuggacccaugccuguuacucauagcucagcggcucaaagaagaggucguauuggucgaaauccgaaaaacgagaaugaucaguacauuuacaugggggagccauuggaaaacgaugaagauugugcgcauuggaaagaggcgaaaauguuacuggacaauauaaauacgccagaaggaauugucccgaguauguuugagcccgagagagagaaggucgaugccauagacggggaauacagauuaaggggagaagcacggaaaaccuuuguggacuuaaugagaaggggagacuuacccguguggcuggcauauaagguugcggcugaaggaaucaauuacgcagacagaaaauggugcuuugauggcauuaaaaauaaccagauucucgaggaaaauguggaaguagagauauggacaaaagaaggugaaaggaagaaacucaaaccccgcugguuagaugcuagaauauauucggacccuuuagcauuaaaagaauuuaaagaauuugcggccggaaggaaaucuuuaacuuuaaauuuaauaacggagaugggaagacugccgacuuuuaugacacaaaaagcacgaucagcacucgacaauuuagcaguucuucauacggccgaggugggagguaaggcuuacacccaugcauugucggaacugccagaaacuuuagaaacacuacuauuacuaacacuucuagcagccgucacagggggaaucuuuuuauuuuuaaugaguggaaaagguauaggaaaaaugacgcuggguaugugcuguauaaucacugcgaguauuuuacuaugguacgcacaaauccagccacacuggauugcagcuagcauaauuuuagaguucuucuuaaucguuuuacuaauacccgaaccugagaaacaaagaacgccgcaagacaaucaauugaccuacgugguuaucgcaauauuaaccguaguggcagcaacuauggcgaaugaaaugggcuuccuagaaaagaccaagaaagaccuaggauuugggucgauuacaacacaagaauccgaaucaaauauuuuagauauagacuugcguccagccagcgcguggacauuauaugcaguagcaacgacuuuuguuaccccaauguugcgacacagcauagaaaauucgagcguaaauguaucauuaacugcuauagcuaaucaggcaaccguguuaaugggauuagggaaagguuggccuuugucaaagauggacauaggggugccuuuauuagcuaucggguguuauagccaggucaauccaaucacguuaacugcagcauuauuauuguuaguugcucacuacgcuauaaucggacccggcuuacaggcaaaagcuacucgugaggcgcaaaagagagcggcugcagggaucaugaaaaauccaacgguugaugggauuaccguuaucgaucuagaaccaauaccuuaugacccaaaguucgaaaagcaacugggucagguaaugcuacuaauuuuaugcguaacgcaaguauugaugaugagaacuacaugggcgcuuugugaagcacuaaccuuagccacuggaccuaucucaacucuuugggagggaaauccugggcgauuuuggaauacuacaauugcaguaaguauggcaaauauuuuucguggcuccuacuuagccggugcaggccuauuguuuaguauaaugaaaaacacuacuaauacaagacggggaacagggaauguuggagaaacucuaggagagaaauggaaaaguagauuaaaugcuuuaggcaagagcgaguuucagauauacaagaaaucaggaauccaagagguagaccguacauuagcaaaagaaggcaucaagcguggggagaccgaucaccaugcaguauccagagguagugccaaacugagaugguuugucgaacgaaacaugguuacaccggaagguaaaguagucgaccuaggauguggucgagguggauggagcuacuauuguggcggacucaaaaauguacgugaaguaaaaggauuaacgaaagguggcccgggccacgaggaaccgauaccuaugaguacauaugguuggaacuuaguacgauuacagucaggaguugauguguucuuuaccccaccagaaaaaugugacaccuugcuaugugacauaggagaaucaucaccaaaccccacaaucgaagcgggaagaaccuuaagaguuuuaaaucuaguagaaaacuggcucaauaauaauacgcaauuuugcauuaaaguucucaauccauacaugccgucaguuauagagaaaauggaaacucuacagcggaaauacgguggggcccuaguacguaauccacuaaguagaaauucgacgcacgagauguacuggguaagcaacgcuacaggcaauauagucucuagcgucaacaugauuagucgcaugcucaucaaucgauuuacuaugaaacacaagaaagcaacauacgagccugacguagacuuaggaucggguacacguaacauugggauugaaagugaaauaccaaaucucgauauaauugggaaaagaaucgaaaagauaaaacaagagcacgagaccaguuggcacuaugaccaagaucaccccuacaaaacuugggccuaucacggaucguaugaaaccaaacagacaggaagugcuucuagcauggugaauggaguaguuaggcuucucacaaagcccugggacguuguucccaugguaacacaaauggcuaugacggauacaacaccauucggccagcagagggucuucaaagagaagguagauaccagaacccaagaaccuaaagaagggacaaagaagcuaaugaaaauaacagcagaauggcuauggaaagaguuaggaaaggagaagacacccagaaugugcacccgugaagaauuuacacgaaagguaagaucaaacgcagcgcuaggugcaguauuuacugaugaaaacaaauggaaaagugcccgagaagcaguggaagauggcagauucugggaacugguagaccgagaaagaaaucuacaucuugaggggaaaugcgaaacuuguguguauaauaugauggguaagcgugagaagaaauuaggagaauuugguaaagcuaaggggucaagagcuauaugguauauguggcuuggggccagauuuuuagaguucgaagcucuaggauuccugaaugaagaccauugguuuucgagaggaaauagccuuagcgguguggagggagaaggacuacacagauuaggauauauauugagggaagucggcaagaaggagggaggcgcaauguacgcugaugauacagcaggcugggauacuagaauaacacuggaggaucuaaagaacgaagagaugguaacaaaucauaugaaaggagaacauaagaaacuagcugaagcaauauuuaaguuaacuuaucaaaacaaaguugugagaguccaaagaccuacuccucgaggaacagucauggacauaauaucaagaaaggaucaacgcggaaguggccagguaggaacauacgggcuaaacacguuuacaaauauggaagcccaacuaauuagacaaauggaaggggaggggauauuuaaaucaauccagcauuuaacagccacugaagaaauagcaguccaaaauugguuggcaaggguggguagagaaaggcuaagcagaauggccauuagcggcgaugauugcguaguaaaaccuauugacgauagauucgcaucggccuugacagcauuaaaugauaugggaaaaguucgaaaagauauacagcaaugggaacccagucgagguuggaacgauuggacccaagugccauucuguucucaccauuuccacgaauuaguuaugaaagauggccgcgucuugguuguaccgugccgcaaccaagacgaauuaauagggcgagccagaauuagccagggcgcugguuggagcuugaaagagacugcguguuuaggaaagagcuaugcgcaaauguggacauugauguacuuucaucggagagauuugcguuuagcagcaaacgcaauaugcucagccguuccaagucauuggguaccgacuucgagaacaacuugguccauccaugcaaaacacgaauggaugacaaccgaggacauguuagcuguuuggaaccguguauggauccaagagaaccccuggauggaagacaaaacccccguagaaaguugggaagaagucccauaccuuggaaagagggaagaccaaugguguggaagucuaauaggucuaaccagccgugcuacuugggccaaaaauauacaaaccgcaaucaaccaaguaagaucacugauaggaaacgaagguuauacugauuacaugccaucaaugaaacgauuccgaagggaagaagaggaggcugggguuuuaugguaa
